United States Patent 10,760,091 (GENES AND USES FOR PLANT ENHANCEMENT) - sequence listing, part 9

SEQ ID NO: 35147 - protein, 378 aa, Coccidioides immitis RS
MVLNIPAVFRALISSSSKQNPSRHLRHRFSQWRAANSTYGISTPSPAKSEDSLAKCPFVFDTGYALSPKRPSRPFPPPFISPPSSSFSDPLTTHHRSQDARPSVNGEIIRGLTNGDDAILVSQHFLGVNDGVGAWATKPHGHAALWSRLILHFWALEVERNVNSTHPDPVEFLQRAYEQTVLATSSPNEWFGTTTSATALLHYKNNAGSVTPLLYVTNIGDCQILVLRPKEEKVVFRTHGQWHWFDCPMQLGTNSVDRPRDDATLSVVDLEEDDIVVALSDGVTDNLWEQDVLDVILLSLKHWESGKVENDVGDRTAGKGGGMVYIAQQLLQTARSIAQDPSAQTPYMEKAIDAGLAISGGKMDDISVVVGLCGRKPT

SEQ ID NO: 35148 - protein, 702 aa, Rhodospirillum rubrum ATCC 11170 [sequence omitted]

SEQ ID NO: 35149 - protein, 152 aa, Corynebacterium efficiens YS-314
MTSLRQDRGRSVDSASMTERTLILIKPDGVTNGHVGEIIARIERKGLKLAALDLRVADRETAEKHYEEHADKPFFGELVEFITSAPLIAGIVEGERAIDAWRQLAGGTDPVSKATPGTIRGDFALTVGENVVHGSDSPESAEREISIWFPNL

SEQ ID NO: 35150 - protein, 328 aa, Coprinopsis cinerea okayama7#130
MAPPKRTSSTLVTSFMNAIKPLNTKLGIPGITVEPDSMEGGHHASRGLTGGPYVNGSGGVGKFATGSSMFLGATSLLGKVAIVTGSGRGTGASIAKCLGEHGCSVVVNYVTDATSASSVVHHIRSQGKGGAIAVKANTATIQGGLQLIEETIKTFGRVDVVVFNSGVMESSTLDGLGEVGEEGEKSWDRAFETNVKVPLWMCKKVAPMMGPGGRIIFFSSTLTAASTVQPNALCYVATKGAIEQISRVLAKDLGSRGITVNTISVGPIDTPMFREGKSSHAISSIAKQTPSKRLGEPEDVAPLVAFLASEAARWINGQNLRCDGGYVV

SEQ ID NO: 35151 - protein, 138 aa, Lactobacillus plantarum
TNEMLKANQLSFPGQRVAISGAGNVAIYAIQKVEELGGKVITCSDSNGYVIDENGIDFKIVKQIKEVERSRIKDYADRVASASYYEGSVWDAQVAYDIALPCATQNEISGDQAKNLIANGAKVVAEGANMPSSPEAIA

SEQ ID NO: 35152 - protein, 284 aa, Oryza sativa (japonica cultivar-group)
MASSSRPEEAAAAAPPWSRLEGRVVLVTGASSGLGREFCLDLARAGCLVVAAARRADRLRSLCDEINASAPRASAAAAAVELDVASGGPALEAAVQSAWDAFGRIDVLINNAGLRGGVHSPLDWPEDEWETLIKTNLTGSWLVAKHVCRRMRDAKLKGSVINISSVSGLNRGHLPGSTGYAASKSAMHYATKLMALELGAYGIRVNSIAPGIFKSEITAPLLQKKWLSTVVSKIVPLKTHGTTDPALTSLVRFLIHETSSYVTGNIFIVDSGATLPGVPIFSSL

SEQ ID NO: 35153 - protein, 468 aa, Pseudomonas syringae pv. phaseolicola 1448A
MSKSVQLIKDHDVKWIDLRFTDTKGTQHHVTMPARDALEDDFFEVGKMFDGSSISGWKGIEASDMILLPDDETAVLDPFTEEPTLILVCDIIEPSTMQGYDRDPRAIARRAEEYLKSTGIGDTVFAGPEPEFFIFDEVKFKSDISGSMFKIFSEQGSWMSDQDVEGGNKGHRPGVKGGYFPVPPFDHDHEIRTAMCNALEEMGQTVEVHHHEVATAGQNEIGVKFNTLVKKADEVQTLKYVVHNVADAYGRTATFMPKPLYGDNGSGMHVHMSIAKDGKNTFAGEGYAGLSDLALYFIGGIIKHGKALNGFTNPSTNSYKRLVPGFEAPVMLAYSARNRSASIRIPYVNSPRGRRIEARFPDPSANPYLAFAALLMAGLDGIQNKIHPGDAADKNLYDLPPEEAKEIPQVCGSLKEALEELDKGRAFLTKGGVFSDDFIDAYIALKSEEEIRVRTFVHPLEYELYYSC

SEQ ID NO: 35154 - protein, 101 aa, Nicotiana tabacum
MASSVLSSAAVATRSNVAQANMVAPFTGLKSAASFPVSRKQNLDITSIASNGGRVQCMQVWPPINKKKYETLSYLPDLSQEQLLSEVEYLLKNGWVPCLEF

SEQ ID NO: 35155 - protein, 176 aa, Aspergillus niger
EVAALVIDNGSGMCKAGFAGDDAPRAVFPSIVGRPRHHGIMIGMGQKDSYVGDEAQSKRGILTLRYPIEHGVVTNWDDMEKIWHHTFYNELRVAPEEHPVLLTEAPINPKSNREKMTQIVFETFNAPAFYVSIQAVLSLYASGRTTGIVLDSGDGVTHVVPIYEGFALPHAISRVD

SEQ ID NO: 35156 - protein, 249 aa, Escherichia coli
AVTKLVLVRHGESQWNKENRFTGWYDVDLSEKGVSEAKAAGKLLKEEGYSFDFAYTSVLKRAIHTLWNVLDELDQAWLPVEKSWKLNERHYGALQGLNKAETAEKYGDEQVKQWRRGFAVTPPELTKDDERYPGHDPRYAKLSEKELPLTESLALTIDRVIPYWNETILPRMKSGERVIIAAHGNSLRALVKYLDNMSEEEILELNIPTGVPLVYEFDENFKPLKRYYLGNADEIAAKAAAVANQGKAK

SEQ ID NO: 35157 - protein, 509 aa, Oryza sativa (japonica cultivar-group)
MDELFYQSLLLSVAAVTVLQLLKLLLVRHRRPRTPPGPWRLPVIGSMHHLVNVLPHRKLRELAAVHGPLMMLQLGETPLVVATSKETARAVLKTHDTNFATRPRLLAGEIVGYEWVDILFSPSGDYWRKLRQLCAAEILSPKRVLSFRHIREDEVMMRVNEIRAAGPTTPVNLSVMFHSVTNSIVSRAAFGKKRKNAAEFLAAIKSGVGLASGFNIPDLFPTWTGILATVTGMKRSLRAIYTTVDGILEEIIAERKGIRDEKISGGAENVDENLVDVLIGLQGKGGFGFHLDNSKIKAIILDMFAGGTGTSASAMEWGMSELMRNPSVMKKLQAEIREVLRGKATVTEADMQAGNLRYLKMVIREALRLHPPAPLLVPRESIDVCELDGYTIPAKSRVIINAWAIGRDPKYWDNPEEFRPERFEDGTLDFTGSNYEFIPFGSGRRMCPGFNYGLASMELMFTGLLYHFDWSLPEGVNEVDMAEAPGLGVRRRSPLMLCATPFVPVVSAN

SEQ ID NO: 35158 - protein, 413 aa, Synechococcus sp. CC9311
MAGTSTKTTDLSESPPTAVMGTYNRYPLTLVRGKGCWVRDHKGHRYLDAVAGIATCTLGHSNRAMRRALKDQLSRLQHVSNLYEIPEQEELARWLVNNSCADSVFFCNSGAEANEAAIKLARKHGHQRRGIERPVILTAAASFHGRTLAAVSATGQPRYHIGFEPMVEGFETFTYNDIHSFELLLNRLEAHGPQVCAVLIEPLQGEGGVNPGDPEVFRAMRRHCDERNILLIFDEVQVGMGRSGRLWGYEQLDVQPDVITLAKGLGGGHAIGALLTTKHADLFTPGDHASTFGGNPFACRAGLTVARELERRQLLRNVSERGAQLRAGLNQLIKRFPQQLEDARGWGLLQGLVLREDCDLNAADVVKAALAQKLLLVPAGTKVVRMVPPLVIDRREVNELLSRLERTLDLLNA

SEQ ID NO: 35159 - protein, 112 aa, Medicago truncatula
MFAEENGLKGDPRLQHISQSIRVIPHFPKNGIMFQDITTLLLDHKAFKDTVDIFVDRYRDMHISVVAGIEARGFVFGSAVALGIGAKFVPLRKPRKLPGTTFLFMLSVHLVI

SEQ ID NO: 35160 - protein, 57 aa, Medicago truncatula
MHVGAVQPGERAIVIDDLVATGGTLSAGIKLLERAKAEVVECACVIGVPEVKVLLKA

SEQ ID NO: 35161 - protein, 315 aa, Brassica napus
  misc_feature (197)..(197): Xaa can be any naturally occurring amino acid
  misc_feature (211)..(211): Xaa can be any naturally occurring amino acid
MILAQLRRLRLSIFAKSHFSLASSHFNLINPNPPVKLARALFSNLATVEPIPLPVSDSSHLDAAPVEIPLDKLFIPPETDISDEEPSRLAARILKGSNIVLSKYARDAQVVQADYVKSSVRTEDCPADGLPEFALVGRSNVGKSSLLNSLVKRKRLALTSKKPGKTQCINHFRINDNWYLVDLPGYGYASAPHELKXKDWNKFTKDYFLNXRSTLVSVFLLVDASIPPKQIDLDYASWLGQNQVPMTMVFTKCDKRKKKKNGGKRPEENIKEFQDLIQGFFETTPPWIMTSSVTNQGRDEILLHMAQLRNYWLKH

SEQ ID NO: 35162 - protein, 129 aa, Medicago truncatula
MASNTKLFSATILVLSLLAYSTFTEAKGSCSPSPKPKPKPSPQGHCPKDTLKLGVCADVLGLVNVVVGNPASGSNCCAIIKGLADLDAALCLCTAIKANVLGINLNVPLTLTWILGACQKTIPPGFQCA

SEQ ID NO: 35163 - protein, 443 aa, Oryza sativa (japonica cultivar-group)
MSPKQKSLRSKRMAEASEEDGIDVLPDALLQHILSFLPAEDAVKTCVLSRRWRHLWKLTPILCITNTERWRSPKDFIKLVNHLVLFRGSSPLHKFEIKINSCAHWMIMSGDSNPFHCAIMWVMYALMCQVQVLTIKNMHAYIEMDDGFSLFSRHLTELNLSGLDFRKFVLNFSSCPALEYIYFSASCCFNSVEKILSQSVKYLTFDFPEFSEHHRTHIYAPNLITLRLDDCWGRVPFLESMPSLIAAFVRPHRDSDDLCSNTYSGNCEDEYCHGCYGMVDNAGNDSAKCVLLGGLSEAKKLELIAGPEMRIFRSDLRWCPLFSKLKSLLLNEWCVANNFWALACILEHSPVLLKLTLQISKETKPMIGAVENYSALVKPAAISKHLKVVKVHCKEVDEGVCETVKFLSTLDVVVLIRRMDRSTNLFSFEEGNSSSSHDEGSSR

SEQ ID NO: 35164 - protein, 131 aa, Zea mays
MACKAFALFLAVNLVVLGVASACSPYCPTPTPTPSTPTTPTPTPSSFGRCPRDALKLGVCANVLGLIKAKVGVPPAEPCCPLLEGLVDLEAAVCLCTAIKGQILGINLNLPIDLSLILNYCGRTVPTGFKC

SEQ ID NO: 35165 - protein, 138 aa, Lactobacillus plantarum
TNEMLKANQLSFPGQRVAISGAGNVAIYAIQKVEELGGKVITCSDSNGYVIDENGIDFKIVKQIKEVERGRIKDYADRVASASYYEGSVWDAQVAYDIALPCATQNEISGNQAKNLIANGAKVVAEGANMPSSPEAIA

SEQ ID NO: 35166 - protein, 402 aa, Solanum tuberosum
MAVKKSVGSLKEADLKGKRVFVRVDLNVPLDDNFNITDDTRIRAAVPTIKYLMQNGARVILASHLGRPKGLVHPKVQLKPFVPRLSELLGIEVKMANDSIGPEVENLVAELPEGGVVLLENVRFYKEEEKNDLEFAKKLASLADLYVNDAFGTAHRAHASTEGVAKVLKPAVAGFLMQKELDYLVGAVSNPQKPFAAIVGGSKVSSKIGVIESLLEKVDVLLLGGGMIFTFYKAQGYAVGSSLVKEDKLDLATSLMEKAKTKGVSLLLPTDVVIADKFAANANSKIVPASEIPDGWMGLDFGPDAIKSFGSALDTTKTIIWNGPMGVFEFDKFAAGTEAIAKKLAELSGKGVTTIIGGGDSVAAVEKVGLAEKMSHISTGGGASLELLEGKPLPGVLALDDA

SEQ ID NO: 35167 - protein, 138 aa, Lactobacillus plantarum
TNEMLKANQLSFPDQRVAISGAGNVAIYAIQKVEELGGKVITCSDSNGYVIDENGIDFKIVKQIKEVERGRIKDYADRVASASYYEGSVWDAQVAYDIALPCATQNEISGDQAKNLIANGAKVVAEGANMPSSPEAIA

SEQ ID NO: 35168 - protein, 351 aa, Pseudomonas syringae pv. phaseolicola 1448A
MNSYNIAAVPGDGIGVEVIAAGVEVLQALSKKSGFDLTFKHFDWNSDNYLKNGHYIPEGGLAELKTFDAIFFGAVGALNVPDHISLWGLRLPICQGFDQYANVRPARVLPGVKSPLHNGHEIDWVVVRENSEGEYSGNGGRVHRGLPEEVATEVSVFTRAGVERIHRFAFELARTRPRKHLTMVTKSNAQRHGMVLWDEIFYEVAKDFPDVRIDKELVDAVTTRMVLKPSSLDVIVATNLHADILSDLAAALSGSLGIAPTANLNPGRNFPSMFEPIHGSAFDITGKGVANPIATFWTAAMMLEHLGESAAAKTLMSAIEAVTESGLHTPDLGGTATTRQVTDAVLQLINR

SEQ ID NO: 35169 - protein, 962 aa, Zea mays
MLLHAGPSFLLAPPPRFAAAPSSASPRRSRTPQSSPPTSHFARPADPVAQRVRPVAPRPPMATAEEGASSDVGVAVAESAQGFLLDARAYWVTKSLIAWNISDQKTSLFLYASRNATMCMSSQDMKGYDSKVELQPENDGLPSSVTQKFPFISSYRAFRIPSSVDVATLVKCQLAVASFDAHGNRQDVTGLQLPGVLDDMFAYTGPLGTIFSEEAVSMYLWAPTAQDVSVSFYDGPAGPLLETVQLNELNGVWSVTGPRNWENRYYLYEVTVYHQTTGNIEKCLAADPYARGLSANSTRTWLVDINNETLKPLAWDGLAAEKPRLDSFSDISIYELHIRDFSAHDSTVDCPFRGGFCAFTFQDSVGIEHLKKLSDAGLTHVHLLPSFQFGGVDDIKSNWKCVDEIELSKLPPGSDLQQAAIVAIQEEDPYNWGYNPVVWGVPKGSYASNPDGPSRIIEYRLMVQALNRLGLRVVMDVVYNHLYSSGPFAITSVLDKIVPGYYLRRDSNGQTENSAAVNNTASEHFMVDRLIVDDLLNWAVNYKVDGFRFDLMGHIMKKTMIRAKSALQSLTIDEHGVDGSKIYLYGEGWNFGEVAENQRGINGSQLNMSGTGIGSFNDRIRDAINGGSPFGNPLQQGFSTGLFLEPNGFYQGNETETRLTLATYADHIQIGLAGNLKDYVVISHTGEARKGSEIRTFDGSPVGYASSPIETINYASAHDNETLFDIISLKTPMDLSIDERCRINHLSTSMIALSQGIPFFHAGDEILRSKSLDRDSYDSGDWFNKIDFTYETNNWGVGLPPREKNEGSWPLMKPRLENPSFKPAKHDIIAALDKFIDILKIRYSSPLFRLTTASDIVQRVHFHNTGPSLVPGVIVMSIEDARNDRHDMAQIDETFSCVVTVFNVCPYEVSIEIPDLASLRLQLHPVQVNSSDALARQSAYDTATGRFTVPKRTAAVFVEPRC

SEQ ID NO: 35170 - protein, 532 aa, Arabidopsis thaliana
MAATGSGRSQFISSSGGNRSFSNSPLIENSDSNQIIVSEKKSWKNFFAYLGPGFLVSIAYIDPGNFETDLQAGAHYKYELLWIILVASCAALVIQSLAANLGVVTGKHLAEQCRAEYSKVPNFMLWVVAEIAVVACDIPEVIGTAFALNMLFSIPVWIGVLLTGLSTLILLALQKYGVRKLEFLIAFLVFTIAICFFVEIHYSKPDPGEVLHGLFVPQLKGNGATGLAISLLGAMVMPHNLFLHSALVLSRKIPRSASGIKEACRFYLIESGLALMVAFLINVSVISVSGAVCNAPNLSPEDRANCEDLDLNKASFLLRNVVGKWSSKLFAIALLASGQSSTITGTYAGQYVMQGFLDLRLEPWLRNLLTRCLAIIPSLIVALIGGSAGAGKLIIIASMILSFELPFALVPLLKFTSCKTKMGSHVNPMAITAFTWVIGGLIMGINIYYLVSSFIKLLIHSHMKLILVVFCGILGFAGIALYLAAIAYLVFRKNRVATSLLISRDSQNVETLPRQDIVNMQLPCRVSTSDVD

SEQ ID NO: 35171 - protein, 346 aa, Synechococcus sp. CC9311
MISALLGRSKSELEEWAVAQGQPAFRGRQLHDWLYAKGVRDLQGITVLPKAWRASLQNEGVSVGRLHEQERRVSADATTKLLLGTEDGETLETVGIPTDQRLTVCVSSQVGCPMACRFCATGKGGLQRSLAGHEIVAQVLSIREVMERRPSHVVFMGMGEPLLNIEAVLESIRCLNDDLGIGQRRITVSTVGVPHTLPRLADLALKQLGRAQFTLAVSLHAPNQALREELIPTAKTYPYDALLDDCRYYLNKTGRRVSFEYILLGGVNDHPHHASELADRVGGFQSHVNLIAYNPIEEEEFQRPTTQRIEGFRRVLERRGVAVSLRASRGLDQDAACGQLRRNRRS

SEQ ID NO: 35172 - protein, 521 aa, Desulfitobacterium hafniense DCB-2
MRVVSAHQMRELEERAIRDFGIPSLLLMENAALAVIQEVRQMLEDRHIQLSAGRATVFVGKGNNGGDGLAVARHLLILGMDITVYSFARAEEFKGDAALNYRLYQNTGGKLFTIEGEKQRRLVRISLAQADVIIDAIYGTGFRGALPSLIDEYVEEINRAQVPVVAVDIPSGVEADTGKVYRKAIMADATVTFGLPKLGHFLGVGPEYAGRVSVDPISIPERFLDDEKLTTSILTEDVCQYLPIRSLQGHKGTHGRGVLVAGSEGMTGAALLAGKAALRSGIGLLQMVVPRGLAEGIDLALTEATVWGAESEKALNGNAWPVIYERAEKAQALAIGPGLGQEPELLLVIEEVLRNLPLPVILDADALNVLAKEPGILGWRQGRGPLILTPHPGEMARLCGCTTEEVQANRLELAISKAVEWESIIVLKGAITIIAAPDGRAFLNPTGNPGLGTGGTGDVLTGSILAWLAQGVEPLAAACLGVYLHGKAADQLTGEFGLSGYTAGEVADQLPKARRSLENNH

SEQ ID NO: 35173 - protein, 254 aa, Oryza sativa (japonica cultivar-group)
MPMEKKHRHARSRSFSGGAIVSFLKSTAASFTATTTTASAPPPPHGRSSFNHRNAFSGPIVSIVPPEARGGGGGSRREHRSGYRTPEPSSPKVSCIGQIKKANAKKVKASCKNGACPLPPRPPADAAAARRQKSSLVRRMLFRRSRSRKASSSSSRDGGFFKGRTAGRAGAAVAAAPAPAGLGQMKRFTSGRAAFEDFDWREAERMASDDDDDVLVAHSAPLVLGGGLVASEPRKEVNLWSRRPMAPPTPLRLP

SEQ ID NO: 35174 - protein, 130 aa, Medicago truncatula
MASNKFSALILVLSLLAYSTFTEANCPPSPKPTPSPTPVPPSPKGQCPKDTLKLGVCADLLGLVNVVIGNPPSGSKCCALIKGLADLEAALCLCTALKANVLGINLNVPITLSLLLSACQKTVPPGFQCP

SEQ ID NO: 35175 - protein, 877 aa, Ashbya gossypii ATCC 10895
MDFQQVDTKEKNSDRLPSPCAPASEKDGKAGSQDVPLSDTQELSLLDDEHLILLLHKMGYKHADLEDIPPVVHYLVARINELTIEKSLTILKKCAVDHAGDPNITEEEATDLERFTSGDFDHTDETEVFQLKLLAALFYYHSPYPEVRAVVGPGDDPTIPVETFRCYFLTTTITIIGCGLTTFFQSRYPLIEFSSMAAQFLFFILGTLWSKFMPAVRIPIFPGYGFQLNLQTSWSKKEQMFATLLYSITTGVFYSYFNILTQDMFYNDPTSLGFQIILSLSLQFMGFGLAGLLRPFVVFPARALWPLSMPTIALNNALLAQDVGKGTSIRKVFFYFGIGMFIYNWFPTVFADVLSNLNWLTWIKPNNFNLAAITGGRYGIATNPLPTLDWNYITHWALALPFYTVFLQYLGSLLSVVIIIAVYYTNYMECQYLPIFGQPLYSNEGKFFDASKVLTDFKLDWQKYQQYSLPYYSAGNIVGYGSFISLYTLLAAYSIITEYEILGGACKRLGVGLWSLTKLDTWRNLHKNDSSILEGYDDAHCREMRKYPEVPEWWFFAIFLISLVLAIILVTTYKTNTPVWGIFLAVGLNVAFLLPLTTLQSTTGASLGLNLLVQMITGYLLPGNPYALMIIKAFGYNIDGQADNYLSNLKMAHYCKIPPVPLFRGQLSMVLLQVIVSLAVINWQIHNVPDFCNPKNRSGFICQGPRTYYNASIVWGIIGPKKVFSYLYPMMKWCWLIGALLGVLFGGWCRLSRKYKLYYPRSFNPVVFVTGMISLMPPYNLRVYTSKLYVAFIGQYWLRRYHLRIWEKYNYVVAAAFNCGVIFSAITIFFAIQYPEIRLDWILNTINDVGIDATPTPLKDVKLTERGYFGPPRGSLP

SEQ ID NO: 35176 - protein, 461 aa, Shigella flexneri 2a str. 2457T
MADNKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGISEITAIGVYVQFWSPEMAQWIPALIAVALVALANLAAVRLYGEIEFWFAMIKVTTIIVMIVIGLGVIFFGFGNGGQSIGFSNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIGSCLNYIIPNPQRVFVYVYSASVLPGMVPWFVILISQLRFRRAHKAAIASHPFRSILFPWANYVTMAFLICVLIGMYFNEDTRMSLFVGIIFMLAVTAIYKVFGLNRHGKAHKLEE

SEQ ID NO: 35177 - protein, 360 aa, Desulfotalea psychrophila LSv54
MWENLDVALEKVSVENLKEKPSSENLCFGSDFTDHMFAMTWSRENGWHDAKICPYHNLVLDPAAMVFHYGQAIFEGMKGYKGKDGQTYMFRPTDNLERMNQSAVRLCMPRLPVDKVLKSLKALLYLEKDWIPEAPGSSLYIRPTMIAVEPSLGVRPSEKYYFFVIMSPVGAYYKEGCNPTKIYVSDEQARAVPGGVGNIKTAGNYAASLYTAEIARKKGCSQVLWLDAKEFKYVEEVGTSNIFFRIGDELITPPLGGSILGGITRDSILKLARSWGLNVSERKITIEEVLRASEDGTLLESFGTGTAAVISPVGEIVYKDKSYIINAGKAGELSQRLYAELQGIQYGELEDPFKWVERVG

SEQ ID NO: 35178 - protein, 609 aa, Coprinopsis cinerea okayama7#130
MTPATVYRSRAPPVPVVRKSVFTYLFEDQYMNEGALPAKPAYIDASTGQTLTREQVKTYSLKFAWGLRNRLSLRRGDTVMLMSPNSLSWPLALFGCVAAGLKISFAGCSATPRELSWQYLDSKPRVILVASHLVPVVKDMFALIGEESKGERDPRIWVIDDLGDYVSPPPQTSTSKSNLATNANDCVELVRGGKLERAERFDGDAAEETVYICYSSGTTGKPKGVETTHKNVCTVLPMTQALWKGCETSHDVYLAVLPAYHMFGLAMQLHYPLRRGKPVVMMNQGFSSEAFCQAVQTYRITSLLLVPPILLTLSEYPDLEKYDLGSLTNIASGAAPLSLALANKFLDQLKKQGANVILIQGCGSTETTCPCQIVAPENAFSKFGSVGELLPNIEARIMVELSPTATSTATASVDGSLFRDANDGEEGEMWLKGPTITKGYLNNPQANASTFTRDGWFRTGDVLRRDPDGYYYIMDRKKEMLKYKGHQIAPAELESVLMENPEVGDVGVIGIMDVYSGNELPRAYVRPANADILKSPTLKKAFELRLAKWFEGHVSNYKFLRGGVIAIPDVPKSATGKILRKELREWAKAEQRKDREIQGRVDRSEAAKL

SEQ ID NO: 35179 - protein, 361 aa, Oryza sativa (japonica cultivar-group)
MNIKGGGRVPVPPAGAGTLVKLVVLGGTAVYAAVNSLYNVEGGHRAIVFNRIQGIKDKGKLCFEANLFGFIGAICLIFVVTKAGVDAENSSNVVSVRSVKRDQICSPTRPDRHWVQTLSLLVPPSGTIYQVYPEGTHFMIPWFERPIIYDVRARPNLVESTSGSRDLQMVKIGLRVLTRPMPEKLPTIYRTLGENFNERVLPSIIHETLKAVVAQYNASQLITQRETVSREIRKILTERARNFNIALDDVSITSLSFGKEFTHAIEAKQVAAQEAERAKFIVEKAEQDKRSAIIRAQGEAKSAELIGQAIANNPAFLALRQIEAAREISHTMSSSANKVFLDSNDLLLNLQQLTVANKSKK

SEQ ID NO: 35180 - protein, 270 aa, Burkholderia xenovorans LB400
MATQAGKGTALVTGASSGIGAVYADRLARRGYDLILVARDAERLNGLAGRLSSETGLHVETIAADLTVKADVRRIEERLRADRSITMLVNNAGVGATASLIDSDVDALEKMIDLNVTALTRLTAAVVPALVERGNGIVINISSIVALSPELLNGTYSGTKAYVLNLTQSLHHEVSGKGVQLQAVLPGATSTAFWGRAGLPVEHLPSEIVMTAEDMVDAALAGLDQGELVTIPSLPDAADWDRLNSARQQLQPNLSHKLPAARYTHVAATA

SEQ ID NO: 35181 - protein, 608 aa, Debaryomyces hansenii CBS767
MECPEPSESVIPNDQSTKSCSIKLQPMNRFRDMSKLRNYEIIQKLGQGTFGVVQKARNIKTKELVALKQLINHSAKEGFPITAMREITILKKLNHKNILKIIDMIYEEPKISNPQDILHQRGCFYTVSPYMCSDLVGLLENPNINLEVSHIKCFMEQLLHGIQYIHEQMFLHRDIKAANILIDRNGTLKIADFGLARVYHGSPPKFMSGPGGGERAYTGLVVTRWYRPPELLLGERRYTTAVDMWGIGCVFGELFTRKPILVGKTDSHQAQLIFDLVGPPNSISWSEATSLPNKHDLNIGLTCQRSLESKFAPLMNPDGINLLSGLLTLDPYKRFNALDALNHNYFKNEPLPMKPQELPKFEECHEIDKERFKLLREKKNNIHEANKIPKAHFPKGPGEYNNSNNYPRNRNGSFPLALPKQPKFYNQHQQEAHVPQQMHTDTYIPKKRDDKPGANAPQKESSEPITSYQSLRDRSPRREGHISRKPSTTNSNNISSNSSASNVGGTLSNPTHQKNRPNAKASAGIFMTNSRKQRPKPNPQSSSRNVSDQFKKRKLLPDEQNESDLTDFDEDVKDSKQLDSFLDWDTFTRSPENRKLQHEKKQFETKYS

SEQ ID NO: 35182 - protein, 339 aa, Mycobacterium leprae TN
MTVRVGINGFGRIGRNFYRALLAQQEHGIADVQVVAINDITDNSTLAYLLKFDSILGRLPHDVSLEEEDTIVVGSEKIKALAVREGPAALPWHAFGVDVVVESTGLFTNAAKAKGHLEAGAKKVIVSAPATDPDITIVFGVNDDKYDGSQNIISNASCTTNCLAPLAKVLHDQFGIVKGLMTTVHAYTQDQNLQDGPHSDLRRARAAALNVVPTSTGAAKAIGLVMPELKGKLDGYALRVPIPTGSVTDLTADLSKCVSVNEINAVFQDAAEGRLKGILKYVDAPIVSSDIVTDPHSSIFDSGLTKVIASQAKVVSWYDNEWGYSNRLVDLVGLVGKSL

SEQ ID NO: 35183 - protein, 913 aa, Burkholderia xenovorans LB400
MTDLSSGSKQLRFLNTHRVDTTEQADTDPQETAEWLQALDGVVAHVGRDRAQFLFDKLASHALSLGVESARTSVTPYQNTIPFEQQPRYPGNLELEERLAAALRWNALAMVVRANKAYGELGGHIASYASAADLFEVGFNHFFRATAPGGEEGTGDLVYFQPHSSPGVYARAYLEGFLSEENLQYYRREIGGPGLCSYPHPWLMPDFWQFPTGSMGIGPINAIYQARFMRYLANRGLVQTEGRKVWGFFGDGEMDEPESTGALSLAAREGLDNLVFVINCNLQRLDGPVRSNGRIIDELEAHFIGAGWNVIKVIWGSDWDALFSRDRTGALLRAFAHTVDGQFQTFSANDGAYNRERFFGQNPELAALAAQLSDDDIDRLRRGGHDVRKLHAAYANALAHHGQPTVILAKTMKGFGMGTSGQGRMTTHQQKKLDFDDLKAFRDRFRLPLTDEDVEQVKFYKPAEDSPEMQYLHARRAALGGYLPRRRRVASKGLIVPPVSSWGQFALESNGREMSTTMALVRMLTALLKDQEVGPRVVPIVADEARTFGMANMFRQVGIYSPLGQLYEPEDLGSMLYYREDTKGQILEEGISEAGAVSSWIAAATSYSVHDLPMLPFYIYYSMFGFQRIGDLIWAAADQRARGFLIGATSGKTTLGGEGLQHQDGTSHLAASTIPNCRAYDPAFAYEVAAIVDEGMREMVEQQRDVFYYVTVMNENYAQPSVPGDSPEALREGILKGIYPLAAQAQESTQARVQLLGAGAILGEVIAARQMLKDDWQIDAAVWSVTSFTELQRDGMAAERLARLGEETGTPYVTRALEASQGPIIAATDYVRAVPELIRAYVPRRYVTLGTDGFGRSDTRQALREFFEVDRKAIVIAALKALADEGAIGATVLAEARRKYLGAAAVGAASWQR

SEQ ID NO: 35184 - protein, 532 aa, Mycobacterium tuberculosis CDC1551
MSFVIAAPEVMAAAATDLANIGSSISAASAAAAGPTMGILAAGADEVSVAISALFGSHAQGYQTLSAQLAAYHNQFVRALNAGAGSYASAEAANVQQTLLNAINAPTQTLLGRPLIGNGADGGPGQNGGPGGLLYGNGGNGGAGDTANPNGGNGGSAGLIGNGGAGGAGAATGAGGAGGNGGWLYGNGGPGGAAGLGTAGGVSPAGGAGGAAGLWGHGGAGGAGGSASGAPGAGGAGGDGGRGGLLYGDGGAGGAGGNGSNGVTGVHGGNGGAGGAAGLIGNGGAGGDGGNGGLSNTGASGGAGGAGGAALIGNGGDGGHGGNGGHGNSGGAGGAGGAGGAGGAGGHVGLIGNGGNGGAGGNGGNDNSSTLADAGSGGAGAAGGNGGLFYGNGGVGGRGGNGGFSSAGTSGGDGGIGGAGGIGGLIGSGGGGGDGGNGGQAPTPGNAGDGGAGGNARLIGDGGRGGNGGEGGDGPPGVKGDGGNGGNGGNAVVIGNGGNGGAGGFGIPVGSGGAGGSRGVLFGTPGANGADG

SEQ ID NO: 35185 - protein, 197 aa, Aspergillus oryzae
MAQQQNDNVMRRKLVIIGDGACGKTSLLSVFTLGYFPTVPTVFENYVTDCRVDGRSVQLALWDTAGQEDYERLRPLAYSKAHVILIGFSVDTPDSLENVKHKWIEEANERCPGVPIILVGLKKDLREDPLAIEEMRKKSLKFVTSKEGSDISTQIGARKYLECSSLTGEGVDDVFEAVTRAALLTFDKRKSSCCIVL

SEQ ID NO: 35186 - protein, 556 aa, Debaryomyces hansenii CBS767
MSNSTKKDDCHDVTIDSTISDIEIERSGSTNNVMIEPSPKSSSELLSSESVISDSDARPSKLIILITLTSSISGFMFGYDTGYISSALVNIGTDLSNKLLSNGEKEFITSATSLGALIGAIIGGILANLIGRKMVLLGSNVIFVIGTIIQLAAHTVWTMIVGRFVLGLGVGIASLISPLMLSELAPSKYRGRLIVTNCMFITGGQLVAYFINWGLTGVNNGWRVSVGLCMVPPIIQFVLFCFLPDTPRFYIMVGRVEEARKVLSKTHHNPSNAFVNATIQDMIASNSTVPGNNPLVQAWNSIKIIHTNPANFRALILACGLQGIQQFTGFNSLMYFSATIFETIGFDNATAVSIIIAATNFVFTGIALCIIDKIGRRRILLGAIPCMCISLVLCAIAFHFLGVKFTSDSDVIVEARGITGWGIVIILGMVWFVASYAIGIGNSAWTGVELFSDVNVRAVGCMYAAATNWAGSLVIASTFLTMLENITPPGTFAFFAGLCFVAFFFVFFLLPEVSGLELEETTEFLANGFNVKASRQISKDRKKVSKFVTQNDDHSA

SEQ ID NO: 35187 - protein, 130 aa, Pseudomonas syringae pv. phaseolicola 1448A
MKDWLDEIHWNSDGLVPAIAQDHKTGRVLMMAWMNREALSLTASENRAIYWSRSRGKLWRKGEESGHVQKLHELRLDCDADVIILMVEQIGGIACHTGRESCFYRVYENSGWKTVDPVLKDPDAIYSAGH

SEQ ID NO: 35188 - protein, 143 aa, Idiomarina baltica OS145
MALERTLSIIKPDAVAKNLIGAIYNRFESAGLRIVASKMMHLSKEQAEGFYAEHSERPFFGALVEFMTSGPIVVQVLEGEEAILKNREIMGATNPADALAGTLRADYAETIDENAVHGSDAAETAAREIAYFFSDEEICPRTR

SEQ ID NO: 35189 - protein, 257 aa, Zea mays
MGRRHSGGGGGGGRGRGRGRGRGRDEEEDLPLHKAARSGDAAAVESVCESNPLAVNSRDRLSRTPLHLAAWAGHVDVVRCLCKHKADVGAAAMDDTAALHFASQKGHVEVARELLASGASVKAKNRKGFTALHFAAQNSHLDLVKYLVKKGVDVTAKTKGGQTALHVAEDDEVRAFLKECEQSLKKGAELPSEKDDSAEKEGDSKSSGEVMKDEEDAEQGEKRKSELVGASSLSGVKKAKVSLGHLVCENDMDEEEE

SEQ ID NO: 35190 - protein, 933 aa, Treponema denticola ATCC 35405
MAKSKYVYFFGGGSAEGNGTMREVLGGKGAGLAEMTAIGLPVPAGFTITTEVCEEYYKNNRKYPVELKTQVESYLSKLEKITGKKLGDKKDPLLVSVRSGAPVSMPGMMETILNLGLNDQSVQGLAEKTGNLRFALDAYRRFILMYGSTAMNIEREKFDKIFDDVKEKRTKKRLNLAQTAKVSDTDVNEPELQDVIDRSKKLYEKEIKSPFPQDPIKQLWGAIGAVFGSWMSDKAVTYRRVENIVGIRGTAVNVMQMVFGNKGDNSGTGVCFTRDPNSGKNDFYGEYLFNAQGEDVVAGIRTPIKLDVFAKKDPDAYKKLCDARKILEKHYKDMQDMEFTVEEGELYMLQCRTGKRLPAAAFQMAVDMVEEKLITKEEAVSRIKASDIEGVFYKALDYSKASEIKSAHLVDGIPAVPGAACGIICLSAEAAEAAAKDGKRAVLVRHETSPEDVGGMHAAEGILTATGGKTSHAAVVARGWGKCCIVGCENLRIDYEKKAISAKGIVLKEGDYITLDGSKGAVYKGELPLITPKPPAAYKKIMEWVDQIRKIKVRTNADTPEDAKIAVGHGAQGIGLCRTEHMFFSDESRIQAIREMIIAENKEAREKALKKLLPYQTKDFEGIFKAMNGYPVTIRLIDPPLHEFVPHDKEGQQKLAEKLNISFASVKNRVDQLTEANPMLGHRGCRLSITYPEILEMQVTAIINAACTVQKKGIAVLPEIMIPLTIDAKEFRILEKRVRAVADDIIEKKAKDKKLKYMVGTMIETPRAALLADKIAEYAEFFSFGTNDLTQMTIGISRDDAGKFLPEYVDENKAGVFKADPFQSLDQEGVGILVSTAIQKGREVKKNLEIGVCGEHGGDLNSVKFFCRAGMDYVSASPLRVPIARLAAAQAEVEALKSKSAAKKPAKPAAKTSKPSEKAKAKTGKKPANKPAK

SEQ ID NO: 35191 - protein, 286 aa, Oryza sativa (indica cultivar-group)
MESTEPLQDIMCEFRAGKMSLDGTRVIPDTRKGLVRIGRDQIVFPEEAVFEKVTQSSGRVYILKFRHDSRKFFFWMQEPSADDDSQICRQVNAYINRPLDGEAVSIEAEMSHEDTADDDISSRAGNLVDQSMTADLAGEVTSAAGPVRLEDLQRILSAIQPSDAVADPDAGLGLGDILKPDLVLPLMETLPIEQLASYLPEGPWTAGDILELLQSPPLRQQVEAFTHVLRTGQIDLAQFGVDPSKYKFTVASFLEALEDSVAKASGAGDKDSESQRGGGNDPMDES

SEQ ID NO: 35192 - protein, 496 aa, Thermus thermophilus HB8
MPLITTETGKKMHVLEDGRKLITVIPGDGIGPECVEATLKVLEAAKAPLAYEVREAGASVFRRGIASGVPQETIESIRKTRVVLKGPLETPVGYGEKSANVTLRKLFETYANVRPVREFPNVPTPYAGRGIDLVVVRENVEDLYAGIEHMQTPSVAQTLKLISWKGSEKIVRFAFELARAEGRKKVHCATKSNIMKLAEGTLKRAFEQVAQEYPDIEAVHIIVDNAAHQLVKRPEQFEVIVTTNMNGDILSDLTSGLIGGLGFAPSANIGNEVAIFEAVHGSAPKYAGKNVINPTAVLLSAVMMLRYLEEFATADLIENALLYTLEEGRVLTGDVVGYDRGAKTTEYTEAIIQNLGKTPRKTQVRGYKPFRLPQVDGAIAPIVPRSRRVVGVDVFVETNLLPEALGKALEDLAAGTPFRLKMISNRGTQVYPPTGGLTDLVDHYRCRFLYTGEGEAKDPEILDLVSRVASRFRWMHLEKLQEFDGEPGFTKAQGED

SEQ ID NO: 35193 - protein, 212 aa, Ashbya gossypii ATCC 10895
MSGLRTVSSSSGAKNYDSIMKILLVGDSGVGKSCLLVRFVEDKFSPSFITTIGIDFKIKAVDINGKKIKLQLWDTAGQERFRTITTAYYRGAMGIILVYDVTDERTFENIRQWFTTVNQHANEEAQLLLVGNKKDMDTRAVTYEQGESLAKELGVPFIEASAKDDENVSDIFFTLAKLIQEKIDNDKLVNNSGREGSVNISSGSNMPSSNCC

SEQ ID NO: 35194 - protein, 566 aa, Zea mays
  misc_feature (197)..(197): Xaa can be any naturally occurring amino acid
ASDPTHGWQTVSYPKRHRKQAHQPPRAMAPDLALQANGKGSGVFDAVEKRSQERHRALQQQLASRAADLDDARIAPVTGGAYSDDSDSDEATAPRQVGEVKKPKKPKKPKVTVAEAAALIDAENLAAHLVEISSSYENQQDIQLMRFADYFGRAFVAVSASQFAWAKMFKESTVSKMVDEIPLCHIPEAVIKTAGRXTSQRSYDALGDFVLWCIDSIMSELSGSSAGSKGSKKVAQQSPRAQVAIFVVLAMTLRRKPDVLVNVMPKIMGNNKYLGQEKLPIIVWFIAQASQGDLVTGMFCWAHFLFPTLCAKPSGNPLARDLVLQLLERILSVTKARSILLNGAVRKGERLVPPVSFDLFMRATFPVSGARVKATERFEVAYRTIKELALAGSPGSKTVKQASQQLLPLCAKAMQENNTELTREAVDVFIWCLTQNAESNKQWERIYPENTEASVAVLSKIVIDWKDVSPKLNSEALKATVKNLKAKNEAALESATDAGKQASIKEADKHCKVILGKLTRGSTCLKSTLVGIALAVAASLVLSSPDMDLALEWEKIQAMVSSHLSF

SEQ ID NO: 35195 - protein, 340 aa, Ashbya gossypii ATCC 10895
MDPQELASINKVAKYIKNHPKAKVVFLVGAGISTSCGIPDFRSPNTGLYHNLSKFKLPYAEAVFAIDYFQRDPKPFYTLAREMYPGKYIPSRFHYLMKLFESKGYLKAVYTQNIDTLEREAGIAADYIIEAHGSFATNHCIDCDKTFPTETFKAMLESGEYARCEDCEGLIKPRIVFFGEDLPSVFYTSWDKLLSEMQAGKEDYLVIVAGTSLVVYPFASLPSETPRKVHRVLMNMEVVGDFKTPRKTDIIIHGETDHIAEELARALGWYDELVDISSGRSSSETTVVEKDTENQTDIKSASASVIKYKEVSSVSKEESSIDKIAEKILKLDLSRENSDD

SEQ ID NO: 35196 - protein, 112 aa, Oryza sativa
MDKGDVAVAVPPSIAGASSSGAKKGKRFEIKKWNAVSLWAWDIVVDNCAICRNHIMDLFSFGLPMICQRESLECGLGRVGVCNHAFHFHCISRWLKTRQVCPLGWLPWKMPL

SEQ ID NO: 35197 - protein, 1165 aa, Medicago truncatula
MLEKKEGKSRKQAVTRLQLGGRQTRAVLAAAAAGAGYVCDKMSTTRPSQSSNNSGRSRNSARIIAQTTVDAKLHATFEESGSSFDYSSSVRVSGSVDGEHQPRSNKVTTAYLNTIQRGKQIQPFGCLLALDEKTCKVIAYSENAPEMLTMVSHAVPSVGDHPALGIGTDIRTIFTAPSASALQKALGFAEVSLLNPILVHCKTSGKPFYAIIHRVTGSLIIDFEPVKPYEVPMTAAGALQSYKLAAKAITRLQSLPSGSMERLCDTMVQEVFELTGYDRVMAYKFHEDDHGEVIAEVTKTGLEPYLGLHYPATDIPQAARFLFMKNKVRMIVDCHAKHVKVLQDEKLPFDLTLCGSTLRAPHSCHLQYMANMDSIASLVMAVVVNDSDEDGDSADAVLPQKKKRLWGLVVCHNTTPRFVPFPLRYACEFLAQVFAIHVNKEIELEFQILEKNILRTQTLLCDMLMRDAPLGIVSQSPNIMDLVKCDGAALLYRNKLWILGATPSEPQIREIALWMSEYHTDSTGLSTDSLSDAGFPGALKLNDTVCGMAAVRITSKDIVFWFRSHTAAEIRWGGAKHEPGEQDDGRKMHPRSSFKAFLEVVKARSIPWKDFEMDAIHSLQLILRNASKDTDMIDLNSKAINTRLNDLKIEGMQELEAVTSEMVRLIETATVPILAVDVDGMVNGWNIKISELTGLPVGEAIGKHLLTLVEDSSTDIVKKMLNLALQGQEEKNVQFEIKTHGSKTDCGPISLIVNACASRDLHENVVGVCFVAQDITAQKTVMDKFTRIEGDYKAIVQNPNQLIPPIFGTDEFGWCCEWNAAMIKITGWKREEVMDKMLLGEVFGTHMSCCRLKNQEAFVNFGIVLNKAMTGLETEKVPFGFLSRKGKYVECLLSVSKKIDAEGLVTGVFCFLQLASPELQQALHIQRLSEQTALKRLKVLTYMRRQIRNPLSGIVFSSKMLENTELGTEQKRIVNTSSQCQRQLSKILDDSDLDSIIDGYLDLEMAEFTLHEVLVTSLSQVMNRSNTRSIRIVNDVAEHIAMETLYGDSLRLQQVLADFLLISINSTPNGGQVVIAATLTKEQLGKSVHLVNLELSITHGGNGVAEAVLNQMFGNNGLESEEGISLHISRKLLKLMNGDVRYLKEAGKSSFILSVELAAAQKLRG

SEQ ID NO: 35198 - protein, 416 aa, Mycobacterium leprae TN
MRIPNLKDLLEEGVSGRCVLVRCDLNVPLGDDGAITDLGRVTASVPTLKALLEAGAKIVVAAHLGRPKNGPDPKLSLEPVAAALGEQLGQNVQLVCSTDRSPVGGDALACVERLTDGDLLLLQNIRFDPRETSKVDDERLALAKQLVELVGSAGAFVSDGFGVVHRRQASVYDVATLLPHYAGILVADEIRILEQLTSSAKRPYAVVLGGSKVSDKLGVIESLATKADSIVLGGGMCFTFLAAQGFSVGKSLLETEMIETCRSLLDTYADVLRLPMDIVVTEKFVADSPPQTVAADAIPDGLMGLDIGPESVKRFATLLSNASTIFWNGPMGVFEFPAYAAGTRGVAEAIVAVTGKGAFSVVGGGDSAAAMRALSLPEGSVSHLSTGGGASLEYLEGKTLPGIEVLGREQPRGGDS

SEQ ID NO: 35199 - protein, 521 aa, Zea mays
MATGALLQPWSLLGFLAALAALWWACRVLQSTLIVPRRLGRALRSQGLRGTTYRFPFGDLKELARLAVAARAKAMPLSHDITPRVNRLYYNVIGEHGKVSVTWLGPTPRVIVNDPKLVREILANKLGHFQKRKHDGIVRRLASGLVNHEGEKWAAHRKLISPAFHLEKLKKMLPAFASCSDELIARWAGYVGSDGAREIDVWPEFQNLTGDVISRTAFGSSFSEGRRIFEIQCEQVQNLVKLMNTLYLPGFRFLPTQLNRRLKANAREVQALLRGIVGKRERAMKDGRANNDDLLGVLMESNIAETRQNGSSEPVMTMDDIIGELKLFYFAGMDTTAVLLTWTMVVLSAHPEWQERAREEVRRVFGNNRPDLDGIQQLKTVTMILYEVLRLYPPVVQLDRQTHNEVELGGVTYPPGVLLSLPIVFVHHDKDVWGEDADEFSPERFKDGVSRASKDSPAFFPFGWGPRICVGQNFALVEAKMALSSILQHFSFALSQSYTHAPFPVSTLQPEHGAHLMLKKL

SEQ ID NO: 35200 - protein, 261 aa, Mycobacterium leprae TN
MSRKSLIAGNWKMNLNHFEAIALVQKIAFSLPDKYYDKVDVTVLPPFTDLRSVQTLVDGDKLRLTYGAQDLSQHDLGAYTGDISGAFLAKLGCSFVLVGHSERRTYHDEGDALVAAKTAAALKNSLTPIVCIGEYLEIREVGEHVSHCQNQLRGSLAGLSPEQIGNVVIVYEPVWAIGTGRVASAADAQEVCEAIRKELGALASPQVAETVRVLYGGSLNAKNIGDIVAQQDVDGGLVGGASLDGAQFATLAVIAAGGPLP

SEQ ID NO: 35201 - protein, 371 aa, Francisella tularensis subsp. holarctica
MQQKCYYEILNISKTASGVEIKRAYRKLAMKYHPDRNPGDKEAEIKFKEISEAYEILSDDSKRSRYDQFGHAGVNQQSGFGGTGGFEDIFDTFFGGGTSRGSNRSRASRGSDLEYTLEITLEEAFFGVEKEITIPRMESCDSCDGTGSKSRSKTTCHACHGQGTIRRQQGFFAFEQTCPVCNGTGYSITDPCDACYGNGKVKKQKTLKVKIPEGVDNGDRIRLQGEGDSGSNGAMNGDLYVQIIIKEHKIFERRDINLYCEMPISFTKACLGGDIKVPTLDGEVVLKVVPETQTGKVFRLREKGMKSLRGHRRGDLLCKVVVETPVNLSAEQKELLEKFADSLGEDYQSKHAPKSKTWFDNVKDYAKKFFE

SEQ ID NO: 35202 - protein, 175 aa, Escherichia coli
  misc_feature (14)..(14): Xaa can be any naturally occurring amino acid
  misc_feature (51)..(51): Xaa can be any naturally occurring amino acid
  misc_feature (76)..(76): Xaa can be any naturally occurring amino acid
  misc_feature (133)..(133): Xaa can be any naturally occurring amino acid
MSTTNHDHHIYVLXGVSGSGKSAVASEVAHQLHAAFLDGDFLHPRRNIEKXASGEPLNDDDRKPWLQALNDAAFAXQRTNKVSLIVCSALKKHYRDLLREGNPNLSFIYLKGDFDVIESRLKARKGHFFKTQXLVTQFETLQEPGADETDVLVVDIDQPLEGVVASTIEVIKKGK

SEQ ID NO: 35203 - protein, 462 aa, Cryptococcus neoformans var. neoformans JEC21
MLARSAIQRALRTAARRPAAAPLPPRRLARSFSATPWRHSQQPVTPPLPLQQPEPAAAATSTPLPPAPADLLPQPPADAGAPTLEDLILHSGKSVQDVLNSEEAVHAAMKLSDLKLIGYDHGILSVTGWFTDGLVALHTELGLPWWAAIAGTTVLIRLCLTRLVVNTQKHSVRLAAVNPQIQELMAEAKVASANKDTHMQTLISQRLRDLMKEHNVNPLRPLLLPLVQMPIFLTFFSIVRGLANLPLPQLKEGGLGWVTDLTAADPYYILPATSLLFTNLVFKFGADGVPTAAKAGSPMTTAHMRNFIQLTTFLSFPLIMYFPSALLFYWTFSTGFTLLQSIILRQPIVKRYLGLPVTKAQALEPGAEPLKSPSYMDTFNAAKEYFQKSVKQASEDSANRAHAEQKAKHASVQRKQQQGAFVERIQEPGPEVSDAQTVKRPEGREAEKQRRIEEARRRRARS

SEQ ID NO: 35204 - protein, 446 aa, Staphylococcus aureus subsp. aureus MW2
MPKRTFTKDDIRKFAEEENVRYLRLQFTDILGTIKNVEVPVSQLEKVLDNEMMFDGSSIEGFVRIEESDMYLHPDLDTWVIFPWTAGQGKVARLICDVYKTDGTPFEGDPRANLKRVLKEMEDLGFTDFNLGPEPEFFLFKLDEKGEPTLELNDDGGYFDLAPTDLGENCRRDIVLELEDMGFDIEASHHEVAPGQHEIDFKYADAVTACDNIQTFKLVVKTIARKHNLHATFMPKPLFGVNGSGMHFNVSLFKGKENAFFDPNTEMGLTETAYQFTAGVLKNARGFTAVCNPLVNSYKRLVPGYEAPCYIAWSGKNRSPLIRVPSSRGLSTRIEVRSVDPAANPYMALAAILEAGLDGIKNKLKVPEPVNQNIYEMNREEREAVGIQDLPSTLYTALKAMRENEVIKKALGNHIYNQFINSKSIEWDYYRTQVSEWERDQYMKQY

SEQ ID NO: 35205 - protein, 327 aa, Arabidopsis thaliana
MQSSNVTDCTMRKRGTKRKIEIEKRMTKQQRSVACSKRRPTLFSKAADLCLLSGANIAVFVTSPDENSDVVYSFSGYSHASEIVDCYLNNKSPPKTTINPESAKFWWEEPDLYRDCDDLSELRIIEDRLMRTKKHLMDYLEKKEKSHSVSKSDQNPNNDSGSSSSSSSSSSQIASDFGQNPSTLSPSSLKIVSFDQNSYSSLEPSSQVTTCFDQNPVFSVGSESSSDQSRYLVNEDSGFVDGLLCETEEENNGMRLPQETQTQPMFTEEDQSFWENLDVDDVFGLFKDDNNLEVPLQDHSSTNEDDELLIDISEYLSEEAMECPCFS

SEQ ID NO: 35206 - protein, 281 aa, Oryza sativa
  misc_feature (243)..(243): Xaa can be any naturally occurring amino acid
MAAATVSVRFHPAASAARCGGGSRRSRRLSGVIRAQSAPASAAAAALTQDDLKRLAAVRAVEQVESGMVLGLGTGSTAAFAVAEIGALLASGKLSGIVGVPTSKRTFEQAQSLGIPLSTLDDHPRIDLAIDGADEVDPDLNLVKGRGGALLREKMVEAASDKFIVVVDETKLVTGLGGSGLAMPVEVVQFCWKYNQVRLQDLFNDEGCEAKLRLDEGGKPYVTDNSNYIVDLYFKTPIKDALXAAGKEISALEGVVEHGLFLDMATSVIIAGTDGVSVKTK

SEQ ID NO: 35207 - protein, 446 aa, Pseudomonas syringae pv. phaseolicola 1448A
MNEPQSARTSSATLRPSACPGLLRIVPALDGGICRIKLAGGVISSVQAMAVAEAAQTYAQGVIEATNRANLQIRGIGADHDGLIKALMAAGLGPANPASDDVRNLMLSPTAGLDSRMLFDARPLAAQVLDALENHPRFHELSPKFALSLDAGEALVMLEHAHDVWLSALNLDGEVLLAFGLAGCPANDRPLAAVPLAAGEALVVGLLELFLDLARPEHTRMRHLLAEVSTDDVLRELSTRLDCALRVDQAVTSWQRPAIQGNRHIGIYPQAEPARVAVGAVVPLGRLDAATLAIVAQLAEEQGDGTLRLTPWQSLLLPNVPVERAATVMTALQAAGLICSAEQPLAQMVACTGSAGCVKGLADTKADALQLATGLVASQAVHLSGCTRSCAAAHVAPVTLLAVSPGRYDLYFRDAAHAGFGVLRARDLTIEAVGAQLNADSRSNIA

SEQ ID NO: 35208 - protein, 432 aa, Pseudomonas syringae pv. phaseolicola 1448A
MTHRIVIVGGGAGGLELATSLGKTLGKKGTASVTLVDANLTHIWKPLLHEVAAGSLNSYEDELNYVAQAKWNNFQFQLGRMTGLDRASRQIHLAETLDENGAELVPARSLGYDSLVIAVGSTTNDFGTTGAAEHCLFLDSRKQAERFHQQLLNHYLRAHAGQADSAQEITVAIVGAGATGVELAAELHNAAHELAAYGLGQIKPENLRITVIEAGPRVLPALPERIGAPVHKTLEKLGVTVLTNAAVSEVTADGLITASGQVIPASLKVWAAGIRAPAFLHELDGLESNRINQLQVLPTLQTTRDENIFAFGDCAACPQKGTDRNVPPRAQAAHQQASLLAKSLRLRIEGKTLPEYTYKDYGSLISLSSFSAVGNLMGNLMGSVMLEGWLARMFYVSLYRMHQMALYGTFRTLMLMLGSKIGKGTEPRMKLH

SEQ ID NO: 35209 - protein, 392 aa, uncultured archaeon GZfos9D8
MFSERIRSLPPYLFAEIDKRKREAEKKGADIIDLGIGDPDLPTPPHIVEAVCRAAKDPANHCYPTYEGMLSFREAVAAWYNREKHVRLDAEDEVLTLIGSKEGIAHSAFAFLDHGDVALVPDPAYPVYNNATVLADGIPHLMPLRQENGFKPVLNDIDRETASKAKVMFLNYPNNPTAATVDRTFFKEVVDFAREHDIVILHDNPYSELTFDGYEAPSFLAVAGADEVGIEFNSLSKTYNMTGWRIGYAVGNSELLKSLGLVKTNIDSGAFQAVQIAGTTALTGPQDCITANVAVYRQRRDILFDALSSAGMEVKKPKATFYLWAKVPPGFSSIQFSMFLLEREGLVVTPGVGFGENGEGFVRFSLCVSVERLKEACERIKGLDRYSHSENY

SEQ ID NO: 35210 - protein, 664 aa, Listeria innocua Clip11262
MPEEKNTFYITTPIYYPSGKAHIGHAYTTVAGDAMARYKRLKGYDVFYLTGTDEHGQKIQAKAKERGISEQEYVDEIAEGFQELWKKLEISNTDFIRTTQDRHKTSVEKIFEQLLEQGDIYLGEYEGWYSVSDEEYFTETQLEEVYKDENGKVIGGKAPSGNEVELVKEESYFFRMSKYADRLVEYYNSHPEFILPESRKNEMINNFIKPGLEDLAVSRTTFDWGIKVPGNPKHVVYVWIDALSNYITALGYNTDNDTKFQKYWPADVQIVGKEIVRFHTIYWPIMLMALDLPLPKMVFGHGWILMKDGKMSKSKGNVVDPYMLIDRYGLDALRYYLLREVPFGSDGLFTPEDFVDRVNYDLANDLGNLLNRTVAMINKYFDGEIPAYQGNVTEFDQTLVDFKNNVVKEYEGSMDHMQFSVALNQLWSLISRTNKYIDETAPWALAKEEDKRTELASVMTHLAENLRIIAVLLQPFLTRTPGEIFLQLGLQEENLKKWDSIYGYGEIPEGTTVVKKGTPIFPRLDAEVEVTYIQDEMKGSAPAPAEETAEVEALETPQIGIEDFDKIDLRVAEVKQVDKVKKADKLLCFQLDLGEGKLRQVLSGIAEFYQPEELIGKKVIVVSNLKPVKLRGLMSEGMILSGEKDGKLSVIEANSALPNGAKVK

SEQ ID NO: 35211 - protein, 214 aa, Agrobacterium tumefaciens str. C58
MSRADKERQHFHGAAKMAERKGEIIRKTNETSVSVRVDIDGTGKSKISTGVGFFDHMLDQLSRHSLIDMDIEVQGDLHIDDHHTVEDTGIAIGQAIAKALGDRRGITRYASLDLAMDETMTKAAVDISGRPFLVWNVNFSAPKIGTFDTELVREFFQALAQNAGITLHILNHYGANNHHIAETCFKAVARVLRTATEIDPRQAGRVPSTKGMLA

SEQ ID NO: 35212 - protein, 258 aa, Trichodesmium erythraeum IMS101
FGPEAEFFVFEDARFDQTENKAYYYVDSIEGRWNSGREEDGGNKAYKPDYKGGYFPVPPTDTMQDLRTEMLLTMAKCGVPIEKHHHEVATGGQNELGFRFGKLVEAADNLMIYKYVIKNVGRKYGKTITFMPKPIFNDNGSGMHVHQSIWKDGEPLFWGDGYANLSKMALHYIGGILKHAPAILGFSNPSTNSYKRLVPGFEAPVNLAYSQGNRSASVRIPLTGTNPKAERLEFRCPDATCNPYLAFAAMLCAGIDGI

SEQ ID NO: 35213 - protein, 134 aa, Glycine max
MMKASCRIIAGTFKTNSERNSQNLNQKKRAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 35214 - protein, 113 aa, Legionella pneumophila subsp. pneumophila str. Philadelphia 1
MNCLFCKIAQGEIPATVVFEDKNILAFRDIRPQAPTHLLIIPKKHIATINDVNDDDSELLANILIRAKKLAQAEGLSEMGYRLVFNVNSGGGQEVYHIHLHLLGGRQMTWPPG

SEQ ID NO: 35215 - protein, 482 aa, Solanum tuberosum
MASATASHTFCGIPTKSSSSTTNRSTTPSSARFLLKTPLRRLGFAGAVADPLFTSHVATKLRSLKASSNPVRAVVSMAKKSVGDLSSADLKGKKVFVRADLNVPLDDAQNITDDTRIRAAIPTIKHLIANGAKVILSTHLGRPKGVTPKYSLAPLVPRLSELLGIQGVKADDCIGPEVEKLVDSLPEGGVLLLENVRFYKEEEKNEPEFAKKLASLADLYVNDAFGTAHRAHASTEGVTKFLKPSVAGFLLQKELDYLVGAVSTPKRPFAAIVGGSKVSSKIGVIESLLEKCDILLLGGGMIFTFYKAQGLSVGSSLVEEDKLELATSLLEKAKAKGVSLLLPSDVVIADKFAPDANSKIVPASAIPDGWMGLDIGPDSIKTFNDALDTTKTVIWNGPMGVFEFDKFATGTEAIAKKLADLSGKGVTTIIGGGDSVAAVEKVGVASVMSHISTGGGASLELLEGKVLPGVIALDEADAPVAV

SEQ ID NO: 35216 - protein, 699 aa, Mycobacterium leprae TN
MTTLDQISTLTQPRHPDDWTEIDSAAVDTIRVLATDAVQKAGNGHPGTAMSLAPLAYTLFQRTLRHDPNDTAWLGRDRFVLSAGHSSLTLYIQLYLGGFGLELSDIESLRTWGSTTPGHPEFRHTKGVEITTGPLGQGLASAVGMAMASRYERGLFDPDAEPGASPFDHYIYVIASDGDIEEGVTSEASSLAAVQQLGNLIVFYDHNQISIEGDTKITLCEDTAARYRAYGWHVQEVEGGENVVGIEEAIANAKAATDRPSFISLRTIIGYPAPTLINTGKAHGAALGEDEVAATKRILGFDPDKTFAVREDVITHTRGLIARGKEAHERWQLEFEAWAQREPERKALLDRLLAQQLPDGWDADLPNWEPRSKELATRAASGAVLSAIGPKLPELWGGSADLAGSNNTTIKDVDSFGPPSISTDEYTAHWYGRTLHFGVREHAMGAILSGIVLHGPTRAYGGTFLQFSDYMRPSVRLASLMDIDTIYVWTHDSVGLGEDGPTHQPIEHLAALRAIPRLSVVRPADANETAYAWRTILARGANSGPVGLILTRQSVPVLEGTNTEGVARGGYVLGDGGSSEAKEPDVILIATGSEVQLAVAAQKLLADKDIIVRVVSMPCVEWFESQPYEYRDSVLPPSVSARVAVEAGVAQCWHKLVGDTGKIVSIEHYGESADYQTLFREYGFTPEAVVAAAEQVLDN

SEQ ID NO: 35217 - protein, 208 aa, Aspergillus oryzae
MSSPQTHQPIVHTNTNSRRRGSPAARRSVSIPTNANTGFGPPHDRKLTQILFSMSIASPINLLLLSLFAVLVYMQFRPKAPVTLPKGPAPIVFRTFTPTTLLEFNGVDGKPVYLAVRGRVFDVSPGRNFYGPGGPYENFAGRDASRGLACQSFDEEMLTKDLKAPLDDLKDLDAEALENLQSWEERFLEKYLVVGKLVAEGDPEAPKA

SEQ ID NO: 35218 - protein, 538 aa, Candida albicans SC5314
MSPSLVHQILAITHPYVEYLEENITKWYILVPGILIVLNVLTTLHTKYLEYKFNAKPVTNFIQDYTFGVITPLILIYYKSQGTVMEFANNFWNFKFLIKNPDVGTGELRIFGMHLIETKDPENIKAVLATQFNDFSLGTRHGFLYSLLGDGIFTLDGAGWKHSRSMLRPQFAREQIAHVKILEPHMQVFFKHIRKNKGKTFDIQELFFRLTVDSSTEFLFGSSVESLRDETIGMSPSVKNLAGRDEFADAFNYSQTINAYRFLLQQFYWLCNGTKFRKSIAAVHKFSDFYVQKALSLSQDELDEQKGYVFLYELAKQTRDPKVLRDQLLNILVAGRDTTAGLLSFVFFELARNPEVYAKLKEEIYNKFGSGEDARIDEITFESLKQCEYLKAVINESLRLYPSVPHNFRTATRNTTLPRGGGPDGMSPIVVKKGQSVMYTVLVTHRDTKTYGADANEFRPERWFEPETRKLGWAYVPFNGGPRICLGQQFALTEASYVTVRLLQEFEHLTMDAETRYPPKLMNSLTLSLLDGANVEMY

SEQ ID NO: 35219 - protein, 248 aa, Zea mays
THEREHEHEHEHHNAAAMVGGGGGGDPRPEDEPFSDGDATESDTDESPPQGISARRPGATTNPILTRLAVSRNPSPLAAATAAPGVCLLRFAWESAAGSLVGAVVGYGKGLVMRKGFKGSFPDAASSAKIFAVLAGVQSLVACSLRKLRGKDDGINAGVAGCCTGLALSFPGAPQTLIQSCLTFGTFSYIIETLNKQQPALALPLATEIKDQKAGQSVLPPFTLPLPQDAMDGFSKFQNFLSSKFQGK

SEQ ID NO: 35220 - protein, 522 aa, Candida albicans SC5314
MSVSDIVQEYITKWYVVIPTLFVVYQVVDFFYVRSLRSRLGAKAPTNNESDGYWGFHLPFLLVSKKAEGTIIDFAGERFKSIAHPEVPTFQFPIFTVKVISTVDPENIKAVLATQFNDFSLGTRHNQFAPLLGDGIFTLDGAGWKHSRSMLRPQFAREQVAHVKALEPHMQVLFKHIRKSGGRTFDLQELFFRFTVDSATEFLFGESVESLRDESIGMALEAVDFDGKKEFAEAFNFSQNYLASRAVMQQMYWLLNSSEFKSCNSKVHKFAEYYVNKALELSHEELEKQQGYVFLYELAKQTRDTKVLRDQLLNILVAGRDTTAGLLSFVFFELARNPRVFAKLREEVEEKFGVGEDARVEEISFESLKSCEYLKAVLNECLRLYPSVPQNFRVATKNTTLPRGGGSDGMSPILVRKGQTVMYSVYVTHRDTKVYGKDADEFRPERWFEPETRKLGWSFVPFNGGPRICLGQQFALTEASYVTVRLLQEFGHLTMDPNTDYPPKKMSHLTMSLYDGTNVEMY

SEQ ID NO: 35221 - protein, 87 aa, Guaduella marantifolia
KPSMVVHQPRVEVGGTDMRTFYTLVMVDPDAPSPSDPNLREYLHWLVTDIPGTTGAAFGQEVMCYESPRPTMGIHRFVFVLFQQLGR

SEQ ID NO: 35222 - protein, 502 aa, Solanum tuberosum
MQFLSLASIFLFLSFLFLLRKWKNSNSQSKKLPPGPWKLPLLGSMLHMAGGLPHHVLRDLAKKYGPLMHLQLGEVSAVVVTSPDMAKEVLKTHDIAFASRPKLLAPEIVCYNRSDIAFCPYGDYWRQMRKICVLELLSAKNVRSYGSIRRDEVDRLVNFIRSSSGEPVNFTERLFLFTSSMTCRSAFGKVFKEQDKFIQLIKEVIGLAGGFDVADIFPSLKFLHVLSGMKGKIMNAHHKVDAIVEDVINEHKKKFAIGKTNGALGGEDLIDVLIRLMNDGGLQFPITNDNIKAIIFDMFAAGTETSSSTLVWAMVQMMKNPSVIAKAQAEVREAFKDKETFDENDVEELKYLKLVIKETLRLHPPVPLLVPRECREETDINGYTIPVKTKVMVNVWALGRDPKYWDDAESFKPERFEQRSVDFVGNNFEYLPFGGGRRICPGISFGLANVYLPLAHLLYHFDWKLPIGMEPKDLNLTELVGVTAARKDDLILVATPYEPPRQ

SEQ ID NO: 35223 - protein, 345 aa, Arabidopsis thaliana
MTATNKQVILKDYVSGFPTESDFDFTTTTVELRVPEGTNSVLVKNLYLSCDPYMRIRMGKPDPSTAALAQAYTPGQPIQGYGVSRIIESGHPDYKKGDLLWGIVAWEEYSVITPMTHAHFKIQHTDVPLSYYTGLLGMPGMTAYAGFYEVCSPKEGETVYVSAASGAVGQLVGQLAKMMGCYVVGSAGSKEKVDLLKTKFGFDDAFNYKEESDLTAALKRCFPNGIDIYFENVGGKMLDAVLVNMNMHGRIAVCGMISQYNLENQEGVHNLSNIIYKRIRIQGFVVSDFYDKYSKFLEFVLPHIREGKITYVEDVADGLEKAPEALVGLFHGKNVGKQVVVVARE

SEQ ID NO: 35224 - protein, 154 aa, Oryza sativa (japonica cultivar-group)
MATSSSPLTALYSSFLSYTPSTPSMAALPRRRRAGCRYPRIQAVDLDQNTIVAISVGVVSVAIGIGIPVFYETQIDNAAKRDNTQPCFPCSGSGAQVCRFCTGKGTVTVVIGGGETEVSNCVNCDGVGSLTCTTCQGSGIQPRYLDRREFKDDD

SEQ ID NO: 35225 - protein, 503 aa, Thermus thermophilus HB8
MVLVLDFGSQYTRLIARRLRELRAFSLILPGDAPLEEVLKHRPQALILSGGPRSVFDPDAPRPDPRLFSSGLPLLGICYGMQLLAQELGGRVERAGRAEYGKALLTRHEGPLFRGLEGEVQVWMSHQDAVTAPPPGWRVVAETEENPVAAIASPDGRAYGVQFHPEVAHTPKGMQILENFLELAGVKRDWTPEHVLEELLREVRERAGKDRVLLAVSGGVDSSTLALLLAKAGVDHLAVFVDHGLLRLGEREEVEGALRALGVNLLVVDAKERFLKALKGVEDPEEKRKIIGREFVAAFSQVARERGPFRFLAQGTLYPDVIESAGGHGAAKIKSHHNVGGLPEDLEFELLEPFRLLFKDEVRELALLLGLPDTLRLRHPFPGPGLAVRVLGEVTEERLEILRRADDIFTSLLREWGLYEKVAQALAVLTPVRSVGVAGDERKYGYVLALRAVTTEDFMTADWARLPLEFLDEAARRITRRVPEIGRVVYDLTSKPPATIEWE

SEQ ID NO: 35226 - protein, 170 aa, Fusarium oxysporum f. sp. lycopersici
MSESTSTQKVWLASNDSATIEVDRVVAERSMLIKNMLEDIGDEGINAENPIPIPNVNEAVLRKVIEWCDHHRNDPLQAQDDDSDARKKTTDIEEWDQKFMQVDQEMLFEIILASNYLDIKPLLDVGCKTVANMIKGKSPEEIRKTFNITNDFTPEEEEQIRRENEWAEDR

SEQ ID NO: 35227 - protein, 451 aa, Alnus glutinosa
MTSLQYFSLNRPVFPATHLHRPGIRHLQVSACANVEVQAPSSVKKQGVSKEVMEAAGRVLVGTYARVPVVLSRGKGCKLYDPEGREYLDLSAGIAVNVLGHADSDWLRAVTEQAATLTHVSNVFYSIPQVELAKRLVASSFADRVFFSNSGTEANEAAIKFARKFQRFTRPDEKQPATEFVSFSNSFHGRTMGSLALTSKENYRSPFEPVMPGVTFLEYGNIEAATQLIQRRKIAAVFVEPIQGEGGVYSATKEFLYALRKACDDSGTLLVFDEVQCGLGRTGYLWAHEIYDVFPDIMTLAKPLAGGLPIGAVLVTERVASAITYGDHGTTFAGGPLVCKAALTVLDKILRPGFLASVSKKGHYFKEMLINKLGGNSHVREVRGVGLIVGIELDVSASPLVNACLNSGLLVLTAGKGNVVRIVPPLIITEQELEKAAEILLQCLPALDRHG

SEQ ID NO: 35228 - protein, 590 aa, Asparagus officinalis
MCGILAVLGCSDDSQAKRVRVLELSRRLKHRGPDWSGLCQHGDCFLSHQRLAIIDPASGDQPLYNEDKSIVVTVNGEIYNHEELRRRLPDHKYRTGSDCEVIAHLYEEHGEDFVDMLDGMFSFVLLDTRNNCFVAARDAVGITPLYIGWGLDGSVWLSSEMKGLNDDCEHFEVFPPGNLYSSRSGSFRRWYNPQWYNETIPSAPYDPLVLRKAFEDAVIKRLMTDVPFGVLLSGGLDSSLVAAVTARHLAGSKAAEQWGTQLHSFCVGLEGSPDLKAAKEVAEYLGTVHHEFHFTVQDGIDAIEDVIFHIETYDVTTIRASTPMFLMARKIKSLGVKMVISGEGSDEIFGGYLYFHKAPNKEEFHHETCRKIKALHQYDCLRANKATSAWGLEARVPFLDKEFMDVAMSIDPESKMIKPDLGRIEKWVLRKAFDDEENPYLPKHILYRQKEQFSDGVGYSWIDGLKAHAAKHVTDRMMLNAARIYPHNTPTTKEAYYYRMIFERFFPQNSARFTVPGGPSIACSTAKAIEWDARWSNNLDPSGRAALGVHDSAYDPPLPSSISAGKGAAMITNKKPRIVDVATPGVVIST

SEQ ID NO: 35229 - protein, 432 aa, Ashbya gossypii ATCC 10895
MSFLSRMLKLGKATATVGECEYTKWSKEQLIERLLLLEGEGKRSADTSVASEDPKRKKTNENAKKVKTKTPKEFDFSKYNTRFIALKFAYLGWNYNGLAIQKDPTPLPTVEGTILEAMNKCRMVPSMVPQDYKFSRCGRTDKGVSAMNQVISLRVRSNLTPQEQEDPANDAREIPYIHILNQLLPDDIRISAICLRPPKGFDARFSCKYRHYKYLFNKSGLDLSKMEKAARLYEGEHDFRNFCKLDGSKQITNFKRTILSAKILHVDGDMYCFDLLGSAFLWHQVRCMMANLFIGGQGLEPLTLINNLLDVEKNPQKPVYDMASDIPLILYDCKFDDMEWQLPDLSAEKAFKTTRSVDGIYLDYQLKAAVSTIFKNTLPRADKNEKITINVGDGKGKVVNVYQKLFDRQFSESVEAVNAKYKERKRKNTKGQ

SEQ ID NO: 35230 - protein, 482 aa, Ashbya gossypii ATCC 10895
MPPFRPMKLCRSITRSSTARPRSLKEAVEQAIPLRRHELKELKAYSNMQIDSITVGSIIGGMRNNKSMLWQGTTLDPFNGIKFQGKTIQECQQLLPCSPDKQSKKTEFMPESMLWLLMTGEIPKKEEAFGLMHELSQRGKTLPPFVEHIIDSLPRTMHPMTQLAVALASLNSSSTFCKNYQDGVIGKEDYWHYIFEDALNLIALLPQLVGKIYSNVTNEGMPLGYFNPDRDWSYNIASLLGMTYRDSVNKRNLTKEQCDDFTDLVRLYCGIHVDHEGGNVSAHATHLVGSALSDPYLSYSAGVMGLAGPLHGLAAQEVVRFLVDMAARIDSPDNESQVSEYLWALLNSGKVVPGYGHAVLRKPDPRFDAMLRFVEARPQEFQGDRYVQLMRNLSKYAPKVLTEHGKTKNPFPNVDSASGVLFYHYGIHDLLFVTVIFACSRAIGPLTQLVWDRILGLPIERPKSVDMATLRRLVNQNLRNAK

SEQ ID NO: 35231 - protein, 468 aa, Sinorhizobium meliloti 1021
MAYDLIVIGSGPGGYVCAIKAAQLGMKVAVVEKRSTYGGTCLNVGCIPSKALLHASEMFHQAQHGLEALGVEVANPKLNLQKMMAHKDATVKSNVDGVSFLFKKNKIDGFQGTGKVLGQGKVSVTNEKGEEQVLEAKNVVIATGSDVAGIPGVEVAFDEKTIVSSTGALALEKVPASMIVVGGGVIGLELGSVWARLGAKVTVVEFLDTILGGMDGEVAKQLQRMLTKQGIDFKLGAKVTGAVKSGDGAKVTFEPVKGGEATTLDAEVVLIATGRKPSTDGLGLAKAGVVLDSRGRVEIDRHFQTSIAGVYAIGDVVRGPMLAHKAEDEGVAVAEIIAGQAGHVNYDVIPGVVYTQPEVASVGKTEEELKAAGVAYKIGKFPFTANGRARAMLQTDGFVKILADKETDRVLGGHIIGFGAGEMIHEIAVLMEFGGSSEDLGRTCHAHPTMSEAVKEAALSTFFKPIHM

SEQ ID NO: 35232 - protein, 206 aa, Solanum tuberosum
MISTVRFLLCSLAVIGTLALAQAKSQENLKEVTHKVYFDVEIDGKPAGRVVMGLFGKTVPNTAENFRALCTGEKGVGKSGKPLHFKGSKFHRIIPSFMIQGGDFTLGDGRGGESIYGEKFADENFKIKHTGPGLLSMANAGSDTNGSQFFITTVTTTWLDGRHVVFGKVLSGMDVVYKMEAEGRQSGTPKAQLPLQTAVNFLCNRF

SEQ ID NO: 35233 - protein, 308 aa, Oryza sativa (japonica cultivar-group)
MDVRRGGGGGRIVGAARRALTWGALPLPMRITNGLAMVSLVLSSCDLLRLCSDRERPLGGREFATVVYLVSLFAHPDAPATTTGDDDDGQGGSRRARPAAAEPAPMHGHGGGMMEADDEEIVAAVASGALPSHRLESRLGDCRRAARLRREALRRVTGRGVEGLPFDGMDYQAILGQCCEMPVGYVQLPVGVAGPLLLDGREYHVPMATTEGCLVASVNRGCRAISASGGAFSVLLRDAMSRAPAVKLPSAMRAAELKAFAEAPANFELLAAVFNSCSWQLEPSTQYRRNSMGCIYGQVSWFHGYLFA

SEQ ID NO: 35234 - protein, 166 aa, Legionella pneumophila subsp. pneumophila str. Philadelphia 1
MKKVYHYIIHYVRTYLLLELLAGLWLTVKYFFRKKITVQFPEEQTPLSPRFRGLLALRRYPNGEERCIACKLCEAVCPALAITIESEQRDDGSRRTTRYDIDMFKCINCGLCEESCPVDSIVVTPIHHYHISERGQNIMTKEKLLAVGDLMESQLAADRAADEKYR

SEQ ID NO: 35235 - protein, 412 aa, Oryza sativa
MASPMLSAATVPLQVSLGGGLSEFSGLRSSSSLPLRRNATSDDFMNAVSFRTHAVVLRRAQVGTSGGARRAPTEAKLKVAINGFGRIGRNFLRCWHGRGDSSPLDVIAINDTGGVKQASHLLKYDSTLGIFDADVKPVGDNAISVDGKVIKVVSDRNPSNLPWGELGIDLVIEGTGVFVDRDGAGKHIQAGAKKVLITAPGKGDIPTYVVGVNADQYSPDEPIISNASCTTNCLAPFVKILDQKFGIIKGTMTTTHSYTGDQRLLDASHRDLRRARAAALNIVPTSTGAAKAVALVLPNLKGKLNGIALRVPTPNVSVVDLVVQVSKKTLAEEVNQAFRDSAANELKGILEVCDVPLVSVDFRCSDVSCTIDASLSMVMGDDMVKVIAWYDNEWGYSQRVVDLADIVANQWK

SEQ ID NO: 35236 - protein, 417 aa, Sinorhizobium meliloti 1021
MATEIRVPTLGESVSEATVGTWFKKVGDAIKADEPILELETDKVTIEVPAPAAGTLSEIVAQAGETVGLGALLGQIAEGAGAAAAAPAAAEKKPEPAAATAAPAAAAQPAAAAATQTSTSMPPAPAAAKLIAENNLSADQIDGSGKRGQVLKGDVLAAVAKGISAPAAAEPAKVQARAPAPAEDAAREERVKMTRLRQTIARRLKDAQNTAAMLTTYNEVDMSAVMSLRSKYKDIFEKKHGVKLGFMGFFTKAVTHALKELPAVNAEVDGTEIIYKNFCHVGVAVGTDKGLVVPVVRDADQMSIAEIEKEIGRLGKAARDGTLSMADMQGGTFTISNGGVYGSLMSSPILNAPQSGILGMHKIQDRPVAIGGQVVIRPMMYLALSYDHRIVDGKEAVTFLVRVKESLEDPERLVLDL

SEQ ID NO: 35237 - protein, 282 aa, Pseudomonas fluorescens Pf-5
MSSFQGIWVPIVTPFIDGAVDFAALGRLTTHLLESGVAGLVVCGTTGEAAALDKDEQLAVLDAVLERAPAGKVIMGLAGNNLKSLLSLQEQILERAVAALLVPAPYYIRPSQAALESFFATVADASSVPLIVYDIPYRTGVSLDTATLLNIVAHPRIAAVKDCGGNLEKTLALLACGQIEVLCGEDLQLFNALCLGAHGAIAASAHIHPQRFVALLQQVRAQQLDAARSTFMQLVPLIKALFAEPNPAPVKALLAHQGLIGTQLRAPMHDCSAALQTLLRTL

SEQ ID NO: 35238 - protein, 670 aa, Nostoc sp. PCC 7120
MAVATQSLEELSINAIRFLAVDAIEKAKSGHPGLPMGAAPMAFVLWNRFMRYNPKNPKWFNRDRFVLSAGHGSMLQYALLYLTGYDSVSIEDIKQFRQWESKTPGHPENFMTAGVEVTTGPLGQGIANGVGLAIAEAHLAAKFNKPDAKIVDHYTYVILGDGCNMEGVSGEAASFAGHLGLGKLIALYDDNHISIDGSTDVAFTEDVSKRFESYGWHVIHVKDGNTDLEAIHKAIEEAKAVTDKPTMIKVTTIIGYGSPNKSNTAGVHGAALGGDEVALTRQNLGWSHDPFVVPEDVLNYTRKAVERGAGYESDWNKTYADYKAKYPQEAAEFERYLSGKLADGWDKVLPSYTPEDKGLPTRKHSETCLNKLAAVLPELIGGSADLTHSNLTEIKGKGDFQKGQYQNPNIHFGVREHGMGAICNGIALHGSGLIPYGATFLIFSDYMRAPIRLSALSQAGSIWVMTHDSIGQGEDGPTHQPIETLASLRAIPNLTVIRPADGNETSGAYKVAIERAKNNAPTLLAFTRQNVPNLAGTSIDDVAKGGYIVVDTDGTPDLILIGTGSELSLCVTAAEKLKAEGKKVRVVSLAAWDLFDAQDAAYKESVLPKAVTKRLAVEAASSFGWHKYIGSEGDAVTIDRFGASAPGGVCLEKFGFSVDNVLAKAKQLLG

SEQ ID NO: 35239 - protein, 250 aa, Flavobacterium psychrophilum
MRAKIVAGNWKMNKNSEETEDLINELIDKLPTNSNAKIIIAPTFINLASAVDHTEFTNIRVAAQNMHQAENGAYTGEISADMLKSIGVNTVILGHSERRAIFHETDAIISFKVDTALRHEMTVIFCFGEELKDRQNKQHFNIVENQLRDGLFHIDKSAWANIILAYEPVWAIGTGETASPEQAQEMHEFIRETVRKVFGSDIAEDVSILYGGSVKPDNAKEIFSKPDVDGGLIGGAALKADDFVVIVNGI

SEQ ID NO: 35240 - protein, 257 aa, Oryza sativa (indica cultivar-group)
MALANKIGNLLKRATSSSPALYQSIRCMSSSKLFVGGLSYGTDEQSLRDTFANYGQVIEAKIINDRETGRSRGFGFITYASSEEASAAITALDGKDLDGRNIRVNTANERTGGFRSGGGGYGGGGYGGGGGGYGGGGYSVGGGYVVGGYSGGVVVVGGYRGGVGGYGVNNGGYGNRGGGGGGYGVAEGSADAFSGINLGGDGSFGGNPAGSFGDAGGSTGGDFSSAGGDSFGSRKNDELMDDLFKDDEPDNYANKQG

SEQ ID NO: 35241 - protein, 409 aa, Oryza sativa (indica cultivar-group)
MAGRKENPVLTACQAPSGRITRAQAAANRGRFGFAPSVSLPARTERKQTAKGKTKRGALDEITSASTATSAPQPKRRTVLKDVTNIGCANSSKNCTTTSKLQQKSKPTQRVKQIPSKKQCAKKVPKLPPPAVAGTSFVIDSKSSEETQKVELLAKAEEPTNLFENEGLLSLQNIERNRDSNCHEAFFEARNVMDKHELADSKPGDSSGLGFIDIDNDNGNPQMCASYASEIYTNLMASEVSEEYKLVPDTLYLTINLIDRFLSQHYIERQKLQLLGITSMLIASKYEEICAPRAEEFCFITDNTYTKAEVLKMEGLVLNDLGFHLSVPTTKTFLRRFLRAAQASRNNHTLEHYTSYKSSDIQICVCALRELQHNTSNCPLNAIREKYRQQKFECVANLTSPELGQSLFS

SEQ ID NO: 35242 - protein, 522 aa, Streptomyces coelicolor A3(2)
MFRSEYADVPPVDLPIHDAVLGGAAAFGSTPALIDGTDGTTLTYEQVDRFHRRVAAALAETGVRKGDVLALHSPNTVAFPLAFYAATRAGASVTTVHPLATAEEFAKQLKDSAARWIVTVSPLLSTARRAAELAGGVQEILVCDSAPGHRSLVDMLASTAPEPSVAIDPAEDVAALPYSSGTTGTPKGVMLTHRQIATNLAQLEPSMPSAPGDRVLAVLPFFHIYGLTALMNAPLRLGATVVVLPRFDLEQFLAAIQNHRITSLYVAPPIVLALAKHPLVADYDLSSLRYIVSAAAPLDARLAAACSQRLGLPPVGQAYGMTELSPGTHVVPLDAMADAPPGTVGRLIAGTEMRIVSLTDPGTDLPAGESGEILIRGPQIMKGYLGRPDATAAMIDEEGWLHTGDVGHVDADGWLFVVDRVKELIKYKGFQVAPAELEAHLLTHPGVADAAVVGAYDDDGNEVPHAFVVRQPAAPGLAESEIMMYVAERVAPYKRVRRVTFVDAVPRAASGKILRRQLREPR

SEQ ID NO: 35243 - protein, 87 aa, Sasa kurilensis
KPSMVLHQPRVEVGGNDMRTFYTLVMVDPDAPSPSEPNLREYLHWLVTDIPGTTGAAFGQEVMCYESPRPTMGIHRFVFVLFQQLAG

SEQ ID NO: 35244 - protein, 412 aa, Ralstonia metallidurans CH34
MVVPHCIPRFLDGEHSLFDSILDWAANGLANWSWWEIVIYTLVMTHITIAGVTIFLHRCMAHRSLDLHPIAQHFFRFWLWMTTGMVTKEWTAIHRKHHAKCETEDDPHSPQTRGIRKVLLEGAELYRAEAKNKETITKFGHGTPDDWIERNLYSRFSWQGVALMLIIDLALFGLVGMSVWAVQMLWIPIHAAGIINGLGHYWGYRNYDCEDASTNVSPWGFIIGGEELHNNHHTYPTSAKFSIKWYEIDVGWWYIRAMQSVGLAKVKKIPPKARLVEARPVDHNTLEAIIANRYDVMARYAKTLKSAYKDELRKHKEGNTPEYSSFKPARKWFHREETKLAAPQRQQLATIVEQNKMLSTFVEMRRELAVIWGRSNLTREQLLAQLQAWCHRAEASGIQALQEFSLRLRRYA

SEQ ID NO: 35245 - protein, 501 aa, Amaranthus hypochondriacus
MAIRVPSRQLFIDGEWREPIKKNRIPIINPSTEEIIGDIPAATAEDVELAVAAARRALKRNKGEDWASASGAHRAKYLRAIAAKITEKKDYFAKLEAMDCGKPLDEAARDIDDVAGCFEYYADQAEALDAKQKAPIALPMDTFKCHVLKQPIGVVGLISPWNYPLLMATWKVAPALAAGCSAVLKPSELASVTCLELAEVCREVGLPPGVLNILTGLGPEAGGPLACHPDVDKVAFTGSTATGSKVMSSAAQLVKPVTLELGGKSPIVIFEDVDLDKAAEWTAFGCFWTNGQICSATSRLLVHESIAAEFLDRLVKWCKNIKISDPFEEGCRLGPVVSKSQYEKVLKFISTAKSEGATILCGGSRPEHLKKGYYVEPTIISDVSTSMQIWREEVFGPVLCQKTFGSEDEAIELANDTQYGLGAAVLSKDLDRCERITKALEVGAVWVNCSQPCFTQAPWGGTKRSGFGRELGEWGIENYLNIKQVTRDTSTDEPWGWYKSP

SEQ ID NO: 35246 - protein, 466 aa, Ralstonia metallidurans CH34
MSRNPATSQDNRQRSRPSKGKASPIRKSPNARQQGADGAPRTPGGLQAFHLQHIDRLLGKVLLFARPSDAVVSHYFRENSKLGHRDRGIIAEAIFAVLRRRVEFGQFAESGTGSATRRLGLLGLAATLGRDVLSPFLHPDEAVWLDRLTTIERSSLAPRVRANLPEWLYDDLVARHGEAFTAALGDAWLRPAPLDLRVNTAKLSREEALAELQTAGIAAELAPMAPAGIRLKGKPALNQLPLFINGGVEVQDEGSQLLCHLLAPRRGEMVVDFCAGAGGKTLALGVAMRSTGRLYAFDVSEKRLANLKPRLARSGLSNVHPVLIDSERDAKVKRLAGKIDRVLVDAPCSGLGTLRRNPDLKWRQTPESVVELTAKQAAILDAAAKLVKGGGRVVYATCSVLEAENEAIIRDFLASHENFRLVPVSEVLAEQKIEVPELPAEGGMLALYPHIHQTDGFFAAVLERTR

SEQ ID NO: 35247 - protein, 557 aa, Magnaporthe grisea 70-15
MPFNSPYEPIQVPETDIWNLCFSRRSKAFLDGKTVYTDGATGDRLDWGGLRSASIEFGKGLKALWGWRRGEVMAFFAPNGIDTPVVTMGLLWAGGVASPANPLYTADELAFQLRDSGARALVTQVQHLDVAVRAAAAAGIADDRIILVGAHMSDGAGGSRFKHYSSIRSTFYCSKYAQTLVEPRKDLAFLVYSSGTTGLPKGVCLSHYNMVANLMQVAQTEGHYLQPVGGLDGQGDRMLGVTPFFHVYGLLSCVLSSAYFGWELVIMSRFDMEQACALIEKHRITYIYVPPPIVLAFAKSPICDRYDLSSLKMLHSGAAPLTRELTEELWNRLKLPVKQGYGLSETSPVVSVQAPDEWAKFMGSVGKLVPNMTAKLVAADGQEVPEGDEMAEGELWVKGPQLFLGYLNNPDKTRETMSEDGYFKTGDVFRKDRFGNLYCVDRLKELIKYKGFQVAPAELEGLLLGHPEVADVGVVGVQDDELASEVPRAYVVLKDQRAGGEAKAREIVDWMASRVAPHKKLRGGVVLVDAIPKSPSGKILRRVLRDVAKKERRGAKL

SEQ ID NO: 35248 - protein, 283 aa, Xanthomonas oryzae pv. oryzae
MPVSRYAVFGHPVAHSLSPAIHADFGKQTGIVLDYTAIDAPPEDFSAALQRFADGGGKGANVTLPLKEAACALASSLSDRARLAGAVNTLVRHEGQWQGENTDGIGLVRDLTDRHGLDLRGRRVLLLGAGGAARGVAPALLQAGITEMVVVNRSPERADALCDTLGEPGRVVSRYIEDLRDLGDFELIVNATAAGRDRDAGAFAMPLGLVNSLTAAVDLNYGATAIAFLAWARSAQCRYAIDGLGMLVEHAAESFALWHGVRPDTDPVYAALRAREAVLVSAD

SEQ ID NO: 35249 - protein, 415 aa, Triticum aestivum
MGGGGAAGDADGWADQDQGNGGSRGGGEAKRSEIYTYEAGWHIYGMNWSVRRDKKYRLAIASLLEQLVNRVEVVQLDESTGDIAPVLSFDHPFPPTKSMFVPDPQGLRPDLLATSADLLRIWRITDDDAAAPGAADSNNGSVRCNGVGSPAGQQPGVKLCCELNGNRNSDFCGPLTSFDWNDADPRRIGTSSIDTTCTIWDVEREVVDTQLIAHDKEVYDIAWGGAGVFASVSADGSVRVFDLRDKEHSTIIYESSSGGGSNSAATDGGAVLPTPLVRLGWNKQDPRYMATIIMDSPKVVVLDIRYPTLPVVELHRHHAPVNAIAWAPHSSCHICTAGDDSQALIWDLSSMGTGNNSGGNGNGNGNAAAAAAAEGGLDPILAYTAGAEVEQLQWSATQPDWVAIVFANKLQILRV

SEQ ID NO: 35250 - protein, 318 aa, Idiomarina baltica OS145
MTRDLVSGGQQIKAPDDLNRLLKEIHQQAMQIQSGNVADYIPALAAVEPEQCALTLTTLDGEVFNVGDTDTLFSIQSISKIFGLMMAMDRLGDDLWQRVKMEPSGQAFNSIVQLEWEKGIPRNPMINAGAILISDVLVSHYSTSKNAVMSLVRSLCGNDRIYADESVHASEKEHGHRNAASAHLMKSFDNIESDVDEVLDHYFWQCAISMSCENLARSFTFLANAGVCPFSQREIITKRDAQRINALLSTSGMYDQSGEFAFTVGVPAKSGVGGGIVAIVPDFGVISAWSPKLNEFGNSARGMFMVRELANRLGLSVY

SEQ ID NO: 35251 - protein, 485 aa, Campylobacter jejuni subsp. jejuni NCTC 11168
MKIVKRALTFEDVLLRPGYSEVLPKEVKIHTKLTKNITLNMPLISAAMDTVTEHRAAIMMARLGGLGVIHKNMDIASQVREVKRVKKSESGVIIDPIFVSPKASVAEALEIMAEYRISGVPVVDEDKKLIGILTNRDLRFESDFSNLVENVMTKMPLITAPKGCTLDDAEKIFSTNKVEKLPIVDEQGRLEGLITIKDLKKRKEYPDANKDNFGRLRVGAAIGVGQMDRVDALVEAGVDVVVLDSAHGHSKGIIDTVKAIKAKYPNLDLIAGNIATAAAAKALCEAGVDAVKVGIGPGSICTTRIVSGVGVPQISAIDECVEEANKFGVPVIADGGIKYSGDIAKALAVGASSVMIGSLLAGTDESPGELFTYQGRQYKSYRGMGSLGAMQKGSSDRYFQQGTAQDKLVPEGIEGRVPYVGSIRSVVHQLLGGLRSSMGYVGAKDIEDFQKRAEFVEITTAGLKESHVHDVTITHEAPNYKVNHQ

SEQ ID NO: 35252 - protein, 403 aa, Synechococcus sp. CC9311
MCLFSEVCSELLFLCCHAEPQSDDADGFDFPSLMIRSRAAVAWAPGEPLDVTEIDVAPPRSGEVLLRVVATGVCHTDAYTLSGSDPEGLFPVVLGHEGGAVVEEIGEGVTSVSVGDHVIPLYTPECGRCRFCLSGKTNLCQAIRSTQGRGLMPDGSSRFSRDLTMIHHYMGTSTFSEYTVLPEIAVAKINADAPLEKVCLLGCGVTTGIGAVHNTAKVEPGSSVAVFGLGGIGLAVIIGAVQARAERIIGIDLNPAKFAIAQQLGATECINPRDHATPIQEVLIELTDGGVDYSFECIGNVDVMRAALESCHKGWGESTIIGVAGAGQEISTRPFQLVTGRVWRGSAFGGVRGRSQLPGYVERYQAGEIPLDSFITHTMELNDINRAFELMHAGESIRTVVHF

SEQ ID NO: 35253 - protein, 314 aa, Shigella flexneri 2a str. 2457T
MDIPNMQNAGSLVVLGSINADHILNLQSFPTPGETVTGNHYQVAFGGKGANQAVAAGRSGANIAFIACTGDDSIGESVRQQLATDNIDITPVSVIKGESTGVALIFVNGEGENVIGIHAGANAALSPSLVEAQRERIANASALLMQLESPLESVMAAAKIAHQNKTIVALNPAPARELPDELLALVDIITPNETEAEKLTGIRVENDEDAAKAAQVLHEKGIRTVLITLGSRGVWASVNGEGQRVPGFRVQAVDTIAAGDTFNGALITALLEEKPLPEAIRFAHAAAAIAVTRKGAQPSVPWREEIDAFLDRQR

SEQ ID NO: 35254 - protein, 646 aa, Mycobacterium leprae TN
MSWSLRVDKPDTGESPFKHSLVTGAQEIPISSFADKTFTAPAQIRNFCIIAHIDHGKSTLADRMLQLTGVVDERSMRAQYLDRMDIERERGITIKAQNVRLSWSVTAGGTTENYVLHLIDTPGHVDFTYEVSRALEACEGAVLLVDAVQGIEAQTLANLYLALERDLTIIPVLNKIDLPAADPDRYAAEIAHIIGYESGDVLRVSGKTGEGVSDLLDEVVRRVPHPQGDPDAPTRAMIFDSVYDIYRGVVTYVRVVDGKISPRERIAMMSTGATYELLEVGIVSPEPKASAGLGVGEVGYLITGVKDVRQSKVGDTVTTVRYGATEPLTGYREPKPMVYSGLYPVDSSDYPSLRDALGKLQLNDAALTYEPETSVALGVGYRCGFLGLLHIDITRERLEREFDLDLISTSPNVVYRVVTEDNTEIVVTNPSDWPEGKIRTVYEPVVKITIIAPSEFIGTIMELCQSRRGELGGMDYLSPERVELRYIMPLGEIIFDFFDSLKSRTRGYASLDYEEAGEQEAQLVKVDILLQGEAVDAFSAIVHKDSASAYGNKMTNKLKELIPRQQFEVPVQAAIGSKVIARENIRAIRKDVLSKCYGGDITRKRKLLEKQKEGKKRMKTIGRVEVPQEAFVAALSADAAGDKDKK

SEQ ID NO: 35255 - protein, 422 aa, Legionella pneumophila subsp. pneumophila str. Philadelphia 1
MKVAKMIELKNYTLNFGPQHPAAHGVLRLVLELEGETIVRADPHIGLLHRATEKLAETKPYIQSIGYMDRLDYVSMMCNEHAYVMAIEKLLGIEPPLRAKYIRTMFDEVTRILNHLLWLGATALDIGAMTVFLYCFREREDLFDCYEAVSGARMHATYYRPGGVARDLPDTMPQYKPSRWHSEREIEKKNHNRQGSLLDFLWDFTERFPHCVDEYETLLTDNRIWKQRTVDIGVVSPENALQWGFTGPMLRGSGIAWDLRKKQSYAAYDRVEFDIPVGKTGDCYDRYLVRVEELRQSNRIIRQCIEWLRKHPGPVKVDDYKVSPPRRVVMKHDMEALIHHFKLFTEGFCLPRGEVYSSVEAPKGEFGIYMVSDGANKPYRLKIRAPGFAHLSSFDDMVRGHMLADGVAILASQDIVFGEIDR

SEQ ID NO: 35256 - protein, 227 aa, Legionella pneumophila subsp. pneumophila str. Philadelphia 1
MTKNEYLIEKLQADLANHITELTSAYGEVTIECEVQNLLPVMIELRDREEFSFDQLIDLCGVDYLHYGDYDWETESATEHGFSRGVERQEAKAYAVNKPRFAVVYHLLSTKKNHRLRVKLFVEESHLIVPSVHHLWKSANWFEREAYDLYGILFDGHPDLRRLLTDYGFIGHPFRKDFPLSGEVEMRYDAKLQKVIYAPVDIVPRIVVPKVIRNDNRYIGNEGSKND

SEQ ID NO: 35257 - protein, 455 aa, Francisella tularensis subsp. holarctica
MDNNQDKLKRDILSRHIVMISLGGTISASFFLGIGSILNTVGAFGTVIGFFIGGIIMMLVMISLAEMAIEMPISGSFQSYATKFISPYSGFLTGWLYLLNWLTAAAGGLVAAGIICNNFYPAISVWQFCLAIILIVSLLNLCAVRVFAEIEFWLSAIKIITIIIFIIIGIGIIGGFLHSNKPIAGLVNFYVDGLFPNGFKAFLFGLVIIVCTFQGAEVVGIAAGETKEPEKNIRKAIRSVAVRILLFFVFSSFIIAYVIPYKDSGITNTPFVTVLQLVNIKYVDTIMQLVILSASLSAVNSCFYTCARLMWSMAEANQAPKIFAKISKKQIPIYGVVFVALLSCICLITKFIGAEKIFILVISSSGMVGCMIWIIISMCHIYFRKSLTASQIESLRFKAWGFPLIPYTSILFNSCVILAMFWDPEQRMVVYSGVILILLFSFLYKFYYKKIIVKT

SEQ ID NO: 35258 - protein, 378 aa, Mycobacterium leprae TN
MARDYYGLLGVSRNASDADIKRAYRKLARELHPDINPDEAAQAKFKEISMAYEVLSDPEKRRIVDLGGDPMENAAASPSGFGGFGGLGDVFEAFFGGSSASRGPIGRVRPGSDSLLPMWLDLEECATGVTKQVTVDTAVLCDRCQGKGTNGDSAPIPCDTCGGRGEVQTVQRSLLGQMVTARPCPTCRGVGVVIPDPCCQCVGDGRVRARREITVKIPSGVGDGMRVRLAAQGEVGPGGGPAGDLYVEVHEQAHDIFVRDGDDLHCTVSVPMVDAALGTTITVDAILDGMSEIDISPGTQPGSVIELRGQGMPHLRSNTRGNLHVHVEVMVPTRLDQHDTELLRELKRRRSRDVAEVRSTHAAGGGLFSRLRETFTNR

SEQ ID NO: 35259 - protein, 249 aa, Legionella pneumophila subsp. pneumophila str. Philadelphia 1
MRQKIVAGNWKMNGQIQQVTELVSQIEELIGFDCAAQVAVMPPSIYIPKVRDCLRTGKIVVGAQNVYPKDYGAYTGELSAPMLKDFDCRYVLVGHSERRQFFHEDENFVAQKFHHVKDHGMIPVLCVGETLSERENGKTEQVIAQQVLAVSAKGKDCFRDCVVAYEPVWAIGTGKTATPEQAQKIHQFIRDLVGEINDSDAKHLTLIYGGSVNENNAKALFSMPDIDGGLVGGASLNAKQFVEIVKCIN

SEQ ID NO: 35260 - protein, 394 aa, Nostoc sp. PCC 7120
MARIETRTEPMVLNMGPHHPSMHGVLRLIVTLDGEDVVDCEPVIGYLHRGMEKIAENRTTVMYVPYVSRWDYAAGMFNEAVTVNAPEKLAGVAVPKRASYIRVIMLELNRIANHLLWFGPFLADVGAQTPFFYQFREREMIYDLWEAATGYRMVNNNYFRVGGVAADLPYGWVDKCLEFCDYFLPVIDEYEKLVTNNPIFRRRIEGIGTISREEAINWGLSGPMLRASGVKWDLRKVDHYECYDDFDWDVQWETAGDCLARYTVRMREMRESVKIIKQAIKGLPGGPYENLEAKRLAAGKKSEWDAFDYQYIGKKVSPTFKMPKGEIYARVESGKGELGIYLIGDDNVFPWRWKIRPADFNNLQILPHLLRGMKVADVVVILGSIDVIMGSVDR

SEQ ID NO: 35261 - protein, 252 aa, Glycine max
  misc_feature (238)..(238): Xaa can be any naturally occurring amino acid
FQRAQSLLSTDREASIDILHSIVKRDIQENDEEAVQVKEQSILELGSLLAKTGQAAELGGLLKYVRPFLNSISKAKAARLVRSLLDLFLDMEAATGQEVELCLECIEWAKSEKRTFLRQALEARLVSLYFDTKRYQEALHLGSQLLRELKKMDDKALLVEVQLLESKTYHALSNLPKARAALTSARTTANAIYCPPKLQATLDMQSGIIHAAEEKDWETAYSYFYEAFESYDSIDSPXAITSLEYMWLGKSC

SEQ ID NO: 35262 - protein, 457 aa, Silicibacter pomeroyi DSS-3
MLKNDQLDQWDRENFFHPSTHLAQHARGDSANRVIKTASGVFIEDRDGNKLLDAFAGLYCVNVGYGRQEIADAIADQARELAYYHSYVGHGTEASITLAKMILDRAPANMSKVYFGLGGSDANETNVKLIWYYNNILGRPEKKKIISRWRGYHGSGLVTGSLTGLELFHKKFDLPVNQVIHTEAPYYFRRADPDQSEAQFVAHCAAELEALIEREGADTIAAFIGEPVLGTGGIVPPPAGYWEAIQAVLRKHDILLIADEVVTGFGRLGTMFGSDHYGIEADIITIAKGLTSAYAPLSGSIISDKVWKVLEQGTDENGPIGHGWTYSAHPIGAAAGVANLKLIDRLNLVQNAGETGAYLNATMTEALAGHPNVGEVRGAGMLCAVEFVKDKDSRLFFDAADKIGPQISAKLLEQDKVIARAMPQGDILGFAPPFCLSRAEADQVVDATLRAVRTVLG

SEQ ID NO: 35263 - protein, 491 aa, Silicibacter pomeroyi DSS-3
MTETALSARADIADKALVRSFSYINGKWCAAANGETFAVTDPADGTELGHAASLSAEESSAAVDAAQAAFPAWAGRLPQERAALLRRWYELLLEHKEDLARIMVLEQGKPLSEARGEIDYGAAFVEFYAEEAKRPNIEGVTSHLPDAEVELWREPVGVAALITPWNFPSAMLTRKAAAALAAGCTVVAHPSRETPFSALALAELAERAGVPPGVFNVVTGTAATVVEPWTRDTRVRALSFTGSTEIGKLLYRQSADTVKRLVMELGGHAPVIVFKDCDLDKAVSETIKAKFATSGQDCLGANRILVERPVYADFCARFTLAAQALTLGPGMADCDLGPLMNEQAVQKQEDHVADALARGARLACGGRRHPRGPLFYEPTVLVDVPPDALIMSQETFGPVAAIAPFDTEEEAVARANDSEYGLVAYVHSNDPRRIYRLSRALQYGMVAVNRTKVTGAPIPFGGTKQSGLGREGARLGMEAFTEVKYICRDWA

SEQ ID NO: 35264 - protein, 506 aa, Petunia axillaris subsp. axillaris
MMLLTELAAATLITLIAHIIISTLISKTTSRRLPPGPRGWPVIGALPLLGAMPHVSLAKMAKKYGAIMYLKVGTCGMAVASTPDAAKAFLKTLDINFSNRPPNAGATHLAYNAQDMVFAHYGPRWKLLRKLSNLHMLGGKALENWANVRANELGHMLKSMSDMSREGQRVVVAEMLTFAMANMIGQVMLSKRVFVDKGVEVNEFKDMVVELMTIAGYFNIGDFIPCLAWMDLQGIEKRMKRLHKKFDALLTKMFDEHKATTFERKGKQDFLDVVMENGDNSEGERLSTTNIKALLLNLFTAGTDTSSSAIEWALAEMMKKPTILKKAQAEMDQVIGRNRRLLESDIPNLPYLRAICKETFRKHPSTPLNLPRISNEPCIVDGYYIPKNTRLSVNIWAIGRDPQVWENPLEFNPERFLSGRNSKIDPRGNDFELIPFGAGRRICAGTRMGIVMVEYILGTLIHSFDWKLPSEVIELNMEEAFGLALQKAVPLEAMVTPRLQMDVYVP

SEQ ID NO: 35265 - protein, 331 aa, Shewanella sp. ANA-3
MAPQPESIMDLNAIRQLADTDMQAVNQLIYKQLESDVALINQLGFYIINGGGKRLRPLLSVLAARAVDYQGEAHLKLAAIIEFIHTASLLHDDVVDESTLRRGRETANALFGNSASVLVGDFLYTRSFQMMTELDSMRVLRVLADTTNVLAEGEVLQLMNCNDPNTTEESYMRVIYCKTAKLFEAATLLAAVLAGATPEQEAALGDYGKYLGTAFQLTDDLLDYTADSEELGKNIGDDLAEGKPTLPLIYAIAHGTEEEQQLIRQAIEQGDGTHAIEKIVAALHHCGALTYTQQKAIEESNKAIAALAVLPDSDFKTALISLAKISVDRNH

SEQ ID NO: 35266 - protein, 424 aa, Thermus thermophilus HB8
MKSEPLSYLGKDGGPWEIFTEQVDRVVPYLGRLAPLAESLKRPKRVLIVDVPVRLDDGSVAYFEGYRVHHNTARGPAKGGVRYHPEVTLSEVMALAGWMTIKNAAVGLPYGGGKGGIRVDPRKLSPGELERLTRRYTSEIGILLGPDRDIPAPDVNTGEREMAWMMDTYSMNVGRTVPGVVTGKPIALGGSLGRRDATGRGVFITAAAAAEKIGLQVEGARVAIQGFGNVGNAAARAFHDHGARVVAVQDHTGTVYNEAGIDPYDLLRYVQEFGGVRGYPKAEPLPAADFWGLPVEFLVPAALEKQITEQNAWRIRARIVAEGANGPTTPAADDILLEKGVLVVPDVIANAGGVTVSYFEWVQDFNSYFWTEEEINARLERVLRNAFGAVWQVAQEKKIPLRTAAYVVAATRVLEAQALRGLYP

SEQ ID NO: 35267 - protein, 419 aa, Thermus thermophilus HB8
MPLKAYRPPEDPGLWDTYLEWLERALKVAEAHPTTLEYLAHPKRLVTLSLPVVMDDGKVRIFQGYRVVHDIARGPAKGGVRLDPGVTLGQTAGLAAWMTLKAAVYDLPFGGAAGGIAVDPKGLSPQELERLVRRYTAELVGLIGPDSDILGPDLGADQQVMAWIMDTYSMTVGSTVPGVVTGKPHALGGSEGRDDAAGLGALLVLEALAKRRGLDLRGARVVVQGLGQVGAAVALHAERLGMRVVAVATSMGGMYAPEGLDVAEVLSTYEATGFLPRLDLAPEEVFGLEAEVLVLAAREGALDGDRARQVQAQAVVEVANFGLTPEAEAYLLGKGALVVPDLLSGGGGLLASYLEWVQDLNMFFWSPEEVRERFETRVARVVDAVCRRAERGGLDLRMGALALALERLDEATRLRGVYP

SEQ ID NO: 35268 - protein, 516 aa, Thermus thermophilus HB8
MTVEPFRNEPIETFQTEEARRAMREALRRVREEFGRHYPLYIGGEWVDTKERMVSLNPSAPSEVVGTTAKAGKAEAEAALEAAWKAFKTWKDWPQEDRSRLLLKAAALMRRRKRELEATLVYEVGKNWVEASADVAEAIDFIEYYARAALRYRYPAVEVVPYPGEDNESFYVPLGAGVVIAPWNFPVAIFTGMIVGPVAVGNTVIAKPAEDAVVVGAKVFEIFHEAGFPPGVVNFLPGVGEEVGAYLVEHPRIRFINFTGSLEVGLKIYEAAGRLAPGQTWFKRAYVETGGKDAIIVDETADFDLAAEGVVVSAYGFQGQKCSAASRLILTQGAYEPVLERVLKRAERLSVGPAEENPDLGPVVSAEQERKVLSYIEIGKNEGQLVLGGKRLEGEGYFIAPTVFTEVPPKARIAQEEIFGPVLSVIRVKDFAEALEVANDTPYGLTGGVYSRKREHLEWARREFHVGNLYFNRKITGALVGVQPFGGFKLSGTNAKTGALDYLRLFLEMKAVAERF

SEQ ID NO: 35269 - protein, 161 aa, Schizosaccharomyces pombe 972h-
MSKIKLISSDNEEFVVDQLIAERSMLIKNMLEDVGEINVPIPLPNVSSNVLRKVLEWCEHHKNDLYSGTEEESDIRLKKSTDIDEWDRKFMAVDQEMLFEIVLASNYLDIKPLLDTGCKTVANMIRGKSPEDIRKTFNIPNDFTPEEEEQIRKENEWAEDR

SEQ ID NO: 35270 - protein, 278 aa, Zea mays
MASHDHHHSHSHDDHHHHSHGDGGGHAAGGSWVGEDGRVWHSHDGLAPHSHEPIYSPGDFTKRAPPLASRDFADRAFTVGIGGPVGTGKTALMLALCRFLRDKYSLAAVTNDIFTKEDGEFLIKHGALPEERIRAVETGGCPHAAIREDISINLGPLEELSNLYKADLLLCESGGDNLAANFSRELADYIIYIIDVSGGDKIPRKGGPGITQADLLVINKTDLAPAVGADLSVMERDALRMREGGPFVFAQVKHGVGVEGIVNHILQAWEIATGNKRR

SEQ ID NO: 35271 - protein, 605 aa, Schizosaccharomyces pombe 972h-
MSSPNNQPLSCSLRQLSISPTAPPGDVGTPGSLLSLSSSSSSNTDSSGSSLGSLSLNSNSSGSDNDSKVSSPSREIPSDPPLPRAVPTVRLGRSTSSRSRNSLNLDMKDPSEKPRRSLPTAAGQNNIGSPPTPPGPFPGGLSTDIQEKLKAFHASRSKSMPEVVNKISSPTTPIVGMGQRGSYPLPNSQLAGRLSNSPVKSPNMPESGLAKSLAAARNPLLNRPTSFNRQTRIRRAPPGKLDLSNSNPTSPVSPSSMASRRGLNIPPTLKQAVSETPFSTFSDILDAKSGTLNFKNKAVLNSEGVNFSSGSSFRINMSEIIKLEELGKGNYGVVYKALHQPTGVTMALKEIRLSLEEATFNQIIMELDILHKAVSPYIVDFYGAFFVEGSVFICMEYMDAGSMDKLYAGGIKDEGVLARTAYAVVQGLKTLKEEHNIIHRDVKPTNVLVNSNGQVKLCDFGVSGNLVASISKTNIGCQSYMAPERIRVGGPTNGVLTYTVQADVWSLGLTILEMALGAYPYPPESYTSIFAQLSAICDGDPPSLPDSFSPEARDFVNKCLNKNPSLRPDYHELANHPWLLKYQNADVDMASWAKGALKEKGEKRS

SEQ ID NO: 35272 - protein, 323 aa, Bacillus halodurans C-125
MKLADIYAHFQEDIFTIERELEEAVQARHDILRKASVHLLKAGGKRIRPVFVLLAGKFGTYDVNVLKHIAVPLELIHMASLVHDDVIDDADLRRGKKTIKSQWDNRIAMYTGDYMFAKAVQTATYFDDPNIHQIISNAINEMCLGEVEQIRDQYNPNQHLRIYFRRIKRKTALLIAVSCQLGALAAKADPAIVQKLYYFGYYVGMSFQITDDVLDFVGTEEQLGKPAGSDLLQGNVTLPALYALHHDMHAKRLIEQVLADRGNNSVHMEEVIAAIVSSGGIDYALSISDLYLKKAMRMLDHLPDDEPKQFLQEIANYIGRRKF

SEQ ID NO: 35273 - protein, 147 aa, Bacillus halodurans C-125
MERTYLMIKPDGVQRNLIGEIVSRFEKKGFTLIGAKLMTVTKEQAETHYAEHKERPFFGELVDFITSGPVFAMVWEGENVIATARKMMGATNPADAEPGTIRGDFGVQVAMNVIHGSDSPESAKREIDIFFDSSELNEYDKVVNRWV

SEQ ID NO: 35274 - protein, 182 aa, Solanum tuberosum
MAPHDPILKDERIAGIASAIRVIPDFPKPGIMFQDITTLLLDPKAFKDTIDLFVERYKDKNISVVAGIEARGFIFGPPIALAIGAKFVPMRKPKKLPGEVISEEYSLEYGTDKMEMHVGAVQAGECALVVDDLIATGGTLSAAIRLLERVGVEVFECACVIELPELKGRERLGDKPLFVLVS

SEQ ID NO: 35275 - protein, 326 aa, Oryza sativa
MASVASFPVINMENLETEERGAAMEVIRDACENWGFFEMLNHGIAHELMDEVERVSKAHYANCREEKFKEFARRMLEAGEKGADVKGIDWESTFFVRHRPVSNLADLPDVDDHYRQVMKQFASEIEKLSERVLDLLCENLGLEKGYLKKAFAGSNGPTFGTKVSSYPPCPRPDLVDGLRAHTDAGGIILLFQDDQVSGLQLLKDGEWVDVPPMRHAIVANIGDQLEVITNGRYKSVMHRVLTRPDGNRMSIASFYNPGADAVIFPAPALAAAEAERADAAAAAYPRFVFEDYMNLYVRHKFEAKEPRFEAMKSAAEVVHAAPIATA

SEQ ID NO: 35276 - protein, 217 aa, Cryptococcus neoformans var. neoformans JEC21
MSCSHEAHDHDHGHDGHSHDVPLESSPLDSLYTQIDLPNVMALNAEGGGEAGRKVIKSWDMKEDDTIWLESEIDDELIIKIPFTSSVSLRSITLKSGPGGHTPSEMHLFRDNPGLDFSDASSSSPTQSFDVVPRKEGVEYQVKAAKFNGLTSLTIFFPGNTADDDEETTKVYYIGLRGSWKPLPNRPGVIIYESSANPADHKVPGVNAGGATHRPGY

SEQ ID NO: 35277 - protein, 259 aa, Helianthus annuus
MAAASSPREENVYLAKLAEQAERYEEMVEFMEKVVAAADGGEELTIEERNLLSVAYKNVIGARRASWRIISSIEQKEESRGNEGHVSTIRDYRSKIESELSSICDGILKVLDSKLIGSASGGDSKVFYLKMKGDYYRYLAEFKTGDERKLAAENTLSAYKAAQDIANAELAPTHPIRLGLALNFSVFYYEILNSPDRACNLAKQAFDEAIAELDTLGEDSYKDSTLIMQLLRDNLTLWTSDMQDDTAEEVKEAPKPDDQ

SEQ ID NO: 35278 - protein, 336 aa, Solanum lycopersicum
MSHHYQEQEQLEAQKIPFLLDSLYCEENNILTEVSIETESFSSHDLLWEEEELTSLFSKETEYEISYNVLEKNQSFISSRRESVEWILKTTAYYSFSAQTGFLAVNYFDRFLLFSFNQSLNHKPWMNQLVAVTCLSLAAKVEETDVPLLLDLQVEESGFLFESKTIQRMEMLILSTLKWKMNPVTPFSFLDFITRRLGLKHCLSLEFLRRCEKVLLYTITDDRFIGYLPSAMASATMLHVLDRLKPCIGEKYQDQLLGILGIVKEKVEGCYRLIQEVACNIDFGSNKRKFGTLPGSPTGVMDMSFSSDYSNDSWSVATSVTSSPEPLSKKIRESNE

SEQ ID NO: 35279 - protein, 1384 aa, Arabidopsis thaliana
MNPATDPVSAAAAALAPPPQPPQPHRLSTSCNRHPEERFTGFCPSCLCERLSVLDQTNNGGSSSSSKKPPTISAAALKALFKPSGNNGVGGVNTNGNGRVKPGFFPELRRTKSFSASKNNEGFSGVFEPQRRSCDVRLRSSLWNLFSQDEQRNLPSNVTGGEIDVEPRKSSVAEPVLEVNDEGEAESDDEELEEEEEEDYVEAGDFEILNDSGELMREKSDEIVEVREEIEEAVKPTKGLSEEELKPIKDYIDLDSQTKKPSVRRSFWSAASVFSKKLQKWRQNQKMKKRRNGGDHRPGSARLPVEKPIGRQLRDTQSEIADYGYGRRSCDTDPRFSLDAGRFSLDAGRFSVDIGRISLDDPRYSFDEPRASWDGSLIGRTMFPPAARAPPPPSMLSVVEDAPPPVHRHVTRADMQFPVEEPAPPPPVVNQTNGVSDPVIIPGGSIQTRDYYTDSSSRRRKSLDRSSSSMRKTAAAVVADMDEPKLSVSSAISIDAYSGSLRDNNNYAVETADNGSFREPAMMIGDRKVNSNDNNKKSRRWGKWSILGLIYRKSVNKYEEEEEEEEDRYRRLNGGMVERSLSESWPELRNGGGGGGGPRMVRSNSNVSWRSSGGGSARKVNGLDRRNKSSRYSPKNGENGMLKFYLPHMKASRRMSGTGGAGGGGGGGWANSHGHSIARSAKSPKHAGEITFTKNSHMVVFPKSLSPKHVLKLLKSEKNPRAAFALFDSATRHPGYAHSAVVYHHILRRLSETRMVNHVSRIVELIRSQECKCDEDVALSVIKTYGKNSMPDQALDVFKRMREIFGCEPAIRSYNTLLNAFVEAKQWVKVESLFAYFETAGVAPNLQTYNVLIKMSCKKKEFEKARGFLDWMWKEGFKPDVFSYSTVINDLAKAGKLDDALELFDEMSERGVAPDVTCYNILIDGFLKEKDHKTAMELWDRLLEDSSVYPNVKTHNIMISGLSKCGRVDDCLKIWERMKQNEREKDLYTYSSLIHGLCDAGNVDKAESVFNELDERKASIDVVTYNTMLGGFCRCGKIKESLELWRIMEHKNSVNIVSYNILIKGLLENGKIDEATMIWRLMPAKGYAADKTTYGIFIHGLCVNGYVNKALGVMQEVESSGGHLDVYAYASIIDCLCKKKRLEEASNLVKEMSKHGVELNSHVCNALIGGLIRDSRLGEASFFLREMGKNGCRPTVVSYNILICGLCKAGKFGEASAFVKEMLENGWKPDLKTYSILLCGLCRDRKIDLALELWHQFLQSGLETDVMMHNILIHGLCSVGKLDDAMTVMANMEHRNCTANLVTYNTLMEGFFKVGDSNRATVIWGYMYKMGLQPDIISYNTIMKGLCMCRGVSYAMEFFDDARNHGIFPTVYTWNILVRAVVNR

SEQ ID NO: 35280 - protein, 153 aa, Solanum lycopersicum
GLSKKPKEHIVDIDAADVNNELAVLEYVEDIYNFYKLAETETRVHDYIDSQPEINEKMRAILIDWLIEVHHKFELNPETLYLTINIVDRYLTVETSSRRELQLLGISAMLIASKYEEIWAPEVNDFVCIADKTYSHDQVLAMEKQILGKLEWY

SEQ ID NO: 35281 - protein, 643 aa, Ustilago maydis 521
MAAIEKNSSKLDERFGANKLATDDVSSHDASNSVTMPHSEDVKFSNPLAGIPKEQLLCNVEAFAQEKGLTDELEMLQKGALLAQRPAEYEEIVELSQAEKDAVAHEYAHKWSHPKLLYMTIFVCSIGAATQGWDQTGSNGANLSFPLEFGIPESSPVGVLPGQPGYVTDAEAQRNQWLVGVVNAAPYIASALFGCWISDPLNNYFGRRGCIFITAIILLVTPICSGLTQNWWELFIVRLILGIGMGAKGSTVPVFAAENSPPQIRGALVMGWQLWTAFGIFLGFVANVAVIDVGKIAWRLQLGSAFIPALPLAVLIYFCPESPRWLMKKNRYPQALRSLIRLRHNKIQACRDLYYIHVQLVEESKIVRGETYLKRFKELFTIPRVRRATVASTTVMLSQQLSGVNVIAFFSSTIFLESGSTAKQALYASLGFGAINFLFAFPALITIDTFGRRSLLLFTFPQMTWTLLAAGLCFLIPGEDSKTRLGLVALFIYLFTMAYSPGCGPVPFTYSAEVFPLAQREQGMSWAVATCLFWAAVLSITFPRMLKAMTPTGAFGFYAGTNIVAFILIYLFVPETARFTLEELDAVFGVPHATFIRHQNTKVLPYWFKTTVLRKNALRPPRLIQLDSNLVGAGEKRPEASIA

SEQ ID NO: 35282 - protein, 79 aa, Phyllostachys aurea
  misc_feature (2)..(3): Xaa can be any naturally occurring amino acid
PXXKFGANDMRTFYTLVMVDPDAPSPSEPNFREYLHWLVTDIPGTTGAAFGQEVVCYESPRPTMGIHRFVFVLFQQLGR

SEQ ID NO: 35283 - protein, 321 aa, Malus x domestica
ILPFKLPAIGPNDVRIRIKAVGICGSDVHYLRTMKCADFEVKEPMVIGHECAGIVDKVGSEVKHLVPGDRVAVEPGISCSRRQQCKGGQYNLCPDMKFFATPPVHGSLANQIVHPADLCFKLPENVSLEEGAMCEPLSVGVHACRRANVGPETTVLIVGAGPIGLVSVLAARAFGAPRIVIVDMDDRRLAMAKSLGADGTVKVSIKMEDLDDEVAKIKEAMGSEVDVTFDCVGFNKTMSTGLNATRPGGKVCLVGMGHGVMTVPLTPAAAREVDVVGVFRYKNTWPLCLEFLRSGKIDVKPLITHRFGFTEKEVEEASLEF

SEQ ID NO: 35284 - protein, 87 aa, Olyra latifolia
KPSMVVHQPRVDIGGNDMRTFYTLVMVDPDAPSPSDPTLREYLHWLVTDIPGTTGAAFGQEVMCYEPPRPSMGIHRFVLVLFQQLGR

SEQ ID NO: 35285 - protein, 219 aa, Synechococcus sp. CC9311
MFGFLKQVGDYTRDAVDAARNLTQGLSVTFDHMKRRPVTVQYPYEKLIPSERYRGRIHYEFDKCIACEVCVRVCPINLPVVDWVMNKETKKKELRNYSIDFGVCIFCGNCVEYCPTNCLSMTEEYELAAFDRHSLNYDNVALGRLPTSVTTDPSVQPLRELVYLPAGEVQPHGVSPDRPRAGKLPEQILEELKAAGSMKAAEDERESSSSASNMEESAG

SEQ ID NO: 35286 - protein, 560 aa, Treponema denticola ATCC 35405
MNESTMQRLRYNYEPKIPKVFAEPLSLIKPEIGEATHAQSNQAELKEIFPHTYGMPIIRFVKGKSEVEHKPLKFGVILSGGQAPGGHNVISGLFDALKKGNANSKLYGFLRGPEGLVKGRYVEIKKALIDKYRNTGGFDIIGSGRTKIETEEQIESSIQNVKKLKLDALIIIGGDDSNTNAAFLAKYFIQAKLDTKVIGVPKTIDGDLKNQYIETSFGFDTATKLYSELIGNICRDVNSARKYWHFIKLMGRSASHIALECALKTQPNVCLIGEELAEKKVTLQQVTDYIVDIIVKRSQKGENFGVVLVPEGIIEFIPEMDELIEEINDIMAEKTSAFSKLKTFAGKKSWLQKHLSKKAFALFDNLPENISLQLLMDRDPHGNVQVSRIETEKLLIDLVTRKITEMKKEGTYNGKFSTYAHFFGYEGRSAFPSNFDSDYCYTLGFTAFLLALNGFSGYIASVKNLTDEVEHWLPCGVPLSMMMNMERRKGKMTPVIKKSVVDLNGKPFKTYEKNRDKWAVETLYRFPGAIQYFGDLEVCDIPTKTLLLEKGNLKEKRKKK

SEQ ID NO: 35287 - protein, 319 aa, Malus x domestica
ILPFKLPAIGPNDVRIRIKAVGICGSDVHYLRTMKCADFEVKEPMVIGHECAGIVDKVGSEVKHLVPGDRVAVEPGISCSRCQQCKGGQYNLCPDMKFFATPPVHGSLANQIVHPADLCFKLPENVSLEEGAMCEPLSVGVHACRRANVGPETTVLIIGAGPIGLVSVLAALAFGAPRIVIVDMDDKRLAMAKSLGADGTVKVSTKMEDLDDEVAKIKEAMESEVDVTFDCVGFNKTMSTGLNATRPGGKVCLVGMGHGMMTVPLTPAAAREVDVVGVFRCKNTWPLCLEFLRSGKIDVKPLITHRFGFTEKEVEEASL

SEQ ID NO: 35288 - protein, 372 aa, Bacillus subtilis subsp. subtilis str. 168
MSKRDYYEVLGVSKSASKDEIKKAYRKLSKKYHPDINKEAGSDEKFKEVKEAYETLSDDQKRAHYDQFGHTDPNQGFGGGGFGGGDFGGFGFDDIFSSIFGGGTRRRDPKLRARGADLQYTMTLSFEDAAFGKETTIEIPREETCETCKGSGAKPGTNPETCSHCGGSGQLNVEQNTPFGKVVNRRVCHHCEGTGKIIKNKCADCGGKGKIKKRKKINVTIPAGVDDGQQLRLSGQGEPGINGGLPDLFVVFHVRAHEFFERDGDDIYCEMPLTFAQAALGDEVEVPTLHGKVKIPAGTQTGTKFRLRGKGVQNVRGYGQGDQHIVVRVVTPTNLTDKQKDIIREFAEVSGNLPDEQEMSFFDKVKRAFKGD

SEQ ID NO: 35289 - protein, 534 aa, Shewanella sp. ANA-3
MAYDQESQLELGKYSSLIDLIERTSQRFGDKTAYACLGKTSSFNDIERDSRYFAAYLQNNTNLKPGDRIAIQLPNITQFVIAAYGALRAGLILVNTNPLYTERELIHQFNDSGAKALVVLSDLLPTLAKVVATTPIELVISTHPLDLIDPQVQPKTGLKNVEFCQVLKQGAELPFSRFVPAANDLAALQYTGGTTGLSKGAMLTHGNMLANAAQVKSRIGSVITEGEDIFVAPLPIYHIYAFMVNLVLYFECGGCSVLIPNPRDISGLIKTLAKYPFTGFAGLNTLFVALCHQPEFKALDFSHLKITISGGTALTAAAANIWQQTTGNTISEGYGLSETSPVISLNAPGYQKIGTIGKPVLGTEVKLLDENGNEVAQGEAGELAARGPQVMLGYWNNPQETANVMTADGFFKTGDIAILNEEGFHQIVDRKKDMIIVSGFNVYPNEVENVLASHPNIIECAVVGVKDEHSGEAVKAFVVLKDDSQDHEQMKTAILNFCREQLTAYKLPKLIEFMPQLPKSTVGKILRRELKHQA

SEQ ID NO: 35290 - protein, 228 aa, Borrelia burgdorferi B31
MENQKILVAKHAIDHYIKSNMNLGIGTGTTIYYAIKYLSEKIKSGSLKNLKFYTTSSDTKYLLSKEQIPYESNFSKLNKNLDIAIDGADEILLEKKSLIKGMGGAHLMEKVIAYNSETLLIIADETKIVKKLGTKMPIPIEVAQNAVGFIMTRLEEMNLEATLRICKEKKGPTITDNNNYILDVKMHVENPEGTEKYFKLFPGILEIGIFNHKNTRIVYYQDKQIKEA

SEQ ID NO: 35291 - protein, 516 aa, Coccidioides immitis RS
MPPPAGRYGPSGIAGPFPHLQQAHLQQQQQSQQHHSAHPQTASTGIPPSSLGGHPGFGLGTSGSNINPFTLPGANGMTVTGFPATGAAGSGIPDGGGTGLASHAAQMGFLRGAQMQQQQQQQQQQAQQQQSHLVHDGRLVMDGKADKSRIRDVWKHNLAQEMESLRALVEKYPYISMDTEFPGIVARPMGTFTTKADYHYQTLRCNVDLLKMIQLGVTLFSEEGEVPPAYPTNGTLHANGNHLVPAPCTWQFNFHFSLENDMYAQESTSMLAKAGIDFTMHEKNGIDPLEFGALLMTSGLVLLDDVHWISFHSGYDFGYLMKIMLCKPLPDDEEEFHKLLSIFFPSLYDIKFLMKHASRNQSVNGSPLTQGAVQILANLGQKSGLQDIADELGVKRVGIAHQAGSDSLVTGEIFWKMRQLVFNGTIDQAKYSGQIWGLNGQIPAMPYHTGNQPQQTPNLNGAMVYSNTATPSTPNTGHAAPNSNQTPAPQSHVSGNPSLTPGGGGGVFGAFQLGRT

SEQ ID NO: 35292 - protein, 524 aa, Synechococcus sp. RS9916
MVLAILDGWGHRDSETHNAIRHASTPVMDALWHAYPHSLIQASGAHVGLPDAQMGNSEVGHLTIGAGRIIRQELVRISETVRQGELAQTPALAQLAQSLQANGGTLHLMGLCSNGGVHSHVDHLCGLLRWAAEAGIARVAIHAITDGRDTPTQSAPTFLKQVEDAIQTAGVGEIASLCGRYWAMDRDQRWERTSKAYSLFTDPSLGCSNAPVSEVLQNSYDAGVTDEFLEPVRLSDAFLKDGDGLVVFNFRPDRARQLVQALTVDGFAGFERQHKPRLDVVTFTQYEAGLPVTIAFPPESLDQLLGQVVSEHGLKQYRTAETEKYPHVTYFLNGGIEQPLAGEDRHLVPSPRVATYDEAPAMSADVLTDSCIAAIERGEYSLVVINYANPDMVGHTGVMTAATEAIQTVDHCIGRLLDAVGRMGGTLLITADHGNAELMEGPDGQAWTAHTTNPVPVILVEGEKRKLAGMGNSIRLRENGGLADIAPTLLQILGLPKPKAMSGSTLIEAIETLSPLSARLPQPV

SEQ ID NO: 35293 - protein, 253 aa, Borrelia burgdorferi B31
MLGDFMYKLVLVRHGESEWNKENLFTGWTDVKLSDKGIDEAVEAGLLLKQEGYSFDIAFSSLLSRANDTLNIILRELGQSYISVKKTWRLNERHYGALQGLNKSETAAKYGEDKVLIWRRSYDVPPMSLDESDDRHPIKDPRYKHIPKRELPSTECLKDTVARVIPYWTDEIAKEVLEGKKVIVAAHGNSLRALVKYFDNLSEEDVLKLNIPTGIPLVYELDKDLNPIKHYYLGDESKIKKAMESVASQGKLK

SEQ ID NO: 35294 - protein, 456 aa, Haemophilus influenzae R2866
MTKHYDYIAIGGGSGGIASLNRAASYGKKCAIIEAKHLGGTCVNVGCVPKKVMFYGTHIAEAINNYAPDYGFDVEVKKFDFSKLIESRQAYISRIHTSYNNVLAKNNIDVINGFGKFVDAHTVEVTLADGTKEQVTADHILIATGGRPYRPNIKGQEYGIDSDGFFALTELPKRAAVIGAGYIAVELSGVLNSLGVETHLLVRRHAPMRNQDPLIVETLVEVLAQDGIQLHTNSTPSEIVKNADGSLTVRCDGQSDITVDCVIWAAGRVPATDKIGLENAGVETNEHGYVKVDKYQNTNVKGIYAVGDIIENGIELTPVAVAAGRRLSERLFNNKPTEYLDYSLVPTVVFSHPPIGTVGLTEPQAIEQYGAENVKVYKSSFTAMYTAVTQHRQPCKMKLVCVGKDEKVVGLHGIGFGVDEMIQGFAVAIKMGATKADFDNTVAIHPTGSEEFVTMR

SEQ ID NO: 35295 - protein, 265 aa, Zea mays
MGDTADDQAMVEAPGVPSFSELLMLSDGFLSSSEDHRREINGGDGGEDSFGFVFSGTSGSKMLCFSGDCQNGDESLFQEPSFPSGVSVSDPSSCTINTCKNSNDTCTDERSIKSSNKKRTGSGNGQNMDHNQKPSKKCKKNQDKSTVGIAKVRKERLGERIAALQQLVSPYGKTDAASVLHEAMGYIKFLQDQIQVLCSPYLINYSLDGGAVTGDVTPGKKVRDLRSRGLCLAPVSSTVHVENSNGADLWSPATASMGHTMSPSQ

SEQ ID NO: 35296 - protein, 838 aa, Rhodobacter sphaeroides 2.4.1
MTSLTRQGEIPRELIQLDARASSKEEAIAQAAAALVAAGCVRPGFEASMLRREAVSNTYLGKGIAIPHGTVEDRDLIQKDAIAVLQVRDGVEWNAGERARLVVAIAARSDGHIEILRRLTRLLQDEDRLAVLAATDDRQALSDALNGVAAGAAATAEPAGDFAQSFDWVLDYPTGLHARPATEWAEAARRFPCRIRIRHGAETADARNMISLLSLGLKSGDAITVSAEGQGAAEALATLKVTMTGLSAREKADAARAEEKRRATAAAGGWVPPSSPRAIEGVPAAPGLAIGRITRIATDGMEIPDEPVELARAADLLHAALGQTAEQLHSLADDTARRLGESDAAIFRAQAGLLADPDLITLASQWLVDGHGLAWSWHRAYEDMAARLSALRNPVLAARAADLRDVGQRVLAHIDPRFARSRLADLPEDTILVAEDISPSDAAGLDPAKVAGLVTALGGPTSHTAILARTLGLPAVVGTGAVVERLEDGACAIVDGHGGRLYLDPSEADLASARDWIAAEEARRARAAETRALPATTRDGHRIDIGANINLAEQAAFALGQGAEGVGLMRTEFLFLERSESPTEDEQAEAYAAMARALEGRPLVIRALDIGGDKQVAHLDLPREENPFLGVRGARLLLRRPDLLVPQLRALYRAAAGGAQISVMFPMVTSLGELLELRATCERIRQELDAPVVPLGIMVEVPSAALLAAEFAAHADFFSIGTNDLTQYALAIDRQNPELAPEADSLHPAVLRLIDLTVKGAAVHGRWVGVCGGIAGDPFGAALLAGLGVDELSMTPRDIPAVKERLRQSDRAGLRALAEHALACSDAEAVRALAAEAP

SEQ ID NO: 35297 - protein, 155 aa, Humulus japonicus
MKNLQHHNKIITFKTPDDSTTLELNSHISLPYHWEQCLDLKTGEIYYINWRNGMKAKEDPRTTITEYNSNGSNGDYYYSEEDSSYDSEESSSESSPPPATTSRESQYRGAEKDHVLVVGGCKSCFMYFMVPKQVQECPKCCGQPLHFDRSQSGSQ

SEQ ID NO: 35298 - protein, 279 aa, Pediococcus pentosaceus ATCC 25745
MLKINQDGLNNLWPVRSNDSHKGSYGRILIVAGNDQYGGAGILSSSAAVYAGGGLVTLATDKTNFTAVRSTLAEVMLLDFLDFDALKAALKKSTGVVIGPGLGTNATSLKILKFVLDHVQPQTPLVIDGSAIDLIATHQIQVDHPQTIFTPHQMEWQRLSGIKIVDQNPSLNQRAVDRLKAMVVLKHYETEIYAPHTDFRQIMAGNPGMATGGSGDALTGVIIALVNQVDSLALGVTLGTFLHSYTADQIYQKEAVVLPHRLIRRLPFTLKQLQKNKLL

SEQ ID NO: 35299 - protein, 417 aa, Burkholderia vietnamiensis G4
MAEIKNYTLNFGPQHPAAHGVLRLVLELDGEVIQRADPHIGLLHRATEKLAENKTFIQSVPYMDRLDYVSMMVNEHGYVLAIERLLGIDVPERAQYIRVLFDEITRVLNHLMWIGAHALDVGAMAVFLYAFREREDLMDVYEAVSGARMHAAYYRPGGVYRDLPDAMPQFKASKIRNEKALAKMNEARSGSVLDFIDDFFTRFPKCIDEYETLLTDNRIWKQRLVGIGVVSPERALQMGLTGPMLRGSGIAWDLRKKQPYEVYDRMDFDVPVGVNGDCYDRYLVRVEEMRQSVRIAKQCIEWLRKNQGPVMTDNHKVAPPSRVGMKTNMEDLIHHFKLFTEGFHVPEGEAYAAVEHPKGEFGIYLVSDGANKPYRLKIRAPGFAHLASLDEMARGHMIADAVTIIGTQDIVFGEIDR

SEQ ID NO: 35300 - protein, 453 aa, Francisella tularensis subsp. holarctica
MSNNHFDVISLGGGSGGIASAVQAAKFGKKVAIIEKRELGGTCVNRGCVPKKAMWYGANLAEILKHDVAGYGFDVEVKGFNWAKLKEKRATYIGNIHGFYDRLLDKWNITHFNNWGKFKDNKTIVLDDGTELTADHIFISPGAYPIVPKNIEGAELGITSDEFFELEETPKKAVIVGGGYIGVEIAGVLNAHGTDTTIMVRRDKPLMEFDNCISDALVECMQMTDLNIMNHTNITKVEKTGSTLKITTDTDKVLEDVDTLIWATGRAPNTHNLGIENTDIRITDKGVIPANEWSETNVAGVYSLGDASGVPQLTPVAIKTGRYLARRLFNGETNLKANLEYIPTVIFSHPAIGTVGLTEKEARDKYGDENVKVYKSRFTALYCAISGHRMPTVMKLVVTGDNEKIVGCHMIGLNVDEMLQGFAVAINMGATKRDFDDTIAIHPTSSEELVTLV

SEQ ID NO: 35301 - protein, 505 aa, Mycobacterium avium subsp. paratuberculosis K-10
MASRWRTKSVEQSIADTDEPDTRLRKDLTWWDLVVFGVAVVIGAGIFTVTASTTGDITGPAIWVSFVIAAGTCALAALCYAEFASTLPVAGSAYTFSYATFGEFLAWIIGWNLLLELAIGAAVVAKGWSSYLGTVFGFSGGTVKFGAAQLDWGALVIVGGVATLIALGTKLSSRFSAVITGIKVSVVVFVVVVGVFYIKRANYSPFIPKPEAGGQAKGIDQSVLSLLTGAHTSHYGWYGVLAGASIVFFAFIGFDIVATMAEETKHPQRDVPRGILASLGIVTLLYVAVAVVLSGMVSYTQLKTMPGRGQANLATAFTANGIHWASKIISIGALAGLTTVVMVLMLGQCRVLFAMARDGLLPRALAKTGSRGTPVRITVLVALVVAVTASVFPITKLEEMVNVGTLFAFVLVSAGVMVLRRTRPDLERGFKAPWVPVLPIASIGACVWLMLNLTALTWVRFGIWLVVGTAIYAGYGYWHSVQGRRDAGEPDRSDALAADPNSPVP

SEQ ID NO: 35302 - protein, 236 aa, Gossypium hirsutum
MGRGRVELKRIENKINRQVTFAKRRNGLLKKAYELSVLCDAEVALIIFSNRGKLYEFCSSSSMIKILERYQKCNYGAPEPNVSSREAALELSSRQEYLKLKARYDALQRSQRNLLGEDLGPLSSKELESLEKQLDSSLKLIRSTRTQYMLDQLNDLQRKEHLLNEANRTLKQRLVEGYQVNSLQLNPNATEDVGYGRQQVHHQPHGDAFFHPLDCEPTLQIGYQHDPMSVVTAGPV

SEQ ID NO: 35303 - protein, 251 aa, Burkholderia vietnamiensis G4
MSKQRTKRVIGNWKMHGRLAGNQALLNEVVQGADAVVAGTSIGVCVPFPYLAQVQAVLGGSRVAFGAQDVSAHEQGAYTGEVAAAMVAEFGAQYAIVGHSERRAYHGERNETVAAKAQRALAAGLTPVVCVGETLDEREAGTTEQVVGAQLDAVLAVLTADEAARIVVAYEPVWAIGTGKSATSAQAQDVHAVLRARLAAKGAAHVSVLYGGSVKPDNAEELFAQPDIDGGLIGGASLKAEDFLAICRAAR

SEQ ID NO: 35304 - protein, 387 aa, Geobacillus stearothermophilus
MKKKCIAMLLAGGQGSRLRSLTTNIAKPAVPFGGKYRIIDFTLSNCTNSGIDTVGVLTQYQPLLLHSYIGIGSAWDLDRRNGGVTVLPPYSVSSGVKWYEGTANAVYQNINYIEQYNPDYVLVLSGDHIYKMDYQHMLDYHIAKQADVTISVIEVPWEEASRFGIMNTNEEMEIVEFAEKPAEPKSNLASMGIYIFNWPLLKQYLQIDNANPHSSHDFGKDVIPMLLREKKRPFAYPFEGYWKDVGTVKSLWEANMDLLDENNELDLFDRSWRIYSVNPNQPPQYISPEAEVSDSLVNEGCVVEGTVERSVLFQGVRIGKGAVVKESVIMPGAAVSEGAYVERAIVTPDSIIPPHSSVCPEDADDVVLVTAEWLKQSNEETARKDEA

SEQ ID NO: 35305 - protein, 115 aa, Thermotoga maritima MSB8
MDHLVKIIEKKYEKKEIPDFRPGDTVRVHVKVIEGDRERTQVFEGIVIAKRGSGINKTFTVRRIGSHGVGVERIFPVHSPVVEKIEVVRKGKVRRAKLYYLRNVRGKIRIKERRD

SEQ ID NO: 35306 - protein, 230 aa, Magnaporthe grisea 70-15
MGREDQIEEREVLESIFPDEITDITETEFRISITLDIPEDDTESEPPVMLLTVQYPEAYPDVAPRLDLAAPQNSTSSHPYFNVSDDKETLLAGVEETINENLGMAMVFTVVSALKEAAEQLVVDRREAKAREQEEAALAAEREENKKFHGEPVNPESFMRWRAGFLKEMEEQRLREEEERLAELKKQKVKEPVKLTGKQLWQQGLVGKVVEDDDDDDAPVAEVEKLKVAA

SEQ ID NO: 35307 - protein, 195 aa, Silicibacter pomeroyi DSS-3
MRRASISRQTAETEISVDINLDGTGAYDNQTGVGFFDHMLDQLARHSLIDMTISAKGDYHIDDHHTVEDTGIALGQALSAALGDKRGIRRYGECHLPMDDAQVRCALDLSGRPFLVWNVDLPTAKIGTFDTELVREFFQAFSTHGGITLHVDQLHGLNSHHIAEAAFKAVARALRQAVESDPRKGDAIPSTKGTL

SEQ ID NO: 35308 - protein, 1806 aa, Streptomyces avermitilis MA-4680
MDLIPRGSAPRTRRTHRHSRTAAAVAAAALAVSLAQPLEARAATPPAPPSDAKLAAEPARHDATREQFYFVMPDRFANGDTSNDKGGLTGSRLSTGYDPTDKGFYQGGDLKGLTRKLDYIKGLGTTSIWLAPIFKNQPVQGTGKDASAGYHGYWITDFTKVDPHFGTNKDLETLISKAHAKGMKVFFDVITNHTADVVDYEEKSYGYLSKGAFPYLTKDGRPFDDAGYTDGPRKFPAVDGDSFPRTPAVAARKKNAKVPSWLNDPTMYHNRGDSTFAGESSTHGDFSGLDDLWTERPEVVRGMEKIYEKWVRDFGIDGFRIDTVKHVNTEFWTQWATALDAYAKKRGKDDFFMFGEVYSADTSVTSPYVTQGRLDSTLDFPFQDAARSYASQGGSAKKLASVFGDDYKYTTDKANAYEQVTFLGNHDMGRIGYFLNQDNPKATDAELLRKDRLANELMFLSRGNPVVYYGDEQGFTGSGGDKDARQTMFASKVADYLDDDEIGTDRGHASDAYDTSAPLYKEIAALSKLRKDNPALADGIQTERYAADGAGVYAFSRTDARTGTEYVVAVNNADKASAATFATGSADTAFKGIHGTDDVLKSDADKKITVTVPAGAAVVLKAAGRPGTPAAKPSLTLKAPDAGATGTVELSADVDGGRLNRVVFAAQVGNAKWRTLGSADHAPYRVTQTIGKDVPAGTALRYKAVVIDAAGRTASATAASTTGTPPAAETPTASSRDYAIVHYKRPDGDYTDWRLYAWGDLADGESTTWPAGHDFVGRDAYGAFAYVKLKPGASTVNFLVIDKDGDKDVSADRTIDVTKAGEVWVEQGKETVRTERPDYPAQDKTKAVIHYHRADGDLTGWGLHVWTGAATPTDWSKPLEPVRTDAYGAVFEVPLTDGATSLSYIIHKGDEKDLSADRSLDLTADGHEVWLLNGQENHLLPQPAGSAAALDLTTSKAVWIDRNTVAWNGSDAAASTQLLSSRDGSIAVKDGSLTSDDERWLRLSKTSLTDAQKAAFPHLKSYTAWSVDPRDRDRVREALAGQVVASQRAANGAVLAATGVQLAGVLDDLYDATKADLGPTFRGGHPTLAVWAPTAQSVSLELDGAHVRMKRNNATGVWSVTGPASWKGKPYRYVVKVWAPTVRKVVTNKVTDPYSVALTTDSERSLVVDLDDRSLAPSGWSSLKKPKAVPLRDAEIQELHIRDFSVADRTVPAKDRGTYLAFTDKNSDGSRHLRQLAESGTSYVHLLPAFDIATIAEKKSGQQATDCDLASYAADSEKQQECLTAVAAKDAYNWGYDPYHYTVPEGSYATDANGTRRTVEFRRMVKSLNQDGLRVVMDVVYNHTAAAGQAGTSVLDRIVPGYYQRLLADGSVATSTCCANTATENAMMGKLVVDSLVTWAKEYKVDGFRFDLMGHQPKANILAVRKALDALTVAKDGVDGKKIILYGEGWNFGEVADDARFVQATQKNMAGTGIATFSDRARDAVRGGGPFDADPGVQGFGSGLYTDPNSSDANGTPAEQKARLLHYQDLIKVGLSGNLAKYRFTDSSGKEVTGSEVDYNGTGAGYADAPGDALAYADAHDNESLYDALTYKLPKGTPAGDRARMQVLAMATAALAQGPSLSQAGSDLLRSKSLDRNSYDSGDWFNAIHWNCQDGNGFGRGLPMAADNKSKWPYATPLLTSVKVGCDQIEGTSAGYQDLLRIRTTEPDFSLSTAGQVQSKLTFPLSGKDETPGVITMKLGDLVVVFNATPDQQEQTVAALAGKDYALHPVQAAGADPIVKSASYTAKSGMFAVPGRTVAIFSQVAR

SEQ ID NO: 35309 - protein, 533 aa, Arabidopsis thaliana
MSFDELLRFVSEVQGERHAGLDYVQDIFHSVKHHNVFHHHGLVHLNAFYRYLFSDTNSPLPMSGQVHHDMKAPLSHYFVYTGHNSYLTGNQVNSRSSVEPIVQALRKGVKVIELDLWPNPSGNAAEVRHGRTLTSHEDLQKCLTAIKDNAFHVSDYPVIITLEDHLPPKLQAQVAKMLTKTYRGMLFRRVSESFKHFPSPEELKGKILISTKPPKEYLESKTVHTTRTPTVKETSWNRVANKILEEYKDMESEAVGYRDLIAIHAANCKDPSKDCLSDDPEKPIRVSMDEQWLDTMVRTRGTDLVRFTQRNLVRIYPKGTRVDSSNYDPHVGWTHGAQMVAFNMQGHGKQLWIMQGMFRGNGGCGYVKKPRILLDEHTLFDPCKRFPIKTTLKVKIYTGEGWDLDFHHTHFDQYSPPDFFVKIGIAGVPRDTVSYRTETAVDQWFPIWGNDEFLFQLSVPELALLWFKVQDYDNDTQNDFAGQTCLPRPELKSGVRPSGFTIEQQGLQEHEASRHVRLGSSLYVSLNLVFFPK

SEQ ID NO: 35310 - protein, 574 aa, Coccidioides immitis RS
MVFRAPAWVGELPPIPDDVAICDFMLDDKYGRYPLASSKDPFTCGMTGRTYSAAKVAERVDVLARALAKEFGWHPNKGTEWEKVVGIYSFNTIDFLVLCWAIHRCGGIASPANAVYSGPELTYQLKDSGAQSLFTCVPSLPIALEAAAKAGIPRNRIYILDLPTEFTGSTEAPQGMRTLEQFITEGYSLPKLEKLNFGPGQGARQTAFLCYSSGTSGLPKGVKIAHRNVIANTLQMMVYEAPHRNSLKPAGQSAFNDVALGLLPQSHIYSLVVMCHCGPYRGDQVIVLPKFELNHYLQTVEKYKIGTLYLVPPIIIAMLRNKELCDKRDLSAVRAIFTGAAPLGKETADELQQWKPSWLIKQGYGMTETCTVVCTTSSHDVWLGSSGSILPGIECVELTGYDEPGELVVKSPSVVLGYLNNEKATEETFIDGWMRTGDEAVVRVAPSGNEHIFIVDRIKELIKVKGLQVAPAELEAHILSHPDVADCAVIPVPDDSAGELPKAFVVKSSSAGSDDAATIRAIMKHVEDHKARHKWLKGGVEFLDVIPKSPSGKILRRLLRDKEREARRKAGAKI

SEQ ID NO: 35311 - protein, 318 aa, Solanum pimpinellifolium
MGSKYSKATNSINDASNLSYGVPFENYRVPFVDLEEATNNFDDNFFIGEGGFGKVYRGVLRDGTKVALKKHKPESSQGIEEFETEIEILSFCSHPHLVSLIGFCDERNEMILIYDYMENGNLKSHLYGSDLPSMSWEQRLEICIGAARGLHYLHKNAVIHRDVKCTNILLDENFVPKITDFGISKTMPELDQTHLSTVVRGNIGYIAPEYALWGQLTEKSDVYSFGVVLFEVLCARPALDRSEIMSLDDETQKMGQLEQIVDPTIAAKIRPESLRMFGETAIKCLAPSSKNRPSMGDVLWKLEYALCLQEPTIQDDPE

SEQ ID NO: 35312 - protein, 378 aa, Arabidopsis thaliana
MAQNGYLVPADPSAVVTVKKKTPQASWALIDATGQSEPLDVDKYEIMHRVQIHARDLRILDPNLSYPSTILGRERAIVLNLEHIKAIITSEEVLLRDPSDENVIPVVEELRRRLPVGNASHNGGQGDGKEIAGAQNDGDTGDEDESPFEFRALEVALEAICSFLAARTAELETAAYPALDELTSKISSRNLDRVRKLKSAMTRLTARVQKVRDELEQLLDDDDDMADLYLSRKLSSASSPISSIGEPNWYTTSPTIGSKISRASRASLATVHGDENDVEELEMLLEAYFMQIDSTLNRLTTLREYIDDTEDYINIQLDNHRNQLIQLELVLSSGTVCLSMYSLVAGIFGMNIPYTWNDGHGYMFKYVRNQNSIRMRMK

SEQ ID NO: 35313 - protein, 515 aa, Crocosphaera watsonii WH 8501
MIVILDFGSQYSELIARRIRETQVYSEVLSYRTTVEKLRQLNPKGIILSGGPNSVYDDRAPQCDPEIWQLGIPVLGVCYGMQLMVKQLGGQVEKATRGEYGKASLCIDDPTDLLTNVEDGSTMWMSHGDSCTRLPEGFSILAHTENTVCAAIANHEKKLFGVQFHPEVVHSVDGIALIRNFVYHICECEPTWTTEAFVDETIREIRAKVGDKRVLLALSGGVDSSTLAFLLHQAIGDKLTCMFIDQGFMRKGEPERLMDIFDRQFHIPVEYVHARDRFLNKLEGITDPEKKRRLIGHEFIQVFEEESKRLGPFDYLAQGTLYPDVIESADTNVDPKTGERVAVKIKSHHNVGGLPKDLRFKLVEPLRKLFKDEVRKVGRSIGLPEEIVRRHPFPGPGLAIRIIGEVTSERLNILRDADFVVRDEIAKQGMYHDFWQAFAVLLPVRSVGVMGDQRTYAHPIVLRLITSEDGMTADWAKVPYDLLEIISNRIVNEVKGVNRVVYDITSKPPGTIEWE

SEQ ID NO: 35314 - protein, 475 aa, Staphylococcus epidermidis ATCC 12228
MRNFTKQYINGEWVDSASGETIDVINPATEEVMGKIAKGNEEDVNKAVDAADKVYLEFRHSSVEERRELLDKIVKEYQNRKNDLIEAITDELGAPLSVSENVHYQMGLNHFTAARDALDSFQFEEQRGDDLVVKEAIGVAGLVTPWNFPTNQTSLKLAAAFAAGSPVVLKPSEETPFAAIILAEIFDKVGVPKGVFNLVNGDGSGVGNPLSEHPKVRMMSFTGSGPTGSKIMEKAAKDFKKVSLELGGKSPYIVLDDVDVEEAANATTKKVVNNTGQVCTAGTRVLIPESIKEDYLTAVKEAFSKVKVGQPREEGTQVGPIISKKQFDQVQDYIDKGINEGAELFYGGPGKPEGLDKGYFARPTIFINVDNHMTIAQEEIFGPVMSVITYNNLDEAIEIANDTKYGLAGYVIGKDKDTLRHVARSIEAGTIEINEAGRKPDLPFGGYKESGLGREWGDYGIEEFLEVKSIAGYFK

SEQ ID NO: 35315 - protein, 441 aa, Francisella tularensis subsp. holarctica
MKFSDLGLNSLICNALEKKGYTKPTPIQAQAIPIVLKGNDVMASAQTGTGKTAGFTLPIIQRLLDQPKAQANRIKTLILTPTRELAAQIQEQIQIYAANTHIRSAVIFGGVSINPQMMKLRKGVEILIATPGRLLDLYSQNAVKFDSLNTFVLDEADRMLDMGFINDLKKIHNLLPKKLQTLMFSATFSSEIKNLANEFLNNPQFVSADVVNTTVKKITQKIYTLDKSNKINALISLIKDQNLHQVLVFSRTKNGANKISEKLNNAGISSSAIHGNKSQTARTKALADFKSNDINVLVATDIAARGIDIAQLPCVINLDLSNVAEDYVHRIGRTGRAGQEGLAISLVSADEVESLSNIEHLIGHLLPREELEGFEATHNVPITSMSHKNKAKKIDEVKIIAAKRAKKNNNNKKPSNKNDFAKKIRQKIHQNKSVRKPKAKD

SEQ ID NO: 35316 - protein, 608 aa, Sinorhizobium meliloti 1021
MSIRNIAIIAHVDHGKTTLVDELLKQSGSFRENQRVAERMMDSNELEKERGITILAKATSVEWKGTRINIVDTPGHADFGGEVERILSMVDGAIVLVDAAEGPMPQTKFVVGKALKVGLRPIVAINKIDRPDARHEEVINEVFDLFAALDATDEQLDFPILYGSGRNGWMNVAPEGPQDQGLAPLLDLVLDHVPEPSVGEGPFRMIGTILEANPFLGRIITGRIHSGSIKPNQAVKVLGQDGKVLESGRISKILAFRGIERQPIEEAHAGDIVAIAGLSKGTVADTFCDPAINEPLKAQPIDPPTVTMSFLVNDSPLAGTEGDKVTSRVIRDRLFKEAEGNVALKIEESSEKDSFYVSGRGELQLAVLIETMRREGFELAVSRPRVVMHKDENGQLLEPIEEVVIDVDEEHSGVVVQKMSERKAEMAELRPSGGNRVRLVFFAPTRGLIGYQSELLTDTRGTAIMNRLFHDYQPYKGEIGGRVNGVLLSNDAGESVAYAMFNLEDRGPMIIDAGEKVYAGMIIGIHTRDNDLEVNVLKGKKLTNMRASGKDEAVKLTPPIRMTLDRALSWIQDDELVEVTPKSIRLRKMYLDPNERKRFEKSRTAGAA

SEQ ID NO: 35317 - protein, 1592 aa, Aspergillus oryzae
MDGQRQQQYIPVQPPPSAPASQSHILLPPPPPRYQPTQTQGVVPPPPPGPPPGTGYGAAKITNPQVQAQNTIGWQQKWAARQALSQGYLPPPPPPPLVPANQQLYNRTHLSIPSGEGRTSATYVPQPGTFGPGVGIPAFDSHTLSAYENQATLMDSDRQRPQVNQLYEYPSPDTAYKRDGTIPPTPSARTIPSALAANDGAHEQLPNHGQTTELTKSSSHRHNSSNTLPGGMSPSEAAAQWPLERVLLWLAKNGFSKDWQETFKALELQGADFIELGHGLNGRPNLGKLHNVVYPQLAKECESSGTGWDQTREREEGKRMRKLIRQIQEDGGYDAGIPIPKQRDSQTLPGSAPEGVLEASPMLTHEPLSAGPAANSPNLKTLQPAYPQRQSVQTRSFTTPIPASHDHLSSEPNSNDGTNWTRSDISRAALSSIAGDHRRQSPSVSSDGGHFFPPARPYEGSPKSGSPATQHATLAHQGASSSTSDLGVRFEHSRGNSSDSTTGRRYYESIRQDNTRPSPYDPYNRQLSGDNPSSYSKDHSNRLLHFFKKRSRTGDSNHPSPEEQFLESPTSPVNMRQNASHLPYTKPNFSSSDMSLGERPSSSSVSDHDRLALRAKSGHKGRKWAFATLDGWNYRLVDITETESVEVLRATICQNLGLSDWTGAQIFLTEPGQTEHDEPLNDPSLTLCRKTKSDSLGSLKFFVRGSHTYAGASSSPHVAGLGVSFPDKHTASPTSGQHQLHRKPLDDEALNRIAKPTSPQVASRQQLRTPAVKLPARDISHTPLSASPVDGGQDAGHLDPDKADLLARHEEHQREVERKQKAYRISKVSSVPQPRKDAYGETGYRREGVIDFDSPRISPYEDKKAEPLVPLRKPPTAPHESHTLTKVNSLRKKDADRPRVHQPVQTHGLGAVLASVGRMTSAIGTPTPSVSTSQAGTNNHANIEAPSESNIPDETKSTSQSPAGQDSQETPTSHTNQSPAKTAVPEEPRPTVQSRKSFGPEFDFEETNVSFQRSPMPQEDSDDDDSDDGLFAIPLANSKSPTKEKDSATGFSASQKLSAKPSLTVNTENRLRKGLSVSFRSPSATRETFASSSGDPDPRTGSLSDLTASPEEEKPPRRDSFARGDIWASRPPVEGVIEYLDDFFPNIDLDAPYLDGQGASPPSSPASRVAAESELSQKERPQPPPNPSESTLGSSEPTIKPQEANIVARRNVNRSGGLTRMKSIREVARGANQTSRNRSVTSSTGNQKSGDILRRKSTKMFGARIMQISPKPGSRLSQLDPIPQNNAPTTSVPQRQPTFRIIRGQLIGKGTYGRVYLGMNADNGEVLAVKQVEINPRIAGQDKDKMKDMVAAMDQEIDTMQHLEHPNIVQYLGCERGELSISIYLEYISGGSIGSCLRKHGKFEESVVKSLTQQTLSGLAYLHNQGILHRDLKADNILLDLDGTCKISDFGISKKSDNIYGNDSTNSMQGSVFWMAPEVIQSQGQGYSAKVDIWSLGCVVLEMFAGRRPWSREEAIGAIFKLGSLSQAPPIPEDVSMNISPAALAFMYDCFTIDSLDRPTAETLLTRHPFCEPDPKYNFLDTELYAKIRHVL

SEQ ID NO: 35318 - protein, 626 aa, Pediococcus pentosaceus ATCC 25745
MCGFAGYINQANVNKDTIKSMADRIKHRGPDDEAFFQDENASMGFRRLSIIDLAHGRQPMMNSAETKVLTFNGEIYNYKQVREELKELGYEFRTDVDSEVLIHGYDAWGPELLKKLRGMFAFVIYDKEKQEVFGARDHFGIKPLYYYDDDKTFLWGSEIKSFLEHPNFVKEFNEELLPIHLSFEFIPSKETMFKNVYKLLPGTYFIHKNGKTETHTYFKFNYDHIDESQTIEEDSKKIRKIVSDSVDAHMIADVEVGSFLSSGIDSSYVLAEAAKLKPIQSFSLGFRNSKYSELSYSTEFAKEINQKNTPLYMDGDDYFDILPTIMYYMDEPLSNPSAMQLFYLSKGTRKNVKVALSGEGADEFFGGYNTYLEAFTFERYQKMVPSFIRKGLAKAVSGLPRFHGRRFLMRGAQPLSERYYRVNYVFNQQERDQILRNPALNVDSGAYTQHIFDEVKGKDEMTQMQYFDINTWLPFDILHKADRMSMANSLEVRTPLVDREVAKFAATMPIKTRIHKEETKVSLRRAAEAELPERVAKKEKLGFPSPIANWIKEDKYRKRIEAAFNSDIAKKFFKPEALMHILDEHVNGKSSMQKIFTIYTFILWYGVFFPEDTNTNTIDLVKRTQV

SEQ ID NO: 35319 - protein, 601 aa, Xanthomonas oryzae pv. oryzae KACC10331
MQGVPGLGVVLAAVIHAHRQHAQGAGYQLLRARALVAVLGHPMHGAVQAFFQPPAQMHLVFAQLDAGDAAALKAGLARKHANARSGIGRVGAGKDGGHGDQYRIPGMYAPLDLYDTAAARTLDAQATTLLGGDGYILMQRAGQAAWQWLLERWPQARRIVVVCGTGNNGGDGYVLARLAHRAGRQVRVVHLPEHGPGSDLAQRACTDYLAVGGAIELFPYPLAQADVIVDALFGIGLNRAPDDAAAALIDAMNAAGVPVLALDVPSGIDADHGVAFGAAVNAALTLQFIVPHLGLSTGDALEHAGERAVASLEVPAAAFDGLTPAAHSWNGDALRAQLRPRRRNTHKGESGRVLCVGGNLGSGGAIMLTAEAALRSGAGLVQVATRAEHVTPLLARCPEAMVRAVQADDDVAALANAADAVALGPGLGQDAWAQALWRAALGTDTAVVIDADGLNLLAGNAVPARGPRILTPHPGEAGRLLGRSTAQIQRDRPAAAAALAKRYHAVAVLKGAGTVVAAPDALPRIIDAGNPGMAVGGMGDLLTGVIAALLGQGWSPFDAASLGALLHACAGDAAARAGERGLLPTDLLPELRRLANAGAIA

SEQ ID NO: 35320 - protein, 224 aa, Triticum aestivum
MRFKASPVVELPVGGAVLSFEQDNDSFEVGTSVWNSSLVLVKFAERCLGDEALPFADALRFAGARAIELGAGCGPAGMGLSRLGLADLVLTDTAAVLPALRRNLRRNRRHLPRAPRLAQLHWNCPAHLSQLAAPRRYDLVVAADVVYVQESVPHLVAAMDALADAERGVVLLGYQIRSPEAHQAFWDAVPAAFPVIEKVSREHLDPEYAFEESDVFILRRRPRQ

SEQ ID NO: 35321 - protein, 380 aa, Lactuca sativa
MSSTTNQVIRCKAAVAWEAGKPLVIEEVEVAPPQKMEVRIKILFTSLCHTDVYFWEAKGQNPVFPRILGHEAGGVVESVGEGVTELQPGDHVLPVFTGECKECAHCKSEESNMCDLLRINTDRGVMIHDQKSRFSINGKPIFHFVGTSTFSEYTVVHVGCLAKINPLAPLDKVCVLSCGISTGLGATLNVAKPKKGSSVAIFGLGAVGLAAAEGARIAGASRIIGVDLNANRFELAKKFGVTEFVNPKDYKKPVQEVIAEMTNGGVDRSVECTGHIDAMISAFECVHDGWGVAVLVGVPHKDAVFKTSPLNLLNERTLKGTFFGNYKPRSDIPSVVEKYMNKELELEKFITHELPFSEINKAFDLMLKGEGLRCIIRMGE

SEQ ID NO: 35322 - protein, 358 aa, Mycobacterium avium subsp. paratuberculosis K-10
MGTPEVDVVILVGGKGTRLRPLTLSAPKPMLPTAGLPFLTHLLSRIAAAGIEHVILSTSYQAAVFEAEFGDGSKLGLQIEYVTEERPLGTGGGIANVAGQLRHDTVMVFNGDVLSGADLGQMLDFHAAQQADVTLHLVRVSDPRAFGCVTTEDGRVTAFLEKTQDPPTDQINAGCYVFARRVIDRIPRGREVSVEREVFPALLSDPDVKVCGYVDATYWRDMGTPEDFVRGSADLVRGIAPSPALHGHRGEQLVHDGAAVSPGAVLIGGTVVGRGAEIGPGVRLDGAVIFDGVKVEAGSVIERSIVGFGARIGPRALIRDGVIGDGADIGARCELLRGARVWPGVSIPDGGIRYSSDV

SEQ ID NO: 35323 - protein, 231 aa, Brassica napus
MSPPPSWFMENQGEVYEGRRRGSESDEELKGLSYQEYRRLKRIKMRNTGRFCIWNNTPSPPRDPNEDENADDDDDDNLTKAKGESDSGKSQSETDRSRKRRGMRSYDSDSESVESESDSDKEDRRQRRRKIKSKRSRRSYDSDGESEESEEDRKKSTSIRKKRRYSDSDESSDASEISASSSGDEQHTKSKINRRKKLSGDGSDEGRRSKKKKRSGGLRSAFDASSYFFVS

SEQ ID NO: 35324 - protein, 450 aa, Silicibacter pomeroyi DSS-3
MAPVIYPTTNLTATEQLVLDRGKGIYVYDTDGNEYIEGLAGLWCTSLGYDNAEVIGAITDQLNRLPFTHTFGGKTHEPIMKLAEKLKAMVPVEDAYFFFGNSGSDANDTHYKMLRYYFNAIGKPEKRKIITRERGYHGVTVAAGSLTSLPANLAHFDAPVEALHILRSDAPHYYTGRQGNETEAQFVDRILDNLEQQILAEGADTIAAMIVEPITGASGVIVPPEGYYEKLQTLLRKHDILVWADEVICGFGRTGADFGCTTMGIKPDLMTFAKQLSSAYFPISASVIPGWMYEKMIAPSAAVGVFGHGYTYSGHPVACAAALKTLEIYERDDLFGHAAEVGAHMQEQLRAIFTDHPLVGEVRGKGLIAALELVSNKTTGATIEKGAGGATVQRLAQENGLLIRAVAGNSAALCPPLIITKEEVDEMLRRLKTAVDGAYAELKDKGLLAA

SEQ ID NO: 35325 - protein, 384 aa, Bordetella pertussis Tohama I
MPRLATRTNDFLTFQVVELFKEAQALQAAGRDIISLGIGEPDFTAPPQVVEALERATRAGLNGYSAPAGLSALREAIAAFYESEFGARVDPARIIVTAGASGALALACAALVNPGAQVLMPDPSYPANSNFVLAAGGQPRLIPSTAAKRFQLSAQDVRDHWNDATQGVLIASPSNPTGTSIAHDELAELLAAVRERQGFSIVDEIYLGLSYESQPRSALLLDDNIIVINSFSKYFHMTGWRLGWMIVPESMAAKVEKMAASLAICAPTLAQHAALACFTPDALKIFEHRREAFKQRRDYLLPEFERLGIPVPVRPDGAFYIYADIAALGTTSMAFSHRLLHEGGVAAVPGLDFGPAHGERTMRFSYATGLDRLQEAVARIEKLL

SEQ ID NO: 35326 - protein, 174 aa, Triticum aestivum
DLSPKDGDLSLVSRIRNVNGKPFSFSFAYHTYLSVSDISEVRIEGLETLDYLDNLSQRERHTEQGDAITFESEVDRVYVSSPNVIAVLDHEKKRTFVIRKDGLPDTVVWNPWEKKAKTMADFGDEEYKQTLCVDAAAAERQITLRPGEEWTGRLELSAVPSTNCSDHLDQPGIM

SEQ ID NO: 35327 - protein, 378 aa, Haemophilus influenzae R2866
MEIKQINSTIKSRAAVAFAPNQPLQIVEIDVEMPRKGEVLIRNTHTGVCHTDAFTLSGSDPEGVFPVVLGHEGAGVVVAVGEGVLSVKPGDHVIPLYTAECGECEFCRSGKTNLCVSVRDTQGKGFMPDCTTRFSYQGQPIYHYMGCSTFSEYSVVAEVSLAKINPEANHEQVCLLGCGVTTGIGAVHNTAKVQEGDSVAVFGLGAIGLAVVQGARQAKAGRIIAIDTNPAKFDLAKQFGATDYLNPNDYDKPIKDVLLDINKWGIDHTFECIGNVNVMRQALESAHRGWGQSIIIGVAGAGQEISTRPFQLVTGRVWKGSAFGGVKGRSELPQMVEDSMKGDIQLEPFVTHTMPLDQINEAFELMHEGKSIRTVIHY

SEQ ID NO: 35328 - protein, 329 aa, Schizosaccharomyces pombe 972h-
MEETAHELTVKQYVEQQRELEREAREVLPYSFDTCTYSMGYLKQPLYACLTCQKASGSLNAVCYSCSISCHADHDLVDLFNKRHFRCDCGTTRTHSIPCNLRKSVDECGSENDYNHNFEGRFCICDTVYNPETEEGTMFQCILCEDWFHEKCLQKTNKGIAIPDAETFEWLVCSECSEKYRDHLLNQKHESIAGTERAPLFLSENFRENLCPCESCISLRNLEMPMLVAEEPIYEPPEDSEDGISEMNEDPSESGEMIEQVISSTMNDVLRILDRLPRVQANESVYAYNRLKSELTDFLTPFARENRVVTKEDISNFFLERSRISKNLR

SEQ ID NO: 35329 - protein, 348 aa, Kluyveromyces lactis NRRL Y-1140
MSSHPFQVIDLCAPAEETSRLLLEAANTQGFLFIDGHSFSQQQVDALFRLSMEYFTNTPHHEKLQYAFDVAKNYGYTDYTREQGDPSKAKDFKECYNFGSINFSNGTYNGQSRSTSENCMQHGEVPPLFTYHNDLIVDSIKKFHELARNIMGLFTVALGIIQEDFFVSRFSDDKKNGCVMRLLHYPLFRDDGVDGSSGIDPTLRIGPHSDYGALTLLLQKEGEQGLEVQLDPGCDQWTKVPFLTSRYEGSAPPIVVNFGDMLSFWTKGVIRSTKHRVKIDPGETRSSDRYSIVFFTHPDADTTLDPVPSRVIESNSNGIGAPPVTAYEYLSAHLSRVINSIPSHDGMV

SEQ ID NO: 35330 - protein, 280 aa, Bacillus subtilis subsp. subtilis str. 168
MKKLYGVIGNPIGHSMSPDIHNASLKDLGLDGHYHAFKVEENDLEDAVKGIRALGVQGINVTVPHKVSIMDYLDHIDESAKVLGAVNTVRREGDKLVGYNTDGEGFVKSLMKVLDKPISELSFLMIGAGGAARAIFTTFVRNTPKKFDICNRTLEKAKRLTEATPSFHNKEVLSIKEAEERLEQYDVIIHTTSVGMYPNVDDVPLSLQRAASSAVVCDIVYNPIQTALLKEASQKGLKTLDGVGMFVEQAALSFQLWTGQEPNIEKMRSIVIGKLGGTEC

SEQ ID NO: 35331 - protein, 439 aa, Shigella flexneri 2a str. 2457T
MLPFLKAPADAPLMTDKHEIDARYRYWRRHILLTIWLGYALFYFTRKSFNAAVPEILANGVLSRSDIGLLATLFYITYGVSKFVSGIVSDRSNARYFMGIGLIATGIMNILFGFSTSLWAFAVLWVLNAFFQGWGSPVCARLLTAWYSRTERGGWWALWNTAHNVGGALIPIVMAASALHYGWRAGMMIAGCMAIVVGIFLCWRLRDRPQALGLPAVGEWRHDALEIAQQQEGAGLTRKEILTKYVLLNPYIWLLSFCYVLVYVVRAAINDWGNLYMSETLGVDLVTANTAVTMFELGGFIGALVAGWGSDKLFNGNRGPMNLIFAAGILLSVGSLWLMPFASYVMQATCFFTIGFFVFGPQMLIGMAAAECSHKEAAGAATGFVGLFAYLGASLAGWPLAKVLDTWHWSGFFVVISIAAGISALLLLPFLNAQTPREA

SEQ ID NO: 35332 - protein, 411 aa, Medicago sativa
MASVGVAPTSGFREVLGDGEIGVDDILPEEMSDMKIRDDREMEATVVDGNGTETGHIIVTTIGGRNGQPKQTISYMAERVVGHGSFGVVFQAKCLETGETVAIKKVLQDKRYKNRELQTMRLLDHPNVVSLKHCFFSTTEKDELYLNLVLEYVPETVHRVIKHYSKLNQRMPMIYVKLYTYQIFRALSYIHRCIGVCHRDIKPQNLLVNPHTHQVKLCDFGSAKVLVKGEPNISYICSRYYRAPELIFGATEYTTAIDVWSVGCVLAELLLGQPLFPGERGVDQLVEIIKVLGTPTREEIKCMNPNYTEFKFPQIKAHPWHKIFHKRMPAEAVDLVSRLLQYSPNLRCQALDCLTHPFFDELRDPNARLPTGRFLPPLFNFKPHELKGVPVETLMKLVPEHARKQCPFLGL

SEQ ID NO: 35333 - protein, 411 aa, Medicago sativa
MATAGVAPASGIVDVNASSAIAVDKLPDEILGMRIKDDKEMEAHVVDGNSTEAGHVIVTTIGGKNGQPKQTISYMAERAVGQGSFGVVFQAKCLETGETVAIKKVLQDKRYKNRELQTMRLLDHPNVVTLKHCFFSTTEKDELYLNLVLEFVPETVHRVIRHYSKMNQRMPLIYVKLYSYQICRSLAYIHNCVGVSHRDIKPQNLLVNPHTHQLKLCDFGSAKVLVKGEPNISYICSRYYRAPELIFGATEYTSAIDIWSAGCVLGELLLGQPLFPGASGVDQLVEIIKVLGTPTREEIKCMNPNYTEFKFPQIKAHPWHKIFRKRMPPEAVDLVSRLLQYSPNLRSTALEALVHPFFDELRDPNTRLPNGRHLPPLFNFKANELKGVPAEMLVKLVPSHARKQCSLFASS

SEQ ID NO: 35334 - protein, 239 aa, Arabidopsis thaliana
MSLIEDCLRSYRFIAIDTEFPSTLRETTQHATDEERYMDMSFSVDRAKLIQLGLTLFDINGRIGGTWEINFSDFGVDDARNEKSIEFLRRNGLDLRKIREEGIRIEGFFSEMFWMLKKTRRNITWVTFHGSYDIAYLLKGFTGEALPVTSERFSKAVARVLGSVYDLKVMAGRCEGLSSRLGLETLAHEFGLNRVGTAHHAGSNNELTAMVFAKVLSPFPLFLRFGSLELRTIESEAIV

SEQ ID NO: 35335 - protein, 118 aa, Zea mays
MASLDSDVNMIPAGESSSSVAASSSSKKAKRFEVKKWSAVALWAWDIVVDNCAICRNHIMDLCIECQANQASATSEECTVAWGVCNHAFHFHCISRWLKTRQVCPLDNSEWEFQKYGH

SEQ ID NO: 35336 - protein, 559 aa, Solanum tuberosum
MGSSGDAWKLKDHPKLPKGKTVAVIVLDGWGEAKPNEYNAISVAETPVMDSLKQGAPEHWRLIKAHGNAVGLPTEDDMGNSEVGHNALGAGRIFAQGAKLVDLALASGKIYDGEGFKYVQECFEKGTLHLIGLVSDGGVHSRLDQLLLLLKGAAERGAKRIRVHALTDGRDVLDGSSVGFMETLENDLAKLREQGVDARVASGGGRMYVTMDRYENDWDVVKRGWDAQVLGEAPHHFKDPVEAIKKLRQEPNTSDQYLAPFVIVDDNGKPVGPILDGDAVVTFNFRADRMVMLAKALEYEDFDKFDRVRVPKIHYAGMLQYDGELKLPNKYLVSPPEIDRTSGEYLVRNGVRTFACSETVKFGHVTFFWNGNRSGYFDEKLEEYVEIPSDSGITFNVKPKMKALEIAERTRDAILSHKFDQVRVNIPNSDMVGHTGDIKATIEACKAADDGVKMILEAIEQVGGIFLVTADHGNAEDMVKRNKKGEPLLDKNGNIQILTSHTLEPVPIAIGGPGLLPGVRFRTDLPTGGLANVAATFMNLHGFEAPSDYEPTLIEVVDN

SEQ ID NO: 35337 - protein, 381 aa, Glycine max
MFISRSILFVFVFSACLLLFPANGIRSFATTNGYETEVEEVDPFVQFREAPEYRNQQKCTLIDTTNVQLVCDPSLVHVAMTIDWHYLRGSIAAVHSVVKHTSCPQNLFFHFIASDARLESKDVFERIVHTSFPSLGFKVYVFRESLVGNLISPSIREALDNPLNYARSYLADLLDQCIERVIYLDSDVVVVDDVQELWKVSLTGSRVIGAPEYCHTNFTRYFSYEFWSSAEFSEVFQGKRPCYFNTGVMVMDLVRWRAGDYTRKIEKWMEIQKERRIYKLGSLPPFLLAFGGNVEAIEHRWNQHGLGGDNVRNSCRTLHPGPVSLLHWSGKGKPWTRLDAKMPCSVDFLWAPYDLYIPHHHTHHQHHHHQRIAIGSTHSSF

SEQ ID NO: 35338 - protein, 303 aa, Arabidopsis thaliana
MNSSSPISIDLIAEILSRVPSKSVARFRCVSKPWASMIRRPYFTELFLTRSSPKPCILFATVADGVWSFFSLPQYPYEKSSSASVAASAKFHVKFPPNNMRIGHNSDRRYFSYGYTSGLIYLYGDSSDDRSVICNPYTGEYAILPYLQRYRKTYSFLVFEPIEKQFKILFMAYLSGDRDHKILTVGTGNMKWRTIRCSLRYEIVSVAPTTAAWGDIVFSMCEYTPGQPFYVFYFNPEKSTLQRVEIQGFGEGVCSVYTFVDDVEDLNVKDLKILKPSNAPFEKTEDSEYEEEYEEEDGDDGWS

SEQ ID NO: 35339 - protein, 345 aa, Zea mays
  misc_feature (41)..(41): Xaa can be any naturally occurring amino acid
VFATCCADMINRWENSMSSKEPSEMDVWPEFQNLTGDVISXTAFGSNYQEGRNIFQLQGEQAERLIQSFQTIFIPGYWLLPTKNNRRMKEIDREIRKILHGIIRKRERAFKNGEASSDDLLGLLLESNMQQSNGKAKLGLSIEDIIQECKLFYFAGMETTSVLLTWTLIVLSMHPEWQEQAREEVLHHFGRTTPDFENLGRLKIVTMIFYEVLRLYPPITFLTRRTYKAMELGGIKYPAGVNLMLPILFIHHDPDIWGKDAREFNPQRFADGISNAAKHPAAFFPFGGGPRICIGQNFALLEAKMALSIILQRFSFELSPSYVHAPYTVITLQPQHGAQIRLKKI

SEQ ID NO: 35340 - protein, 204 aa, Brassica napus
MGSSSGTSGYDLSFKILLIGDSGVGKSSLLLSFISSSVQDLAPTIGVDFKIKQLKVRGKRVKLTIWDTAGQEKFRTLTSSYFRGSQGIILVYDVTKRETFLNLADVWAKEIELYSTNHDCIKMLVGNKVDIESERKVSREEGTALAKELKFLFHECSARTRENVKQCFEELALKIMEVPSLLQEGSNSLKRKPDSRTHQSRCCS

SEQ ID NO: 35341 - protein, 461 aa, Saccharophagus degradans 2-40
MKTFNPDFVWGAASSAYQVEGATTTDGRGPSIWDAFSSIPGKTYHNQNADIACDHYNRWQEDVAIMKEMGLKAYRFSISWSRIFPTGRGEVNEKGVAFYNNLIDELIKNDITPWVTLFHWDFPLALQMEMDGLLNPAIADEFANYAKLCFARFGDRVTHWITLNEPWCSAMLGHGMGSKAPGRVSKDEPYIAAHNLLRAHGKMVDIYRREFQPTQKGMIGIANNCDWREPKTDSELDKKAAERALEFFVSWFADPIYLGDYPASMRERLGERLPTFSDEDIALIKNSSDFFGLNHYTTMLAEQTHEGDVVEDTIRGNGGISEDQMVTLSKDPSWEQTDMEWSIVPWGCKKLLIWLSERYNYPDIYITENGCALPDEDDVNIAINDTRRVDFYRGYIDACHQAIEAGVKLKGYFAWTLMDNYEWEEGYTKRFGLNHVDFTTGKRTPKQSAIWYSTLIKDGGF

SEQ ID NO: 35342 - protein, 362 aa, Brucella melitensis 16M
MWSKRKVGALARPDRAHAAPGEMALGVVLNLDGKMKQEGSVQPLVDLTRADMARVNELILSRAGSDVEMIPEVANHLISSGGKRLRPMMTLASARMFGYEGDGHVRLATSVEFMHTATLLHDDVVDESDLRRGKSTARTIWGNQASVLVGDFLLGQAFKMMVDVGSLDALDVLATSASIIAEGEVMQLAAAKNMETTEDEYLAVIKAKTAALFSAAAEVGPIIAGAQRSDRAALRDYGLNLGLAFQLVDDALDYGGSAADLGKNTGDDFREGKITLPVILSYRRGTDEERAFWKGAIEGGASDDASLQKAIGLMMKHGAIADTVQRARHFGEIARDALAPLKASPQKDALIEVVDFCISRVN

SEQ ID NO: 35343 - protein, 110 aa, Thermus thermophilus HB8
MLSMECVFCRIIAGELPSRKVYEDEGFVAFHDIRPKAPVHVLVVPKEHVEKLSDYPDTEEGERKLGALFRTANRVARLLGLQGYRVQVNVGEKGGQEVFHVHVHVMGGWG

SEQ ID NO: 35344 - protein, 579 aa, Coccidioides immitis RS
MSSATMDFFRPDEYLPLPTKDILSWIFDDPQYDQDKPVNETLSPPFPSTCWVISTLLNYIQIYINPHNASESISCNQARVLVRKLIAGLRANGFKNGDCLNVHSFNDIYYPILFLAVIGAGGVFAGTNPSYTQFELSHHIKTARVNFLISEPEILENVLLAAKDNNIPSSRVWVFNTNGRPLPPGCSSWTDLMNYGEEDWVRFNDLDTCKNTTAARLFSSGTTGLPKAAVISHYNLIAQHELVFGVISLPYEISRIVAVPMFHASAVPSTHTSALKAGHVVYVMRRFDLEAFLKVSQKYKVTEASTVPPMAVAIVKSPLSKQPFLKSVRSGAVGAAPLDKGVQAQFRALLSERGRYTQVWGMTETSCVATRFPWPEDDTTGSVGRPIPCLEMKLIDDSGNNISAYDTRGEICVRGPTIISGYFENPHANAESFDSDGFFKTGDIGYCDSKTKKWYIVDRKKELIKVRGFQVAPPEIEAVLLSHPLIMDAAVIGVTLPGEEKVEHPRAIVVRQPVPEAQSLSEEEVKRFAAARLAKYKSLTGGVKFVDSIPKNASGKILKRLLREQAKEEIKQGLVVPKL

SEQ ID NO: 35345 - protein, 434 aa, Arabidopsis thaliana
MDHVSSLPDEVLYHILSFLTTKEAALTSILSKRWRNLFTFVPNLDIDDSVFLHPQEGKEDRYEIQKSFMKFVDRVLALQGNSPIKKLSLKLRTGFDSHRVDGWISNALARGVTELDLLIILNLVTLKLNSVRVDWLAAGDIFLPMLKTLVLHSVRLCVDNVNWGGKDVNVSNASLKILTVNYNICLGTFSVDTPSLVYFCFTEYVAIDYPVVIMQNLFEARISLLVTQDQIERARAPNIDWVEDDVVLRLVNMEKLIKGIRNVQYMYLSPNTLEVLSLCCESMPVFNNLKSLTLKSHKSRGWQAMPVLLRNCPHLETLVLEGILHHVTDKCGYACDCVSREEKGCSLTSCPVKVLEIKGFRGTIKEMHMIKHFVNYFPCLMETNIYIEESGPPKLRVPQVCEFIAEMMEHYGKSSSFNVQLLVGGYLYKKWTAQ

SEQ ID NO: 35346 - protein, 469 aa, Streptomyces avermitilis MA-4680
MFQNADEAKKYIADEDVKFVDVRFCDLPGVMQHFTIPAEAFDPAEELAFDGSSIRGFQAIHESDMALRADLSTARVDPFRRDKTVNINFFIHDPITGEQYSRDPRNVAKKAEAYLASTGIADTAYFGPEAEFYVFDSVRFKTAENESFYHIDSEAGAWNTGAIEDNRGYKVRYKGGYFPTPPVDHFADLRAEISLELANSGLQVERQHHEVGTAGQAEINYKFNTLLAAADDLQLFKYIVKNVAWRNGKTATFMPKPIFGDNGSGMHVHQSLWANGDPLFYDEAGYAGLSDTARYYIGGILKHAPSLLAFTNPTVNSYHRLVPGFEAPVNMVYSQRNRSAAMRIPITGSNPKAKRVEFRAPDSSGNPYLAFSALLLAGLDGIKNKVEPAEPIDKDLYELAPEEHASVAQVPTSLPAVLSALEADHEYLLQGNVFTPDLIETWIDYKRTNEIAPLQLRPHPHEFELYFDV

SEQ ID NO: 35347 - protein, 557 aa, Chlamydomonas reinhardtii
  misc_feature (537)..(538): Xaa can be any naturally occurring amino acid
MAHDYKLKAHPAIPAPEGPLLVCILDGFGENEYKDEFNAVHVAKTPTVDALRAVPHRFRSIKAHGKAVGLPSDADMGNSEVGHNALGSGQVVDQGARLVDLALETGRMFSDPGWKLISEAFPSHTVHFIGLLSDGGVHSRADQLHGCLRGAVERGAKRVRVHILTDGRDVPDGSSIRFVEELEAVLAELRGKGCDIAIASGGGRMQVTMDRYEADWSMVKRGWDAHVLGKAPHYFKDAKTAVTTLRGSEDAPVSDQYVAPFVIVDEADKPVGTIEDGDAVVLFNFRADRMVEISKAFEYEDGFTAFERERFPKGLRFVGMMQYDGDLKLPANFLVPPPLIEHVSGEYLCKNGLSTFACSETQKFGHVTFFWNGNRSGYLDAKQEQYLEIPSDKIEFNKAPDMKAREITAAGIEALKSGKYKVVRINYANPDMVGHTGDMAATVRACETVDGCVKELLEVVDSLNGRWIVTSDHGNADDMVQRDKKGKPLLGEDGKPLPLTSHTLAPVPFFIGGKGLPDGVVLRDDLPDAGLANVAAXXFNLLGFEAPGIYKPSMVKA

SEQ ID NO: 35348 - protein, 377 aa, Agrobacterium tumefaciens str. C58
MAKADFYETLGVSKTADEKELKSAFRKLAMKFHPDKNPDDADSERKFKEINEAYETLKDPQKRAAYDRFGHAAFENGGMGGGGMGGGGFANGGFSDIFEDIFGEMMGGGRARRSSGGRERGADLRYNMEITLEEAFAGKTAQIRVPTSITCDVCSGSGAKPGTQPKTCATCQGSGRVRAAQGFFSVERTCPTCHGRGQTISDPCGKCHGQGRVTEERSLSVNIPSGIEDGTRIRLQGEGEAGMRGGPAGDLYIFLSVRPHEFFQRDGADLYCTVPISMTTAALGGTFDVTTLDGTKSRVTVPEGTQPGKQFRLKGKGMPVLRSAQTGDLYIQIQIETPQKLSKRQRELLQEFEQLSSKENNPESTGFFARMKEFFDG

SEQ ID NO: 35349 - protein, 431 aa, Francisella tularensis subsp. holarctica
MENKSNSQILFAEAQQYIPGGVNSPVRAFKSVGQEFPRFIKFAKGAYLYDVDWNKYIDYIGSWGPMILGHCDDDVLEAIQCQVKNGLSYGAPCKQEVDLAKKIIELMPNIEQVRFVNSGTEATISAIRLARAYTCRNKIIKFEGCYHGHADEFLVAAGSGALSLGQPNSPGVPEDVVKDTLVASFNDMESIQALFEKYKDEIACIIVEPIAGNMNMIFPQDGFLAKLRAICDQNSSLLIFDEVMTGFRVALGGAQSIYNVKPDLTTLGKVIGGGMPVGAFGGRKEIMQKVSPAGPVYQAGTLSGNPIAMTAGIKTLEKISQPGFFDELGVKAQKLVDGLNEAAKAYDFNFHAKCLGGMFGLFFCSDKIAVNTFVDLGKTNLKMFNQFFAYMLDNGVYLAPSAYEAGFISIAHSDEDIEKTICLAKKFFQEN

SEQ ID NO: 35350 - protein, 274 aa, Nostoc sp. PCC 7120
MDASELLETITLLIEQAEQGEIDPWDVKVIEVIDRYLELMTPKTTARGYESDLSQSGQAFLSASMLVLFKANTLMQLSTAEDLEDIEDGLLAENGDGLFHQTHRLPLERVLRRRPAAMPPPKRRVTLQELIAQLQIMANQLKLVQKVSKPERPKRQPTVKAMREALELAHQENLTEVAGELEQVLHFSAKELLLEQNYLNLEQLVQLWTQTKQSHQLSAHESVNSHLVSVFWALLLLSAQSKVELVQEEFYQEVRIRLLSDSANTYQSLEQPIN

SEQ ID NO: 35351 - protein, 389 aa, Nostoc sp. PCC 7120
MKAMILAAGKGTRVRPITYTIPKPMIPILQKPVMEFLLELLRQHGFDQIMVNVSHLAEEIENYFRDGQRFGVQIAYSFEGKIDDEGKLVGEAIGSAGGMRRIQDFSPFFDDTFVVLCGDALIDLDLTAAVKWHKSKGSIATIITKTVPEEEVSSYGVVVTDENSRVKAFQEKPSIEEALSTNINTGIYIFEPEVFNYIPSGVEYDIGGQLFPKLVEIGAPFYAIAMDFEWVDIGKVPDYWRAIRGVLQGDIKNVQIPGHEVAPGIYTGLNVAVNWDKVDITGPVYIGGMTRIEDGAKIVGPAMIGPNCWICGEATVDNSVIFEWSRLGHGARLVDKLVFGRYCVDKTGAAIDVQAAALDWLITDARQTPPEHTPVERQAIAELLGTNAT

SEQ ID NO: 35352 - protein, 475 aa, Frankia sp. CcI3
MTIPNPAATGIGLPATGGPRLPQEPRLHTEIPGPRSRALAARRVGAVARGVGETLPVYAHAAGGGVVVDVDGNSLIDFGSGIAVVSVGNAADGVVEAVREQIGRFTHTCFMVTPYEGYIAVCEALNRLTPGTHEKRSALFNSGAEAVENAVKIARSATGRGAVVVFEHAYHGRTNLTMAMTAKSMPYKSGFGPFAPEVYRMPLAYPYRWPTGPDRCGEEAAERVIELVRDEIGAASVAAMVIEPIQGEGGFIVPGTGFLPRLAEFCTVAGIVFVADEVQTGFARTGTMFACEHEGVVPDLITTAKGIAGGLPLAAVTGRAEIMDAPQVGGLGGTYGGNPAACAAALAAIDLIESEDLAGRARRIGEIALPRLHALRERYDFVGDVRGRGAMVALELVRGAGDDSPDKVLTAAAAAACHRRGLIVLTAGTWGNVLRLLPPLVIEEPLLLAGLDLLDEAFAELAARRQPPSPARPEG

SEQ ID NO: 35353 - protein, 117 aa, Nostoc sp. PCC 7120
MGLKFLQVSKELAEQHYGVHRERPFFPSLVEFITSGPVVAMVWEGDGVIASARKIIGATNPLTAEPGTIRGDFGINIGRNLIHGSDAPETAQKEVSLWFTDAELVNWQPHLTPWLHE

SEQ ID NO: 35354 - protein, 480 aa, Frankia sp. CcI3
MSEPTPFWLAGKPATGSATTTVRHPFDGAEVAVVAQPDPDQVETAVAAAAAVAPAFAALPAHVRAGALAGVSKEIARRGDELARLITAESGKPLTWSRAEVARASSTFRWGAEEARRFAGELTRLDTDPPGEGRLALTRRFPRGPVLGITPFNFPLNLVAHKVAPALAVGAPIIVKPAPRTPLSALFLGDLLADAGLPEGSWSVLPIPNDRLGPLVADPRLPVVSFTGSGPVGWSIRDTVPRKHVVLELGGNAAVLVAADYATPADLARAAGRIALFANYQAGQSCIAVQRVYADRTIVDELLAEIVAAVRALHDGDPADPATDVGPLIDVAAAERVEAWITEAVEAGATLVCGGTRHGTSLSPAVLTGVPPTAKVVSEEVFGPVIVVAAVDGVDEGFARINDSAYGLQAGVFTHDLATAFRAHRELQVGGVVIGDVPSYRADQMPYGGTKGSGIGREGVRSAMTDLTEDRVLVLTGLDL

SEQ ID NO: 35355 - protein, 374 aa, Ostreococcus tauri
MTVAGLDSSRLRVKITGRSLPRCADEDLGFGTVITDHMLKVEWSVERGWNAPMIIPAGPVGLHPFAHVFHYAVECYEGMKAYVDANGDVRLFRPRMNMQRFRTSAKRLSLPDFDGEELLKCIETLVDIDKDWIPRKRGFSMYLRPVIFSTTPWLGLTQCAEAMILVLCCPVGPYFKSGFVPIKLSVDAKYIRAWPGGTGNVKAGGNYGPTVISQANATAAGASQSLFVYDKHEYVTEAGTMNVFFLIRNERGVKQLITPSLEDGTILPGVTRQSVIELSQQWGECETIERMIPFGDIKAAFERGDVLEIFGTGTAAVIQPISGIVYEGVEYKPITEFNDKALQVRLTNFLVSVQYGDIDHPWSHVVPKSTWSKR

SEQ ID NO: 35356 - protein, 225 aa, Burkholderia vietnamiensis G4
MSIRFCRKGVLMNRPKSMLVANIAWARETREHTPGFFDTLARGQNPRVLWIGCSDSRVPAETITHSVPGELFVHRNIANLFHPDDDNSASVLEYAVRVLKVDHVIVCGHYGCGGVRASLLPPPADLPHVARRIAPLCALARRHRDTLGGLDETAAADRLAELNVLEQVRLLRASPIVRDRERPPLVHGWIFSLADGRLKELDSGYTAPEPAESDLEHAATAAAVG

SEQ ID NO: 35357 - protein, 276 aa, Silicibacter sp. TM1040
MTENRIPLAGVIGCPIAHSKSPQLHRHWLKTYGVDGHYMPMHVEPEDLESVVRMMPRMGFVGANVTIPHKQSIMEIADKVTDRAKLMGAANTLIFHEDGAIVADNTDGYGFITNLHEGAPDWDAKSGPATVFGAGGASRAVIASLIEAGVPEIRLTNRTRSRAKEVAQTFGSKVTAVDWVEAGNVIEDASLVVNTTSLGMTGQRRLRVPLDGLHSGIVVTDLVYNPLKTELLQAAEEAGCTVVDGLGMLLHQAVPGFERWFGQRPEVNSAARDAIL

SEQ ID NO: 35358 - protein, 623 aa, Oryza sativa (indica cultivar-group)
MEYVESLKSVEVPDSIDTLDIVNALDSIEGLESEMVLDSAEVPNSVEVVLESVEVAPDSVEVVQCPRCGTFHAGGVFGEACFQARRRARRCARCGLLHEDYDLIARFLHNMEKFDCELYIPDVEKLQMDGETILLPEHVIKKLEEIYSMKELEDAKMKQEQSGRDERGAEVRAAGPGRERRGDRGAHRGDEHLLPRRLAGGGVGVRPRGAPPHHRAVGGMFLAGSAATAAASGYAALMAGQLVAGVACGFGLVVAPVYIAEIAPPSSRGFLASIPEIAGNSGILLSYIADFALAGLPMSLNWRLMIGIGAVPPLFLAAAALLAMPETPRWLVLHGHHDDARQVLVRTTGGDAALAERRLQEIVSSVKESATKQQLSAAAAAAAAGGASTGVWRDILVRPTPAVRRVLFAILGLQFFQQASGVAAMVLYAPRVFNHVGVTSERAVLGATVLLGATKTASIVVPLFLADRLGRRPMLLSSAGGMAVSLLVLGFSLRVSSSSGSGSEWWAAATSVAAAAAFMATFSLGFGPVIWMYGSEILPLRLRAQGTGIGTAANRVMSAAVGMSFISLYEAAGMAGTFYLFAACSAAAWVFVYACLPETKGRSLEEMEALFDAAHPSSPPPAS

SEQ ID NO: 35359 - protein, 152 aa, Bordetella pertussis Tohama I
MLKVSEILRVKGDTLYTASPDTHVSVAVQTMSEQDIGSLVIMESGMLAGMLTFREIIRHIDQHGGNVGDTTIRAIMDDAPVSVSPNTSADEVQRLMLEKHARYIPVMDGPTLLGVISFYDMAQAIVAAQQFENNMLKAYIRDWPMESAPSKP

SEQ ID NO: 35360 - protein, 297 aa, Kluyveromyces lactis NRRL Y-1140
MADFKVKSGLAQMLKGGVIMDVVTAEQAIIAEKAGACAVMALEQIPADMRKSGKVCRMSDPKMIKEIMNSVSIPVMAKVRIGHFVEAQILQALEIDYIDESEVLTPADWKGHIKKNDFNVPFVCGAKDLGEALRRIEEGAAMIRTKGEAGTGDVSEAVKHIKKIKSEIKEYQDTLGDDTDFIKQRAESIGVSYELLKYVLDNGKLPVVNFAAGGVATPADAALLMQLGCEGVFVGSGIFKSSDPEKLARAIVEATTHYDDAETLLKVSTDLGDLMGGLSIESLKNSENPKRLANIGW

SEQ ID NO: 35361 - protein, 478 aa, Arabidopsis thaliana
MKIELVFIPLPGIGHLRPTVKLAKQLIGSENRLSITIIIIPSRFDAGDASACIASLTTLSQDDRLHYESISVAKQPPTSDPDPVPAQVYIEKQKTKVRDAVAARIVDPTRKLAGFVVDMFCSSMIDVANEFGVPCYMVYTSNATFLGTMLHVQQMYDQKKYDVSELENSVTELEFPSLTRPYPVKCLPHILTSKEWLPLSLAQARCFRKMKGILVNTVAELEPHALKMFNINGDDLPQVYPVGPVLHLENGNDDDEKQSEILRWLDEQPSKSVVFLCFGSLGGFTEEQTRETAVALDRSGQRFLWCLRHASPNIKTDRPRDYTNLEEVLPEGFLERTLDRGKVIGWAPQVAVLEKPAIGGFVTHCGWNSILESLWFGVPMVTWPLYAEQKVNAFEMVEELGLAVEIRKYLKGDLFAGEMETVTGEDIERAIRRVMEQDSDVRNNVKEMAEKCHLALMDGGSSKAALEKFIQDVIENMD

SEQ ID NO: 35362 - protein, 217 aa, Nanoarchaeum equitans Kin4-M
MIYLIGLGIRKGDISYRAIELLKNLDKIYLDSYTVYINSYYKDYIKWLENIIDKKIIFADRALVEEQLEEIAKKEDVALLTIGDPLFATTHIYQFKDLIKDIIHAPSVLNYIYNLGLSPYRFGRIISIPHPSKGLYDIESKIEVNLKNDLHTLILLDTDPVLDYKTAIKVYNLDKYCTIAVSIGEKIVYGKEIDAPPPHALIIPAKLMHYEKDFIQC

SEQ ID NO: 35363 - protein, 378 aa, Arabidopsis thaliana
MSTMSDLFPDLVEEILSRVPITSLKAVKLTCKQWNDLSKDSSFTKNHYGKEAKEIQVIMICDLKACLMSVNLHNHKDLADPSIKQIGKLNQVEIDSVFHCDGLLLLLLCNPKDNSKLMVWNPYLGQTRWIQPRNNSHKHRPAGRFNHRPAGRFYMGYDSNNNHKILWFSSMYREYEIYDFKSDAWTVIDVNTDQDHIIDNQRVSLKGNVYFIAHDILKEEAFLLSFDFTCERFGPSLPLPFHCCHEDTVLLSTVREEQLAVLFQKSDAYEMGIWITTKIELNIVLWSKFLKVDMTLPNSYWFEDLSFFLVDEKKKVAMVSELDIETCKNYKTYILGENGYYREVDLRKSKGCVYLCVLMFQVWCKSSKVPVLARCERK

SEQ ID NO: 35364 - protein, 828 aa, Escherichia coli K12
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGANMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEDLLAKKPELRGKTLYEVLYATPEVSKFPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 35365 - protein, 121 aa, Borrelia burgdorferi B31
MDLIRKIEAQNKKNEAFVFNVGDTVRVVYKIIEGSNERLQSFEGIVISFQNKGIGKTFLIRKISSGIGVEKIFPVYSPIIEKVEVLRRGKVRRAKLYYMRNRIGKAAMKIKERLTIKKVKH

SEQ ID NO: 35366 - protein, 354 aa, Zea mays
MATSSVLPFHLPSCARRASTAARASAAPVAAAAATTAQSLEESFGRKGLRFVADPAGGAPAAELSVRNGSSLHLRLGDGLVTSYKPKVQWKDDGCREVLHTVGGKGGVGLVLSDQASGGQSSLLDGAEWAVRDADSDSYDAVQVELGCTMGKLDISYVVTLYSLSMATAVIVRNTGSKPVALTGAVLSHIKFDKRSGTAVEGLRGCPYCSHPPPAAAFSLLSPAEAMKREDPGWFGGGGGEEPRQGVWTIEEDLYTTLKKKVSRVYAAPPEERKKRVYSTAPSKFTTIDQYSGLGFRLVRMGFDDMYLCSPGGMYDKFGKDYFLCTGMASMLVPVVVNPGEEWKAAQVIEHDNL

SEQ ID NO: 35367 - protein, 554 aa, Ustilago maydis 521
MAARRAPARMPTQTRSPPTNALSVLLVTAGYDHTIRFWEAWSGICSRTIQHPDSQVNRLSISPDKRFLAAAANTHIRLYDCSIASSSSIAAANAAAGGSAAGGSGTNNIGAPAQPIATLEGHTGNVTGIAWHCDMQWLVSGGEDGLLKIWDLRTSRATRIYDHRGPVNDVVVHPNQGELVSCDQNGSVKVWDLGQNGCSHELVPEEGVPIRSVTVAADGSCLVAGNNTGKVYVWRFINGVYDAQQAGQPPSPAGGAGDFTELQPVTTFQAHEKYLTRVLLSPDVRHLATCSADATVKIWSTSRYEFALEKTLVGHQRWVWDAAFSADSAYLVTASSDHVARLWELASGETVRQYNGHHRAAVCVALNDASLDSWTLKKQLRPSTLAFLAPEQPLSAASKWIMSGSNGFGKASYSRDAGLGSSGSISSSFLGLKDELERSKASSSTWSSKRKSYKSSESDLQSRSKKLSSAFLETSSSKKPKHDARCDVNDSKRKKRSTRPSDAEASRSNLRPASSWKVRRLHECRTERRQHRLGAQTTGTSSSLSLTLPDRNGR

SEQ ID NO: 35368 - protein, 153 aa, Burkholderia vietnamiensis G4
MSTTVAQILKAKPDSGRTIYTVTKADFVYDAVKLMAEKGIGALLVMEGDEIAGIVTERDYARKVVLQDRSSKATRVDEIMTSKVRYVEPSQSSDECMALMTEHRMRHLPVLDGGKLIGLISIGDLVKSVIADQQFTISQLEHYIHGTPVITSA

SEQ ID NO: 35369 - protein, 102 aa, Ostreococcus tauri
  misc_feature (102)..(102): Xaa can be any naturally occurring amino acid
MIHTDAAVDNFYITAREAKDTPSRAHGVGEETEFVQRIYGASLIRASCVLLRLSLSVVVTAQTLLQRFYTKKSLRDYDVKLVVVAAIALACKLEGTDRKLRX

SEQ ID NO: 35370 - protein, 235 aa, Citrus sinensis
MAEEIKKQQKSHEYEPSVGTEGAVETKDRGMLDFLGKKEEEKPQHHDQEVIATEFEKVHVSEPQPKAEEHRKEEKEEEKKPGFLDKLHRSTSSSSSSSDEEEGDDEEKKKKKKEKKGLKEKLKEKISGEKEEDTTVPVEKLDDVHAPHHQEEAHPEEKKGFLNKIKEKLPGQQKKPEDHQVPSPPAAEHPTSVEAPEQRPRRRRAYWRNSRRSPLATTQSLRTKRIRTKKLLPIN

SEQ ID NO: 35371 - protein, 254 aa, Rhodopirellula baltica SH 1
MSRRILIAGNWKMNMRAESGASLAKGIVDAVGKSPAVEVVLCPPSVYLSGVADAVVGTPVELGAQNLYAAEDGAFTGEVNASMLTDVGCRFVILGHSERRQLMGETDACVAKKLHAALAGNLVPIVCVGETLEQREADDTESVIETQIRGSLEGLDEARAANIVIAYEPVWAIGTGKTASKEQAEAVHAFIRELLGKMFSTEVAEQIRIQYGGSVKPGNAEELLSQPNIDGALVGGSSLKVDDFAGIIKAAPSA

SEQ ID NO: 35372 - protein, 402 aa, Silicibacter pomeroyi DSS-3
MLHRRGIMAAPLKRRIGLGLLTAYGVGVMVGAGIYVLVGAVAGDAGVWAPVAFLLAGLIAAPTALSYAEFSTRLPEAAGEAAYVGTGLNSQSLALLVGLAVVVAGTVSAGAVLRGGVGYLSAVTEINPVWAMIGLGGALTLVAVAGVLESLALAAVFTVVELAGLALVVWAGLGADPSPDWVAPAPPVWTGIGLGGVLAFFAFIGFEDIVNMAEEVEAPERTLPRAILISLVVTSVLYALVAWAAVRAVPLDVLGQSESPLALVWQYGRGSGAGFLSAIAVFAALNGILAQIVMATRVLYGLGGRTKALALFHTAHPRFGTPVLATFLVGAAVIFCALYVPVETLAETTSSILLAVFALVNGALIVQKRRAPEARFRVPMAVPVLGLVLSLAALSVAVRGIL

SEQ ID NO: 35373 - protein, 349 aa, Ostreococcus tauri
MGDELDEVIGFLSDKNPAVRAQAAHIVQGLTGTDDGAKLLCEKADALVPKLLHMIGKEGTESKYAATALVNLTHDPEVIVKCVNKGAVERAMDALRDGDGAPVDLLLSILANVTTAESGVHVISQEGKPLEGFYVSKLIQLLSTGKPEESYDQAASVLTNVTRDPIGRRVFLDPKRGLLASVIPFMTQPNELRRERVAAALRNCCMDDIQRKALLDFVNPGTQEPEGDVIRALLRPISGKKVGAELSDNVRQACAEAIYALAKDEAARPILSKLEAPRLLKDGYELEEHPETCAALVAIGNLFLESGMVPEDLQEGLNQPQAVEVIDDDEAMVMMGPGMGPGGFINTVD

SEQ ID NO: 35374 - protein, 366 aa, Mycobacterium leprae
MATLAESPEPKSGASRAGVLGEEAGYHKGLKPRQLQMIGIGGAIGTGLFLGAGGRLAKAGPGLFLVYAVCGVFVFLILRALGELVLHRPSSGSFVSYAREFFGEKAAYVVGWLYFLDWAMTAIVDTTAIATYLHRWTIFTALPQWTLALLALAVVLVMNLISVEWFGELEFWAALIKVCALMAFLVVGTIFLGGRYPVDGHNTGLSLWTSHGGLFPTGVAQLIVVSSGVMFAYAAVELVGTAAGETVEPKKIMPRAINSVIARIAIFYVGSVILLALLLPYSAFKASESPFVTFFSKVGFYGAGDLMNIVVLTAALSSLNAGLYATGRVMHSIAINGSGPKFTARMSKNGVPYGGILLAAVICLCG

SEQ ID NO: 35375 - protein, 900 aa, Streptomyces avermitilis MA-4680
MTDPTAIQPSELDQLPDRDPEETAEWQASLDAVTQAAGPHRAAYLMRRTLERAEGNGIALPKLLETDYVNTIPTSAEPVVDGDEEMEHRITAWNRWNAAAMVTRGSKYGVGGHIATFASAAWLYETGFNHFFRGKEADGSGDQLYIQGHASPGIYARAFLDGRLTEHHLDHFRQESGGNGLPSYPHPRRLPWLWEFPTVSMGLGPLSAIYQARFNRYLTSRGIKDVSQSHVWAFLGDGEMDEPESTAALALASREGLDNLTFVINCNLQRLDGPVRANFKIVQELEAQFRGAGWNVVKTLWGSAWDELFQLDTTGALVRRLREVPDAQVQTYQTRDAAYIRQDFFGADPALVEMAKLIGDDKILECFHLSRGGHESRKVYAAYRAAVSHKGAPTVILAQTVKGHTLGEGFASKNANHQMKKLSTDEFKQMRDLLELPISDSQFVDGVVPYGHPGADSPEVRYLQERRAALGGPAPARRTHPLAPLPAPADKTFASFDKGSGSQNVATTMAFVRLVKDLVRDKQTGRRWVPIVPDEARTFGMESLFPSLGIYSPKGQTYEPVDRDQLMYYKEAKDGQILNEGITEAGSMADFIAASTAYSTHGEAMIPFYIFYSMFGWQRTADQMWQLGDQLGRGFLVGATAGRTTLTGEGLQHADGHSPVIAATNPAALTYDPAFAYEIAVIVKDGLRRMYGEAAPGEDPNVFYYLTVYNEPVPQPAKPAGLGIDEGIVKGLYRFNTAESADLSPAANAPRIQLLGSGTAIHWVLQAQRLLAEEWGVAADVWSATSWTELRRDALEADAALLRGEERVPFVRQALHGAEGPVLAVSDYMRQVPDQIAQWVEQDYSSLGADGFGLSDTRDAARRHFGVDAESIVVAALAQLARRGEVKATAVKEARERYGL

SEQ ID NO: 35376 - protein, 751 aa, Silicibacter sp. TM1040
MPKAKITDEEALAFHLEPSPGKWEVTATVPMTTQRDLSLAYSPGVAVPCEAIAENPETAYDYTNKGNLVAVISNGTAVLGLGNLGALGSKPVMEGKSVLFKRFADVNSIDIELDTEDPDEFIKAVRLMGPTFGGINLEDIKAPECFIIEQKLKEEMDIPVFHDDQHGTAVICAAGLINALHLSGKKIEDVRIVLNGAGAAGIACIELLKSMGARHENCIVCDTKGVIYQGRTEGMNQWKSAHAVKTELRSLEEAMNGADVFLGVSVKGAVTQDMVKSMADNPVIFAMANPDPEITPEEAHEVRVDAIVATGRSDYPNQVNNVLGFPYLFRGALDIHARAINDEMKIACAHALARLAREDVPDEVALAYGKSLSFGRDYIIPTPFDPRLIHRIPPAVAKAGMDTGVARRPIIDMDAYEHGLRGRMDPTQSILRGLNARARAAQSRMIFAEGDDPRVLRAAVTYQRSGFGKALVVGRQDDVKAKLEEAGLGDAVRELEVVNAANTHHFETYKDFLYERLNRKGFDRKDIHRLVGRDRHVFSALMLAHGHGDGLVSGATRKSAHVLDRINHVFDADAEHGAAGVTALLHKGRIVLIGDTLVHEWPDENDLATIAERAAGVARHMGLDPRVAFVSFSTFGYPVSERAEKMHIAPTVLDKRGVDFEYEGEMTVDVALNAKAQEHYPFQRLSGPANILVVPARHSASISVKLMQEMGGATVVGPILSGVDKPIQICSTTSTANDVLNMAVLAACNIG

SEQ ID NO: 35377 - protein, 607 aa, Streptomyces avermitilis MA-4680
MPVSVTLPALGESVTEGTVTRWLKAEGERVEADEPLLEVSTDKVDTEIPSPAAGVLASIKVAEDETVEVGAELAVIDDGTGAPAAAPAPAAEQAAEQVAPPAPEPAPQATPSTEQAAPAPAPTAEAAAGAGSAEGTDVVLPALGESVTEGTVTRWLKEVGEEVSEDEPLLEVSTDKVDTEIPAPASGTLLLEIVVGEDETAEVGAKLAVIGAPGAAPAAAPAQAAPAPAAAPAAPAPAPAAPAPAAPAPAPAAPAPAQAAPAAPAAPAQAAPAPAAPQAPAAPAPAPVTPAAAPAATSGDDGAYVTPLVRKLAAENGVDLATVKGTGVGGRIRKQDVTAAAEAAKAAAPAPAAAPAAAKKAPALEVSPLRGQTVKMPRIRKVIGDNMVKALHEQAQLSSVVEVDITRLMKLRAQAKDSFAAREGVKLSPMPFFVKAAAQALKAHPAVNARINVDEGTITYFDTENIGIAVDSEKGLMTPVIKHAGDLNIAGIAKATADLAGKVRANKITPDELSGATFTISNTGSRGALFDTIIVPPNQVAILGIGATVKRPAVIETEEGTVIGVRDMTYLTLSYDHRLVDGADAARYLTAVKAILEAGEFEVELGL

SEQ ID NO: 35378 - protein, 178 aa, Rhodobacter sphaeroides 2.4.1
MTHKSVRDYIRTIVDFPHEGILFRDVTTLFADPRGFRIAIDQLLAPYAGMRFDKVAGLEARGFILGGAVAHRLSTGFVPIRKKGKLPGRTISVSYQLEYGEAVVEVHDDAIQAGEKVLLVDDLLATGGTAEAGIKLIEQLGGQVVGCAFVVDLPDLGGRKRLEAMGMEVHALCAFEGL

SEQ ID NO: 35379 - protein, 135 aa, Zea mays
NLRCPEYVKHPSGSEKFQQSSIKECHLCLFHADNLAANFSRELADYIIYIIDVSGGDKIPRKGGPGITQADLLVINKTDLAPAVGADLSVMERDALRMREGGPFVFAQVKHGVGVEGIVNHILQAWEIATGNKRR

SEQ ID NO: 35380 - protein, 215 aa, Arabidopsis thaliana
  misc_feature (90)..(90): Xaa can be any naturally occurring amino acid
MAIMSDLPRDLLAEILSRVPLASLRSVRFTCKKWNDLSKDRSFLKKQIVEAKKKQLKSKEFEVIMMRNFRVYLTSVDLHNDVNPSFTPKXVGEEQLALLFQSDATLMMEIWVTSKVDPTEVLWNKLFLAVDHDMIEFDYELKFVADAGSFFIDQKKNVVVVFDKDMNEHTHRGMAYIVGKNGYFKRVDIGEEAYTSCFPLVCSYVPSSVQIRQLT

SEQ ID NO: 35381 - protein, 258 aa, Ostreococcus tauri
MFDADERRALVLSVLAGATTTLGGVVAVYKKPGRASLYVKNVIEHGILSVTGATMGGAGLYACAAPLLPNTEQRAGTTSNGSSPSERTAMNAMEKSDDKKDTGGIGGVSKVRLLRLGILMAFAMTLHNLPEGFAVACASFTKIGPTMAFAIGMHNVPEGIIIAARCTRRLEVELVRILLATASGLSEPIGALVALKFMKPYLTPARLEHLLAATGGIMIAVSVLELWPEAKKCANNDSMYRGILIGSGLMLLTLYLGA

SEQ ID NO: 35382 - protein, 548 aa, Ostreococcus tauri
MELRAHGTIPRKKPVLVCVLDGWGENAIEDEHNAVHVAKTPTMDGLKARGPSRYRTVKAHGTAVGLPTDADMGNSEVGHNALGAGKVIAQGASLVDIALETKNAFSDAGWSYIKPAFANNTLHIIALLSDGGVHSRTDQIFGMMRGAVADGCKRLRVHPLTDGRDVADGTCHEYMEKLVAELDSYAAQGCDAKVASGGGRMAVTMDRYEADWAMVERGWRAHVLGDAPNKFTCPKEALKELKKDGTTDQYIAPFVIVDEAGKAVGTIEDDDAVVIGNFRADRVVEISKAFEYVDFNEFDRVRFPKTKFVGLMQYDGDLKLPANYLVPPPLIERTSGEWLAKNGLKTFACSETQKFGHVTFFWNGNRSGYFNEALETYVEIPSDNVPFNQAPLMKAREITAAGKEALLSGKYDVVRVNYANPDMVGHTGDMKATVAACEECDACVKELLDLVEELGGMFLVTADHGNADDMVQRDKKGNALTDKATGALLPLTSHTLAPVPVAIGGPALPESVKFRDDLPDAGLANVTATYINLMGFQAPAEMEPSLIA

SEQ ID NO: 35383 - protein, 93 aa, Glycine max
MEGRMGLLFLLVLGGAWACDGRELANCNQLSKLSRKPDVCALCEEYTTNALDYLNENKTQLEIIDILHNTCYQLHSFKQKCITFVDYYAPLFF

SEQ ID NO: 35384 - protein, 849 aa, Ostreococcus tauri
MGVHTGDSITIAPAQTLTDKEYQRLRDASVAIIREIGVECGGSNVQMAVNPVDGQVMIIEMNPRVSRSSALASKATGFPIAKMAAKLAVGCTLDGIPNDITLKTPASFEPSIDYVVTKIPRFAFEKFPGAKPVLTTQMKSVGEAMAMGRTWQESFQKAFRSLETGFAGWGLGKKDGFMQGDVAAINEGLLVPNPERIVVIHEAFLAGFTEDQIIKATTMDPWFIRQLGELYQTECWLKSLKSLDDLSENDWFEVKRRGYSDSQISMAFPGTTELQVRKERTAKGCKPSMKRVDTCAAEFVADTPYMYSSYDGFDESEPTDNKKILILGGGPNRIGQGIEFDYCCCHAAFALADAGYETIMLNSNPETVSTDYDTSDRLYFEPLTVEDVLNVCEVERPEGIIVQFGGQTPLSLATRLEAALKENPIPAASGNGFTQILGTPPDSIDAAEDRERWIDILEELNILQPPGGVARSEEEALKIAEKLTYPVMVRPSYVLGGRAMEIVGSNADLKRYIKTAVEVDEDRPVLVDKYLQNATEIDCDALCDKDGNVVIGGIMEHIEQAGVHSGDSACSLPTQTIPESALATIREWTPKLAKRLGVIGLINIQYAVTPEGTPYIIEANPRASRTVPFVAKAIGHPLAKYASLVMAGKTLKEIGFTEEVKLNHVAVKEAVLPFDKFPGADTLLGPEMRSTGEVMGIDRDFSRAYCKAQLAAGQRLPTSGKVFISVRDSDKDAIVDIARDFVSMNYTVVSTGGTATHLEKAGVAVTKVLKLHEGRPNVSDMIRDGEIGMMVVTSSGDAQDLVDGRKIRREAVGLKVPLVTTIAGAKATAGAVRVLQKGDLKMDALQDFF

SEQ ID NO: 35385 - protein, 431 aa, Xanthomonas oryzae pv. oryzae KACC10331
MECLVPDITGNARGKIIPADKFSHDYGTRLPEGIFATTVTGDFPDDYYALTSPSDSDMHLRPDASTVRMVPWATDPTAQVIHDCYTKEGDPHELAPRNVLRRVLDAYAQVKLQPVVAPELEFFLVQKNTDPDFPLLPPAGRSGRPETARQSYSIDAVNEFDPILDLMYDYCDAMELDVDTLIHESGAAQLEVNFTHADPLSRADQVFLFKRTMREAALRHGVYATFLAKPMETEPGSAMHIHQSLLHADTGKNVFSGKREGGFSDTFAHYLGGLQKYIPMAMGLLAPNVNSYRRLMFGEVSPSNVLWGFDNRTCGLRVPIDAPQNMRVESRFAGSDANPYLAMAATLACGLLGIRENLEPTAPISSNGKEQGYDLPRSLGEALDELEGCDALQEMLGQRFVRAYISVKRKEYETFFRVISSWEREFLLLNV

SEQ ID NO: 35386 - protein, 199 aa, Brassica napus
MSKNWKSVRLRLQMRTLMLFVVILSFDSLETEGLAVTKNLQNDRDAAALEAVSFHRKLLGRFRNPYTHLNSYKDHRPVASVTPPSSSVVPSHRSKTSRSSASHPPRKSPPALHVSSAPPPSVAFPNIPTLRRSSSNSIAPIVVGCTGGVLLLLLATGVFFFKSKAGKSVNPWRTGLSGQLQKVFITGVPKLKRSEIETA

SEQ ID NO: 35387 - protein, 560 aa, Arabidopsis halleri subsp. gemmifera
MASSTALISDTEAWKDLKGHVEDIKKTHLRDLMTDANRCQSMMMEFDGLLLDYSRQRATVETVDKLLNLAKAAQLTEKISRMFNGEHINSTENRSVLHVALRAPKDAVIKADGKNVVPEVWNVLDKIKEFSEKIRSGSWVGATGKPLKDVIAIGIGGSFLGPLFVHTALQTDPEALESAKGRQLRFLANIDPVDVARNINGLNPETTLVVVVSKTFTTAETMLNARTLREWITAALGASAVAKHMVAVSTNLALVEKFGIDPNNAFAFWDWVGGRYSVCSAVGVLPLSLQYGFSVVEKFLKGASSIDQHFQSTPIEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATHVRKQLHSSRTQGTTLEGFNYSTTTLLKRYLETSSEPQM

SEQ ID NO: 35388 - protein, 448 aa, Pseudomonas syringae pv. syringae B728a
MNPRLAAAKALAAVLSGKASLNSSLPTQLDKVEVRDRGLTQDLAFGTARWQPRLSALAAKLLQKPFKAADADVEALLLVGLYQLFYSRIPAHAAIGETVGCADKLKKPWAKGLLNAVLRNAQRDGEALLIELEHDPVVRTAHPRWLQKALKAAWPEQWEAICAANNAHPPMILRVNRRHHRRDQYLELLDTAGLQASACTFSQDGIVLAEPCDVRSLPGFAEGWISVQDEAAQLAADLLELAPGQRVLDACCAPGGKTCHLLEVQPQLDGVVAVDLEAKRLVRVRENLDRLGLDAELIAADARETAQWWDGKPFQRILLDAPCSATGVIRRHPDIKLTRQADDIAALAALQGELLDALWPTLQVGGMLVYATCSTLPTENTDVIEAFLARTSGARELDIAGQAGQPPAGIKQAHGRQLLAQQGGHDGFYYAKLIKIADQDRGGAGVSA

SEQ ID NO: 35389 - protein, 242 aa, Zea mays
QQQDEIVDRSMVSLQPSSAAPLLPEAATANKLPPWLSLVGSVVASSTGTAATSKKRKRDGSGGGGDEDDRGEVVDGIELNFDAAPLPPEWQRCLDIKSGQIYYYNTRTQKRTCKDPRGHGLQPDYRAEEGQEEEEDSANCAPPGLDLELNLTFEPRRVLAAHRKTMKRANKQPAEEEEAEDDDSSSSSREMVAGVCVRCHMLVMMCRASPACPNCKFLHPPSRAAPPPPPLKLGLQLLCCRD

SEQ ID NO: 35390 - protein, 395 aa, Staurastrum punctulatum
MTMLKTKADPMIVSMGPHHPSMHGVLRLIVTLDGENVIDCEPILGYLHRGMEKIAENRTTLQYLPYVTRWDYLATMFTEAVTVNAPERLANIQVPKRASYIRVIMLELSRLASHLLWLGPFMADIGAQTPFFYIFREREMIYDLFESATGMRMMHNYFRIGGVAVDLPYGWVDKCLDFCDYFLPKIDEYERLITRNPIFLKRVEGVGFIGREEAINWGLSGPMLRASGVQWDLRKVDHYECYDEFDWQVEWQTEGDCLARYLVRIGEMRESTKIIQQALKSIPGGPYENLEARRIGLIGTDSAQWNDFEYQFISKKPSPTFKLPKQEHYVRVEAPKGELGIYLIGDDSIFPWRWKIRPPGFINLQILPQLLRGVKLADIMTILGSIDIIMGEVDR

SEQ ID NO: 35391 - protein, 181 aa, Staurastrum punctulatum
MINGLKNYSQDALRAARYIGQGFFVTLDHMNRTPITIQYPYEKLIPSERFRGRIHFEFDKCIACEVCVRVCPINLPVVDWEFQKSMKKKQLKSYSIDFGVCIFCGNCVEFCPTNCLSMTEEYELSSYDRHELNYDQVALGRLPNPASKDPLVHPILGLGYLQKKLLTQSTESKTITNFDKS

SEQ ID NO: 35392 - protein, 336 aa, Streptococcus pyogenes M1 GAS
MVVKVGINGFGRIGRLAFRRIQNIEGVEVTRINDLTDPNMLAHLLKYDTTQGRFDGTVEVKEGGFEVNGNFIKVSAERDPENIDWATDGVEIVLEATGFFAKKEAAEKHLHANGAKKVVITAPGGNDVKTVVFNTNHDILDGTETVISGASCTTNCLAPMAKALHDAFGIQKGLMTTIHAYTGDQMILDGPHRGGDLRRARAGAANIVPNSTGAAKAIGLVIPELNGKLDGAAQRVPVPTGSVTELVVTLDKNVSVDEINAAMKAASNDSFGYTEDPIVSSDIVGVSYGSLFDATQTKVMEVDGSQLVKVVSWYDNEMSYTAQLVRTLEYFAKIAK

SEQ ID NO: 35393 - protein, 464 aa, Carboxydothermus hydrogenoformans Z-2901
MVETEKELKRGLEARHIELIALGGTIGVGLFMGSASTLKWAGPSVILAYIIAGIFIFFIMRTIGEMLYIEPITGSFATYAHKYIGPLWGYLTAWSYWFMWVAVGMSEVTAVGIYMKFWFPTLPQWVPGLIAILIVGTANLAAVKYYGEFEFWFALIKVVTIVVMIILGIGMIFFGFGNHGRPIGLENLYIHGGFFPNGIKGFLFALCLVVAAFQGVELVGVTAGEAKDPQRTLRRAVQNITWRILIFYIGAIFVIVALYPWNKLGTIGSPFVLTFAKVGIPAAASIINFVVLTAALSGCNSGIYSSARMLYTLSQNGQAPKFLAKVSPSGVPVNSLLVTIACLLIGVALNYIAPQKLFVYIYSASVLPGMMPWFVILISQLKFRKLKDNEIKDHPFKAPLSPYSNYLTIIFLVLVLVGMWLNSDTRLSLIIGAAFMALIIISYYVFGIDKKQVPEVKKIKEEAI

SEQ ID NO: 35394 - protein, 328 aa, Staurastrum punctulatum
MSEMLLFEALREGLQEEMDRDPKVLVMGEDVGHYGGSYKVTKGFAEKYGDLRLLDTPIAENSFTGMAIGAAMTGLRPVVEGMNMGFLLLAFNQIANNAGMLHYTSGANFTIPIVIRGPGGVGRQLGAEHSQRLESYFQSVPGLQLVACSTPINAKGLIKSSIRSENPVILFEHVLLYNLKETIPDNEYLVCLEKAEIVRPGTDITILTYSRMRHHVLQATKSLVYKGYDPEIIDIVSLKPVDLGTISTSIKKTHKVLIVEECMRTGGIGASLRATIMEHLFDFLDAPIMCLSSQDVPTPYSGPLEELTVIQPAQIVQAVEQLCNNGNN

SEQ ID NO: 35395 - protein, 337 aa, Chromobacterium violaceum ATCC 12472
MLGDVGGSNARFALETAPGVIEDILTLSNERYPTLEDALRDYLAQVGARRVAHAAIGIANPLNGDLVRMTNCHWSFSIEATRRALGLSTLLLLNDFTALALALPRLPRRELAQVGGGAPRPDAPLALIGPGTGLGVSALVPHAGGWRALAGEGGHTSFAPANEREIGIWRYASARFGHVSHERLLSGSGLSLLHRALCALDGAEEAGLAPAEVSARGLSGADARCREALEIFCALLGSAAGNLALTLGARGGVYIGGGIVPRLSGFFEQSPFRRRFEDKGRMSAYLADIPVYLITSAYPALPGVAAHLADHLAPRSDPAPVAAPTHPRGGTAGDMHA

SEQ ID NO: 35396 - protein, 149 aa, Brassica napus
MGMIKSNPNPKAEEANIDPSDLLDEEKETHKAAILSLSETAEKMDPSSLATFLEKVSDEDWYHPLKQILKVIDYYGIQFSQVSSFHWVNMFDDYPLSKLIHVPLSLIPMSVYEQSLDFINTLPFETLPAVVLWASDLILTEWPGVVKVE

SEQ ID NO: 35397 - protein, 547 aa, Chromobacterium violaceum ATCC 12472
MSELTELPAWQALWDHFAEAKHLHMRDLFAADPGRAERYSLEVGGLFLDYSKNRITDATLLGLMELAREAGLPARIKAMFKGEKINRTENRAVLHVALRNRTNSPIRVDGEDVMPKVNSVLERMGKFAHAVRSGDWLGFTNQPITDIVNIGIGGSDLGPLMVCSALKPFGHPRLNMHFVSNVDGAQLKETLKKVHPETTLFVVESKTFTTQETLTNALTAREWFLSHARDEGAVAKHFVAVSTNQKAVAEFGIDPANMFEFWNWVGGRYSLWSAIGLPIMLYLGEENFTELLNGAHIMDQHFMNAPFEQNMPVLLAMIGVWYINYYGGGSHVIAPYDQYLHRLPAFIQQLDMESNGKQVTLSGQPVDFETAPIIWGETGINGQHAFFQLLHQGTHISPIDLIASLGNRASLPGHHEILLANVFAQAEAFMRGKTADEVRAELAEQGLSGEEMEALVPHKVFGGNRPTNTLLMSRLDPRNLGSLIALYEHKIFVQGVIWHINSFDQWGVELGKQLAKTIHAELTGKLEQAEHDSSTRRLIQLYRKANG

SEQ ID NO: 35398 - protein, 439 aa, Nostoc punctiforme PCC 73102
MLSIPINLNLPRIPHLITSLPGPLAQAIVQRDRAVTSPSYTRDYPLVVSRGQGCMVEDVDGNVFLDMTAGIAVTATGHAHPEVVKAIQEQSERLLHMSGTDFYYEPMVELAEQLAIRAPFPQPQGNSAFPAKVFFTNSGAESNEGALKLAKYYTKRSLIVAFLGAFHGRTYGAMSLTGSKAVQRANFGPLVPGVTHIPYGTHASLDYLEQQLFGTILPPQEVAAIVVEPIQGEGGYIVPEDGFLKRIRDICDRHGILMVVDEVQAGMGRTGRLFAIEHWGVMPDIITTAKGIASGLPLGAILAKPELMTWPPGSHATTFGGNPVACAAGIATLRLLESGLMANATQMGELLQASLSELHQRFPRVSPPRGKGLMVAVDLLDEQGNLDRELRDRIIQEAFLRGLLLLGCGKAAIRFCPPLVIDSDQIQIALQIISNILTS

SEQ ID NO: 35399 - protein, 422 aa, Medicago truncatula
MGGKKTSKTKSLLSFRRRSNKLPSPPPRSPPPTLEITGSPSENRLVPKPKKKTGGARLWMRFDRFGKSELVEWEKNTIIRHAAIPARDLRILGPVFSHSSNILAREKAMVVNLEFIKAIVTAEEILLLDPLRQEVLPFVEQLRQQLPHKTQPKLLGGAGGGDESVPEGAEELPLPFEFQVLEIALEVVCTYLDKNVAELEKGAYPVLDALAKNVSTKNLEHVRSLKSNLTRLLARVQKVRDEIEHLLDDNEDMAQLYLTRKWLQNQQLDAHLGATASNNLLNTSHSVRRINSTRSGSLVTSSDDNDVEDLEMMLEAYFMQLDGTRNKILSVREYIDDTEDYVNIQLDNHRNELIQLQLTLTIASFAIAFETLVAGAFGMNIPCTLYTQNGIFWPIVGGMTAVSILLFLVVLAYAKWKKLLGS

SEQ ID NO: 35400 - protein, 528 aa, Nostoc punctiforme PCC 73102
MDARALWQRYQNWLYFHEGLGLYLDISRMRFDDAFVESLQPKFDKAFADMAELEKGAIANPDENRMVGHYWLRNPDLAPTPELTQEIVQTLEQIEAFAEKVQTGAIHPPRASRFTDIISIGIGGSALGPQFVAEALAPDFPPLKIHFIDNNDPAGIDRVLNHLRNSLASTLVLVISKSGGTPEPRNGMIEVKKAYAGHNLEFAQYAVAITSVDSNLDKLAKDEGWLARFPMYDWVGGRTSEMSAVGLVPAALQGIDVRAMLDGAKEMDDATRVPDVKNNPAALLALSWYFAGNGKGEKDMVVLPYKDSLFLFSRYLQQLVMESLGKEKDLDGNVVHQGIAVYGNKGSTDQHAYVQQLREGVANFFATFVEVLEDRQGPSTEIDPGVTSGDYLSGFLQGTRQALYENHRDSITVTIPQVNPRTVGALIALYERAVGLYASLVNVNAYHQPGVEAGKKAAASILDLQTRVVAVLQKEKTPISLDELAKKAGASDQIEAIYKILRHIHANQRGVVLQGDLHKPGSLTVSAS

SEQ ID NO: 35401 - protein, 302 aa, Ralstonia metallidurans CH34
MPRIEFARPRIVDGLWLPMVTPLHHGQVDFDGVQRLAAHYADAGVDGLIVLGTTGEGGLLTDVERLQVAAATLEAVQGTVPVIAGVGGVATHAVCEQVRRLERLDLAGYLVPPPYYLRVSDEGIAWHLRSVASHTARPLMLYNVPKRTGCTISPDLTWRLAAHPQIVALKECDAAGMRALAGQDRLDVFCGDDAAMLDHLLRGGAGIVPASAHIRPDLFVRLIQLARTGREEAARALFRQLSPLIGMLFDEPNPAPVKAALALCGLARPEVRRPLMPASKSLVARLDAAIALLPPVVAREAA

SEQ ID NO: 35402 - protein, 621 aa, Thermotoga maritima MSB8
MVKFKREVNFSGGDRGVYRPDLIRNICIIAHIDHGKTTLVDRILEITNTVDRRKMREQYLDMMDIERERGITIKAQPVKVMYTAEDGNTYEINIIDTPGHVDFSYEVGRSMAACEGAILLVDATQGVEAQTVAHTYLAIEHDLEIIPVINKIDLPNANIEETALEIKDLLGVSENEILLVSAKEGTGVKELLEAIVKRVPPPKGDINGKLKALIFDAKYDNYKGVIVHVRLFDGQVKPGDKIMTFSNKKVYEVQEVGVFLPEMEPVDSLSAGEVGYIIAGIKEVSDARVGDTITSANDPVDEALPGYREIKPMVFAGMFPGLPEYYEELRKALEKLKLNDSALYFEPTMSPAMGFGFRCGFLGPLHMEVVRERIEREFDLAVILTAPNVRYRVKLRNGEEIEITDPSKFPDEGEILEAYEPYVDLSIITPSEYIGAIINLVQNEKRGELRITENAGKNRVILRFDAPLAEIIYDFFDRMKAVSRGYASMDYEFKEYRRSDLVKVTILVNKEPVDALSFIVHRSKAYQMARKIVEKLKDLIPRHQFQIPIQAKAGGRIIARADIKALRKDVLAKCYGGDVTRKMKLLEKQKEGKKKLREIGRVTIPQEAFLALLKIGGEDEK

SEQ ID NO: 35403 - protein, 560 aa, Arabidopsis halleri subsp. gemmifera
MASSPALISDTEAWKDLKGHVEDIKKTHLRDLMTDANRCQSMMMEFDGLLLDYSRQRATVETVDKLLNLAKAAQLTEKISRMFNGEHINSTENRSVLHVALRAPKDAVIKADGKNVVPEVWNVLDKIKEFSEKIRSGSWVGATGKPLKDVIAIGIGGSFLGPLFVHTALQTDPEALESAKGRQLRFLANIDPVDVARNINGLNPETTLVVVVSKTFTTAETMLNARTLREWITAALGASAVAKHMVAVSTNLALVEKFGIDPNNAFAFWDWVGGRYSVCSAVGVLPLSLQYGFSVVEKFLKGASSIDQHFQSTPIEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATHVRKQLHSSRTQGTTLEGFNYSTTTLLKRYLETSSEPQM

SEQ ID NO: 35404 - protein, 560 aa, Arabidopsis halleri subsp. gemmifera
MASSTASISDPEAWKDLKGHVEDIKKTHLRDLMTDANRCQSMMMEFDGLLLDYSRQRATVETVDKLLNLAKAAQLTEKISRMFNGEHINSTENRSVLHVALRAPKDAVIKADGKNVVPEVWNVLDKIKEFSEKIRSGSWVGATGKPLKDVIAIGIGGSFLGPLFVHTALQTDPEALESAKGRQLRFLANIDPVDVARNINGLNPETTLVVVVSKTFTTAETMLNARTLREWITAALGASAVAKHMVAVSTNLALVEKFGIDPNNAFAFWDWVGGRYSVCSAVGVLPLSLQYGFSVVEKFLKGASSIDQHFQSTPIEKNIPVLLGLLSVWNVSFLGYPARAILPHSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATHVRKQLHSSRTQGTTLEGFNYSTTTLLKRYLETSSEPQM

SEQ ID NO: 35405 - protein, 128 aa, Escherichia coli K12
MPKSVIIPAGSSAPLAPFVPGTLADGVVYVSGTLAFDQHNNVLFADDPKAQTRHVLETIRKVIETAGGTMADVTFNSIFITDWKNYAAINEIYAEFFPGDKPARFCIQCGLVKPDALVEIATIAHIAK

SEQ ID NO: 35406 - protein, 304 aa, Oryza sativa (japonica cultivar-group)
MAKFTLDDADDDPPVATARDKRKRDDGPADAEDEPPRARGSAVAGREPAAPGAEAEAAGRRGPAEEMANGEVEGGLSVQIDPDVLDCSICFESLRPPLYQCQNGHVACFSCWSKLSNKCHICSRDAKFARNIALEKIVESIKSSCSYAKWGCCKFINYAQRDAHEEACLFAPSVCPISNCGYRGFTGRWSGHFLTSHSSDVMRFIYGQPFEVNIEVSVPFLVFLGEDDHLFLLQNNNLTPFGHAFSVVCLRSGNLNWMFSYQIEATSRKKPENRLQLKASVTNTRQWTALIAIPLRQDWGCVIG

SEQ ID NO: 35407 - protein, 507 aa, Ostreococcus tauri
  misc_feature (1)..(2): Xaa can be any naturally occurring amino acid
XXRLASFVGAMAIGDLVKSTLGPKGMDKILQSVQKGRQVTVTNDGATILKSIYVDNPAAKVLVDISKAQDDEVGDGTTSVVVFASELLRQAEQLVAQHVHPMTIIQGFREACEAAKAALEETARDNAGSKEKFEEDLMNIAKTTLSSKILTHDKEHFARLAVDAVLRLKGSGDLEMIQVIQKPGGNLKDSFLDEGFILDKRFGVGQPKRIENAKILIANTPMDTDKIKIYGARVRVDSMAKVADIEQAEREKMKRKCEKIIGYGINCFINRQLIYNYPEQIFTEAGVAAIEHADFDGIERLALVTGGDICSTFDNPEDVQLGGCDLIEEIMIGEDRLIRFSGVAKGEACTIVLRGASEHILGEAERSLHDALCVLTSTVKDSRVIYGGGCSEMIMSKAVEELAAKTPGKRSLAMECFAKALRAIPTIICDNAGLDSADIVSQMRAAHAEGDKKAGVNVLTGEVGDMQQCGVVECFRVKQQVLLSATEAAEMIIRVDDIIKSTPRQRE

SEQ ID NO: 35408 - protein, 760 aa, Bordetella pertussis Tohama I
MDENLTKLALDYHAYPTPGKISVTPTKTLANQDDLSLAYSPGVAAACMAIFDQGNDAASKYTSRSNLVGVITNGTAVLGLGNIGSLAAKPVMEGKGCLFKKFAGIDVFDIELAENDPDKLVDIIAALEPTLGGVNLEDIKAPECFYIEKKLRERMNIPVFHDDQHGTAIISSAAILNGLKVVGKDIGQVKLACSGAGAAAIACLDLLVHLGIKREHIYVVDSRGVIWEGRDENMEPNKRRYAQKTEARTLADVVNGADVFLGCSTAGVLTPEMVKTMAAQPLILALANPEPEIRPELAKAARPDCIVATGRSDYPNQVNNVLCFPFIFRGALDAGATRITEEMKLACVKAIAELAQAEQNDEVARAYAGQELSFGPDYIIPKPFDPRLIVQIAPAVAQAAADSGVATRPIEDIEAYRQKLMGFVYHSGQLMRPLFQQAKQAPKRVVYADGEDERVLRAVQTVIDEKLAEPILVGRPSVIEMRIKKFGLRMVPGQNVEIVDPEDDSRFNDTWNGYYQLRGREGVTPAIAKAMIRKHNTLIGAMLLRRGDADALLCGVASKYDNQLKYVEEVIGRKPGQTYGALNVLMLPNQTLFVTDTHVNENPSADEIANITIQAAEEMLRFGVMPKIALLSHSNFGSRPTDSSRKMAHARKLVAERAPHLEVDGEMHADAALSESIRLQAYPDSTLKGRANLLVMPNLDTGNITYNMLKMTGSNGIAMGPILLGSARPVHILTTSATVRRIVNMTALAVVDAQQEAAEG

SEQ ID NO: 35409 - protein, 898 aa, Bordetella pertussis Tohama I
MCNAQAGATPPQIPDPDPVETAEWCEALDSLTQAGGPERAAYVLQQLLARATALGVRAPGITRTAYLNTIAADQEPPFPGNLSLEERIASINRWNALAMVVRANQAHGELGGHIASYASAADLFEVGFNHFFRAPAPGFGGDLVYMQPHSAPGIYARAYLEGFLNDVDLAHFRQEITAGAQGLRGLSSYPHPWLMPDFWQFPTGSMGIGPINAIYQARFMRYLEHRSLAMPSDRKVWGIFGDGEMDEPESIAALTLAARERLDNLVFVINCNLQRLDGPVRGNGRIIDELETLYAGAGWNVIKLVWGGDWDALLRRDPDGVLAGTFSHTVDGQFQTFAANDGAYNRQHFFGQDPRLSALVADWSDEAIDRLRRGGHDMVKIHAAYHRATHHRGQPTVILAQTKKGFGMGTAGQGKMTTHQQKKLDDEALLAFRDRFALPISDADCLALKFYKPAEDSAELRYLESRRAALGGYLPRRRTEAPRLAPPPVADWARFALQAAGKEMSSTMAIVRMLTALLKDPQLGPRIVPIVADEARTFGMANLFRQVGIYSAQGQLYEPEDIGSVLAYREARDGQILEEGITEAGAISSWTAAGTSYSVNGLPMLPFYIYYSMFGFQRIGDLIWAAADQRTRGFLIGATSGRTTLGGEGLQHQDGYSHLAAAAVPNCRAYDPAYAYEVAVLVEHGMQRMLDEQCDEFYYLTVTNENLAQPDMPEGEETRTGILRGMHRVRAADATPQVRLLGAGPMLDEAMRAAQLLRDEHGLDAEVWSVTSFSELARGGRGAERAQALGLPCPDGNWLAQCLGDQATPVVAVSDYVRAVPEQIRAWVPGPYRVLGTDGFGHSDTRARLRDFFEVGAPWIVLHALDLLAREDSAWQPALQARREQLQAATRNVPSWQS

SEQ ID NO: 35410 - protein, 391 aa, Glycine max
MISSMKCTASSLTCSAFSNRKIPIARPQLVTLPTINNVEQNTGLSQLCSQKPLYLSSTENLALVKRRRETECQAYEADRSRPLEINIELPGEEAAQRFKIGLYFATWWALNVVFNIYNKKVLNAFPYPWLTSTLSLAAGSLMMLVSWATRVAEVPKVNLDFWKALFPVAVAHTIGHVAATVSMSKVAVSFTHIIKSGEPAFSVLVSRFLLGEAFPMPVYLSLLPIIGGCALAAVTELNFNMIGFMGAMISNLAFVFRNIFSKKGMKGMSVSGMNYYACLSIMSLLILTPFAIAVEGPKVWIAGWQTAVSQIGPNFVWWVAAQSVFYHLYNQVSYMSLDQISPLTFSIGNTMKRISVIVSSILIFHTPVQPINALGAAIAILGTFLYSQAKQ

SEQ ID NO: 35411 - protein, 560 aa, Arabidopsis halleri subsp. gemmifera
MASSTASISDPEAWKDLKGHVEDIKKTHLRDLMTDANRCQSMMMEFDGLLLDYSRQRATVETVDKLLNLAKAAQLTEKISRMFNGEHINSTENRSVLHVALRAPKDAVIKADGKNVVPEVWNVLDKIKEFSEKIRSGSWVGATGKPLKDVIAIGIGGSFLGPLFVHTALQTDPEALESAKGRQLRFLANIDPVDVARNINGLNPETTLVVVVSKTFTTAETMLNARTLREWITAALGASAVAKHMVAVSTNLALVEKFGIDPNNAFAFWDWVGGRYSVCSAVGVLPLSLQYGFSVVEKFLKGASSIDQHFQSTPIEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLLELTAYNVGQLLAIYEHRVAVQGFVWGINSFDQWGVELGKVLATHVRKQLHSSRTQGTTLEGFNYSTTTLLKRYLETSSEPQM

SEQ ID NO: 35412 - protein, 274 aa, Pseudomonas syringae pv. syringae B728a
MDRYVVFGNPIGHSKSPLIHRLFAEQTGQTLDYQTSLAPLDDFTAFAQAFFQAGRGANVTVPFKEQAWRLADSLTQRAQRAGAVNTLSKLDDGTLLGDNTDGAGLVRDLTVNCGRSLRGQRILLLGAGGAVRGALEPLLGQQPAALVIANRTVEKAERLAQEFADLGPVFASSFDWLEESVDVIINATSASLAGELPPIAPSLIQPGVTFCYDMMYSNEPTAFCRWATEHGAAQAVDGLGMLVEQAAEAFLLWRGVRPDSAPVLAELRRLLAAG

SEQ ID NO: 35413 - protein, 448 aa, Borrelia burgdorferi B31
MVYRIKNENLDFKIDSLGECKQNNPLIDFYASEGSSHFVNEKNKIKFSVYRNEDKGDRYEDVLLEKAGPREKIYFVPRHVKAAITTCGGLCPGFNDVIRSIVRTLWKIYGVRNIYGVKFGYQGLLPESNSPFINLNPDVVDDINKFGGTILGSSRGGIKPVEIVDTLERMNINMIFNIGGDGTQKGSLLIAEEIEKRNLKIAVVGIPKTVDNDFMFVQKSFGFETAVEQAVAAVAGAHFEANSAYNGIGLVKVMGRDSGFIAAHTALSSNDVNFCLIPELDFDIEGPNGFLVHLERRLLEKESLEEIPHAVILIAEGAGQKYFDHFPKKKDDSGNLLYEDIGLYIKDKITEYFKAKNIQFTLKYIDPSYIIRSSPANASDSLYCARLGSNAVHAAMAGKTKMLISLWSTKFVHIPIKMAVIDRNKVNPNGSFWRDVLSSTGQPISMKN

SEQ ID NO: 35414 - protein, 444 aa, Borrelia burgdorferi B31
MMKIIIIGGTSAGTSAAAKANRLNKKLDITIYEKTNIVSFGTCGLPYFVGGFFDNPNTMISRTQEEFEKTGISVKTNHEVIKVDAKNNTIVIKNQKTGTIFNNTYDQLMIATGAKPIIPPINNINLENFHTLKNLEDGQKIKKLMDREEIKNIVIIGGGYIGIEMVEAAKNKRKNVRLIQLDKHILIDSFDEEIVTIMEEELTKKGVNLHTNEFVKSLIGEKKAEGVVTNKNTYQADAVILATGIKPDTEFLENQLKTTKNGAIIVNEYGETSIKNIFSAGDCATIYNIVSKKNEYIPLATTANKLGRIVGENLAGNHTAFKGTLGSASIKILSLEAARTGLTEKDAKKLQIKYKTIFVKDKNHTNYYPGQEDLYIKLIYEENTKIILGAQAIGKNGAVIRIHALSIAIYSKLTTKELGMMDFSYSPPFSRTWDILNIAGNAAK

SEQ ID NO: 35415 - protein, 269 aa, Bacillus halodurans C-125
MCLLTFAYQTNKRFPFVFAANRDEYYDRPTLFAHEWKEDPNVIGGRDLKKGGTWLGFTKEGKIAALTNVRDSFKHSGIPFQSRGFIVQDYLTSNTSAQLFMERLIQTADEFDGYNLVFGSYHDLYYYTNRMEKGEKLKPGYYMLSNGQMNSHWPKAVKVRTHLQSVLEREQDIETIIKKLLAIMQDEERFPDEQLPDTGVGIEWERILSPIFINGKTYGTRATTVIICTDEGESFFLEWNYGPMGIFLEKREFHIQLPSSYLNMKKDYE

SEQ ID NO: 35416 - protein, 532 aa, Borrelia burgdorferi B31
MFMLNYKNLNELENFKILEGIAPEVLKTALTGKRIKEYDITIEGDSVHYNYASKQINETHLKIFQNLSDEANLIEKYKEVLDGEKINISENRKVLHHLTRGQIGKDVIEDNKENMREFFQSELEKIYNFAKQIHSGNIKSSNGKKFKNVVQIGIGGSSLGPKALYSSIKNYAKKHNLALMNGYFISNIDPDESEEVLSSINVDETLFIIVSKSGNTLETKANMQFLINKLKLNGIKEYKKQMVIITLKDSMLAIEEKGYLEYFFMHDSIGGRFSPTSAVGLTLLTLCFTEKVAKEILKGANEADKKSLNKNVKDNASLLAALISIYERNVLNYSSNCIIAYSKAMENFYLHLQQLEMESNGKSVNRFNETINYKTVRIIWGGIGTDVQHSFFQMLHQGTDIVPMDFIGFNETQLKEDVISDNSSSNDKLKANLIAQIIAFSKGKENSNKNKNFQGERPSALIYSKELTPYAIGAILSHYENKVMFEGFLLNINSFDQEGVQLGKIIANQILKNDNFKDEVIESYSKKILKKF

SEQ ID NO: 35417 - protein, 452 aa, Escherichia coli K12
MLSIFKPAPHKARLPAAEIDPTYRRLRWQIFLGIFFGYAAYYLVRKNFALAMPYLVEQGFSRGDLGFALSGISIAYGFSKFIMGSVSDRSNPRVFLPAGLILAAAVMLFMGFVPWATSSIAVMFVLLFLCGWFQGMGWPPCGRTMVHWWSQKERGGIVSVWNCAHNVGGGIPPLLFLLGMAWFNDWHAALYMPAFCAILVALFAFAMMRDTPQSCGLPPIEEYKNDYPDDYNEKAEQELTAKQIFMQYVLPNKLLWYIAIANVFVYLLRYGILDWSPTYLKEVKHFALDKSSWAYFLYEYAGIPGTLLCGWMSDKVFRGNRGATGVFFMTLVTIATIVYWMNPAGNPTVDMICMIVIGFLIYGPVMLIGLHALELAPKKAAGTAAGFTGLFGYLGGSVAASAIVGYTVDFFGWDGGFMVMIGGSILAVILLIVVMIGEKRRHEQLLQERNGG

SEQ ID NO: 35418 - protein, 334 aa, Staphylococcus epidermidis ATCC 12228
MNNEQIVFNKVPDGMPQDDTFKYEDIDVIEPSENELQLKTLYISVDPYMRGRMTNADSYVDPFKQGEPFNGHTVSKVLKSKDSNFDEGDIVVGMLPWRKINTVNSEYVNKVPTSDVPLHLYLSVLGMPGQTAYHGLLDIGQPKEGETVVISAASGAVGSVVGQIAKLKGCRVVGIAGGDKKVNYLKNELRFDAGIDYKKDNFPEALKEAVPNGIDVYFENVGGYIGDEVFKHLNTHARIPVCGAISSYNHPEKDIGPRIQQTLIKNQAMMRGFIVAEFADGFKEASKQLAQWVQENKIKTQVSVEDGFDKVPQAFRNLLTGDNFGKQVIKVASE

SEQ ID NO: 35419 - protein, 104 aa, Brassica napus
MPLSLRLAPYPTALASTTGGYGPVKKQCRIPYSGVATTRIGFFSLDYGKRVESSVVRCSLETVNVNVGQVKEVDKDTFWPIVKAAGEKIIVLDMYTQWYVSYPL

SEQ ID NO: 35420 - protein, 470 aa, Staphylococcus epidermidis ATCC 12228
MTKKLPDDFIFGGATAAYQAEGATQTDGKGRVAWDTYLEENYWYTAEPASDFYNRYPVDLELSERFGVNGIRISIAWSRIFPKGYGEVNQKGVEYYHNLFKECHKRHVEPFVTLHHFDTPEVLHKDGDFLNRKTIDYFVDYAEFCFKEFPEVKYWTTFNEIGPIGDGQYLVGKFPPGIKYDFEKVFQSHHNMMVAHARAVKLFKDENYKGEIGVVHALPTKYPYDPSNPEDVRAAELEDIIHNKFILDATYLGKYSRETMEGVQHILSVNGGQLEISDEDYKILDEAKDLNDFLGINYYMSDWMRGFEGESEITHNATGDKGGSKYQLKGVGQREFDVDVPRTDWDWMIYPQGLYDQIMRVVKDYPNYHKIYITENGLGYKDVFDEKEKTVHDDARIDYIKQHLSVIADAIADGANVKGYFLWSLMDVFSWSNGYEKRYGLFYVDFETQERFPKKSAYWYKELAESKEIK

SEQ ID NO: 35421 - protein, 215 aa, Brassica napus
AGFQLLITIGILAASFVNYLTSTMKNGWRYSLGGAAVPALILLIGSFFIHETPASLIERGKDEEGKKVLRKIRGIDNIELEFNEIKRATEISNKVKTPFKELFTKSENRPPLVCGTLLQFFQQFTGINVVMFYAPVLFQTMGSGNNASLVSTVVTNGVNALATVFAVIMVDRLGRKFFLVEGATQMMATQITIGALLLKYLHLVGPITSHAVPLI

SEQ ID NO: 35422 - protein, 407 aa, Glycine max
MLIIIGPPPNNSKLHFFSNSRQFSVLSQLSTNSSKSVSGSSGLQNSSFVSGIEYRKRPLYSVFPTKPAQVSSVEDLYEFICSGPLLDKIGITQEQVAESIDNWLLYGRYLCRLFQLNELFLTEPQKARIYHYYVPVFLWCEQQITEHQSKFKDGEDIPPLVIGFSAPQGCGKTTLVFALDYLFEVIGRKSATVSIDDFYLMAEGQNKLREANPGNALLELRGNAGSHDLAFSVETLTALTKLTREGMKLKLPRYDKSAFNGRGDRADPSTWSEVEGPLTVVLFEGWMLGFKPLPVDAVKVVDPQLETVNKNLEAYYDAWDKYIKSWIVIKIKNPNCVFQWRLQAEIAMREAGKPGMTDDEVRDFVSRYLPAYYAYLPTLYSEGPNGSDPQHLLTIEIDEGRNPILAT

SEQ ID NO: 35423 - protein, 149 aa, Triticum aestivum
MSVELVLWLFSFASVMALVGLTAYQLICLSDLEFDYINPYDSSSRINAVVIIEYVLQGVLCASFLLTLNWFPFLVMAPVTYYHVKLYMNRKHLIDVTEIFRQLHGEKKYRMIQLAFYFALFIISIYRLVMTAVLLFIDEDANLVETRTI

SEQ ID NO: 35424 - protein, 1320 aa, Escherichia coli K12
MGTTTMGVKLDDATRERIKSAATRIDRTPHWLIKQAIFSYLEQLENSDTLPELPALLSGAANESDEAPTPAEEPHQPFLDFAEQILPQSVSRAAITAAYRRPETEAVSMLLEQARLPQPVAEQAHKLAYQLADKLRNQKNASGRAGMVQGLLQEFSLSSQEGVALMCLAEALLRIPDKATRDALIRDKISNGNWQSHIGRSPSLFVNAATWGLLFTGKLVSTHNEASLSRSLNRIIGKSGEPLIRKGVDMAMRLMGEQFVTGETIAEALANARKLEEKGFRYSYDMLGEAALTAADAQAYMVSYQQAIHAIGKASNGRGIYEGPGISIKLSALHPRYSRAQYDRVMEELYPRLKSLTLLARQYDIGINIDAEESDRLEISLDLLEKLCFEPELAGWNGIGFVIQAYQKRCPLVIDYLIDLATRSRRRLMIRLVKGAYWDSEIKRAQMDGLEGYPVYTRKVYTDVSYLACAKKLLAVPNLIYPQFATHNAHTLAAIYQLAGQNYYPGQYEFQCLHGMGEPLYEQVTGKVADGKLNRPCRIYAPVGTHETLLAYLVRRLLENGANTSFVNRIADTSLPLDELVADPVTAVEKLAQQEGQTGLPHPKIPLPRDLYGHGRDNSAGLDLANEHRLASLSSALLNSALQKWQALPMLEQPVAAGEMSPVINPAEPKDIVGYVREATPREVEQALESAVNNAPIWFATPPAERAAILHRAAVLMESQMQQLIGILVREAGKTFSNAIAEVREAVDFLHYYAGQVRDDFANETHRPLGPVVCISPWNFPLAIFTGQIAAALAAGNSVLAKPAEQTPLIAAQGIAILLEAGVPPGVVQLLPGRGETVGAQLTGDDRVRGVMFTGSTEVATLLQRNIASRLDAQGRPIPLIAETGGMNAMIVDSSALTEQVVVDVLASAFDSAGQRCSALRVLCLQDEIADHTLKMLRGAMAECRMGNPGRLTTDIGPVIDSEAKANIERHIQTMRSKGRPVFQAVRENSEDAREWQSGTFVAPTLIELDDFAELQKEVFGPVLHVVRYNRNQLPELIEQINASGYGLTLGVHTRIDETIAQVTGSAHVGNLYVNRNMVGAVVGVQPFGGEGLSGTGPKAGGPLYLYRLLANRPESALAVTLARQDAKYPVDAQLKAALTQPLNALREWAANRPELQALCTQYGELAQAGTQRLLPGPTGERNTWTLLPRERVLCIADDEQDALTQLAAVLAVGSQVLWPDDALHRQLVKALPSAVSERIQLAKAENITAQPFDAVIFHGDSDQLRALCEAVAARDGTIVSVQGFARGESNILLERLYIERSLSVNTAAAGGNASLMTIG

SEQ ID NO: 35425 - protein, 122 aa, Oryza sativa
MASEKEAALAAVPNDNPTIFDKIIKKEIPSTVVFDDEKVLAFRDINPQAPTHIVIIPKVKDGLTGLSKAEERHVEILGYLLYVAKVVAKQEGLEDGYRIVINDGPSGCQSVYHIHVHLLSVE

SEQ ID NO: 35426 - protein, 157 aa, Triticum aestivum
  misc_feature (77)..(77): Xaa can be any naturally occurring amino acid
  misc_feature (90)..(90): Xaa can be any naturally occurring amino acid
  misc_feature (107)..(107): Xaa can be any naturally occurring amino acid
KPLVGGFFSPPCGGGPQKGFFSTLRNPLFWAQNIGFNPLGDVAGIIPFKANLKLGGPNVMLENRSDASLGVFQYFEXLRDTKPAEEDLCXQHLHLVDTFWSRNLCRXLIEPYSRVEIEHVAQMIELPVDHVEKKLSQMILDKKFAGTLDQGAGSSLS

SEQ ID NO: 35427 - protein, 560 aa, Arabidopsis halleri subsp. gemmifera
MASSTALISDTEAWKDLKGHVEDIKKIHLRDLMTDANRCQSMMMEFDGLLLDYSRQRATLETVDKLLNLAKAAQLTEKISRMFNGEHINSTENRSVLHVALRAPKDAVIKADGKNVVPEVWNVLDKIKEFSEKIRSGSWVGTTGKPLKDVIAIGIGGSFLGPLFVHTALQTDPEALESAKGRQLRFLANIDPVDVARNINGLNPETTLVVVVSKTFTTAETMLNARTLREWITAALGASAVAKHMVAVSTNLALVEKFGIDPNNAFAFWDWVGGRYSVCSAVGVLPLSLQYGFSVVEKFLKGASSIDQHFQSTPIEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATHVRKQLHSSRTQGTTLEGFNYSTTTLLKRYLETSSEPQM

SEQ ID NO: 35428 - protein, 404 aa, Bordetella pertussis Tohama I
MAITDVLVPQLSESVSEATLLTWKKQAGAAVEADEILIEIETDKVVLEVPAPSSGVLSEIVMGDGSTVTSGEVIARIDTAAKAAAAPAAAAEAPAAAAAPAAAAPAAASSAASGVASPAAAKILAEKGVDAASVAGTGRDGRVTKGDALAAGNAPAAKAAAPVAPPTLSLDGRPEQRVPMSRLRARIAERLLQSQAENAILTTFNEVNMQAVMDLRARYKDKFEKEHGVKLGFMSFFVKAAVAALKKYPVLNASVDGKDIIYHGYFDIGIAVGTPRGLVVPILRNADQLTIAEIEKTIADFGKRAADGKLGIEEMTGGTFSISNGGVFGSMLSTPIINPPQAAILGIHATKERPVVENGQIVIRPINYLAMSYDHRIIDGREAVLGLVAMKEALEDPQRLLLDL

SEQ ID NO: 35429 - protein, 776 aa, Nanoarchaeum equitans Kin4-M
MRILVTAALPYSNGPIHLGHIAGAYLPADIFYRFVKLKGYNALYICGSDQYGSPIELNAIKLNIDPKDYASFYRKIQEEIFKKFNIKFDIYSGTAESNIHPIIVKEFFLSLFSAGLLIEKEQELPYDPKIKRFLPDRFVVGQCPYCGYEKAYGDQCEKCGRLLEPKELINPKSAITGEKVIFKKTRHLFFNIPKLKDKLKQYIESKKDVWNDFTYSWSLALLDNFKERAITRDNKWGVKVPAKEMLEILKKALKEGKTPKDFGLLIDSTNEKDLENHIKEYENKVLYVWFDAPIGYISFTFETSPEYRYYWDEKEKPYIVHFIGKDNIPFHTIFWPALIIGRNLGYKNINHILDFDIALPYQVFGNPYLNYYGKKFSKSKRWGVFLDNIDKIDIDIDYFRFYLAYIHTVSKDMSFEWDQFKEVINKELVDNIGNFIHRVLTFIYNRFNGIPPKIEHLDDKDKELLDKIKQLPEKVFNFIWKGEIGNALREIVNTSNLANKYFQEKEPWKTNDPNTIAIAFEAVKTFIILLYPFIPEKAKLLASIANIDIKWDFNQKVEKINKPFIVFHKLSDNQIEMAKQILTNPKEYDLGKKKVIGVLRYEDELYKIELECDDNPWVCLKRELDKRKIKYIYDTVKGDVPPHIIDGNTYIYLLPALEKPNLEKAEEEYGLVSYLDFAKLDMRVGKIIDVQDHPNADKLYIIKVSLGNKQKTLVGGLKQYYKKEELIGKYVVLINNLKPKQLRGITSEGMLLAADDGKEVALLMPDKPISLGSKVR

SEQ ID NO: 35430 - protein, 475 aa, Bordetella pertussis Tohama I
MSKQFDVVVIGAGPGGYIAAIRAAQLGMSVACIDAWQNGQGGPAPGGTCTNVGCIPSKALLQSSEHYEQANHHFAEHGIEVKGVSLKLDTLIGRKNTVVKQNNDGILYLFKKNKVTYFHGKGAFAGQVDGGWSIKVTGTTDADLVAKHVIVATGSSARELPGLPFDEKNILSNDGALNIGAVPKKLGVIGAGVIGLEMGSVWRRLGAEVTILEAMPEFLAAADQQVAKEALKSFAKQGLDIQTGVKIGEIKAAAKSITVPYVDAKGAEQKLVVDKLIVSIGRVPYTGGLNAEAVGLKLDERGFVAVDEDCKTNLPNVWAVGDVVRGPMLAHKAEEEGVAVAERIAGQHGHVNFATVPWVIYTSPEIAWVGKTEQQLKAEGREYKAGSFPFMANGRARALGDTTGFAKVIADAKTDEVLGVHIIGPMASELISEAVTIMEFRGAAEDIARICHAHPTLSEAVKEAALAVDKRTLNF

SEQ ID NO: 35431 - protein, 560 aa, Arabidopsis halleri subsp. gemmifera
MASSTALISDTEAWKDLKGHVEDIKKTHLRDLMTDANRCQSMMMEFDGLLLDYSRQRATVETVDKLLNLAKVAQLTEKISRMFNGEHINSTENRSVLHVALRAPKDAVIKADGKNVVPEVWNVLDKIKEFSEKIRSGSWVGATGKPLKDVIAIGIGGSFLGPLFVHTALQTDPEALESAKGRQLRFLANIDPVDVARNINGLNPETTLVVVVSKTFTTAETMLNARTLREWITAALGASAVAKHMVAVSTNLALVEKFGIDPNNAFAFWDWVGGRYSVCSAVGVLPLSLQYGFSVVEKFLKGASSIDQHFQSTPIEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATHVRKQLHSSRTQGTTLEGFNYSTTTLLKRYLETSSEPQM

SEQ ID NO: 35432 - protein, 499 aa, Arabidopsis thaliana
MVFSVSIFASLAPYLVSSLLLFFLIEQLSYLVKKRNLPGPLFVPPIIGNAISLVRDPTSFWFKQSDTAGTSPGLAANYLIGKFIIYIRDTELSHQIFSNVRLEAFHPLGHPFGKQLFGDHSLIYLFGEDHKTVRRHLAPNFTPKALSTYSDLQQIVMLRHLRQWEESFSGGTKPVSMRDLVRELNLETSQTVFVGPYLDKEARNTFCTDYNLFNLGSMALPINLPGFAFNKARRAVMNLEKTLSVCAGKSKKRMATGEEPTCLIDFWMHAFVTEIESGNPPPLHSEDEAIGGLLFDFLFAAQDASTSSLLWAVTFLESHPKVLSKVREEVAKIWSPQSGHLITADQLAEMKYTRAVAREVVRYRPPATMVPHIATNDFPLTESYTIPKGTIVFPSVFDASFQGFTEPNRFDPDRFSETRQEDQVFKRNYLAFGWGAHQCVGQRYALNHLVLFIAMFSSLFDFKRLQSDGCDDIIYCPTISPKDGCTVFLSKRIVTYPNL

SEQ ID NO: 35433 - protein, 560 aa, Arabidopsis halleri subsp. gemmifera
MASSTALISDTEAWKDLKGHVEDIKKTHLRDLMTDANRCQSMMMEFDGLLLDYSRQRATVETVDKLLNLAKAAQLTEKISRMFNGEHINSTENRSVLHVALRAPKDAVIKADGKNVVPEVWNVLDKIKEFSEKIRSGSWVGATGKPLKDVIAIGIGGSFLGPLFVHTALQTDPEALESAKGRQLRFLANIDPVDVARNINGLNPETTLVVVVSKTFTTAETMLNARTLREWITAALGASAVAKHMVAVSTNLALVEKFGIDPNNAFAFWDWVGGRYSVCSAVGVLPLSLQYGFSVVEKFLKGASSIDQHFQSTPIEKNIPVLLGLLSVWNVSFLGYPARAILPHSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATHVRKQLHSSRTQGTTLEGFNYSTTTLLKRYLETSSEPQM

SEQ ID NO: 35434 - protein, 560 aa, Arabidopsis halleri subsp. gemmifera
MASSTALISDTEAWKDLKGHVEDIKKTHLRDLMTDANRCQSMMMEFDGLLLDYSRQRATVETVDKLLNLAKAAQLTEKISRMFNGEHINSTENRSVLHVALRAPKDAVIKADGKNVVPEVWNVLDKIKEFSEKIRSGSWVGATGKPLKDVIAIGIGGSFLGPLFVHTALQTDPEALESAKGRQLRFLANIDPVDVARNINGLNPETTLVVVVSKTFTTAETMLNARTLREWITAALGASAVAKHMVAVSTNLTLVEKFGIDPNNAFAFWDWVGGRYSVCSAVGVLPLSLQYGFSVVEKFLKGASSIDQHFQSTPIEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATHVRKQLHSSRTQGTTLEGFNYSTTTLLKRYLETSSEPQM

SEQ ID NO: 35435 - protein, 313 aa, Leptospira interrogans serovar Lai str. 56601
MHLTRNESKKLNLVCKIHKEKIEMKTKTNQSVKTFGIVGFPLSHSLSPLIHNSIYKDRNINASYLVFETQNLNVEKIQEFRNSGILGLSVTIPHKETAFTLADKADDTSRIMKASNTLLIGPDSTYAYNTDGEGAYHSILEFSPESLKTGKVVILGSGGSARGIAFSLAVSGKIQNLLVCSRNEITAKEICLLVTKNSNVKAEPISQDVLLTRKEEISLVIHTTPLGMKGQSPGPYLPEDFFNSNMTLFDIVYNPLETPLVKTAQKAGAKIIPGSEMLLYQAMKQFELFTGISPNAEDIIKTRERLSKALENR

SEQ ID NO: 35436 - protein, 113 aa, Carboxydothermus hydrogenoformans Z-2901
MSDCLFCKIARKEISSAIVYEDELVVAFRDINPVAPVHILIVPKVHVENIADLGEEHRELAGHLLLKAREIAEKEGISESGYRLVSNCRKDGGQEIYHLHFHLIGGRPLGKFA

SEQ ID NO: 35437 - protein, 497 aa, Oryza sativa (japonica cultivar-group)
MRLHAGAVQLQYFMPQQGATAAAAADHHQADSATACSASTSPAAAAATMWEYHHQLSTHAALQPSSSFPYSYWSPYSGSTALAGSAFAADSSSSSTDVMRLPAAGEHAHGHGWSHGELSNSTTGGGYRENFLDLLASKNVTPEMFEEVPASEHYNVAPAGTTLTTTARSFDHHARSDVSPIKYEIAGSPLYLGGTNTVLQVQDMTMMSSTPACYGEHHHHHHHQLTKEGSCNHQQQEQHELAISPMASFLQQISSGSASVGVHNSSLDYSGLGDQPDKICCQDGREMEASPFGMRSLPDLGSFAGYTPAIESTSVQPYMRCANSSDSNRQEQETVPARSSSSGSGAAATDRKKRKSEERQESTVKKSKQEASKASPPKQPVPKVKLGEKITALQQIVSPFGKTDTASVLFETIKYIKFLHEQVQLLSEPYTNSSRSNKQGNSVPWGDQAEASKGETMEHDLRNRGLCLVPVSWTPEVYRDGNAMDYWTPAYRGCLYR

SEQ ID NO: 35438 - protein, 187 aa, Rhodopseudomonas palustris CGA009
MRCRRMPVSPEPMTSEPRPRALIVMGVSGSGKSTVGEALAQRLGWRYEDADAYHPKANVAKMSAGQPLTDDDRWPWLKAIAAEIDRVIAGGGHIVFGCSALKGAYRDVLVHGRDDIRIVFLDGSRELIGGRMAARKNHFMPAGLLDSQFATLERPGPDERPIIASIDAPVATIVDDIVGQLPTSTSD

SEQ ID NO: 35439 - protein, 281 aa, Lactobacillus johnsonii NCC 533
MKSISKELISTVIKKRKSATHKGNYGRLLLIGGSKKYGGALIMAAEGALNSGAGLVTVATDRVNIAALHTRDPEIMTLNWDESIELKNLIKNSDVVVCGMGLGLDDKAQQILRLVRDNITLKQTLILDASALDLIGQQTDLLPLNSKILIFTPHQMEWERLSGIKISDQSDELNQVALDKLVKNKNAILVLKSNHTKVYDQAGHIYLNPFGNPGMAIGGMGDTLAGIIGGFCGQFIPNLETVAAAVGIHSLTADKIAERQYIVRPTQLSAHLPEIMKQYEK

SEQ ID NO: 35440 - protein, 107 aa, Nostoc punctiforme PCC 73102
MTPELKEKIDNLLQQNKILVFMKGNKLMPQCGFSNNVVQILNTLGVPFETVDVLSDSEIRQGIKEYSNWPTIPQVYINGEFVGGSDILIELYQKGELQQKVEVALAS

SEQ ID NO: 35441 - protein, 144 aa, Glycine max
  misc_feature (16)..(16): Xaa can be any naturally occurring amino acid
MATKNPPFKIILGSSXKARREILSEMGYEFTVMTADIDEKCIRREKPEDLVMALAEAKADAIVQRLPTGGPLEEDASTTLLITADTVVVYRGVIREKPTSEKEARDFIKGYSGSHAAVVGSVVVTNLATGKRCGGLGQCRGLLS

SEQ ID NO: 35442 - protein, 156 aa, Triticum aestivum
NKFVQKSRLVPVRNSRDIVDPRVRPRVRISRFEKKGFYLKGLKLQNVEKSFAEQHYSDLSSKPFFAGLVEYIVSGPVVAMVWEGKSVVATGRKIIGATNPLASEPGTIRGDFAVDIGRNVIHGSDSVESARKEIALWFPEGIAEWRSSQHNWIYEA

SEQ ID NO: 35443 - protein, 693 aa, Rhodopseudomonas palustris CGA009
MRLTAGTDSRLGATWDGRGTNFALFSANAHKVELCLFDAQGRRELERIELPERTEDVWHGYLNDVSPGQLYGYRVHGPYDPDRGHRFNAHKLLLDPYAKRLNGRLVWSEAHFAYRTGSPREDLSFDRRDNARGMPKVVVVDETVGSGRRETRPGVRWEDTIVYEAHVKGLTQLRDDVPPGLRGTFGGLACPTMIAHLKRLGVTTIELLPVQGFVDDRVLVEKKLVNYWGYNTISFFAPEARYAPDKDNPLDSFRTTVARLHDAGIEVLLDVVYNHTAEGNHLGPTLSFRGIDNASYYWLKPDNPRYYDDFTGCGNSMNLTHPRVLQMVMDSLRYWVEVCHVDGFRFDLATTLARGSNGFDRNSGFFTAIRQDPILAGVKLVAEPWDLGMGGYQVGAFPSQWSEWNDRYRSVMRRYWSGEGSLIGEVSRRMTGSSDMFNRDGRMPRASINHVTVHDGFTLADLFSYERKHNVANGEDNRDGSNDNHSINCGVEGPTDDPKLLGMRRQLRKNQLACLFLAQGVPLLLAGDEVGNSQAGNNNAYCQDNEIGWVGWDGTNTEDDMVEFVGLMTDIRRRFPQLRSRRWLDGRRADGSYGVLWLTPSAAEMTDQDWAFPDGRFLAYVLSPSEPGGSAIFIVLNSGVQEIEFHLPKLPEYQTWKELFDTTKNTVQVATLGCGNPMIAPPRSVLAFSGTTE

SEQ ID NO: 35444 - protein, 356 aa, Acinetobacter calcoaceticus
MTAFVQTIQEVLEKGHGPAARALDKLPSFVQESIAKVLGYPYQYPQLDSFIKCLMAVQIKQGQTGFIGSDVEKSRLAFETQMESILRKPTAITFVEDIRLPLQSGTIFARHYHPAPNKKLPMIVFYHGGGFVVGNVDTHDEACRLIAKYANAQVLSIDYPLAPEVSPQRLIQSCEDALAWVYQNKRHFKILKNQIAVAGDSAGGNISTVVAQRAIGKVYAQDAQFLIYPVVDFKSRHPSFYAYKDGLVLTGNDVDYVTDYYATKHAVHLDDPIISPTYGNFKKLAPAYIVTAGHDVLHDEGEIYSHKLRQAGVKIHFEEYLDQTHGFINLTPVSHKARANLIQMSKSFRKFWNKYA

SEQ ID NO: 35445 - protein, 592 aa, Burkholderia vietnamiensis G4
MNSSKIRAASAAMFALATIGAHAQTADSTSSAQSSTSSTAIGQGGGSSMNTNVTSSRGGNATSGSTSGVRGSGNSSVQVNLTLPSSTSGGSTVTPQSASSLAAGAPGSSPYNTQVAENVNYSGTQTIKTNPAIQAPGLTTTLSDTCMGSVSVGVSFPGFGATGGTTLVDQACVRRLDAREFRAMGLTDVALALLCQSDANRRAVEATGHLCPGTTAPLARSNVAPAADATVADDLKYRDPLVRSRMGLPPLDAAGPAPAQMRAVAVNAGQAGASVAGAPIGAPAAAAMPGAAQAAAGNGAQAAAVVPGVAAVSAAMSAVPAAATAAVSPSAATVADNVSRPAPAPVAGDKVPAPASVIAEKVSKPAPMVAQEASKPAQVVAEKAPAPVPTVAEKAPEPASTSADKASTPAPVVAEKASEPASVIAEKASTPAPVIAENASAPVPTVADEAPEPASTIAEKTTEPAATAADKAPMVADKPADPAPSLAANASARTPAATDTGAPAMPTADANAVDHAPQAPQAPIASAMPAAEAAQPVAATAPSAADATAVVESAAVPAADVPATATPAIDQHAAPSAPLAPAPTVVSTSTSS

SEQ ID NO: 35446 - protein, 377 aa, Zea mays
MADSEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFSVPAMYVAIQAVLSLYASGRTTGIVLDSGDGVSHTVPIYEGYALPHAILRLDLAGRDLTDSLMKILTERGYSFTTTAEREIVRDIKEKLAYVALDYEQELETAKSSSSVEKSYELPDGQVITIGAERFRCPEVLFQPSFIGMEAPGIHETTYNSIMKCDVDIRKDLYGNIVLSGGSTMFPGIADRMSKEITALAPSSMKIKVVAPPERKYSVWIGGSILASLSTFQQMWISRAEYEESGPAIVHRKCF

SEQ ID NO: 35447 - protein, 397 aa, Rhodopirellula baltica SH 1
MPCRLMIGGFLFLSSFTGRVMDRSVVPPSSKSTVSKRTADSDSSVASSDAVSSAHGTSGEVSPLRSIYAPIVESLAAVDARLHRELQSRYEALVPVLRHGTQLGGKRLRPALLLLSGAAMHADRTSKNPLTTEELATTEDHIVMATVVEMVHTATLIHDDVLDKAATRRHVPTINARWNDDTSILLGDYLFAQSFYLAATLPSTLACRLVGQAAQKVCEGELRQVLGRDWLDIDEETYLDIIRGKTAELTRVSCQIGADLSGGDESQVEAFARFGNDLGIAFQIADDFLDLWGDDDDVGKTLGTDLQQGKITLPLIRLLRHEDTTVATAALDALRLSPEDRLARVMPLLRKSDAAEYTRKVAESYRRSAIEAISGFAPSSALESLKTIADFAVDRRF

SEQ ID NO: 35448 - protein, 66 aa, Triticum aestivum
SQAEVAMRADGKAGMSDEEVMDFVSRYLPAYHAYLPTLYKEGPNGAKKDHLLVIDIDEERTPISGS

SEQ ID NO: 35449 - protein, 53 aa, Oryza sativa
MTLQDCIGVLSKQFPGSMRVGRLEALLFEAKGEWTDAERAYALILENNPFDQV

SEQ ID NO: 35450 - protein, 1003 aa, Cryptococcus neoformans var. neoformans JEC21
MTEGERPTFDIAVPAKDPEPKEDDKPKHTGDKGKARDESKDEGPEMSEEDLQLKAELEMLVQRLREPDSGLYQPALESLRTLIRTSTSSMTSVPKPLKFLRPFYEEMGKIRDGWSEDLKEQRSLLASILSVLAMTYSDTGKRETLYYRVLSGSEEAPGLWGHEYVRHLAAELGEEYAATYAALGEDADIPQPDTKYTTDQLRALSIELVEFFLKHNAEADAVDILLEVENISAITKYVDDKTFERVCRYMVSCVPLLVNPDDNAFLETASVIYSKYDRYPEALALAVRLNSPELIRKYYEAPTNPVMKKQLSYFLARAQIPLHWVHTNEDAEPNDTIPTQPEDVLECLGNVKLSTHFRNFGKAVGVEEAKSVDDIYKTHLEPSSRNTAIPDSARQNLASTFVNAFVNAGFGNDKLMVNAPEGQSWIYKNKAEGMMSATASVGLSLLWDSESGIDHIDKYSYSAEEHIKAGAFLATGIVHSGIRSDPDIAFALLEEHVDSQSIPLKVSAINGIAIAYAGSERQDIADKLLPYVQDESTSMEVSSMAILALGFVFVGSSNGDIASEILQTLMEREENQLASEWTVFACLGLGLLYLSAQEKSEPTLATLKAIEHPIAQIAQTIVNICANAGTGNVLKIQEMLYICSEHATEKKDEKKEDTAAEGEGESPVASSEVPGAIPAAGPPVPPTAAGVPGTDIEGDVDMSDVAAEAGAPDGGAQSAVTGEEGEKEKEAEKTAEQLKHQAFATLGIALIAMGEDVGAEMALRQFQHLMTYGDPVIRKSVPLALGLISASNPQLSILDTLSKYSHDSDLDVAINAILAMGFVGAGTNNARLAQMLRGLAVYYAKEVDCLFMVRIAQGLVHMGKGTIGINPFYSDRQVMSKTAVAGLLSVLVSFTDARKFVLGKYHWMLYWIVPAMFPQFLITLNEELEEIPVTVRVGQAVNTVAQAGTRHGISGFQTHQSPVRIATTERAELGTNEFFPYQSVLEGLVILKKNEQYNAEDLH

SEQ ID NO: 35451 - protein, 113 aa, Carboxydothermus hydrogenoformans Z-2901
MDLLKSLEEEQLRKDLPEFRPGDTVKVYFKVIEGNRERIQPYEGVVIRKRGSGLSATFTVRRVSYGIGVERTFPLHSPRIEKIEVIRRGKVRRARLYYLRKLTGKAARIAERR

SEQ ID NO: 35452 - protein, 292 aa, Vibrio angustum S14
MFKGSMVALLTPLDSAGEVDYVGLKTLVDYHINAGTSAIIAVGTTGESATLTVDEHIKVVLKTLEYVDGRVPVIAGTGANATHEAITITKLFSGTGVAACLSVTPYYNKPTQEGLFQHYKAIAEATDIPQILYNVPGRTAVDLLPETVARLAKIDNIIGIKDATADLSRVKNTRELCGEDFIQLSGDDATAVDFVAEGGHGVISVTANIAAADMAQMFTLALSGQIDAAREINERLMPLHSHLFVEANPIPVKWAAHQLGLIDNGELRLPLTVLSESQQPIVKQALLDAGVL

SEQ ID NO: 35453 - protein, 180 aa, Arabidopsis thaliana
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGFVYREHGNSPGYYDGRYWTMWKLPLFGCTDSAQVLKEVEECKKEYPNAFIRIIGFDNTRQVQCISFIAYKPPSFTG

SEQ ID NO: 35454 - protein, 558 aa, Triticum aestivum
  misc_feature (415)..(415): Xaa can be any naturally occurring amino acid
MATTNWTLPDHPTLPKGKTVAVVVLDGWGEASPDQYNCIHVAQTPVMDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLIVKGASERGAKIIRLHILTDGRDVLDGSSVGFVETIENDLAQLREQGVDARIASGGGRMYVTMDRYENDWSVVKRGWDAQVLGEAPHKFQNALEAVKTLRAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMKALEIAERTRDAILSXGKFDQVRINLPNGDMVGHTGDIEATVVACKAADEAVKMVLDAVEQVGGIYLVTADHGNAEDMVKRNKAGQPMLDKSGSIQILTSHTLQPVPVAIGGPGLHPGVRFRSDIQTPGLANVAATVMNLHGFQAPADYETTLIEVVDK

SEQ ID NO: 35455 - protein, 421 aa, Bifidobacterium longum NCC2705
MVSLRGSQIEQMEQEDARGAKVAKIARDPNTFLSTVQIGVTLSGFLSASFGASSIAPYLIPAVESWGVHPGIASGLVNIILTLIISYCSIVISEMVPKRIAMQRTEQIARAVVPAIDAFAAVCRPIIWLIGKNTNGIVRLLGFDPQQTESEVSDDELRVLVSSNTNLSKDERTILDDVFDASETIVAEVMRPRADVVFIEGDQPLAEAAAFVRDQPYSRYPVTGKDFDDVIGFVHVRDLLDVRDPNAKIVRDVVREGISLPGTSKLLPSLELLRKRGIHLAVVIDEYGGTDGIVTLEDMTEELVGDIRDEYDLPSEKGGERTTRTAFVNGVATIEASMTIEDFADLTGIELEDGPYETVAGYFLSKTGKMGAVGDVLHSDDGYNMVITKVDGRRIETIEVRKAGAPDHAPLPAESQSDDAN

SEQ ID NO: 35456 - protein, 215 aa, Glycine max
  misc_feature (158)..(158): Xaa can be any naturally occurring amino acid
  misc_feature (168)..(168): Xaa can be any naturally occurring amino acid
  misc_feature (183)..(183): Xaa can be any naturally occurring amino acid
MEFSVLPLLYSLVFLLSNPTWVCGNGELRALMDMKASLDPESLYLPSWSINGDPCDGSFEGVACNEKGQVANISLQGKGLFGKLSAAIAGLKHLTGLYLHYNSLYGEIPREIANLTELVDLYLNVNNLSGEIPRKIASMENLQVLQLCYNQLTGSIPXSFGALEKLSXLVLLQSNNLTGAIPXNLGELGMLVRLDLSSNNLFGSISTSLADAPSL

SEQ ID NO: 35457 - protein, 355 aa, Claviceps purpurea
MSRANPPNAGGSRKISFNVSEHYDIQDVVGEGAYGVVCSAVHKPSGQKVAIKKITPFDHSMFCLRTLREMKLLRYFNHENIISILDIQKPRGYDSFNEVYLIQELMETDMHRVIRTQDLSDDHCQYFIYQTLRALKAMHSANVLHRDLKPSNLLLNANCDLKVCDFGLARSAASQDDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPPRVLFPKTSDLALDLLEKLLAFNPVKRITVEEALKHPYLEPYHDPDDEPTAPPIPEAFFDFDKHKDNLSKEQLKLLIYEEIMR

SEQ ID NO: 35458 - protein, 207 aa, Arabidopsis thaliana
MASVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWIEDVRTERGSDVIIVLVGNKTDLVDKRQVSIEEGDNKARDYGVIFIETSAKAGFNIKPLFRKIAAALPGMETLSSTKQEDMVDVNLKTSSNSAQGEQQRGGCAC

SEQ ID NO: 35459 - protein, 507 aa, Nanoarchaeum equitans Kin4-M
MPIISIDTKYLKDKFDLDLEIEDLPKIKAELDSIDGNIWKIEVKDTERIDLWSVFGIARELKGIKGIEEGLPDYKIKEGNYVLYNYSRNRPYVAAAVVRNVSMDKETLKYIIQMQETLAKNYGRDRKYVAIGIHNFKMIKFPLYYKEVDPNTKFVPLGYNKELTLKEILETEKGKKYKHLVKYYEVLMDSEGKILSFPPIINSNTVGRIREDTTDLFIDVTGIDERRVHRTLNAIVANLLEIAEYAETVKIIKNNEEKVYKIEKRTMEVNWKDIEDWLGIKVEPELLRKARYDIDGNKVSWLTYRFDIYDFTDIAEDYMIIKGYDYLPYQEYKSHGQFNKTIQLYNDIRKLLLGLGATEVYTIALTDKGIIPIKNPVSSNYSYLRDSLIHPLLKFLANNQYKAPIEIFEFGRIYREKPYWSIVYLSLSEDSDYNKAASKLAFLLKELGINYEIKEGKHKYFLEGRTAEFVNDKFKAYAGEIDPNVLEKYGIVFPVSGFEIIMENLNL

SEQ ID NO: 35460 - protein, 423 aa, Debaryomyces hansenii CBS767
MTESSTLLEQARAASSNENFKEAESKYQEIILSKESSGQPTSKVLQDQEAAILELGKIYQNQKQPDKLNELLAYSRAVLGNFAKSKTAKIVKTLIEYFDNISDALELQIQATKDSIEWSVENKLSFLRQSLQLKLSALLYQKGSYQDALRIITDLLREYKKLDDKSSLVEVQLLESKLFHALRNIPKAKAALTSARTSANSIYCPTLLQAELDCQSGILNLEDKDYKTAFSYFYEAFEGFNSQDDDKAIVILKYMLLTKIMLNLIDDVNTILGSKNVLKYQSKDIDAMKSIATAYSNRSLKDFETSLSTYSQELRSDPIIKSNFNVLYDNLLEQNLLKIIESYSCVELSHISQTIGLNLQQVEGKLSQMILDKVFYGVLDQGNGWLIIYDEPRKDATYEASFGLVNNLSNIVDLLYEKASSLN

SEQ ID NO: 35461 - protein, 794 aa, Magnetospirillum magnetotacticum MS-1
MAAVLLVVWVSGSLVAWRDRVDSLSDSSRLTEALTRVVAERLSGALRGLDLMLKDVDLHSREHPDPIELVSVMHHRSAGLPEVRNVFVAGADGRVVASTLASMIGQDLSRRVYFEAAAKAPFHSGLIIAAPAVSPFTGKMGQVVVRPIIGPLGTFGGIVAAALNPEFFSEALGGVVSGDVDRAVIANLDGDVLARLPDPGRHMGGSIKSGPMFTEQLPKSRAGTFIAPSAFDGQERLASFQVLDRHPIVVSVGITTQAALRRWAVNTMIMGGTGLVFTALLLAAFIQLQRHERNRREAEAALKASEESYRILVDDQDDLIHRYAPDTTLLAVNRAYARFYGQPADQLIGRRWIEFMPEEERPFVLSCLHALNQLQPYREDRRRVFLADGQERWIEWRTTALYGALDNLTGYQTVGRDVTDSHRAQIAIAEREELYSQSFHRNPAIKLLVDPRTGAITDANDSAALFYGYPVEVLKRMHIHDINVASDEDIAREMAAVENDGRKFLRFRHRLSSGEIRDVEVYSSPLHVGGRAYLSSFVVDVSDRNRFEAELQAKTAELARSNAELEQFAYVASHDLRQPLRMVTSYVTLLERRLGDALDESSREFIGFAVSGVRRMDALIKGLLDYSRVGRGGEDFTQLDLGSVLADACANLGLGETGDEASVVVEPPMPVLPGVPSELIRLFQNLIGNAVKYRHPERKPEIRISARPEGTEWIITIADNGMGIGANYFDRIFGMFQRLHAENEFEGTGIGLAICRKIVATHGGRIWVESEEGQGSRFMVALPQSHGHTGPAAH

SEQ ID NO: 35462 - protein, 897 aa, Nocardioides sp. JS614
MTTFVFDFAEGNRELKDLLGGKGANLAEMTNLGLPVPPGFTISTEACRAFLVEGREPDSLAAEVAEHLRALEDRMGRRLGDPADPLLVSVRSGAKFSMPGMMETVLDVGLNDESVVGLAQQSGDERFAADSYRRLLQMFGGTVLGIEHDAFSDRLDALKKRRGVIADTELGVADLHELVDEYKVVIREHTGSDFPQEPAEQLRLCILAVFKSWNTPRAALYRRQERIADDLGTAVNIQAMVFGNRGVDSGSGVAFTRDPASGEPGVYGDYLTNAQGEDVVAGIRNTVPLADLEQIDPASYRELMEIMATLEKHYRDMCDIEFTIEDGKLWMLQTRVGKRTPEAAVRIAVHMAEELLIDRDEAMLRVTGHQLAALMFPRFAPDPARRAVATGMNASPGAAVGRVVLDSATAVEWAGRGEQVILVRKETNPDDLHGMVVSQGILTSRGGKTSHAAVVARGMGRTCVCGAEALDVDPENRRFIVRNGPVVNEGDVISIDGSTGEVFLGEVPVSDSAVVRKLEGEDVDDPVASAVARLLRHADEVRRLDVRANADTPEDAQRARRFGASGIGLCRTEHMFLGDRRELVEHLIVAEDEPGQAAALDKLLPLQRQDFTEIFEAMDGLPVTVRLIDPPLHEFLPDLTELSVRVALEDERQVVDEHDHKLLKAVKRLHEQNPMLGLRGVRLGITIPGLFLMQARAIAEAAATRVLAGGDPRPEIMVPLVSTERELALVRAQLEEVVASVLDEQGVELHIPIGTMIEIPRAAVTADKIAHWADFFSFGTNDLTQMTWGFSRDDVESEFFAAYLEKGVFTASPFESIDTEGVGAMVRTAAELGRRAKPGLHLGVCGEHGGDPESIHFFHEVGLDYVSCSPFRVPVARWEAARAVLAAQATGPRSDVR

SEQ ID NO: 35463 - protein, 534 aa, Cryptococcus neoformans var. neoformans JEC21
MPSGIPTRRVRLVDENAPPPPGAVVTRTRSRALASTTSTATNVKPTTTSIPMMKRQRSTISSENKIVDKSDVRRNALGEVRNGKGGEKEKESGKGKVVAIERKPLATTQAKAQRVTRSASAQPVMGVKDGDKKRKAVITSKIPSRSRSTGAEPAQVEVKPTIKTEEEPVRKRRKTSSPVVEVGEDGPTVDGKELLLSSGSKNATAFRSPKIKAKDDGWTDLDAEDEGDPTMVSEYVVEAFKYMMDIQGQTMPDPEYMDNQAELQWKMRQILMDWIIEVHSKFRLLPETLFIATNLVDRFLSKRVISLVKFQLVGLTALFIASKYEEVCCPGVEHFLHMSDGGYTVEELLKAERYMLSTLQFDMSYPNPLNFIRRISKADGYDIQSRTVAKYLVEISCVDHRLLGYTPSMLAAASMWLARLCLERGEWNANLVHYSTYSEDEIRPCAQVMLDHILDPDFDESTSFYKKYASKKHMKASVYVREWATQLWPASADGSAVERGTELELLKMFLEDEEEENNKGSKRRMKAVDEEEEY

SEQ ID NO: 35464 - protein, 383 aa, Arabidopsis thaliana
MTSRTFTRHSSLIHVFLLLSLVFSGNILQTVTSLGINYGQVGNNLPSPDKVINLLRSLRITKTRIYDTNPQILSAFANSNIEIIVTIENQVLPLLQDPQQATQWVDSHIKPYVPATRITGIMVGNELFTDDDSSLIGYMMPAIINIHKALVQLGLDRYIQVSSPSSLAVLGESYPPSAGSFKPEVSSVMQQLLDFLEATKSPFWINAYPYFAYKDNPQEIPVDYVLFNRNIGMTDPNTRLHYDNMMYAQVDAVAFAAAKLGYRNIEVRVAETGWPSKGDVGEIGASPVNAATYNRNLMMRQFAGEGTPARRNARLDVYIFALFNEDMKPGPTSEKNYGIFQPDGSLAYNLGFSTMSTTTANSESVTYSSSATKVRLVLCGEFC

SEQ ID NO: 35465 - protein, 481 aa, Xanthomonas campestris pv. campestris str. ATCC 33913
MFPGEPMSSVSIDGAPDAGENTRFIILISCVATIGGFLFGFDSGVINGTVDGLKQTFQSSAAETGFEVASMLLGCAIGAFFAGRLADRWGRRAVLIISAALFLLSAIGAGASHSSGFFIFARVMGGFAVGAASVISPAYIAEVASARYRGRLATMQQIAIISGLFCAFLSNYLLANAAGASTEPLWGGQAAWRWMFWMQAIPSLLFLLLLLVIPESPRYLVVKGRREQALVVLKRLYGNAAAQTKLGEISASMSADQHKPKFSDLISKTTGKIRPIVWIGVGLAVFQQLVGINVVFYYGAVLWQAVGFSEQDALLINVLSGGLSIGACLVTVMLVDKIGRKPLLWIGSAGMAVSLALVTYAFATASLDPNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKYVYETKGKELEQMEG

SEQ ID NO: 35466 - protein, 498 aa, Kineococcus radiotolerans SRS30216
MARAPPPRGAPSDRGAGPGDPGTTVEEDVVQLAPQEQSGLGTGLKPRHITMISIAGVIGAGLFVGSKTAIAEAGPGVLLSYAFAGLLVVLVMRMLGEMATAHPDTGSFSTYADRALGRWAGFSVGWLYWWFWVLVIPVEATAAADILSSWIGAPQWVWALLVTLALTASNLTSVGNYGEFEFWFAGVKVVAIVGFIAVGLLAIFGVLPGSDISGTPGFSLTGDAGGFLPNGFSAVLAGILLTMFSFMGTEIVTIAAAESPDPQKGVRRAVNSVIGRIGVFYLGSIFVVVALVPWNSAALDADGSFQTTLQAIGIPGAATIMDVVILTAVASCLNSALYTASRMVFSLSRRGDAPVWLSHVSRRGVPYPAILASTVVGFLAVVGNYLLPEKIFEYLLATSGALALVIYAFIALSQVVVRRRLDEAGERPAVRMWLFPWLTYATIAFIAVVLVLMVVLPGQRVQLALSLVLTVVVVALGLRHQRRRGPAARPADEAAAHR

SEQ ID NO: 35467 - protein, 178 aa, Hibiscus rosa-sinensis
ECALWMPSGTGMHLQLSHTLNYQIQVGSTVQINLPVVNEVFNTGRALRIPYTCPLARIRPLAGRYVPPEVVAVRVPLLHLSNFQINDCPDLSAKNYAVMVLILPTDSARKWRDHELELVEVVADQVAVALSHAAILEESMRARDQLMEQNVDLDLARREAERAIHARNDFLAVMNHEM

SEQ ID NO: 35468 - protein, 197 aa, Oryza sativa
PGSSNFQQHGVVTDPEAIDTLVRYSMACPALPTCGLAVTESERIMPSVNARLRDLLNSLDLPNESIVTRMTGCPNGCARPYMAEIGFVGSAPNSYQVWLGGSPNQERLAAAYTEKMPLEQLESLFEPLFVYFKQSRKGKESFGDFCHRVGFTALREFSHGYTAPAKGGKNRKNQRRVSLSDEMYAQLKGPSERDYSP

SEQ ID NO: 35469 - protein, 427 aa, Arabidopsis thaliana
MATGPVVHPQPVRGDPIDLKNAAAKNRRALGDIGNVDSLIGVEGGKLNRPITRNFRAQLLENAQVAAAANKKAPILDGVTKKQEVVRAVQKKARGDKREPSKPIEVIVISPDTNEVAKAKENKKKVTYSSVLDARSKVDSLFNIESIMCKAASKTLDIDYVDKENDLAAVEYVEDMYIFYKEVVNESKPQMYMHTQPEIDEKMRSILIDWLVEVHVKFDLSPETLYLTVNIIDRFLSLKTVPRRELQLVGVSALLIASKYEEIWPPQVNDLVYVTDNSYNSRQILVMEKTILGNLEWYLTVPTQYVFLVRFIKASGSDQKLENLVHFLAELGLMHHDSLMFCPSMLAASAVYTARCCLNKTPTWTDTLKFHTGYSESQLMDCSKLLAFIHSKAGESKLRGVLKKYSKLGRGAVALISPAKSLMSSAP

SEQ ID NO: 35470 - protein, 391 aa, Chromobacterium violaceum ATCC 12472
MKFNKLSEQNLSGKRALIRVDMNVPLKNGVIGDDTRIRASLPTIEHCLKAGAAVLLMTHLGRPTEGEPKPEDSLAPVVARLSELLGKPVRLIADFHAGVELAPGEVAMLENVRLNKGEKKNNDELGRAYAALCDVFVHDAFGTAHRAEASTHAVAKFAPVACAGLLLSAELDALGKALQAPARPLVAIVAGSKVSTKLTILEALADKVDQLIVGGGIANTFLLAEGKAIGKSLAEADLVEDARRVIAKIRARGGDVPLPADVVCAKEFAETAAAATKNVAEVVADDMILDIGPDAAKQLAAIIAQAGTVVWNGPVGVFEFDQFGNGTKTLAQAIAQSKAFSIAGGGDTLAAIAKYGITDDISYISTGGGAFLEFLEGKELPAVAILAERAQ

SEQ ID NO: 35471 - protein, 336 aa, Chromobacterium violaceum ATCC 12472
MTIRLAINGYGRIGRQVLRAIYENKLHDDFKVVAVNASGDLNINAHLTQFDTVHGRFPGSVEQDGEHLILNGDKIPFFSTRNPAELPWQALDVDLVLECTGAFTTKEKCQAHLNAGAKKVLISAPGGDDVDATIVYGVNHDTLTPEMTVVSNASCTTNCLAPVAKALNDAIGIKKGLMTTIHAFTNDQVLTDVKHKDLRRARSATDNMIPTKTGAAKAVGLVLPELKGKLDGFAVRVPTINVSLVDLTFTAMRDTCKDEINEILQGAAKGSMKGILGFNTLPLVSGDFNHTEEASTFDATLTKVTGGNLVKVLAWYDNEWGFSCQMLRTARAMFGR

SEQ ID NO: 35472 - protein, 662 aa, Chromobacterium violaceum ATCC 12472
MVTRTELANAIRFLSMDAVEKAKSGHPGAPMGMADIAEVLWRDHLKHNPANPAWADRDRFVLSNGHGSMLIYSLLHLTGYDLSIDDLKNFRQLHSKTPGHPEYGYAPGVETTTGPLGQGITNAVGMALAEKMLAAQFNRDGHEIVNHHTYVFLGDGCLMEGISHEACSLAGTWGLNKLVAFWDDNGISIDGHVEGWFSDDTPARFEAYGWQVIRNVNGHDPAEIATAIATAKKSADKPTLICCKTTIGFGAPNKQGSHDCHGAPLGAAEIAAARELLKWPHAPFEIPSEIYAEWSARDQGAVAEIEWNKRFDAYRAAHPQLAAEFERRMAGELPAGWAEAQAAAVAKIADAAQTVATRKASQIALEAFSPSLPEFVGGSADLTGSNLTNWSGSQWIDGEGNGNYISYGVREFGMAAIINGMTLHGGLRPYGGTFLMFSEYARNALRMASLMKINPIFVFTHDSIGLGEDGPTHQPVEQTATLRYIPNHHTWRPCDTTETAVAWAHAIEQKTTPSSLVLSRQNLPFVARDAAQTAAIKKGGYVLRDAENARAVLIATGSEVELALKAQETLAAEGVPVRVVSMPCTNVFDAQDKAWQQSVLPAGLPRVAVEAGHPDFWRKYVGLEGDVVGIDHFGESAPAGQLFKEFGFTVENVVAKIRAVLR

SEQ ID NO: 35473 - protein, 118 aa, Brassica napus
NELNRPLQQLRDNARKIAEIQHECKLEIDVEEYVESTIREGLMDVIYCWTTGSTFAEVMNKTDIFEGSIIRSARRLNEFLNQLRLAAEAVGENNLASKFAAASESLRRGIMFANSLYL

SEQ ID NO: 35474 - protein, 326 aa, Oryza sativa (japonica cultivar-group)
MAVYIAREATKLWRKVCAEIAVELQLLFEKWRLLLAGLVFQYIHGLAARGVHYLHRPGPLLQDLGFMALPELGQDKGYVSESVFTFIFISFLLWSFHPFIYHSKRFYTVLLWRRVLAFLVASQFLRIITFYSTQLPGPNYHCREGSKMATLPPPHNVLEVLLINFPRGVLFGCGDLIFSSHMIFTLVFVRTYHKYGSKRLIKILAWLMAIIQSLLIIASRKHYSVDVVVAWYTVNLVVFFIDNKLPEMPDRTNGSSLLPVTAKDKDGRTKEELHKLEKDCKMKEEFHKLLNGNTVDSTDRRQRVQMNGKHGEDINHTLSDATPNGT

SEQ ID NO: 35475 - protein, 332 aa, Bacillus thuringiensis serovar konkukian str. 97-27
MNPLIFKGNRPFDLIAVGRLCVDLNANETQRPMEETRTFTKYVGGSPANIAIGAARLGLQTGFIGKVSDDQMGRFITGYLKDNKINTDQIPIDCTGAVTGLAFTEIKSPEDCSILMYRDNVADLNLDPTEVSEDYIKQSKALLISGTALAKSPSREAVFLALEYARKHDVVVFFDVDYRPYTWQSEAETAVYYNLAAEKSDVIIGTREEFDMMEKLLNYEKSNDQVTAERWFSHHAKIVVIKHGGDGSIAYTRDGQSHRGGIFKTKVLKTFGAGDSYASAFIYGLMQGLEIPQAMRLGGASASIVISKHSCSDAMPTRAEISAFMETAEELV

SEQ ID NO: 35476 - protein, 393 aa, Arabidopsis thaliana
MAEEFKATASICGGGGSAWWNSPRSVMSPSDHFLSPCFGAAITSNDFSSQENHLKSRMTCTDNNNIVFGQREADSDSGGSTVTMDSTLQMMGLGFSSNCSSDWNQTILQEDLNSSFIRSSQDQDHGQGFLSTTTSPYILNPACSSSPSTSSSSSLIRTFYDPEPSPYNFVSTTSGSINDPQLSWANKTNPHHQVAYGLINSFSNNANSRPFWNSSSTTNLNNTTPSNFVTTPQIISTRLEDKTKNLKTRAQSESLKRAKDNESAAKKPRVTTPSPLPTFKVRKENLRDQITSLQQLVSPFGKTDTASVLQEAIEYIKFLHDQVTVLSTPYMKQGASNQQQQQISGKSKSQDENENHELRGHGLCLVPISSTFPVANETTADFWTPTFGGNNFR

SEQ ID NO: 35477 - protein, 444 aa, Bifidobacterium longum NCC2705
MQKFSNMPLSEVASAAVPAARRVAVPTAKPASLSAEALNIPRSGIRDVFDRVERVPDAISLTVGEPSATAAPHIVAAACEAAQAGRTRYTNVLGVPEYRKAVADYSARVKGLTYDPETEIQAVDGATIGLFLALKAVVGTGDEVIIPSPFFTSYDAEVMLCGGRPVTVALRPEHGMRVNAADIEAAITPRTRAVIINSPGNPTGAVTSAAELARIAEVCKQHNIWAISDEVYHPFVFGETFGETLGGEAAVAPSIAAVPGMKDRTIVVESLSKTYAMTGWRIGYLLAPEAVIEQTGKIAELMHSSVNSLAQYAGVAALAGPQDHVAAMREEYRAKRQIVLDGLAGCPVLRLIEPQGAFYAFVDVRLTGLDSGEFADRLLDEEHVAVVPGEAFGEEGRGFVRLSYAGDAGELREGVARLRAFAERVWNPITGHHTATYHPMEVLA

SEQ ID NO: 35478 - protein, 348 aa, Pyrococcus horikoshii
  misc_feature (1)..(1): Xaa can be any naturally occurring amino acid
  misc_feature (122)..(122): Xaa can be any naturally occurring amino acid
  misc_feature (174)..(174): Xaa can be any naturally occurring amino acid
  misc_feature (212)..(212): Xaa can be any naturally occurring amino acid
  misc_feature (244)..(244): Xaa can be any naturally occurring amino acid
  misc_feature (250)..(250): Xaa can be any naturally occurring amino acid
  misc_feature (310)..(311): Xaa can be any naturally occurring amino acid
  misc_feature (333)..(333): Xaa can be any naturally occurring amino acid
XPKFDVSKSDLERLIGRSFSIEEWEDLVLYAKCELDDVWEENGKVYFKLDSKDTNRPDLWSAEGVARQIKWALGIEKGLPKYEVKKSNVTVYVDEKLKDIRPYGVYAIVEGLRLDEDSLSQXIQLQEKIALTFGRRRREVAIGIFDFDKIKPPIYYKAAEKTEKFAPLGYKEEXTLEEILEKHEKGREYGHLIKDKQFYPLLIDSEGNVLSXPPIINSEFTGRVTTDTKNVFIDVTGWKLEKVXLALNVXVTALAERGGKIRSVRVVYKDFEIETPDLTPKEFEVELDYIRKLSGLELNDGEIKELLEKXXYEVEISRGRAKLKYPAFRDDIXHARDILEDVLIAYGY

SEQ ID NO: 35479 - protein, 441 aa, Rhodopirellula baltica SH 1
MTQLLSARAGEITPEMEYVAKREDLPVELIRDEVASGRMVIPANKVHAAGALEPMAIGIAAKCKINANIGNSAVTSNVGEELEKLHTAVHFGADTVMDLSTGKDIDNIRRQIIDKSPVPIGTVPIYQMLEELGGNIEDMNAQHFLDMVEHQAKQGVDYMTIHCGVKLEHLHLTVNRVTGIVSRGGSLIAKWMMAHNKQNPLLEAFDDLCDIMREYDVTWSLGDGLRPGSIADASDDAQFAELDVLGECTKRGWEKGTQVMVEGPGHIPLDQIQMNIERQIEVCHGAPFYVLGPLVTDIAPGYDHITSCIGAANAGMHGAAMLCYVTPKEHLGLPNEEDVKQGVIAYKIAAHTADVARKRKGAQDRDDALSKARFAFDWKEQFRLSLDPETAQRYHDETLPQDTFKSAHFCSMCGPKYCSMKITEDIRQMAKEKKLVELPTT

SEQ ID NO: 35480 - protein, 585 aa, Oryza sativa (japonica cultivar-group)
MAAPPLPLVLAAAAIASLVILVLVVFACRRWRRAVVAAAPQPPPRAAADVVAASPVRSQNEDLNKPLLEILDDHSSQSNTFPGNVVGESSKVQTSRSDTSPRSHGISDSGRTYPADSCTPQGETHVIDVTDDTSEEFHLGSTLKCTKQTSWSRPDKKHKRWGSGEDNKNGSISLKDNTYRSNLDVEVIAGPSHGISCSRQSTSPTIPITLGRVPPSDLVLKDSEVSGKHARINWNAKTLKWEIVDMGSLNGTFVNSRAVHHPNVGSRHWGEPAELADGDIITLGTSSKLSVQISLQNQRVPAGIGMASDPMVGRRSGKKLAMEDISFCQCPLQGVEQFGLFGIFDGHGGDGAARAVSKIFPENVATLLSHHETKEKVLSYSDASDVLRYAFTMTEAAIDHEYEGCTATVLLIWFDQKKDCFAQCANLGDSACVMSVNGKMIEMTEDHRVASVTERARIARAGQALKAGEVRINGLNLARMFGDKFLKEQDSRFSSEPYVSQAVHITKACTAFAVIASDGLWDVISTKRAVQLVVEGRERNSGDSASADKVANRILSEARNLRTKDNTSVIFVDFDILRTDHCIAK

SEQ ID NO: 35481 - protein, 314 aa, Nanoarchaeum equitans Kin4-M
MKVLGIECTAHTFGVGIFDSEKGVLANEKVTYKGYGIHPREAAELHLKEFDKVLLKALEKANISLKDIDLIAVSSGPGLLPTLKLGNYIAVYLGKKLNKPVIGVNHIVAHNEFARYLAKAKDPLFVYVSGANTQFLAIVNNSWFLVGETLDMGVGNLIDKVARDLGLEFPGGPKIEELAKKGKNLIELPYTIKGLNLQLGGIYTYIKRIKDQYSKEDIAYSLQEWVFALILEIAERAMHMLDKKELILTGGVACNNRLNDMAEQMAKENNFKFYRLPCQYLTDNGAMIAYLGYYWYSQGIYYEPKPRPYWRIWI

SEQ ID NO: 35482 - protein, 453 aa, Pseudomonas stutzeri
MSILNDYKRKTEGSVFWAQRARSVMPDGVTADTRAFDPHGLFISDAQGVHKTDVDGNVYLDFFGGHGALVLGHGHPRVNAAIAEALSHGVQYAASHPLEVRWAERIVAAFPSIRKLRFTGSGTETTLLALRVARAFTGRRMILRFEGHYHGWHDFSASGYNSHFDGQPAPGVLPETTANTLLIRPDDIEGMREVFANHGSDIAAFIAEPVGSHFGVTPVSDSFLREGAELARQYGALFILDEVISGFRVGNHGMQALLDVQPDLTCLAKASAGGLPGGILGGREDVMGVLSRGSDRKVLHQGTFTGNPITAAAAIAAIDTILEDDVCAKINDLGQFAREAMNHLFARKGLNWLAYGRFSGFHLMPGLPPNTTDTGSITRAEVARPDVKMIAAMRMALILEGVDIGGRGSVFLSAQHEREHVEHLVTTFDRVLDRLADENLLSWQGTNLSGNQS

SEQ ID NO: 35483 - protein, 469 aa, Mesorhizobium loti MAFF303099
MTTAKDIMKQIKDNDVKFVDLRFTDPKGKLQHVTMDVVEVEEDMFADGVMFDGSSIAGWKAINESDMVLMPDPDTVHMDPFFAQSTMVILCDILDPVSGESYNRDPRGTAKKAEAYMKSEGIGDQIFVGPEAEFFVFDDVKYKADPYNTGFKLDSTELPSNDDTDYETGNLGHRPRIKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFPDPGANPYLAFAAMLMAGLDGIKNKIHPGQPMDKDLYDLPPKELKKIPTVCGSLREALQSLDKDRGFLKAGGVFDDDQIDSYIELKMAEVMRFEMTPHPVEYDMYYSV

SEQ ID NO: 35484 - protein, 356 aa, Oryza sativa (japonica cultivar-group)
MTSSPSWFSGIARASSAMPPGGVASAAAPLSDGAGGRGGGGGGGGGGGGVVAAVVAAGPGAGAGVGAGGKRRQVQGALFKYGPKSAQVAFKTGDFNHQVIFIGGLTDGFLATDYLEPLSLALEVEKWSLVQPLLSSSYTGYGISSLEQDALELDQLISYLINKENSDGVILLGHSTGCQDIVHYMRTNFACSKAVSGVILQAPVSDREYRATLPETAEMIDLAAKMLSEGRGMDLMPREANPDAPITAYRYHSLCAYMGDDDMFSSDLSEDQLRQRLGHMSTTQCQVIFSMGDEYVPEYVDKEALVDRLCRALGNAEKVEIEWGNHALSNRVQEAVRAIVDFVKREGPKGWDDPWS

SEQ ID NO: 35485 - protein, 117 aa, Glycine max
DLCLITCSTSCLRLTKLGALLASGQLSDIVGVPTFKRTEEHALSLDIPLSVLYNIPRLDLAIDGTYEVDPDLNLVKGRGGSLLREKMVEASSDKFIVCRHDTMLVHVSCGSWLAMQV

SEQ ID NO: 35486 - protein, 132 aa, Glycine max
EEEKIPLCFLSQAITARTLVILSALAMILIQPAIAPAAFATFQTAAKTGGPAAAVGRKLIHTELLSSAWTGFLAGCLHTLSGPDHLAALAPLSIGRTRMESAAVGALWGCGHDAGQVLFGLIFLILKDQLHI

SEQ ID NO: 35487 - protein, 339 aa, Nocardioides sp. JS614
MTRSSTVSTAEALVAPGKGILAADESTPTIAKRLAAIGVESTEPVRRAYRELLLTAPGLSEHISGVILYDETLRQRTDDGVPFGELVAGAGMIPGIKVDAGTADLAGFPSEVVTEGLDGLRRRCAEYVELGARFAKWRAVIKVGEGRPTRTCIEANAHALGRYAALAQEAGLAPIVEPEVLMDGSHTIDRCAEVTVAVLWAVYDQLAEQRVLLEGTLLKPNMVLPGAECPDQVDDETIATRTVTAMRESVPVAVPGIVFLSGGQTHQQATARLDAINRHGSQPWQLSFSFGRALQAPVLEAWGGDERNRDAAQAALLERAALNGAARYGSYRPEMERPR

SEQ ID NO: 35488 - protein, 571 aa, Lolium temulentum
MRKRGTNSFYRTLGGPPKFPELRPVECQCQRIDDLAGVIKAGNGTWANDMVNKASQVLGDVAVPGQALGGNASLSGNPEKVLPRRRNLSSVEDEAWDLLRESVVNYCGSPVGTIAANDPNDSNPANYDQVFIRDFIPSGIAFLLKGEYEIVRNFILHTLQLQSWEKTMDCHSPGQGLMPASFKVRTIPLDGDENATEEVLDPDFGEAAIGRVAPVDSGLWWIILLRAYGKCSGDLSVQERIDVQTGIKMILKLCLADGFDMFPTLLVTDGSCMIDRRMGIHGHPLEIQALFYSALLSAREMLTPEDGSADLIRALNNRLVALSFHIREYYWVDMQKLNEIYRYKTEEYSYDAVNKFNIYPDQVSPWLVEWIPPKGGYFIGNLQPAHMDFRFFSLGNLWSIVSSLATTQQSHAILDLIESKWSDLVAEMPLKICYPALENLEWKIITGSDPKNTPWSYHNGGSWPTLLWQLTVASLKMNRPEIAAKAVEIAERRIATDKWPEYYDTKRARFIGKQSRLYQTWSIAGYLVAKQLLDKPDAARILWNDEDTEILNAFSTNRKRGKKVLKKTYIV

SEQ ID NO: 35489 - protein, 294 aa, Zea mays
MEQYEKVEKIGEGTYGVVYKALDKATNETIALKKIRLEQEDEGVPSTAIREISLLKEMNHGNIVRLHDVVHSEKRIYLVFEYLDLDLKKFMDSCPEFAKNPTLIKSYLYQILRGVAYCHSHRVLHRDLKPQNLLIDRRNNALKLADFGLARAFGIPVRTFTHEVVTLWYRAPEILLGARQYSTPVDVWSVGCIFAEMVNQKPLFPGDSEIDELFKIFRVLGTPNEQSWPGVSCLPDFKTAFPRWQAQDLATIVPNLEPAGLDLLSKMLRYEPSKRITARQALEHEYFKDLEMVQ

SEQ ID NO: 35490 - protein, 444 aa, Lactobacillus johnsonii NCC 533
MKKMPKDTFHNDDAILDVYEKPELGQGILLSMQHLFAMFGSTVLVPILVGINPSIALLSSGVGTLVHMLLTRFKIPAYLGSSFAFVATMQALMKQDGYPAIAQGAIAAGLVYVIVALVIAKVGSNWVNKVLPPIVVGPIIIVIGLSLATTAANDAMMKGTKYNLTYFGVAIFTLVMTLIFQMCFKGFTSLVSIMLGIVCGYALSCVLGIVDFSGVAKAAWFSMPALDVPGISYHFKWYPAAILTMAPIAFVTMTEHMGHIMVLNSLTKRNFFKNPGLHRTMMGDGLSTIIAGFIGGPPTTSYGENIGVLAMTKVHSVWVLAGAAVFAIIFSFVGKVAAVIESIPMPVIGGISFLLFGTIASNGLKILVDDRIDFGEKRNMLIASVILVIGIGGAYLQLGNFQLTSVALCTIFGMLMNWILPKQAASEKALEAEKKEKSEQKYFN

SEQ ID NO: 35491 - protein, 495 aa, Acidovorax sp. JS42
MSTNVHPVDEKLPWGRAATLGLQHVLVMYAGAVAVPLIVGRALNLPPEQVAHLISADLFVCGLVTLIQAWGATQWFGIKLPVMMGVTFAAVAPMVSMAQATGGQAGAGLIFGAVIGAGVVSMLIAPVISGLLRFFPPVVTGTIIAVIGISLMRVGINWIFGNPVGPTAPAVPNPEHLKWLAEAQAAAGAPGSSLPPVPKGFAVVPTLPNPRYADLTGVGISGVVLLTILLVARFGKGFWANISVLLGIIVGGVVTASMGLMDFHKVAGAQWFDMVLPFEIALPVFDPILILTMTLVMIVVMIESTGMFLALGEMTGREISRDDLTRGLRTDGLGTLIGGLFNTFPYTSFSQNVGLVAVTGVKSRWVCVAGGMILIVLGVLPKMAALIESLPTVVLGGAGLVMFGMVAATGIRILSNVDFQKNRNNAMIVAVSIGVGMIPLIAPNFRQWMPHAIHPLIESGILLASITAVVLNIFFNGASRDTSAAVLAARQADAH

SEQ ID NO: 35492 - protein, 306 aa, Lactobacillus johnsonii NCC 533
MIQLEKLVKKNLPKEKEGKVASYIPALAEVNPKQLGIALYDLEDGEVGEAGQSEVRFAIESISKVITLMLAIKKMGIQEVFKHVGSRQTGFAFNSILNMEIERAKYPLNPFINAGAIATTSMVVSKTGDDAFEEILDFARDICNDPDLYLDQIIYHSERRTGNLDRSLAYYMESKNMMLGDVVTSLDTYFKQCSMMVTARSLANLGAVLANGGVKPWDNKRIIPDEEARCIKSLMMTTGLYNQSGTYSRLIGVPTKSGVGGGLMSAAPHKYGIGIFSPALDKDGNSIAGLDLLRDIVDGLELDIFD

SEQ ID NO: 35493 - protein, 519 aa, Geobacter sulfurreducens PCA
MKVVSGETMQRMDRRAIDEFGIPGLVLMENAGRGCADAIREMFGRDGCIPVLVVAGKGNNGGDGYVIARLLAGEGWPVHTVVLARKDEIGGDARENLDRLDPSTVSYLPAGGTLSSLTARLDAAALVVDALLGTGLKNEVQGAYAEAIRHIAASARPVVSVDIPSGIDAATGKVLGVAVTASLTVTFALAKYGHVLYPGALHCGRLRVVNIGIPESVAREADGILYVDAAEAAAVVKRRDPCSHKGSFGHSLVIAGSVGKTGAAAMAANSAVRSGAGLVSLAVPASLNAILELKTTEAMTIPLADGGVGFLGDESLVPLRDAIRGRDAIALGPGLSWQPATAALVRHLLADIMVPLVLDADGLNAISEQTELLKGARPDTVVLTPHPGEMARLAGTTTAAVEADRIGVARDFAAQFGVYLILKGARSVIAAPDGRIALNGSGNPGMASGGMGDVLTGVVTALLGQGYEPFDACILGAFVHGHAADLVAADKGETGMSALDVQERLPYAFNSLIRLKGEQ

SEQ ID NO: 35494 - protein, 178 aa, Oryza sativa
  misc_feature (118)..(118): Xaa can be any naturally occurring amino acid
MSHFGRSGPPDIRDTFSLLVLNISFRTTADDLFPLFDRYGKVVDVFIPRDRRTGDSRGFAFVRYKYAEEAQKAIDRLDGRNVDGRNIMVQFAKYGPNAEPIRKGRIIEEVEKSRDSSXMGFMVFIVSIRHRDDHRDRERRGRSRSRSRERHGRDRDRDHRRHSRSRSRSRSRSRSRSL

SEQ ID NO: 35495 - protein, 255 aa, Xanthomonas oryzae pv. oryzae KACC10331
MCLVALAWKTHPRWCLLLAGNRDEFHERPTAALAQWAAPAENVLAGRDLRSGGSWVGLGQDGRAAVVTNVRAPLATASGRSRGNLIADYLSGSLGATAYADALAGAAHAFPPFNFLLCDADRCEHLSNHPSLARPLAAGIHGMSNGPLDALWPKTAALTEVLRHWCAHGNEDLQPLWAALGNPAIAPDAALPQTGVDLPIERLLSAAFITGPSYGTRASTIVAVDDRGQGFIHERRFGPNGLFQGETRLEIPGAR

SEQ ID NO: 35496 - protein, 531 aa, Oryza sativa (japonica cultivar-group)
MAMAASPFLILPSLFPKPTILAARIHPSIFRGRHIRCSPNGAAVPESPEPAPRRGRRKSPSPSPPKAKTTRRRTKKNTQESDSEGEEEPPKRRGRRTRKSKQEAEQEAAEKEDEVRAASPGTEDSKRAVQDEDGEAEATGSDSEDGEDSPYDWPPLVCCFGAPRWEFVPTVRVSDRQMHPDIYSTWLHLQWEPPEFARAPGSAASNVAIALTRLGGRAAVLGKVGDDDFGRELVYRMNCERVQTRAIRFDDGAATATARMKVGFRDREDGSGGTRLVAETVKSAAEDSLSKAEINVDVLKEARVFHFNSEVLLTPSMESTLFRAIELSKKFGSKIFFDLNLPLPLWRSRDETKELINKAWNEADIIEVSRDELEFLLDHEYYQYKRANPPQYYLDGFHLTRNWPQYYHYTPEEIAPIWHDGIKLLLVTYGTLRIHYYTPKFHGCVIGTEDALITPYTTDRTGSGDAVVAAAIRKLTSCPEMYEDQDTLERNLRFAVAAGIISQWTIGAVRGFPTESAAQNLKEQVYVPSMW

SEQ ID NO: 35497 - protein, 512 aa, Mesorhizobium loti MAFF303099
MSDELLTSAEMGEADRLTIAAGPLDGYGLMQRAGEAVAAVVLARYPAASRVHVLCGPGNNGGDGYVVARILAGSGVATTIWASGAPRPQSDAALAAAQCPIASRPLSGFEAESGSIVVDALYGAGLSKPLSGDAARAVGVATDRRLPVVAVDLPSGVSGDSGRVLGVAFTAAVTVTFARKKPGHLLLPGLERCGEILLADIGIGDDIIARLQPRTFENRPAHWLRDFPVPAVDAHKYKRGHVGVFSGGPSATGAARLTALAAARSGAGAVTVLSPGNAMQVNAAHLTSIMLRKTDDVADIREFVGERRPSAFVLGPGFGVGDKTRSFGLALLASGPAQDAATQVDGLVFDADAITAFRDEQGVLFEAARGPHAPALVMTPHEGEFARLFPDIADDNASSKLDRARAAAARANAVIVYKGADTVIAAPDGRAAINSNGAAWLATAGSGDVLSGISAGLLAQAMPAFEAACAAVWIHAEAGSRFGAGLIAEDLPLALVPVLRELVEARRKVPVE

SEQ ID NO: 35498 - protein, 656 aa, Methanopyrus kandleri AV19
MEMEREFEEALRNSKTFLRSIDRVITDYPKWRTVVVDLEEFDEPDIAFAVSDDVVEAMKVVQRVAMELIKKERPDVDRVWVEFRGSPIRLRARDMSVEFKDRLVTVEGIVRRVDNVAAEVVRVEAECPQCGNRFEVRRREYRPDVRCPNCGMRCEPDELFYTDYQLVVLQEAPEHVRGGEQPATVEVEFRYDHINRVRPGDRVRVTAVPRVRLPSSSPRPGDTGEIVLEAHGVERSDSPLPEEDLRFTQDEVERFEELAEGDPLGEFVEAVAPHIHGHEVIKKAVSLQLFSCVEEGQIRERVHVLIVGDPATAKSQILQHVIEHLAPRGVYVSAQHVTGAGLTAAAERTEDGWTLEAGAVVMADGGVIAIDELDKASRGDLNALLEAMESGKISVAKAGITTTLNARCAVLAAANPEAGRWQGGHPIEEINLDPALLSRFDVILFTRDEPDPEQDKLVAERMMEAFDGEFDEIEGKYELLRRYVLYATKEFPNVTISEDAREELRDWFVSARQEAADRIDEGDLRTVPVTRRQMGSVLRLARASARMRLSETVGRGDVSVALSVVEEFMKEVMQEDGVLDADVIETGKPKSVREVREYVLKVVRKLAKKHEDGVPKREIVKAVKHRVSRERVEEILDDLVEEGSLLQPRPGVYLPM

SEQ ID NO: 35499 - protein, 341 aa, Debaryomyces hansenii CBS767
MSSNTSNPLKIVDVTSVDHETAEEMLEAATSQGFLFIEGHDFTQEEVDMLFEVSKQFFALPDPYKEKYLIDSSNHGYTNYGGENLDPSSQKKGDPKEALNFCCLNFLSGLSSRAIPDWFNEDPARLELVQSTIKKLYGLSIKILNLLALGLKIEDTDECKGIDWFNSKYLASKESGSTFRFLHYPGQKSLNPESVIRAGAHTDYGSMTLLFQQENQEGLEIYSPVSKKWEAVPFVPTNSQKFPTSAPPIVVNIADQLSYWTAGLLKSTIHRVRFPAKFQETDQDRYSIVFFSHPNDESLLEPVPSELVRSRKGRGANKDTTLLTAKEHLDKRLAATYGWTY

SEQ ID NO: 35500 - protein, 504 aa, Xanthomonas campestris pv. campestris str. ATCC 33913
MTHTNGFDALHAHAQRLRGAAIPALLAAEPQRPTQYARQVGPLYFNFARQKYDRAALDALFAIARERDLAGAFQRLFRGEQVNVTEQRAALHTALRGDLTDAPVASDAYATAAEVRQRVGALIQQLEGTDVTDIVSVGIGGSDLGPRLVADALRAPSGARFRVHFVSNVDGAAMQRTLATLDPARTAGILISKTFGTQETLLNGSILHAWLGGSERLYAVSANPERAAKAFDIAPGRVLPMWDWVGGRYSLWSAVGFPIALAIGFERFEQLLDGAAQFDAHVLNTPLEENVAVLHGLTAVWNRNLLGSATHAVMTYDQRLALLPAYLQQLVMESLGKRVKLDGAAVDSDTVAVWWGGAGTDVQHSFFQALHQGTSVVPADFIGTVHNDDPYAENHVALMANVLAQTEALANGQDSSDPHRSYPGGRPSTVILLDALTPQALGALISMYEHSVYVQSVMWGINAFDQFGVELGKQLASQLLPALKGEAADVADPVTRELLAKLRG

SEQ ID NO: 35501 - protein, 365 aa, Acidovorax sp. JS42
MSKTYRIACIPGDGIGKEVIPAGQAVLEALAASQPGLGFAFTSYGWGGDWYRAHGEMMPADGLQALRDKDAILFGSAGDPHIPDHITLWGLRLKICQGFDQYANVRPTRILPGIDAPLKRCAPQDLDWVIVRENSEGEYAGVGGRVHQGHPLEAATDVSMMTRAGVERIMRFAFKLAQSRPRKLLTVVTKSNAQRHAMVMWDEIAVQISREFPDVRWDKELVDAATARMVNRPASLDTIVATNLHADILSDLAAALAGSLGIAPTGNIDPERRYPSMFEPIHGSAFDIMGKGLANPVGTFWSCVMLLEHLGEHAAAQRLMRAVEHVTANPALHTGDLGGQATTQQVTDAVCAQLAQPVGQQAALA

SEQ ID NO: 35502 - protein, 116 aa, Acidovorax sp. JS42
MGLSTHVLDTMHGCPAAGMVVALYATQGDQATLVKRLVLNPDGRTDAPLFDNASLRTGTYRLTFDVGAYFKAKGVMLPEPSFLDRVSLDFGIAHADQHYHVPLLVSPWSYSTYRGS

SEQ ID NO: 35503 - protein, 584 aa, Nostoc punctiforme PCC 73102
MLFDAFKNRKSPKIEFIKTDPTWRVAWGTVDESYENIAWRDEKFYVVLPRTASGFLTEKLAISSGGRFVVVGDVWLTNQVQLLQKLGIEPDSFQGSYLQVVANLWERWGFECLHQLVGMFALVVWDRERQVLKLVRDRIGVRTLYYTTTGSVRWIAPQLRTLSPHRSSELDLVALRDYLCCAFVPGERTLWEQVRELRPGTVLEFPDQKIEAYWQLQEQIVAIDQPLAWHGDRLRELLDQVVQEYLPPANEPVGVFLSGGLDSSCITALAAKFHKAPVHTFSIHFGSECPNELEFSSLVASHCQTQHHILEITFKDMWSRLPETMAYLDDPIGDPLTVPNLLLGRLARENVEVVLNGEGGDPCFGGPKNQPMLINSLYGSVTNQDALQAYLISFQKCAVDLPQLLKPEVWTAVQTAPWVFEEDLYSQASYLNRLMAMNIKFKGADQILTKVSNLTQAALLHGRSPLFDQRVVDLSMEIPPEYKLSGVEEKAVLKQVIADILPEEIIHRPKSGMMVPVQLGFRKYWQQEARDLLLNRNAAITPYLNQLPIRNWLNYQGDTWSRYGVKLWLLASLEIWLQVNQKVR

SEQ ID NO: 35504 - protein, 485 aa, Acidovorax sp. JS42
MSASSPHGLLINGEWVSTSQAAPNTNPSNLADVVGEYAQGDASHVDAAVAAATAAFPAWSTSGIQARHDALDKIGNEILARREELGALLAREEGKTRAEGIGEVARAGQIFKFFAGECLRLAGETVPSVRPGIGVEVTREPIGVVGLITPWNFPMAIPAWKIAPALAFGNCVVLKPADLVPGSAWALAEIIHRSGIPAGVFNLVMGRGRVIGEALVQHPGVAAISFTGSVGVGRGIAQACVQNGKKVQLEMGGKNPQVVLDDADLAQAVELSAQSAFYSTGQRCTASSRLIVTQGIYPKFIEALQARMAKIKVGDALATGTDVGPVVSQAQLEQDLSYVEIAKAEGGVLAAGGLRAACHTGSGNEGFFMAPALFVDTAPAMRINREEVFGPVASVIRVRDYDEALAVANDTEFGLSAGIATTSLKYATHFKRHAQAGMVMVNLPTAGVDYHVPFGGRKGSSYGPREQGRYAQEFFTTVKTAYTLA

SEQ ID NO: 35505 - protein, 219 aa, Zea mays
PRVRVAPPFIYIDQVKNSLTGRIEVSAQNVWIGKGGAYTGEISAEQLVDIGCQWVILGHSERRHIIGENDEFIGKKAAYALSQNVKVIACIGELLEEREAGKTFDVCFRQMKAFADSISNWADVVIAYEPVWAIGTGKVATPEQAQEVHAAVRNWLKTNISPDVASSTRIIYGGSVNAANCAELAKKEDIDGFLVGGASLKGPDFATIINSVTAKKVAA

SEQ ID NO: 35506 - protein, 318 aa, Oryza sativa
  misc_feature (242)..(242): Xaa can be any naturally occurring amino acid
MAALHHQAAAAPVTTTTDGGELRAMDLYEKLEKVGEGTYGKVYKAREKATGRIVALKKTRLPEDDEGVPPTALREVSLLRMLSQDSHVVRLLDLKQGQNKEGQTILYLVFEYMDTDLKKFIRAHRQNLQKIPVPTVKILMYQLCKGVAFCHGRGVLHRDLKPHNLLMDRKTMALKIADLGLSRSFTVPLKKYTHEILTLWYRAPEVLLGAAHYSTPVDIWSVGCIFAELATNQPLFAGDSEXLLGTPNEQVWPGVSKLPNWHEYPQWNPSKVSDLVHGLDADALDLLEKMLQYEPSKRISAKKPMEHPYFNDVNKELY

SEQ ID NO: 35507 - protein, 257 aa, Oryza sativa (japonica cultivar-group)
MAATRVWLSALLLAFLLAAAPVVQVARAQSMEEAATAEVVDGADLGIVSDDTQVSSDGPLSPAPGVETVCVFPKNAGKIVLAGEETELLVGLQNEGESTLNVVAIHSTLHLPFDHKMYGQNLTVQNFFNASVPVSVQATFPYTFAVSKFLQPGAYDLVGYIVYEIDQNPYQNVFYNGTVEVVEAGGLLSVESVFLITLGVALLGLFGLWAYGQVQQLSKKTKKAPKVELGTGTTDANMDEWLEGTAFAQGSKSKKKK

SEQ ID NO: 35508 - protein, 268 aa, Arabidopsis thaliana
MAKAEENLRDKCRWSLGGMTALVTGGSKGLGEAVVEELAMLGARVHTCARNETQLQECVREWQAKGFEVTTSVCDVSSRDQREKLMENVASIFQGKLNILVNNAGTGITKPTTEYTAQDYSFLMATNLDSAFHLSQLAHPLLKASGSGSIVLMSSTAGVVHINVGSIYGATKGAMNQLAKNLACEWARDNIRVNSVCPWFIATPLYLNDEELKKEVERKTPMGRVGNANEVSSLVAFLCFPAASYITGQTICVDGGFTVNCFSFKPVL

SEQ ID NO: 35509 - protein, 515 aa, Frankia sp. CcI3
MGYGQPPHILIVGGGYVGMYTALRLRRKLRQDEALVTVVEPNSYMTYQPFLPEAAAGNLEPRHVVVPLRKVLKGCRVVSGSALQVSHGTRTAVIKPSLGEKFDLKYDILVMCPGSVARTLPIPGLAEQGIGFKSAAEAIYLRNQVISRLDAAASVTDPAVRRRALTFLFIGGGYAGIEALAELEDMARDACSFYPDLKPTDMRWVLVEAAGRILPEVSPGMGLYTLRQLEHRGIDVRLNTRVESLVGGRVVLNNGEEFDAGTIVWTAGVRANPMLADTDLPLDDQGRVRATVFLQIDGVGDAWAAGDCAAVPDLTRGEDVTTGPSAQHAVRQARRLALNILAELRGEPLEPYEHSYAGSVASLGLHKGVAEVYGVKLRGWPAWFMHRTYHLSRVPTLNRKTRVVADWSLALFFRREIVSLGSFADPRAEFRRAAMPSAFAAAISPGTPGTPVTTTGRNGTTRAPASAVAADSPGDAEGGEAEGGEAASPGEDVVRAAPTGRISRGRSRTPGPRGT

SEQ ID NO: 35510 - protein, 638 aa, Azotobacter vinelandii
MSEIIRVPDIGGDGEVIELLVKTGDLIEVEQGLVVLESAKASMEVPSPKAGVVKSVSVKLGDKLKEGDAIIELEPAAGAAAAPAEAAAVPAAPTQAVDEAEAPSPGASATPAPAAASQEVRVPDIGSAGKARVIEVLVKAGDQVQAEQSLIVLESDKASMEIPSPASGVVESVAIQLNAEVGTGDLILTLRTTGAQAQPTAPAAAAAASPAPAPLAPAAAGPQEVKVPDIGSAGKARVIEVLVKAGDQVQAEQSLIVLESDKASMEIPSPAAGVVESVAVQLNAEVGTGDQILTLRVAGAAPSGPRARGSPGQAAAAAAAAPAPAPVGAPSRNGAKVHAGPAVRQLAREFGVELAAINSTGPRGRILKEDVQAYVKAMMQKAKEAPAAGAASGAGIPPIPPVDFAKYGEIEEVPMTRLMQIGATNLHRSWLNVPHVTQFESADITELEAFRVAQKAVAEKAGVKLTVLPLLLKACAYLLKELPDFNSSLAPSGQALIRKKYVHIGFAVDTPDGLLVPVIRNVDQKSLLQLAAEAAELAEKARSKKLGADAMQGACFTISSLGHIGGTAFTPIVNAPEVAILGVSKASMQPVWDGKAFQPRLMLPLSLSYDHRVINGAAAARFTKRLGDLLADIRAILL

SEQ ID NO: 35511 - protein, 550 aa, Oryza sativa (japonica cultivar-group)
MEEGAKIGREHEQQQQQHGRVNGSGRVAAVGGGSGGGGDEIEIEVAAAAGASPSRQHGGLHGDVQAPTWKRFLAHVGPGFVISIAYLDPSNLQTDLVAGSSHRYSLLWVLLFGFIFVLTVQSLAANLGIITGRHLAELCMGEYPKYVKYCLWLLAELGVIAATIPGVLGTALAYNMLLHIPFWAGVLACGACTFLILGLQGYGARKMEFTISVLMLVMATCFFMELGKVNPPAGGVIEGLFIPRPKGDYSTSDAVAMFGSLVVPHNLFLHSSLVLTRKMPYTSKGRKDASTFFLLENALALFIALLVNVAIVSISGTICANNLSFADTSTCSSLTLNSTYVLLKNILGKSSSTVYGVALLVSGQSCMVATSYAGQYIMQGFSGMRKCIIYLVAPCFTLLPSLIICSIGGTLRVHRIINIAAIVLSFVLPFALIPLIKFSSSCTNIGPYKNATSIIRIAWILSLVIIGINIYFFCTSFVAWLVHSDLPRVVNAIISSLVFPFMAAYIAALIYLAFRKVNLSDPFPTNSVSGEIEVQHIQIQEKQEDLGVHL

SEQ ID NO: 35512 - protein, 488 aa, Aspergillus flavus
MDPANRPLRVVTIGTGISGILMAYQIQKQCPNVEHVLYEKNADVGGTWLENRYPMAGCDVPSHAYTYPFAPNPDWPRYFSYAPDIWNYLDRVCKVFDLRRYMVFHTEVVGCYWKEDRGEWTVRLRQHAGGSEAREFEDHCHVLIHASGVFNNPKWPQIPGLHDRFQGRVIHTARWPDGYQESQWKNDRVAVIGSGASSIQTVPGMQPTVKHLDVFVRTGVWFGVLAGNTGSQTKEYSPTERDEFRRNPAALVAHAKAIEDQVNGMWGAFYTGSKGQAMGSAFFRQRTANLIKDERLREGLDPSFAFGCRRITPGDPYMEAIQKENVDVHFTPVVSCTEKGVVGGDGVEREVDTVVCATGFDASYRPRFPIVGRDGVDLREKWKECPNSYLGLAVPEMPNFFTFIGPTWPIQNGSVIGPLQAVSNYVVQWIKKAQNEYLRSFVPRQDRTDQFNDHVQEWVKHTVWKDNCRSCMFPLSLCSRLNILTRTI

SEQ ID NO: 35513 - protein, 517 aa, Oncidium Goldiana
MELCMKSQIALSAAVLQPHAGSGRFSDGETMGQRLDFSSFRRANEQICRRRRASLLRMSFATTELVAEGKLRDLELEGRDPRTVVAVILGGGAGTRLFPLTRQRAKPAVPIGGAYRLIDVPMSNCINSGINKVYILTQFNSASLNRHLLRAYNFSNGIGFGDGFVEVLAATQTPGEAGKKWFQGTADAVRQFHWLFEDAKGKEIEDVLILSGDHLYRMDYMDFVQSHRQSGADITISCVPMDVSRASDFGLMKIDNNGRVLSFSEKPKGQELKAMEVDTSVLGLSREQAKKTPFIASMGVYVFKKEILLNLLRWRFPTANDFGSEIIPASAKELFVKAYLFNDYWEDIGTIKSFCEANLSLTRHPPNFSFYDATKPIYTSRRNLPPTAINNSKIVDSIISHGSLLSNCLIEHSVVGIRSRINDNVHLKDTVMLGADLYETDAEIAALLAEGRVPVGIGENTKIKDCIIDKNARIGKNATISNVDGVQEADRSAEGFYTRSGITVILKNSTIPDGFAI

SEQ ID NO: 35514 - protein, 387 aa, Aquifex aeolicus VF5
MFEFSDRLKVLPPYLFAELDRKKQEKIEQGVDVIDLGVGDPDMPTPKPIVEAAKKALENPENHKYPSYVGKYEFRKAVADWYKRRFDVDLDPNTEVITLIGSKEGIAHFPLAFVNPGDIVLCPDPAYPVYRIGAIFAGGTPYTVPLKEENNFLPDLDSIPEDVAKKAKIIWINYPNNPTSAPPTLEFYKKLVDWAKEYNVIIASDNAYSEIYTGQEKPPSILQVPGAKDVAIEFHSLSKTYNMTGWRIGMAVGNKELVAGLGKVKTNVDSGQFGAVQDAGIVALNLPEEEVEKIRDVYRERKKIMTEALEKIGLEIYRSDYTFYLWIKVPEGYTSAEFVGRLIDEAGIVCTPGNGFGEYGEGYFRISLTVPTERLLEAAERIKNLKL

SEQ ID NO: 35515 - protein, 164 aa, Brassica napus
  misc_feature (27)..(27): Xaa can be any naturally occurring amino acid
  misc_feature (38)..(38): Xaa can be any naturally occurring amino acid
  misc_feature (51)..(51): Xaa can be any naturally occurring amino acid
  misc_feature (82)..(82): Xaa can be any naturally occurring amino acid
  misc_feature (97)..(97): Xaa can be any naturally occurring amino acid
  misc_feature (105)..(105): Xaa can be any naturally occurring amino acid
  misc_feature (138)..(138): Xaa can be any naturally occurring amino acid
  misc_feature (145)..(145): Xaa can be any naturally occurring amino acid
MASSMLSSAAEATSPAQATMVAPFTGXKTSAAFPVTRXKSNTVITYIASNXDELCCMKVWQPYRKKKFETLYYISDLTDVEXAKEVDYLLHNKWIPXVEFEMKHXFEYREHGITPGYYKGRYWTMRNLSLIRCTDFAXQLNEVQXCNTEYPNAFIRIIEYDNNQ

SEQ ID NO: 35516 - protein, 292 aa, Triticum aestivum
  misc_feature (249)..(249): Xaa can be any naturally occurring amino acid
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDHLMKILTERGYSFTTTAEREIVRDVKEKLSYIALDYDQEMETSKTSSSVEKSYELPDGPXLSPIVSERFRCPEGLFPAIFIGKETAGIHENYYNSFIKGHVDF

SEQ ID NO: 35517 - protein, 466 aa, Triticum aestivum
  misc_feature (373)..(373): Xaa can be any naturally occurring amino acid
  misc_feature (397)..(398): Xaa can be any naturally occurring amino acid
MSLGYAEKLSYREDVGTVGMPEKFDSPKLLQGKIEELAVMVQKSKHLVVFTGAGISTSSGIPDFRGPKGVWTLQRAGKGVPDASLPFHRAAPTLTHMALVELERAGLLKFVISQNVDSLHLRSGFPREKLAELHGNSFKEVCPCCKTEYLRDFEIETIGLKDTPRRCADKNCGARLKDTVLDWEDALPPEEMNSAEEQCRTADLVLCLGTSLQITPACNMPLLSIKNGGKVAIVNLQATPKDKKASLVIHGLVDKVIAGVMCILSLRIPPYIRTDFIQLLLRHTVKKKCVRWTLRVTSVHGMRAPLSFLRSIDRFPFPDRSDMKPVVLMEQPFSLQRETSMTSIFSMLLTLNFSDGCGCSSSSIECHVNFQKXKESFVRDRSLVLQELKCTAERQSXXGQHPILERESLPRAETSIHAFVTNIIRYDAEDPKGSWMNSGSSTSSNLAKRLVEGASGYSASTKKLKC

SEQ ID NO: 35518 - protein, 375 aa, Thermosynechococcus elongatus BP-1
MAMARDFYEILGVSRSADAEELKRAYRRLARKYHPDVNKEPGAEEKFKEINRAYEVLSDPQARANYDRFGEAGVSGVGAAGFSDFGIGDMGGFADIFETFFGGFTTSSRRQQGPTRGEDLRYDLKLEFREAVFGGEKEIRINHLETCKTCQGTGAKPGTRPVTCSTCGGVGQVRRSARTPFGSFTQLTTCPTCGGSGVVIEDRCESCGGQGHIQVSKKLKITIPAGVDNGTRLRVSGEGDAGLRGGPPGDLYVYLFVQPDPEFQREGNNILSRIKISYLQAILGCRISVSTVDGEAELKIPAGTQPGTVLVLEGRGVPRVGNPVARGDHLITVDVEIPTHITHEERELLEKLAKIRGERLGKGGLEGFLGSLFGG

SEQ ID NO: 35519 - protein, 316 aa, Mycobacterium sp. JLS
MTVPGLDPDAAARVASFGAIPPMRERGLDAVRRAVEATPHPDDTPEMADVDDLSIPGPAQPIPVRIYRPTEDDSAPVLVYFHGGGMVMGSNRSFEPLARALAAHSGATVVSVEYRLAPEAPAPAQFDDAYAATVWVAGNAEVIRVDASRLAVVGDSAGGSLAAAVALAARDRGGPSILCQVLLYPGLDRDMTCESIQLLADAPMLTRADIDYMHELADQGAAVPPDQYRFPALATDLTGLPPAIVVTAGCDPIRDWGERYATRLRDAGVQTTQTRYPGAYHGFLMRSDATARGRLAIAETGALLRAKFACPVPVSR

SEQ ID NO: 35520 - protein, 497 aa, Lactobacillus johnsonii NCC 533
MYHKQLDEFPTDFLWGASSAAYQIEGGAKEDGKGLSIWDKYAHQAGNTFKGTNGDVAVDHYHRYKEDVELMAKQGLKAYRFSVSWSRILPAGEGKVNQAGINFYRDLINELRKNKIEPILTIYHWDLPLALQEKYGGWESRKTIEAFVNYAKILFSEFGEKVKYWITINEQNVFTSMGYRWGTHPPKKQNIKTMFQANHYINLANALAITEFHKMVPAGKIGPSFGYGPVYPKTNSPEDVLAALNADDFNNNWWLDVYCRGKYPFFIRKQLENLNLMLEITKKDKAILENDAAHPDFLGINYYHGGTVQENRLQKPATNDKEKQFNKVDPYLMQPKGDQAKNPEVPMFNGVENDYVNKTNWGWEIDPTGLRIALRQVYEKYQLPIMITENGLGAKDIVENGKINDQYRIDYLADHVLAMKEAISDGVDLIGYCAWSFTDLLSWLNGYSKRYGFVYIDQNDEQKGTLKRIPKKSYTWYKSIIATNGNDLSLLKHGEQK

SEQ ID NO: 35521 - protein, 651 aa, Oryza sativa (japonica cultivar-group)
MTTLQLDPPVVPARRSAATSCDLHPDETFTGFCTACLRERLAGLEASAAAASAPGRKSTSAIRSLFARPFGGGAGGSSVAGAGASLPDLRRCKSFSCGRGGDALAAAAAAAAAGTARADEPQRRSCDVRGHSTLWSLFHQDDRGRVPSSSSAADIAPPHQQPPPPPPRPFIPDDFLDEDIPVVMEHDEIMPVVEPVIVVDTSGEIETEPNVVAREGKAMKDHMDFESSQPKKPPTKDLKESFWVAASVFSKKWQKWRRKQKLKKEAAVSKAAAAAMPPPEKPSKPSFLRRRRLRGEAGSELAGGRRSCDTDPRFSLDAGRMSVDDAGFSWDEPRASWDGYLFGAGAGIGLGRAPPPLSRLPPMMSVLEDTPATIVERSDGQIPVEDDADIDPPGGSLQTRDYYLDSSTRRRRSLERSSSVRRPSFEVTEPKPAPTTIANGKESPLGGSEFYHFHHAEDLLDRGFSSNSLIEDISASLEAALSGPGSAKKPRRWRKAWSLWGFIHRRASGRRSGGPSDIADRSFSEAWPDLRVRGYNPKMQRCNSNLSARSSFSSNSGGLGSSRRSHVDVNGSSARRREEHVLERNRSARYSPPGRVDNGMLRFYLTPMRSGGGGGGARRGGGGGGGGGGLPAKAGRQLTSQSFARSLLRMY

SEQ ID NO: 35522 - protein, 480 aa, Triticum aestivum
  misc_feature (458)..(458): Xaa can be any naturally occurring amino acid
AATASTGWSGQVLWRVLVPTPKQQAAGTEQPANVFLAQEHQQQRQDAAVQEASQAQNPTLMAAPYSPSPSPSHPTAAALVLLLLLLHVALLGKCAAAANVTFRPGEELRRYRRVQALLTRLNKPSLRTIQSPDGDLIDCVPAHLQPAFDYPRLRGQRPLGPPVRPSGHHRRPNHTADVGVQLWAVSGASCPEGSVPVRRITEADVLRASSVRRFGRVPMARVRRDTVAGGHEHAVGYVAGDEYYGARASINVWAPKVSTPTEFSLSQIWVIGGTFGNDLNTIEAGWQVSPQLYGDNSPRFFTYWTTDAYQTTGCYNLLCSGFVQTNSRIAMGAAISPTSGYKGGQFDISLLIWKDPNHGNWWLEFGSGELVGYWPSFLFSHLASHASMVQFGGKVVDTRAEGSHTATQMGSGHFPGEGFGRSSYFRNLEVVDWDNSLIPLTTFHVTADHPNCYDIQGXGVNAVWGNYFYYGGPGRNVRCT

SEQ ID NO: 35523 - protein, 339 aa, Hordeum vulgare subsp. vulgare
MENILHATPAHVSLPESFVFASDKVPPATKAVVSLPIIDLSCGRDEVRRSILEAGKELGFFQVVNHGVSKQVMRDMEGMCEQFFHLPAADKASLYSEERHKPNRLFSGATYDTGGEKYWRDCLRLACPFPVDDSINEWPDTPKGLRDVIEKFTSQTRDVGKELLRLLCEGMGIQADYFEGDLSGGNVILNINHYPSCPNPDKALGQPPHCDRNLITLLLPGAVNGLEVSYKGDWIKVDPAPNAFVVNFGQQLEVVTNGLLKSIEHRAMTNSALARTSVATFIMPTQECLIGPAKEFLSKENPPCYRTTMFRDFMRIYNVVKLGSSLNLTTNLKNVQKEI

SEQ ID NO: 35524 - protein, 534 aa, Glycine max
MADSTPLLSQPDSSSSPDTQKPQPPPPPRNQQHPSLGSTVELCIGEFNWSQFLQSILVSLAWIFDAQQTFISVFTDAPPAWRCTEQAGNACKTANTNTVCNLPEGSWAWDGPTQASMVSDWGLECANSSITGLPASMFFAGCLLGGFLLASLADSSLGRKNMLFFSCLVMAITSFLVTFSPNVSIYSALKFLCGFARATIGTSALVLASELVGRLSYVGPPPIGFFCFTIGFLSLPAMAYINRSSSWRNLYLWTSISTMLYCILVKLFVTESPRWLLVRGKTEEAVETLKCITSITQSNLNLAINNMSHEEETCDVDIFSALKILLQNKWSSRRLSSIMAMGIGIGLVYYGMPLGLQNLSFNLYLSVIFNALSELPSALIVLFFIDKFNRRITLLLFTILSGLFSVMSTVQVSKSSSSWNNNVQIVFELVSFFSACTSFNVYLIYTTELFPTCVRNSALSMARLAVVLGGMFSPLLVSAGRGNKFLCYGVFGLVIGFSGVFGIFLPETKGRAFCDSMDEEENKEKNMACGMLLA

SEQ ID NO: 35525 - protein, 423 aa, Leifsonia xyli subsp. xyli str. CTCB07
MSTGGDVAITAGERATESGAGRLGAGRLLLLGPAFVAAIAYVDPGNVAANLTAGASYGYLLVWVLVAANAIAVFVQYQSAKLGILTGRSLPELLGERLGAGARRGYWAQAEVVAAATDIAEVIGGAIALSLLFGLPLSLGGLIVGVVSIGILALQTCHGQRTFELVIVGFLAVISVGFLAGLVVSPVEWGAAAGGLLPRFDGTPTVLLAASMLGATVMPHAIYLHSALARDRHGVTGDPGRIRTLLSATRLDVVLALIVAGAVNIAMLLLAAASLPGVPGTDTIEGAHAAITAALGPAIGVIFGIGLLASGLASTSVGSYAGAAIMSGLLTVRVPLLARRVVTLVPAVVILSLGVDPTWALVLSQVVLSLGIPFAMIPLLRLTGSRALMGDRADALWVRAAGGAVAALVVLLNLALVVLTLLG

SEQ ID NO: 35526 - protein, 427 aa, Pseudomonas aeruginosa UCBPP-PA14
MSRSETLFNNAQKHIPGGVNSPVRAFKSVGGTPLFFKHAEGAYVLDEDDKRYVDYVGSWGPMILGHSHPDVLDAVRRQLDHGLSYGAPTALEVEMADLVCSMVPSMEMVRMVSSGTEATMSAIRLARGYTGRDSIIKFEGCYHGHSDSLLVKAGSGALTFGVPNSPGVPAAFAKHTLTLPFNDIEAVRKTLGEVGKEVACIIVEPVAGNMNCVPPAPGFLEGLREACDEHGVVLIFDEVMTGFRVALGGAQAYYGVTPDLSTFGKIIGGGMPVGAFGGKREIMQQISPLGPVYQAGTLSGNPLAMAAGLTTLRLISRPGFHNELTAYTTRMLDGLQQRADAAGIPFVTTQAGGMFGLYFSGADAIVTFEDVMASDVERFKRFFHLMLDGGVYLAPSAFEAGFTSIAHGDKELEITLNAAEKAFAALK

SEQ ID NO: 35527 - protein, 510 aa, Xanthomonas campestris pv. campestris str. ATCC 33913
MSADLLKALDLAPSNAGTYLGEGTWSQATGAGVLQPLNPTTNAVIADVQATTPQDYELIVARAQAAFKVWRTTPAPRRGEAVRLCGEALRAHKDALGSLVALEMGKSKPEGDGEVQEMIDIADFAVGQSRMLYGYTMHSERPGHRMYEQYQPLGLVGIISAFNFPVAVWAWNAFLAAICGDICIWKPSNKTPLTAIATMKICNAALKEAGFPDIFFLINDAGTSLSEKLVEDGRVPLISFTGSTQIGRVVAEKVARRLGRCLLELGGNNAIILDETADLKLAVPGIVFGAVGTAGQRCTTTRRLIVHESIYDNVLATLVKAYKQLDSKIGDPTDPANLMGPLNSRGAVEQFLESIAKAKAAGGTVEVGGTAIDRPGNFVLPAIVTGLKNSDAVVQHETFAPILYVMKYSTLDEAIDLQNGVPQGLSSSIFTQNLKAAEKFLSAAGSDCGIANVNIGTSGAEIGGAFGGEKETGGGRESGSDAWKVYMRRQTNTINYSDSLPLAQGIKFDL

SEQ ID NO: 35528 - protein, 653 aa, Candida albicans SC5314
MKVSQILPLAGAISVASGFWIPDFSNKQNSNSYPGQYKGKGGYQDDCGDDYKKGYKSKTYSKVKPITSTDCTTPIQPTGTTTGYTKDVVESTSYTTDTAYTTTVITVTKCDGGSCSHTAVTTGVTIITVTTNDVITEYTTYCPLTSTPATESTPATESTPATESTPATESTPATESTPATESTPCTTSTETTPATESTPATESTPATESTPATESTPATESTPATESTPATESTPATESTPCTTSTETTPATESTASTETASSTPVESTVIVPSTTVITVSSCYEDKCSVSSVTTGVVTISSEETIYTTYCPITSSITIPVPNTSTPAAPGTPVESQPVIPGTETTPAAPGTPVESQPVIPGTETTPAAPGTPVESQPATTPVAPGTETTPAAPGTPVESQPATTPVAPGTETTPAAPGTPVESQPVIPGTETTPAAAGTPVESQPATTPVAPGTETTPAAPGTPVESQPVIPGTETTPAAPGTPVESQPATTPVASGTETTPAAPGTPVESQPVIPGTETTPAAPGTPGTEATPVTTQPVSVLSTSQVVTASGEFSTVTAHSTSIVASCPEGGCVPEGQQTETSPSVPTNGPEVEASSSVLSIPVSSVTTSTIASSSETSVPPAQVSTFEGSGSALKKPYYGLAVAALVYFM

SEQ ID NO: 35529 - protein, 977 aa, Arabidopsis thaliana
MDRISNLPNEIICHIVSFLSAKEAAFASILSKRWRNLFTIVIKLQFDDSVKNEGSLKDFVDGVLALPTSSRVRSCSLECRREFDPTHYDDFNRCICALLKRGILDLKLDICAGRRYSLPLEVFTCKTLVKLELGSDFGGFVVDLVPEDAFLPALETLLLNYIRFKDLRRCAFEKLLSACLVLKELVIHNMEWERWKWSGNISSPTLERLTISHVDLYECEFTRINLDTPNLTYLELSDAVPDDYPIVNLDSLVEVKLDLTLMVDHKYHGYVDDNDTISSNPTNLINGLKNVEIMNLQSPNTFQAFSYFHEAIPVFKNLYHLTITNNDTVIGFCWEFLPFVIKKCPNLKTLVIDGPLHYNEDRPKSVCHCLSGYSFLLSCPLEVLQITDYSGTPGEVEQLKHFLEKLSGLKLVKLHSLTRFGSDKKKLLMLPRASSKCKIKHYDSLENALLPSLKTLILDSVKFYDRCGCCAFQKLLSACPVLVESVMRNLEWEDWEWSGCASSQTLERLTIDHRYWAEHNLESFTFDTPSLTYLDYNAHVPGSYPTVNLDSLVEAKLNLGFTTDLVEDDDDPFTSDPTNLIKGLRNVEILRLWIVVCNEFKSRVQKVDLVSNLPEEVRCHILSFLPTKHAALTSVLSKSWLNLWKLVPNLDIDDSEFLLPEEEIPEIFLSRTLVELKIRSERYVDWWRRDRGTVLPMLKTLDIDSESIHCGTIDMFLPSFPVLEYLRMANMEWTESDETVSSATIKLLSIHGTVAEDYPLVNMKALFEARINFIVTEKQIKRVRAPNEDWLQDDEVDVVLRFSNVVKLMNGIQNVQKLYLTADTIEVLSLCCESVPLFNNLKTLGITSEEGRGWQAMPVLGLLHYMTDKCGDACDCISREDKGRSLTSCPVKKLEIRGFRGTMKEMTMIKHFLVYFPCLKEMNIYVEEYDPTELRFPQVSKVIIQMMEEYNKLSSCNVQLLITDYLSEKWTAAGRIL

SEQ ID NO: 35530 - protein, 484 aa, Zea mays
MLQVLPNSGVYGPAQMLHFMSQKEFLMVSTALGTTPNRMTAPYRDFFWWQGKWLATKLLIPSPPLRNHQITPLFGPVLTQMKMTIANVVASGLPWLNLTRYKRAPGSPYVPCPHFFPLFYPHRLLSAIKCVATKPFAVEDYLVATCGLTQAQALKASKHVSHLKDPSKADAVVAFLSNLGLSSAEITDVVTRDPKVLCSDVERSLTARVAELTDLGFSRPEIVRLLIVGMNHFRHSSLRLNLEFWISVFGSLDELIRALRINAALLSTRIEEVCKPNLELLQECGINVSDISNSFMSRVLTRDPKSLQEALARLHEFRIQPGSQPFFRGLYTFAILGSGKITKSIQLFEKLGWSKDHIVSAVKRDPTILGFTEERVRRNMEFLIRVVGLEVPYIARRPALINYSIDRRLLPRNCLINFLRAKGLFNDEASFLSVAAIGDEKFRRRYVHPYEEDFPGLAAAFASSCAGEHQWERLYKMTGENKES

SEQ ID NO: 35531 - protein, 571 aa, Cucurbita maxima
MGNTCRGSFKGNIFQGYSQPEDSSTLYSKRNNSSSSARSNSDISPTSINTHNLIAQEFSKENKTKSKDNDYNQAFLSPTKKDFTMRKSAENQAYYVLGHKTANIRDLYTLGRKLGQGQFGTTYLCTEITTGIEYACKSISKRKLIAKEDVEDVRREIQIMHHLAGHKNIVTIKGAYEDSLYVHIVMELCSGGELFDRIIHRGHYSERKAAELTRIIVGVVETCHSLGVMHRDLKPENFLLVNKDDDFSLKAIDFGLSVFFKPGQIFTDVVGRPYYVAPEVLLKHYGPAADVWTAGVILYILLSGVPPFWAETQQGIFDAVLKGHIDFDSDPWPLISDSAKDIIRKMLCSRPSDRLTAHEVLCHPWICENGVAPDRALDPAVLSRLKQFSAMNKLKKMALRVIAESLSEEEIAGLREMFTAMDTDNSGAITFDELKAGLRRYGSTLKDIEIRDLMDAADIDNSGTIDYGEFIAATIHLNKLEREEHLVAAFRYFDKDGSGYITVDELQQACAEHNMTDAYLEDVIREVDQDNDGRIDYGEFVAMMQKGNAGVGRRTMRNSLNLSMRDGPGAL

SEQ ID NO: 35532 - protein, 460 aa, Aspergillus nidulans FGSC A4
MAASNDLRGWVMSAVSGVACVLGSSVICVDLLLRHFWPRSHFQIVRNNSFLSASLCLSAGVIIFTSLYSMLPTSRDYLMKAGWSPSRSAYALIGLFIAGVIGIRGLSAVLHKFLPSHVVDCAHTHEASPRDDSDLERGKLSHAALDHRPRKRLSERTPLLTSHKSTPAGIGLPGTGREPGGIVRTGREPWRVRLGRRMYTLIGGAKAYCDENGPCYGFSQACGDECTKTLIRPAVSADDASDTDIQVPGLSADAPSSSSETETADNAPSSPPMGAEADGQSKHPVSVAQHHHHVPQNAFLSIGLQTSVAIALHKLPEGFITYATNHASPTLGMTVFLALFIHNISEGFAMALPLYLAIHSRGWAMFWSSLLGGISQPAGAGLAALWIWGARKAGSGAGDGQNETSWAVYGCMFAVTAGVMTSVGLQLFTEGLVLTHQRNMAIGFAIGGMGLMGLSFALTT

SEQ ID NO: 35533 - protein, 312 aa, Rhodococcus sp. RHA1
MTRVRRAYTRAMTDSSAPVAPFGRVLTAMATAFTVDGEIDEEATARIAVHLVDHGHDGLVVSGTTGEAATTTTAEDGRILQVVKDAVGDRAKIVAGVGTNDTRHTLELARQAVMHGADGLLLVTPYYNKPSQGGVLQHFRYVVEAVDAPVMVYDIPSRAGTKLAPSTFETMAEWPSVVAVKDAAGDPTQAIMLRELGYAVYSGDDSLTLGFLAYGACGVVSVLGHVAGDEIRTMIDAFVSGDVETAREINARLQPALRAVMGVPNYGATTVKGALQLLGVLQNRIVRSPLLALDDGEYEALRTGLHASGLLH

SEQ ID NO: 35534 - protein, 558 aa, Cucurbita maxima
MGNTCRGSFKGNIFQGYSQPEESSTPNFKRNINGSSDHSPSSINTNNLISQAFAEENKTKSKDNDCKKDYTMRKSAENQAYYVLGHKTANIRDLYTLGRKLGQGQFGTTYLCTEIMTGIEYACKSISKRKLIAKEDVEDVRREIQIMHHLAGHKNIVTIKGAYEDSLYVHIVMELCSGGELFDRIIQRGHYSERKAAELTRIIVGVVETCHSLGVMHRDLKPENFLLVNKDDDFSLKAIDFGLSVFFKPGQIFTDVVGSPYYVAPEVLLKHYGPAADVWTAGVILYILLSGVPPFWAETQQGIFDAVLKGHIDFDSDPWPLISDSAKDLIRKMLCSRPSDRLTAHEVLCHPWICENGVAPDRALDPAVLSRLKQFSAMNKLKKMALRVIAESLSEEEIAGLREMFTAMDTDNSGAITFDELKAGLRRYGSTLKDTEIRDLMEAADIDNSGTIDYGEFIAATIHLNKLEREEHLVAAFRYFDKDGSGYITVDELQQACAEHNMTDAYLEDIIREVDQDNDGRIDYSEFVAMMQKGNAGIGRRTMRNSLNLSMRDGPGAL

SEQ ID NO: 35535 - protein, 389 aa, Haloferax volcanii DS2
MPTRSARFPVDERDGRPAAVKWTIHIASHLCPQGPYLTAYVKSAVYRGPGDVRIEEKPEPELQQPTDAVIRVTHTAICGSDLWFYRGHEEHEEGSGVGHEPMGIVEEVGEDVTSVQPGDRVLVPFAYSCGECEFCRKGIHTACVDGGFFGPHGDETGGAQAEKVRVLHADGTVVRVPERYADDEETLKSLLPLTDVMSTGHHAAVLADLEAGDTAVVIGDGAVGLCGVLAAKRIGAERIIAVGHHEDRLEVARELGATDTVSSRGQEAVEEVLELTHGGANHVLECVGAASALETAAQVARPGGSIGAVGVPHVESADFLQPIFYKNLSFSAGGAPVRNYIEELMDDVLQGTLDPSPILTKTVDLDGVPEGYQAMDDREAIKVMVKVDE

SEQ ID NO: 35536 - protein, 310 aa, Mycobacterium sp. JLS
MTGALDPQIADLIERLDRGFPPVQTMTGAQARATIRSRFIAPAEPEPVAAVEDRSVGEIPIRIYHPAGAGPLPVLVYAHGGGFVFCDLDSHDGLCRDIANQTAAIVVSVDYRLAPEHPWPAAAEDVYAVTRWVADNCTALGADPGRIAVGGDSAGGNLAAVTALIARDRGGPSLVAQLLVYPMVTPDFTTESYRLFGSGYYNPAEALRWYWDQYVPNDFDRTHPYVSPLHADLSGLPPAVVVIAGHDPLRDEGVRFGEALSAAGVPTVVRCFDGGIHGFMTMPSLELAQTARAQLCQDAVALLTGVPAGG

SEQ ID NO: 35537 - protein, 470 aa, Geobacter sulfurreducens PCA
MTPQEVVSFAKENGALMVDYKFMDFVGIWQHVSVPISEFGEDTFEEGQGFDGSSIRGWQPIHASDMILLPDPATAKMDPFIAVPTLSLICNVFDPITKEDYTRDPRNIARKAEAYLKSTGLGDTAFFGPEAEFFIFDDVRYDSTSNQSFYMVDSVEGAWNTGREEFPNLGYKPRHKEGYFPVSPTDSQNDLRNEMVMELQKVGIRVECQHHEVASGGQAEIDMRFSSLVDMADQLQWFKYVIKNVAYRNGKTVTFMPKPLYGDNGSGMHCHMSIWKDGQNLFAGDKYGGLSQMALWYIGGIIKHAKALCALTNPTTNSYKRLVPGFEAPVNMAYSSRNRSASIRIPMMSTNPKAKRIEYRTPDPSCNGYLAFAAMLMAGLDGIENKIDPGQPLDKDIYGLSPEELKNIPSAPGSLEEALKALEADHEFLLKGDVFTPDVVEKWIEYKMEAEVNPVRMRPVPLEFALYYDI

SEQ ID NO: 35538 - protein, 228 aa, Geobacter sulfurreducens PCA
MLSAVIFDFDGIIVDTEPLHYRAFQAILEPIGFGYSWEAYVDVYMGYDDRDAFREAFRVRGADLEDRELEGLIARKAAAFQEIIASGVTPYPGVVELIRNIKANHPVALCSGALRSDILPILEGLGLSGIFDVMVTADEVSASKPDPASYALAVRRLTAAFPNRQIRPETCIAIEDTPAGIASATGAGIGVLAVTNSYPAVRLGGARRVVDSLADVGLADLAALAGQE

SEQ ID NO: 35539 - protein, 497 aa, Triticum aestivum
  misc_feature (68)..(68): Xaa can be any naturally occurring amino acid
MARKMLKDGEAPVVADDGGSYDYDLFVIGAGSGGVRGSRTAAGFGAKVAICELPFHPISSEWLGGHGXGTCVIRGCVPKKILVYGASFRGEFDDAKQFGWEINGDINYNWKKLLENKTQEIVRLNGVYKRILGGSGVTMIEGAGSIVDAHTVEVTQPDGSKQRHTTKHILIATGSRATLVNIPGKELAITSDEALSLEELPKRALILGGGYIAVEFASIWKGLGAEVDLFYRKELPLRGFDDEMRTVVASNLEGRGIRLHPGTNLTELSKTADGIKVVTDKGDELIADVVLFATGRAPNSNRLNLEAVGVEVDQIGAIKVDEYSRTSVPSIWAVGDVTNRINLTPVALMEATCFAKTVFGGQTVKPDYKDVPCAVFCIPPLSVVGLSEQEALAETKNDLLIYTSSFNPMKNSISKRVEKSTMKLVVDAETDKVLGAAMCGPDAAEIMQGIAVALKAGATKATFDSTVGIHPSAAEEFVTMRTLTRRVSPPSKPKTNL

SEQ ID NO: 35540 - protein, 184 aa, Triticum aestivum
QAIYLHRPAMAPPVMASSATSVAPVQGVKSTAGLPVSRRSNGDGLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 35541 - protein, 473 aa, Arabidopsis thaliana
MVFFRSVSAFTRLRSRVGQQSSLNNSVRWIQMQSSTDLDLKSQLQELIPEQQDRLKKLKSEHGKVQLGNITVDMVIGGMRGMTGLLWETSLLDPEEGIRFRGLSIPECQKVLPTAQSGAEPLPEGLLWLLLTGKVPSKEQVEALSKDLANRAAVPDYVYNAIDALPSTAHPMTQFASGVMALQVQSEFQKAYENGIHKSKFWEPTYEDCLNLIARVPVVAAYVYRRMYKNGDSIPSDKSLDYGANFSHMLGFDDEKVKELMRLYITIHSDHEGGNVSAHTGHLVGSALSDPYLSFAAALNGLAGPLHGLANQEVLLWIKSVVEECGEDISKEQLKEYVWKTLNSGKVIPGYGHGVLRNTDPRYVCQREFALKHLPDDPLFQLVSKLYEVVPPVLTELGKVKNPWPNVDAHSGVLLNHYGLTEARYYTVLFGVSRSLGICSQLIWDRALGLALERPKSVTMDWLEAHCKKASSA

SEQ ID NO: 35542 - protein, 391 aa, Acalypha californica
REFTSDSADVPITAAGALKSYKLAAKAISRLQSLPSGNMSLLCDVLVKEVSDLTGYDRVMVYKFHEDEHGEVIAECHRPDMEPYLGLHYPATDIPQASRFLFIKNKVRMICDCLAPPVKVIQDSSLTQPVSLCGSTLRSPHGCHAQYMTNMGTLASLVMSATINEDADEIDDDQQKGRKLWGLVVCHHNSSRFVPFPLRYACEFLIQVFGVQINKELELAAQMREKNMLQTQTVLCDMLLRDAPEAIITQSPNVMNLVKCDGAALYYRKKFWLLGVTPTEAQIKDIADWLLEYHGESTGLSTDSLMEAGYPGASILGDAVCGMAAIRISSKDFLFWFRSHTAKEIKWSGAKHDPEDKDDGRKMHPRSSFKAFLEVVKWRGLPWEDMEMDAI

SEQ ID NO: 35543 - protein, 366 aa, Bacillus cereus E33L
MIRTEEMLLNVGPQHPSTHGVFRLVIKIDGEIIKEATPVIGYLHRGTEKIAESLQYTQIIPYTDRMDYLSAMTNNYVICHAVETMMGLEIPERAEYLRVLAMELGRIASHLVWWGTNLLDIGAVSPFLYAFREREMIINLLNELCGARLTFNYMRVGGVKWDAPDGWIEKVEEFVPYMREQLAGYHDLVSGNEIFLNRVKGVGIYSEEDAISYSLSGANLRCTGVNWDLRKDEPYSIYDRFDFHIPVGSVGDAWDRYVCRMQEIEESLKIVEQAVQQFPKEGAVLAKVPKIIKAPKGEAFVRIESPRGEIGCYIASDGKKEPYRLKFRRPSFYNLQILPKLLKGENIANLITILGGVDIVLGEVDG

SEQ ID NO: 35544 - protein, 391 aa, Atuna racemosa
DLEPVNPADVPVTAAGALKSYKLAAKAISRLQSLPSGNISLLCDVLVKEVSDLTGYDRVMVYRFHEDEHGEVVAECCRPDLEPYLGLHYPATDIPQASRFLFMKNKVRMICDCLAPPVKVIQDKRLAQPLSLCGSTLRAPHGCHSQYMANMGAIASLVMSVTINDDEEEMEADQRKARKLWGLVVCHHTSPRFVPFPLRYACEFLIQVFGIQINKEVELAAQTREKHILRTQTVLCDMLLRDAPVAIITQSPNVMDLVKCDGAALYYRKKFWLLGITPTEAQIKDIVEWLLHYHGESTGLSTDSLMEAGYPGASVLGGAVCGMAAVKITSKDFLFWFRSHTAKEIKWGGAKHDPNDKDDGRKMHPRSSFKAFLEVVKRRSLPWEDVEMDAI

SEQ ID NO: 35545 - protein, 156 aa, Brassica napus
  misc_feature (35)..(35): Xaa can be any naturally occurring amino acid
  misc_feature (82)..(82): Xaa can be any naturally occurring amino acid
  misc_feature (108)..(108): Xaa can be any naturally occurring amino acid
RPTRPLKAFFAYAGRDWILATAAALFCAYIAPAAXAGSGIPEGKAYGNGLDACGILADSTLYVKVLMHFDMSFESIFEVAHXCMTRKEGPMVHTGTCIANPLGQGRPXKYKLTWKDIRCYKNDRYRRDLITCGSAAGVTAALRAPVGRILLDLDEA

SEQ ID NO: 35546 - protein, 375 aa, Xanthomonas campestris pv. campestris str. ATCC 33913
MTPILFVDRDGTLITEPADFQIDAYEKLRFVDGVIPAMLKLRDAGYQFVIVSNQDGLGSESYPQASFDGPNNLMLQIFASQGIVFREVLIDCSWPADNAPTRKPGVGLMVPYLQDRTIDWSRSAMVGDRITDIQFAQNLNIRGFQLRTEQFGGDWDWAGIAHELADAPRRAVVQRNTKETRIRVELDLDRVAEPHTATGLPFFDHMLEQIGKHGGFALDIRAEGDLHIDEHHTIEDTGLALGQALREALGDKRGIGRYGFDPDDSPWRVAGDTTQHGFTLPMDETIASAALDFSGRPYFVFDGDFKRERVGDMPTELVPHFFRSVCDASGLNLHLHVRGENDHHKVEGCFKALARALRQAIRREGTALPSTKGAL

SEQ ID NO: 35547 - protein, 458 aa, Listeria monocytogenes EGD-e
MEEQKEELQRGLKNRHIQLIAIGGAIGTGLFLGAGKSIHLAGPSIMLVYLIIGAILFFVMRALGELLIHNPTTGSFTEFAEQFIGPWAGFITGWTYWFCWIVTGIAEITAVGMYVKFWVPDLPQWIPALACVLILLLFNLATVKAFGEIEFWFAIIKVVVIIALIVIGFVLVFIGYKHGTSTASFSNLVDYGGFFPNGIAGFLLAFQMATFSFVGIELVGVTAGEADDPERTLPKAINNIPIRILIFYIGALLVLMSIYPWSNIDPNTSPFVSVFTMIGIPAAAGIINFVVLTAAMSSCNSGIFSTSRMLYTLSAEGKAPKKMHHLSSNGVPATALITSTACLLIGVFLNYFLPEQVFILVTSIATICFIWVWGVILVAHLRFRHKHPEISEKSKFKMPLSPLMNWVSLIFFGGLLVILGFAADTRIALFVTPVWFLILGIAYQILKASNRKTKIRHN

SEQ ID NO: 35548 - protein, 385 aa, Xanthomonas oryzae pv. oryzae KACC10331
MLAVPVLEPHRQERHPMKSRAAVAFGPGKPLEMVEIDVAPPKAGEVLVRITHTGVCHTDAFTLSGDDPEGIFPSVLGHEGGGIVEQVGEGVTSVKVGDHVIPLYTAECRKCKFCLSGKTNLCQAVRATQGKGLMPDGTTRFSYNGEPIYHYMGCSTFSEYTVVPEISLAVVNPEAPLEKVCLLGCGVTTGIGAVHNTAKVKPGESVAVFGLGGIGLAVIQGAVQAKAGRILAIDTNPGKFDLARSMGATDCINPKDYDKPIQEVIVELTDGGVDFSFECIGNVNVMRSALECCHKGWGESVIIGVAGAGQEISTRPFQLVTGRVWRGSAFGGVKGRTQLPGMVEQSMKGEIDLDPFITHTMPLEEINEAFHLMHEGKSIRTVIHF

SEQ ID NO: 35549 - protein, 632 aa, Chromobacterium violaceum ATCC 12472
MNAPVNKQMVVDAAAIQPLPNSRKIYVEGSRPDIQVPMREIRQADTPTQFGGEKNPPIFVYDTSGPYSDPAARIDIQSGLAPLRAAWIAQRGDCEQLPGLSSEYGRAREADPKLAELRFNLQRKPRRAKAGRNVTQMHYARRGIVTPEMEFVAIRENLNRRAYVESLQAAGNRRLLDLMTRQHQGQSFGAHLPEEITPEFVREEIAAGRAIIPANINHPESEPMIIGRNFLVKINGNIGNSAVTSSISEEVDKMTWGIRWGADTIMDLSTGKNIHETREWILRNSPVPIGTVPIYQALEKVNGKAEDLSWEIFRDTLIEQAEQGVDYFTIHAGVRLAYVPMTANRMTGIVSRGGSIMAKWCLAHHRENFLYTHFEDICEIMKAYDVAFSLGDGLRPGSAWDANDEAQLSELKTLGELTEIAWKHDVQVMIEGPGHVPMQLIKENMDKELEWCREAPFYTLGPLTTDIAPGYDHITSAIGAAQIGWYGTAMLCYVTQKEHLGLPNKHDVKEGIITYKLAAHAADLAKGHPGAQIRDNALSKARFEFRWEDQFNLGLDPDKARDFHDETLPKDSAKVAHFCSMCGPHFCSMKITQDVREYAASQGVGEQDALRLGMREKAIEFVKGGGKLYDKV

SEQ ID NO: 35550 - protein, 496 aa, Haloferax volcanii DS2
MVDDIATDADWNALYIDGEWTESESGESIAVEDPSTRETVAHVPRGTEADVDAAYEAAAEAQESWAEAPPARRQEVVEQFLQALNEYEDEIIDLLAHEVGGSRIMGETSIQIASDHASEAATLPRRMRGEHVASNIPGKENIVQKNPKGVVTVISPWNFPLNLSMRAVAPAVAAGNAVVLKPSTNSPITGGLLFAKLFEETDLPEGVVNVVTGRGSEIGDRVAGHPESDVVAFTGSTEVGKRVSGIAGENLAVPAMELGGNNAHVVTEGADVDRAADAAVFGSFVHQGQVCISINRHIVHESVYDEYVEKLTERAAELPVGSAHEDDTVVGPIIDESQRDEMLGYVEETVAAGATLETGGSTADLDGVDDSLVVQPTVLSGVTNDMAAARNEHFGPIAPVIPFSDVDEAVELANATEYGLSGSVHAGDLATGKEIALRMETGNVHVNDQPINDEAHVPFSGTGASGVGTYNSDAFLDEITEDKWISLQHEPRDYPL

SEQ ID NO: 35551 - protein, 155 aa, Brassica rapa
MPVPLAPYPTPPATPLAPAYTPPSPANGSTGGQSQLVCSGCRNLLMYPVGATSVCCAVCNAVTAVPPPGTEMAQLVCGGCHTLLMYIRGATSVQCSCCHTVNLALEANQVAHVNCGSCKMLLMYQYGARSVKCAVCSFITSVGGSTSTTDQKLNN

SEQ ID NO: 35552 - protein, 229 aa, Brassica napus
MGKEMESPKEQSSYTVEQLVAVNPFNPEILPDLENYVNEQVTSQTYSLDANLCLLRLYQFEPERMNTHVVARILIKALMAMPAPDFSLCLFLIPERVQMEEQFKSLIVLSHYLETGRFQQFWDEAAKNRHILIETVPGFEQAIQAYATHLLSLSYQKVPRSVLAEAVNMDGASLDKFIEHQVTNSGWIVVKEDGSIVLPQNEFNHPELKKNTGENVPLEHIARIFPILG

SEQ ID NO: 35553 - protein, 468 aa, Pseudoalteromonas tunicata D2
MSQSVLQFIKDNDVKFIDLRFTDTKGKEQHVSIPHHQVDEDFFEDGKMFDGSSIAGWKGINESDMVLMPDASSVKLDPFTEEVTLIVRCDVVEPGTLIGYTRDPRSVAKRAEEYMRSTGIADTVLFGPEPEFFVFDDVKYKTDMSGSMFKIDSKQAAWNSDKEYEGGNTGHRPGVKGGYFPVAPVDDFQDWRSATCLVLEEMGHVVEAHHHEVATAGQNEIATRFNTMVTKADEIQEMKYVIHNMAHLYGKTATFMPKPIVGDNGSGMHCHQSLAKDGVNLFAGDKYAGLSEEAIYYIGGIIKHAKAINAFANPATNSYKRLVPHFEAPVMLAYSARNRSASIRIPVVPSAKGRRIEVRFPDPAANPYLAFSAMLMAGLDGIKNKIHPGDAMDKDLYDLPAEEAAEIPQVAGSLQEALDCLSADREFLTQGGVFTDDLIDAYIDLKTKEVQKLNTSTHPVEFEMYYSC

SEQ ID NO: 35554 - protein, 456 aa, Salmonella enterica subsp. enterica serovar Paratyphi A str.
MESNNKLKRGLSTRHIRFMALGSAIGTGLFYGSADAIKMAGPSVLLAYIIGGVAAYIIMRALGEMSVHNPAASSFSRYAQENLGPLAGYITGWTYCFEILIVAIADVTAFGIYMGVWFPAVPHWIWVLSVVLIICAINLMSVKVFGELEFWFSFFKVATIIIMIVAGIGIIVWGIGNGGQPTGIHNLWSNGGFFSNGWLGMIMSLQMVMFAYGGIEIIGITAGEAKDPEKSIPRAINSVPMRILVFYVGTLFVIMSIYPWNQVGTNGSPFVLTFQHMGITFAASILNFVVLTASLSAINSDVFGVGRMLHGMAEQGSAPKIFAKTSRRGIPWVTVLVMTIALLFAVYLNYIMPENVFLVIASLATFATVWVWIMILLSQIAFRRRLPPEEVKALKFKVPGGVVTTIAGLIFLVFIIALIGYHPDTRISLYVGFAWIVLLLIGWIFKRRRDRQLAQA

SEQ ID NO: 35555 - protein, 590 aa, Rhodopseudomonas palustris CGA009
MGSEFSIDQKRYLEGFATGVTAARAARGSLPAGSAASPSGPDAIHHQAQDRVTASGKKLNDQEKWKREQHPFDAYARLKQQAKDNAAPKPADNFRWRYYGLFYVAPAQTSYMCRLRIPNGILTSWQMAGLAYLADTLADGYAHVTTRANLQMREIAPKDAVQLLQGIESLGLWARGSGADNIRNVTGSATAGIDPQELIDTRAYARDWHFYILNERALFGLPRKFNVAFDGGGLIPTLEDTNDIAFQAVTIGDGHGVAPGVYFRLALGGITGHKDFARDTGVIVAPDEATEVADAIVRVFIEHGDRTDRNKARLKYVLDAFGFDKYLELVEDKLGRKLIRVPAEAAAPRPAQDRAAHLGVHPQQQAGMNWIGVRLATGHLTSVQMRGLAEIARSFGDGDLRLTVWQNLLISGVPDARVTDATAAIEALGLAITASPLRAGLIACTGASGCRFAAAHTKETAEAIAQYCEPRVPLDTPINIHLTGCHNSCAQHFISDIGLIGAKVAVSDEDSVEGFHIHVGGGFGVDAAIGTEVLRDVKQDDAPRVIERMLQTYLARRASPAETFLAFVRRQDAAALQQLFAYEQSPETVA

SEQ ID NO: 35556 - protein, 442 aa, Nostoc sp. PCC 7120
MTPPENRPSLPEVHRSIRVPNSNSFWRKMLAYAGPGYLVSVGYIDPGNWATDIAGGSKFGYTLLTVILLSNLMAILLQSLCVRLGVATGRDLAQACRDYFSPKVSFCLWVLCEIAIAACDLAELLGSAIALQLLFVIPLIWGVCITALDVLVLLFLQHKGFRYTEALVIMLVATVGICFTAEILFSRPDMGGILLGYLPKKEILQNPEMLYIAIGILGATVMPHNLYLHSSIVQTRDWQPTTEKRWEAIKFGTIDSTFALSLALFINSAILIVSAATFHFSGNQNVAEIQDAYKLLSPLLGVSAASAIFGIALLASGQSSTLTATLAGQIVMEGFLQFRLPSWLRRLITRLLAIIPALITIILFGENSTSSLIVLSQVILSLQLPFAVIPLVMFTSNRRLMGEFVNPLWLKSLAWLVAIVIVGLNAWLLLQSLWGWLLQVPS

SEQ ID NO: 35557 - protein, 552 aa, Rhodopseudomonas palustris CGA009
MSHPGEQYYPPGVRWDAVIARGTLPELLAQAAKDYASRPALEFRDRQITYTKLEAMAETAAAALLAAGYGRDSSVALYIGNTPDHPINFFGALKAGARVVHLSPLDGERALSHKLSDSGARVLITTDSAALLPMAERFLAKGLLDRLIVCSDASWGESATPLAPLPSDPRVITYADFIKGASKPMAWPAIVPDDIALLQYTGGTTGLPKGAMLTHSNLTSAVAIYDVWGLVRANSGGIHRVICVLPLFHIYALTVILLRCLKQGDLISLHQRFDVAAVFRDIEEKRATVFPGVPTMWIALANDPSLEKRDLSSLTMAGSGGAPLPVEVARLFERKTNLKLKSGWGMTETCSPGTGHPPEGPDKPGSIGLMLPGIELDVVALDDPKRVLPPGEVGELRVRGPNVTKGYWNRPEESAHSFVGDRFLTGDIGYMDQDGYFFLVDRKKDMIISGGFNVYPQMIEQAIYEHPAVQEVIVIGVPDDYRGEAAKAFVKLREGAKPFSIDELRAFLTGKLGKHELPTAVEFLDELPRTTVGKLSRHELRSQQTTTKTQTK

SEQ ID NO: 35558 - protein, 205 aa, Arabidopsis thaliana
  misc_feature (134)..(134): Xaa can be any naturally occurring amino acid
MFSLMSGLWSYMFSKTEFNVLILGIDKAGKTTFLEKLKTIYSISEGLPHDRIVPTVGLNIGRIEVSNAKIVFWDLGGQPGLRSIWEKYYEEAHALIYLIDAACPTRFEDSKSALEKALRHEDLQGAPLLILANXQDLTNAVSAEELDRYLDLKKLDDRVYMFEAVSGYDGRGIKESIEWLVGVMEKSKRTESLRARAGYTPVPNS

SEQ ID NO: 35559 - protein, 437 aa, Beta vulgaris subsp. vulgaris
SSNLDLRSELQELIPEQQERLKKIKKEFGSFQLGNINVDMVLGGMRGMTGLLWETSLLDPEEGIRFRGFSIPECQKLLPAASAGAEPLPEGLLWLLLTGKVPSKEQVDALSADLRKRASIPDHVYKTIDALPITAHPMTQFCTGVMALQTRSEFQKAYEKGIHKSKFWEPTYEDCLSLIAQVPVVAAYVYRRMYKNGQVIPLDDSLDYGGNFAHMLGFDSPQMLELMRLYVTIHSDHEGGNVSAHTGHLVGSPLSDPYLSFAAALNGLAGPLHGLANQEVLLWIKSVVDECGENISTEQLKDYVWKTLNSGKVVPGFGLGVLRKTDPRYTCQREFALKHLPDDPFFQLVSKLYEVVPPILLELGKVKNPWPNVDAHSGVLLNHYGLTEARYYTVLFGVSRSLGICSQLIWDRALGLPLERPKSVTMEWLEKFCKRRA

SEQ ID NO: 35560 - protein, 391 aa, Austrobuxus megacarpus
DLEPVNPADVPVTAAGALKSYKLAAKAISRLQSLPSGNISLLCDVLVKEVSDLTGYDRVMVYRFHEDEHGEVVAECCRPDLEPYLGLHYPATDIPQASRFLFMKNKVRMICDCMALPVEVVQDERLSQPLSLCGSTLRSPHGCHAQYMANMGSVASLVMSVTINEDDDEMDSGQQTGRKLWGLVVCHHTCSRFVPFPLRYACEFLIQVFGVQISKEVELAAQMREKHILRTQTVLCDMLLRDAPVAIISQSPNVMDLVKCDGAALYYRKKFWSLGVTPTEAEIRDIAEWLLECHNGSTGLSTDSLMEAGYPGASILGDAVCGMAAVRITSKDFLFWFRSHTAKEIKWGGAKHDPDDKDDGRKMHPRSSFKAFLEVVKRRSLPWEDVEMDAI

SEQ ID NO: 35561 - protein, 391 aa, Balanops vieillardii
DLEPVNPADVPVTAAGALKSYKLATKAISRLQSLPSGNISVLCDVLVKEVSDLTGYDRVMVYRFHEDEHGEVVAECRRPDLEPYLGLHYPATDIPQASRFLFMKNKIRMICDCLAPPVKVIQDKRLAQPLSLCGSTMRAPHRCHVQYMANMGSIASLVMSVTINEDDDETESDQQNGRKLWGLVVCHHSSPRFVPFPLRYACEFLIQVFSIQINKEVELAAQMREKHILQTQTVLCDMLLRDAPEAIITQSPNVMDLVKCDGAALYYRKKVWLIGVTPTEAQIRDIAEWLLEYHRESTGLSTDNLVEAGYPGASVLGVAVCGMAAVRITSKDFLFWFRSHTAKEIKWGGAKHDPDDKDDGRKMHPRSSFKAFLEMVKRRSLPWEDVEMDAI

SEQ ID NO: 35562 - protein, 390 aa, Bergia texana
DLEPVNPADVPVTAAGALKSYKLAAKAISRLQSLPSGNISLCDVLVKEVSDLTGYDRVMVYKFHEDEHGEVIAECHRPDLEPYLGLHYPATDIPQASRFLFMKNKVRMICDCMAPPVKVIQDKRLTQPLSLCRSTLRSPHGCHAEYMANMGSIASLVLSVTINDEVDKIEGDKLLGRKLWGLVVCHHASPRFIPFPLRYACEFLIQVFGVQINKEVALAAQTREKHILRTQSVLCDMLLRDAPVAIITQSPNVMDLVKCDGAALYYRKKFWLLGVTPSEAQIRDIADWLLECHSGSTGLSTDSLMEAGFPGASVLGDAVCGMAAVKITSKDFLFWFRSHTAKEIKWGGAKHDPDDKDDGRKMHPRSSLRAFLEVVRWRSLPWEDVEMDAI

SEQ ID NO: 35563 - protein, 306 aa, Prochlorococcus marinus str. MIT 9313
MHQFLPYAWFQGACVPFEEAKISVATHALHYGTGAFGGMRAIPDPQNSNTMLLFRADRHAKRLSQSARLLLTELSETRILSALEAMLQANRPTTPIYLRPFVYTSDLGIAPRLHNIETDFLIYGLELGDYLSPEGVSCRISSFTRQEDRSLPLRGKISGAYITSSLAKTEAVLSGFGEALLLNSRGKISEASGMNLFLVRDGQLITPGVDQDILEGITRSSVLELARVMGLSVIERPVDKTELFIADEVFLTGTAAKITPIRQIESTILATERPIMNALRDRLIEITQGRDKDYEHWITRICMTND

SEQ ID NO: 35564 - protein, 390 aa, Bergia texana
DLEPVNPADVPVTAAGALKSYKLAAKAISRLQSLPSGNISLCDVLVKEVSDLTGYDRVMVYKFHEDEHGEVIAECHRPDLEPYLGLHYPATDIPQASRFLFMKNKVRMICDCMAPPVKVIQDKRLTQPLSLCGSTLRSPHGCHAEYMANMGSIASLVLSVTINDEDDKIEGDQLLGRKLWGLVVCHHASPRFIPFPLRYACEFLIQVFGVQISKEVALAAQTREKHILRTQSVLCDMLLRDAPVAIITQSPNVMDLVKCDGAALYYRKKFWLLGVTPSEAQIRGIADWLLECHSGSTGLSTDSLMEAGFPGASVLGDAVCGMAAVKITSKDFLFWFRSHTAKEIKWGGAKHDPDDKDDGRKMHPRSSLRAFLEVVKWRSLPWEDVEMDAI

SEQ ID NO: 35565 - protein, 131 aa, Bifidobacterium longum NCC2705
MTDTTYDNSTELDPRIAARLKRDAKGLVAAVIQQYDTREVLMVGYMNDEALRRTLTTGRVTFWSRSRQEYWRKGDTSGHVQYVKGVSLDCDGDALLVEVDQVGAACHTGKRSCFLEGGPLPVVEGHRPAEQ

SEQ ID NO: 35566 - protein, 391 aa, Calophyllum soulattri
DLEPVNPADVPVTAAGALKSYKLAAKAISKLQSLPSGNISLLCDVLVKEVCELTGYDRVMVYKFHEDDHGEVVAECHRPDLEPYLGLHYPATDIPQASRFLFMKNKVRMICDCLAPPVKVIQDNGLSQALKSRWIYLESSPWLHSQYMANMGSIASLVMSVIINEDGDEMESDQQKGRKLWGLVVCHHTGPRFVPFPLRYACEFLIQVFGIQINKEVELAAQMREKHILETQTVLCDMLLRDAPMAIVTQSPNVMDLVKCDGAALYFKEKFWLLGITPTEAQIRDIAEWLLDYHNGSTGLSTDSLMEAGYPGASILGDAVCGMAAIRINSKDFLFWFRSDTAKEIKWGGAKHDPGDKDESRKMHPRSSFKAFLEVVKWRSLQWEDVEMDAI

SEQ ID NO: 35567 - protein, 206 aa, Xanthomonas campestris pv. campestris str. ATCC 33913
MGSETTAAGDALDALDWNKGDGLLPVIVQDADNLRVLMLGYMNAEALAVTRARGEVTFFSRSKQRLWTKGESSGNVLRVVAIETDCDADTLLVQARPHGPTCHLGRTSCFPTAPSQFLGSLDALIAEREHERPHGSYTTKLFEQGIRRIAQKVGEEGVETALAGVVQGDAELLGESADLLYHLIVLLRARGLGLGDAVALLESRHK

SEQ ID NO: 35568 - protein, 337 aa, Triticum aestivum
MKGLFKSKPRTPADVVRQTRELLIYVDLHAGSRGADPKREEEKMAELSKNIRDLKCILYGNGEHEPVTEACVQLTQEFFRENTLRLLIMCVPKVNLETRKDSTQVVANLQRQQVNSRILASEYLEANKDLLDTLISGYEDTEVALHYGAMLRECIRHQSIARYVLESDHMKKFFDYIQIPNFDIASDASATFKELLTRHKATVAEFLSKNYDWFFAEFNSRLLSSSNYITKRQAIKLLGDMLLDRSNSAVMMRYVSSKDNLMILMNLLRDSSKNIQIESFHVFKLFAANKNKPAEVVNILVTNRSKLLRFFAGFKTDKEDEQFEADKEQVIKEISAL

SEQ ID NO: 35569 - protein, 476 aa, Xanthomonas campestris pv. campestris str. ATCC 33913
MFKQLWATKHPHASHEAADGLGLQRALGPWGLTALGIGAVIGGGIFVITGQAAADHAGPAIVLSFVLAAICCAFCAMAYAEFAAMVPVSGSAYTYTYATFGELAAWFIGWMLVLEYGVSASAVAVSWTGYFLSLLEHFGIHLPAALVSAPLDGKLQRTGAIANLPAAGIVLLLTWLCYVGIRKSSAMNMAMVILKTGLIILVIAAGWKYVDPANWHPFIPANEAPGKYGMEGVLRGAAMVFFAYIGFEAVSVAAQESHRPQRDLPIGMMLSLVICTVLYIAMAAVMTGLVPFTQLGTDEPVVTAVAAHPQLAWLRVVVEVGALIGLSSVVLVMIIGQPRIFMIIARDGLLPAVFTRIHPKYRTPHINTVITGIGIALLAAVFPLDVLGELTSMGTLIAFAAVCAGVLILRRTHPELPRPFRMPAAWLICSAGVLSCLALLSAMTLHNWMLMGLWTLVGLVVYFGYGYRHSRLREGR

SEQ ID NO: 35570 - protein, 335 aa, Malus x domestica
MADESVAGSADFPVKRPREEEENGSAAAASAVSMEPDGGKEPDSVSAVIPGWFSEISSMWPGEAHSLKIEKILFQGKSDYQNVMVFQSATYGKVLVLDGVIQLTERDECAYQEMITHLPLCSIPNPKKVLVIGGGDGGVLREVARYASVEKIDICEIDKMVIDVSKQFFPEVAIGYEDPRVTLHVGDGVAFLKAVPAGTYDAVIVDSSDPIGPAKELFEKPFFQTVANALRPGGVVCTQAESIWLHMHIIEDIVANCREIFKGSVNYAWTTVPTYPSGVIGFMLCSTEGTAVDFKHPVNSIDESKRPLRFYNSEIHTAAFCLPSFAKKVIDAKAK

SEQ ID NO: 35571 - protein, 335 aa, Malus x domestica
MADEIVVGSADLPLKRPREEEENGAEAAASAVSMETDGGKEPDSVSAVIPGWFSEISPMWPGEAHSLKIEKILFQGKSDYQNVMVFQSATYGKVLVLDGVIQLTERDECAYQEMITHLPLCSIPNPKKVLVIGGGDGGVLREVARYASVEKIDICEIDKMVVDVSKQFFPDVAIGYDDPRVSLHVGDGVAFLKAVPAGTYDAVIVDSSDPIGPAKELFEKPFFQTVANALRPGGVVCTQAESIWLHMDIIEDIVENCREVFKGSVNYAWTTVPTYPSGVIGFMLCSTEGPAVDFKHPVNSIDASKRPLKFYNSEIHTAAFCLPSFAKKVIDAKAK

SEQ ID NO: 35572 - protein, 292 aa, Malus x domestica
MINFTPLLSYMSSSVGMQGEAHSLKIEKILFQGKSDYQNVMVFQSATYGKVLVLDGVIQLTERDECAYQEMITHLPLCSIPNPKKVLVIGGGDGGVLREVARYASVEKIDICEIDKMVVDVSKQFFPDVAIGYDDPRVSLHVGDGVAFLKAVPAGTYDAVIVDSSDPIGPAKELFEKPFFQTVANALRPGGVVCTQAESIWLHMDIIEDIVENCREVFKGSVNYAWTTVPTYPSGVIGFMLCSTEGPAVDFKHPVNSIDASKRPLKFYNSEIHTAAFCLPSFAKKVIDAKAK

SEQ ID NO: 35573 - protein, 352 aa, Glycine max
MSRAQDANRSFFPFGNPFRMISPKSPKISSQLLLILHAFEATLEERLKKLIPKSKDEILSLSWMTLAMQSLCESHNDIKTIITELELPVHDWDEKWIDVYLDISVKLLDICIAFSSELSRLNQGHLLLQCALHNLGSSSSEQYVRACSSLDGWKQHIGSGNPRIEKCGSILDDLLRSLDLPKVKKSAKGKVLMQAMYGVKVQTVFVCSVFAAAFSGSTKNMSDLNVADVYSWAPTFKSLQDLVNEEIRVRFSSGRFTILNELEVVDSSVKELYPIIQGIADTIETESLAKIVGELSRATEKLSQGLDLLTKEVDSFFQVVLTGRDTLLSSLRSGATFIDSIQVGNRDAQIVN

SEQ ID NO: 35574 - protein, 141 aa, Acidovorax sp. JS42
MAIERTLSIIKPDAVAKNVIGQIYARFEAAGLKIAAARMIHLSRAEAEQFYAVHKERPFFKDLVDFMISGPVMVQALEGENAVLKNRELMGATDPKKAAPGTIRADFADSIDANAVHGSDAAETAQVEVAFFFPGLNIYSR

SEQ ID NO: 35575 - protein, 401 aa, Pseudoalteromonas tunicata D2
MSFLSTSVRGHINALVQTQDHPFFIYDLDQLAAHLAPLTAQNVVKLWYAVKANPLSSVIQTLDKAGFNFDVASAGELNQVLKQGIAAERVLNTGPAKSKKQINHFLEAGVRTFVAESLNQVAWLNQAAQNHQVQLRILLRVQLRWPEGEKNPLGGNSLTPFGLGTQQWQHLNIADYPQLNFVGLHIFQWGNMLSTDKLAQLWSQMIAPLQALADQLGFALEILDLGGGLGIPYTTAQDPLNWPQLLDALSNIKFESGVNELWMELGRYAVGECGHYVNPVVEQKENFGYHQLITAGGINHILRPAVTNQAFPAQLLRQSNAPAREFLIHGPLCTALDSLGTHQLPADLNENDHVIFSQVGAYGFTESMPYFLCHELAAEYVIENNQVRCVRSCETADYYLR

SEQ ID NO: 35576 - protein, 299 aa, Pseudoalteromonas tunicata D2
MSSVEMIQQFDLSEYPLWTALITPFTPQDTVDFDALAKLVAEQVAANNGILLLGSTGEGLALTETEQKEIVTFVCQLAPQVPLMVAVGGFNLKQQVQWLEFCNDLPIHAYLLGSPLYAKPGIQGQTQWFDTLLNHSKHPCMLYNVPGRSAVAIAPEVLTNLSHHTRLWAMKEASGDIAKFEAFRSAAPQLAIYSGDDALMPYFAQAGAKGLVSVAANAWPNQTAEFVRRSLAGTYPNLFRQWSSAINSLFEVANPIPVKVLMHKQGRIQFPDLRPPLTHLELNNHAALEAANHTILSFN

SEQ ID NO: 35577 - protein, 591 aa, Oryza sativa
  misc_feature (373)..(373): Xaa can be any naturally occurring amino acid
MVRRLLVILLQALTGLLVILALWIVSHLAGDRPPPGPVVCAANGTSGCTLTNIYGSFSDRAICRAANVTYPRTEEELVAAVAAAVAAGRKVKVATRYSNSFPRLACPGGEDGTVISTRWLDRAVRVDAARRLMTVESGMVMRDLIREAAAAGLALPHSPYWSGLTIGGVLATGAHGSSLWGKGSAVHEYVVGMRIVTPAPASEGFAAVRELAAGDPDLDAAKVSLGVLGAISQVTLELQPLFKRSVAFVTRNDSDVADTVAAWGRLHEFGDVAWLPRRRVAVYREDDRVDVATPGDGRSDYPAFRPTPTLPLVASRLAEEWLEERSGSDAARCAASRVMPATLEHLNYGLTNDGEAFTGTTGTSPAPTVSGTXALRGHLFYNSGFSIALSRAPAFVADVARIRDLNPGAFCQIDSKMGLLMRYVAASSAYLGKAEDSVDFDVTYYRSYARGAPRAHADVFDEVEQMALRKHGGVPHWGKNRNYAFDGAIARYPNAGKFMRVKDRFDPDGVFSSEWSDQVLGVGGASPVIVGDGCAMEGLCVCSDDSHCAPEKGYFCRPGKVFTAARVCSPSPRGAANGGDDDDEISDVGDE

SEQ ID NO: 35578 - protein, 455 aa, Aspergillus nidulans FGSC A4
MSAPTADIRARAPEAKKVHIADTAINRHNWYKHVNWLNVFLIIGIPLYGCIQAFWVPLQLKTAIWAVIYYFFTGLGITAGYHRLWAHCSYSATLPLRIWLAAVGGGAVEGSIRWWARDHRAHHRYTDTDKDPYSVRKGLLYSHLGWMVMKQNPKRIGRTDISDLNEDPVVVWQHRNYLKVVFTMGLAVPMLVAGLGWGDWLGGFVYAGILRIFFVQQATFCVNSLAHWLGDQPFDDRNSPRDHVITALVTLGEGYHNFHHEFPSDYRNAIEWHQYDPTKWSIWAWKQLGLAYDLKKFRANEIEKGRVQQLQKKLDRKRATLDWGTPLDQLPVMEWDDYVEQAKNGRGLVAIAGVVHDVTDFIKDHPGGKAMISSGIGKDATAMFNGGVYYHSNAAHNLLSTMRVGVIRGGCEVEIWKRAQKENVEYVRDGSGQRVIRAGEQPTKIPEPIPTADAA

SEQ ID NO: 35579 - protein, 392 aa, Cespedesia bonplandii
DLEPVNPADVPVTAAVALKSYKLAAKAISGLQSLSSGNISMLCNVLVKEVCDLTGYDRVMVYKFHEDEHGEVIAEYHRPDLEPYIGLHYPATDIPQASRFLFMKNKVRMICDCMAPAVKVVQEKKLAQPLSLGGSTLRAPHGCHSQYMANMGSIASLVMSVMINDDDYNEMESDRQKPRKLWGLVVCHHTSPRLVPFPLRYACEFLIQVFGVQINKEVELTAQMKEKQILQTQTVLCDMLLRDTPVAIVTQSPNVMDLVKCDGAALFYKNKFWLIGITPPEDQIRDIACWLNEYHDGSTGLSTDSLMEAGYHGASILSGAVCGMAAIRVSLKDFLFWFRSQAAKEIKWGGAKHDPNEKDNGRNMHPRSSFNAFLEVVKWRSLPWEDMEMDAI

SEQ ID NO: 35580 - protein, 392 aa, Clusia gundlachii
DLEPVNPADVPVTAAGALKSYKLAGKAISKLQSLPSGNILLLCDVLVKEVRELTSYDRVMMYKFHEDDHGEVIAECRRPDLEPYLGLHYPATDIPQASRFLFMKNKVRMICDCMAPPVNVIQDNGLSQPLSLGGSTLRAPHGCHAQYMANMGSIASLVMAVTINEDDDGDREGDQRKQRRLWGLVVCHHTGPRFVPYPLRYACEFLIQVFGIQINKEVELGAQMREKHILETQTVLCDMLLRDSPVAIVTQSPSVMDLVKCDEAALYYKKKFWLLGITPTETQIRDIAEWLLEYHSGSTGLSTDSLMEAGYADASLLGDAVCGMAAIKINSRDFIFWFRSHTAKEIKWGGAKHDPDDKDEGMKMHPRSSFKAFLEVVKWRSLPWEDIEMDAI

SEQ ID NO: 35581 - protein, 623 aa, Aspergillus oryzae
MANIESKSAALNHDRVQKPVADDFMYDFKYNHHLPTTDILGVDIPADCDAKKEAEGIVARLAKTMSEGDAQAFAGLFLDYGVWRDKLSFTWDFRTFNFRDAILKAATDLFPQTKARSFQFLEPVPTVARPYTDYSYLQFVVSFETELVVASAVINAVLTQDGWRIYTMHTVAEGLKQFPEQPAPDGHMTGITSWASQRSEAINNVDPEILIIGGGQNGLAMAARCKVLGMENLIIERSDEVGDIWKKRYEYLSLHFPHWPDALPYFKYPQHWPTYTPAQKQALYMQWYASALELNVWTKSSVVKAEQDAEGKWTITINKEGKETRTLHPKQVIMATSLCGVPYTPTVPGMDEFRGVIRHSSAHDSAREFVGKKVCVVGTSSSGFDTAFECARLGIDVTLLQRSPTYVMSLTHSVPRMLGSYAPDEHGNLPDLEEQDRLFFSTPVGPGEELSRRTAKVLEDLDRPLLEALNARGLRTWRGQRDTGNSTLGQTRNGGFYFDAGACEEIINGNIKVEPGYCEKFTADKVILNGGREKEFDLVVFATGFSNTIDSIRATLGEKIASQCGPIWGIDEEGEYKTAYRETGVPNLWIMVGFLPMTRYASKLLALRLKALQEGISPPPYKV

SEQ ID NO: 35582 - protein, 391 aa, Croton alabamensis
DLEPVNPADVPITAAGAMKSYKLAAKAISKLQSLPSGNMSLLHDILVKEISDLTGYDRVMVYKFHEDDHGEVVAECRRNDLEPYLGLHFPATDIPQASRFLFMQNKVRMICDCSAPPVKVIQDKSLAQPLSLCGSILRSPHGCHAQYMGNMGTIASLVMSVTINEDDDEMETDRQKGKKLWGLVVCHHTSPSFVPFPLRYACEFLIQVFGVQIIKEVKLAAQKREKHILQTQPLLCDMLLRDDPVAIVTQTPNIMDLVNCDGAALYYKKKIWLLGAAPSEERVRDIAEWPLEYHSESTGLSTDSLMEAGYPGASILGDATCGMAAIRISSRDFIFWFRSHTAKEIKWGGAKHDPGAKDDVRKMHPRSSFKAFLEVVKWRSLPWEDVEMDAI

SEQ ID NO: 35583 - protein, 493 aa, Xanthomonas campestris pv. campestris str. ATCC 33913
MYRMLKSLLRVKPIEPAGRVDAGEPVEGSLQGEATLQRTLTAKHLIMLGIGAVIGAGIFVMTGQAAANHAGPAVMLSFVFAGIACTFAGLCYAEFAAMMPVSGSAYSYSYATLGEGIAWFIGWCLVLEYLFAGSSVAVAWSAYLISFITGTLGLPFPTELTNAPLAWINGEFVASGNILNLPAVLIVAAVSGLCYVGITQSAFINAIVVAIKIAVICLFVGFGAAYIDPANWHPFIPENTAPGVFGWSGVFRAASIVFFAYIGFDAVSTSAGETKDPQRNMPIGILGSLAVCTIIYIIVCAVLTGLMPYTQLGTAKPVATALEAHPQLTWLKTAVEIGAIAGLSSVVLVMLMAQPRIFYTMAKDGLMPKLFGKVHPKFHTPYVGTVIVGVVAASLAGLIPLSVLGELVSMGTLLAFATVCAGVMVLRFTKPELERPFRVPLAMIVCPLGTLACLALFFQAFQEHWKVFVGWTVIGLVIYFGYGIHHSRLARKA

SEQ ID NO: 35584 - protein, 486 aa, Listeria monocytogenes EGD-e
MKKETHGEIRRDLKTRHLSMIAIGGSIGTGLFLASGNAIHTAGPGGALVAYVAIGIMVYFLMTSLGEMATYMPVSGSFSTYASRFVDPAFGFALGWNYWFNWAITLAVDISTAAIIVQFWLPNTPAWLWSAIFLILIFGLNALSVKAYGESEYWFSIIKVATVIIFLIVGVLTIVGILGGEVIGFSNFTAGDAPFKGGFFAILGTFLIAGFSFQGTEMVGIAAGESATPETSVPKAIKQVFWRILLFYIFAIFIIGMIIPYTNPNLLSAEATDVAISPFTLVFEKAGLAFAASVMNAVILTSVLSAGNSGLYASTRMLWAMARDKKAPKFLGKVNRRGIPMAALIVTTIVGAMTFITTLTENGTVIYTWLLSASGLTGFIAWVGIAISHYRFRKAFIKQGHDLSELKYKAKFFPFGPILALVLCILVIVGQDYAAFLKPEFTNPAWWQKIGISYIGLPIFLVFWLSFKFTNKTKVIPLEDCKFDQK

SEQ ID NO: 35585 - protein, 391 aa, Dichapetalum macrocarpum
DLEPVNPADVPVTAAGALKSYKLAAKAISKLQSLPSGNISLLCDVLVKEVRDLTGYDRVMVYKFHDDEHGEVVSECHRPHLEPYLGLHYPATDIPRASRFLFMKNKVRMICDCLAAPVKVIQDNRLTQPLSLCGSTLRAPHGCHAQYMENMGSIASLVMSVMINEDDDEDRNCQQKGRKLWGLVVCHHTSPRFVPFPLRYACEFLIQVFGIQINKEVELSAQMREKHVLRIQTVLCDMLLRDAPVAIITQSPNVMDLVRCDGAALYYRKKFWLLGITPTEGQISDIAEWLLEYHRESTGLSTDSLMEAGYPGASDLGDAVCGMAAVRIASKDFLFWFRSHTAKEIKWGGAKHDPDVKDDGRKMHPRSSFKAFLEVVKWRSLPWEDIEMDAI

SEQ ID NO: 35586 - protein, 515 aa, Prochlorococcus marinus str. MIT 9313
MMTYTITTPLYYVNDKPHLGSLYTTMASDALARFQRLEGKQVMFVTGVDEHGQKIQRTAEGNNISPKHHCDQITRSYQNLWSRWGISNDRFIRTTSHRHQLLVEAFFHRVETSGDVYLGRQQGWYCVGCEEYKDEPPQAQSPCCPIHQKPLEWRDEENLFFKLSRFQSKIEDLISQPDFIWPVMRRNEIQNFVAQGLRDFSISRVDVDWGLPVPGYPKHTFYVWFDALVGYLSALLDDGGQVRIERLEECGWPASVHLIGKDILRFHAVYWPAMLISAGLPLPKQVFGHGFLTREGQKMGKSLGNVLDPEKLLEICGADAVRWYLLRDIQFGHDGDFQQKRFMDLVNNDLANTIGNLLNRTSTMARKWFEGSVPTHRDEIDYAHPLVTTAETTITIVRQSMPSMAFHDAAEAILKLAIAANVYLNETAPWSRMKTPGNEAEVADDLYSVLEACRLVGLLINPLVPSLSERLLNQLGLSIDGNDWSKGLAWGQLQSGALLPPSQPVMQRLELSSSL

SEQ ID NO: 35587 - protein, 367 aa, Glycine max
MKLTVKTLKGSHFEIRVQPSDTIMAVKKNIEDVQGKDNYPCGQQLLIHNGKVLKDETTLSDNKVSEDGFLVVMLSKGKTLGSAGISSTQFASNPPTTVSTPNSTPLVQPQSANNNASATDVTTTNVTTNTYGQAASNLVAGSNLEQTIQQLMDMGGGSWDRDTVTCALRAAYNNPERAVDYLYSGIPVAAEIAVPAASYPISQTTETGGASVGAVPGVPNSSPLNMFPQETISGAGAEIGSLDFLRNNPQFQALRSMVQSNPQILQPVLQELGKQNPSLLTLIQEHHAEFLQLINEPVEGSEGDIFDQPEQDMPHAINVTPAEQEAIGRLEAMGFDRASVIEAFLACDHDEQLAANYLLENAGDFEG

SEQ ID NO: 35588 - protein, 170 aa, Musa acuminata
YRHKVEVELSGVCSDIMTLIDEHLIPSSSAGESSVFYYKMKGDYYRYLAEFTTGNERKEAADNSLKAYQAATSTAEADLSPTHPIRLGLALNFSVFYYEIMNSPERACHLAKQAFDEAISELDTLSEESYKDSTLIMQLLRDNLTLWTADIPEDGEEYAKSGAGEDAQRV

SEQ ID NO: 35589 - protein, 317 aa, Escherichia coli O157:H7 EDL933
MTDKLTSLRQYTTVVADTGDIAAMKLYQPQDATTNPSLILNAAQIPEYRKLIDDAVAWAKQQSNDRAQQIVDATDKLAVNIGLEILKLVPGRISTEVDARLSYDTEASIAKAKRLIKLYNDAGISNDRILIKLASTWQGIRAAEQLEKEGINCNLTLLFSFAQARACAEAGVFLISPFVGRILDWYKANTDKKEYAPAEDPGVVSVSEIYQYYKEHGYETVVMGASFRNIGEILELAGCDRLTIAPALLKELAESEGAIERKLSYTGEVKARPARITESEFLWQHNQDPMAVDKLAEGIRKFAIDQEKLEKMIGDLL

SEQ ID NO: 35590 - protein, 812 aa, Cryptococcus neoformans var. neoformans JEC21
MSTNLGINHNSNQYLDDEKDLVLEKKESDLHGTHIAEVHYYTTKNGVRITVGDTPKEVKAVAVEVDDVNEPCETFRAYVIGTILAAVGTGLNVWFGARQPGIYISPFIIQLISHPLGLILSKILPTRRFTLFGQEWSLNPGPWTIKEHAIITMMSTVSLPTATALDVVVAVRQPTFFNDSEMGNSQGFRWLVVLSTQFLGLSLAGLAREYLVYPSDMTFPLNLAKLSLFNALHRRKVDENGMVQVAEHHLHEDENEKDPPVHGWKISMFKFCLIATAGSFIWFFFTAFIFPALTYFNWPTWIAPDNKKLAIVMGSITGLGLNPIPTFDWTYISGAGLTPLITPWWATLQTFIGCTIGFFAILGIYWSNVWYSAYLVPNSNQAFDRFGAIYNITGVLSADKTLDVEAYRQYSPMYFGAGYNIVIAGFFASYSAILVYAALEHGSQIKNGLATAYGKTVSFVRRSSAPEESHNRPEYDIHYAIMHKYKEVPQWAFILVLVFSLVTGIIMVEVYKTTMPVWGIFVCLALAFIFLIPAGIIQALSNMQITLVILAEIIPGVAIPGRPYANMIFKLYGWVALVMALLYVQDQKLAHYLHIAPRATFRVQMWGVLVSSIVSVGVLTWQFNAIPDMCEIGQKDLMTCPYYTTFYSSALMFGVVGPERMYGANGLYKWTMFAFLAGAIATFAAWLVKRKWPNKYTKSVNIPVVITGLLYYAPYNWSFVWSGVPLAWFFMSYVYNRYSSWWSKYCYVLSIGLTVGAALSGVVQFFCITYPGGAMPSWWGNTAYASGCDGLGCPLLEMPEQGYFGPGPGEFS

SEQ ID NO: 35591 - protein, 459 aa, Mycobacterium sp. JLS
MTLTNETTLPNGLSIDDARAEAARAYELDRAHVFHSWSAQAEISPMVITAAQGSYIWDGEGRRLLDFSCQLVNTNIGHQHPKVVAAIQAQAAKLCTVAPQHANDARSEAARLIAERTPGELNRIFFTNGGADAVEHAVRMARLHTGKYKVLSRYRSYHGGTETAINLTGDPRRWPNDHGNAGVVHFFGPFLYRSQFHATTEAEESARALAHLEDIVRLEGPSTIAAIVLESIPGTAGIMVPPPGYLAGVRDICDRYGIVMIADEVMAGFGRSGKWFSIDHFDVTPDLLTFAKGVNSGYVPLGGVAIGPAIAETFAHRPYPGGLTYSGHPLATAAAVATINAMEEEDIVGNAARIGAEVLGPGLAELAARHPSVGEVRGTGVFWAIELVANPQTREPLAPYGASSAAMNAVVAACKANGLLPFANFNRIHAVPPCTVTADEVREGLAILDQALDVADSHL

SEQ ID NO: 35592 - protein, 254 aa, Brassica napus
RVVVLCTKTRDPVSPHLDSNESIERKKKREMESPKEQSSYTVEQLVAVNPFNPEILPDLENYVNEQVTSQTYSLDANLCLLRLYQFEPERMNTHIVARILVKALMAMPAPDFSLCLFLIPERVQMEEQFKTLIVLSHYLETGRFQQFWDEAAKNPHILEAVPGFEQAIQAYASHLLSLSYQKVPRSVLAEAVNMDGASLDKFIEHQVANSGWIVAKEDGSIVLPQNEFNHPELKKNTGENVSLEHIARIFPILG

SEQ ID NO: 35593 - protein, 218 aa, Pseudoalteromonas tunicata D2
MNKLANLFDNNRHWACKMTTRDENFFKILSMQQNPEYLWIGCSDSRVPANEIVGLLPGELFVHRNVANVVVHTDHNCLSVMQYAVDVLKVKHIMVVGHYGCGGVKAALDGARFGLIDNWLRHVTDAKEKNFTQFELISNPQHKFDALCEINVIEQVRNVCQTNIVENAWDRGQELSVHGWIYGLKDGHLRDLCSGITQPSEMNSIYQDAIEQVFNSKL

SEQ ID NO: 35594 - protein, 391 aa, Dillenia philippinensis
DLEPVNPTDVPVTAAGALKSYKLAAKAISRLQSLPSGNMSLLCDALVQEVSDLTGYDRVMVYKFHEDDHGEVVAECRRPDLEPYLGLHYPATDIPQASRFLFMKNKIRMICDCLAPPVQVIQDKCLAQPLSLCGSTLRSPHGLHAQYMANMGSIASLVMSVTINEDDDEVESDKQKGRKLWGLVVCHHTSPKVVPFPLRYACEFLIQVFGVQVNKEVELAAQLKEKHILKTQTVLCDMLLRDAPVGIVTQSPNVMDLVKCDGAALYYRNKFWLLGITPTEAQIRELAGWLLDCHNGSTGLSTDSLMEAGYPGASILGDALCGMAAIKITSKDFLFWFRSHTAKEIKWGGAKHDPVDKDDGKKMHPRSSFKAFLDVVKRRSFPWEDVEMDAI

SEQ ID NO: 35595 - protein, 120 aa, Campylobacter jejuni RM1221
MSNYPKAIGPYSAYREVNGLLFISGQLPINPDSGEIESHDIKEQTKQSLKNIGAILEENGISYDKVVKTTCFLADINDFVAFNEIYAEFFKAPYPARSAFAVKDLPKKAKVEIEIIAQKG

SEQ ID NO: 35596 - protein, 391 aa, Dissiliaria muelleri
DLEPVNPADVPVTAAGALKSYKLAAKAISRLQSLPSGNISLLCDVLVKEVSDLTGYDRVMVYRFHEDEHGEVVAECRQPDLEPYLGLHYPATDIPQSSRFLFMKNKVRMICDCMAPPVEVVQDERLSQPLSLCGSTLRSPHGCHAQYMANMGSVASLVMSVTINEDDDEMDGDQQTGRKLWGLVVCHHTCPRFVPFPLRYACEFLVQVFGVQINKEVELAAQMREKHILRTQTVLCDMLLRDAPVGIITQSPNVMDLVKCDGAALYYRKKFWLLGVTPTEAEIRDIAEWLLECHSGSTGLSTDSLMEAGYPGASILGDAVCGMAAVRITSKDFLFWFRSHTAKEIKWGGAKHDPGDKDDGRKMHPRSSFKAFLEVVKRRSLPWEDVEMDAI

SEQ ID NO: 35597 - protein, 391 aa, Dovyalis rhamnoides
DLEPVNPADVPVTAAGALKSYKLAAKAISRLQSLPSGNISLLCDVLVKEVSALTGYDRVMAYKFHEDQHGEVVAECCRPDLEPYLGLHYPATDIPQASRFLFMKNKVRMICDCLAPPVKVVEHKRLAQPLNLCGSTLRSPHGCHVQYMENMGSIASLVMSVTINEDDDEMDSDQQKGRKLWGLVVCHHTSPRFVPFPLRYACEFLLQVFGVQINKEVELAAQMREKHILETQTVLCDMLLRDAPAAIITQSPNVMDLVKCGGAALYFRKKFWLLGVTPTEAQIRDLSEWLLQYHSESTGLSTDSLLEAGYPGASALGDAVCGMAAIKISSKDFLFWFRSYTAKEIKWGGAKHDPDDKDDGRKMHPRSSFKAFLEVVKRRSLPWEDVEMDAI

SEQ ID NO: 35598 - protein, 391 aa, Drypetes roxburghii
DLEPVNPSDVPVTAAGALKSYKLASKAISRLQSLPVANISLLCDVLVKEVRDLTGYDRVMVYRFHKDEHGEVVAECCRPDLEPYLGLHYPATDIPQASRFLFVKNKVRMICDCMAPAVKVIQDKRVARPLSLCGSTLRAPHGCHTQYMVNMGSIASLVMSVTINEDDDEMDSDQEQGRRLWGLVVCHHTSHRFVPFPLRYACEFLIQVFGVQIDKEVELARQMRKNIFCKLKLVLCDMLLRDAPMAIITQSPNVMDLVNCDGAALYYRKKIWLLGVTPTEAQIRDITEWLLEYPSGSTGLTTDSLMEAGYPGASILGGSVCGMAAIRITSNDFLFWFRSHTAKEIKWGGAKHDPGDKDDGRQMHPRSSFKAFLGVVKWRSLPWEDIEMDAI

SEQ ID NO: 35599 - protein, 433 aa, Pinus sylvestris
MAMAASTMMRSSVTAGSFRENHRPSVAVDAQIRSKITSTDGTVRLPFGSFGSNFFGSTAEFGQGSALQCQSARTLQPVRATATEAPPRVQRSSGKERTKIGINGFGRIGRLVLRVALSKEDIEVVAINDPFIDAKYMAYMFKYDSTHGVYKGSLKIVDDTTLEIDGHRITVNSKRDPSEIPWGNYGAEYVVESSGAFTTTEKASAHLKGGAKKVVISAPSADAPMFVVGVNEGSYKPEMSIVSNASCTTNCLAPLAKVVNEEFGIAEALMTTVHATTATQKTVDGPSMKDWRGGRGAGQNIIPSSTGAAKAVGKVLPELNGKLTGMAFRVPTPNVSVVDLTCRLEKPASYDDIKAAMKAASEGSLKGILGYTDEDVVSNDFVGDARSSIFDAKAGIALSSTFVKLVSWYDNEWGYSNRVVDLISHMALVASRK

SEQ ID NO: 35600 - protein, 441 aa, Bifidobacterium longum NCC2705
MTKHRIQSVDECGVLFRNACNMQSGKIGHFDVRFVKERIFMKTLKDLGDLKGKRVLVRADFNVPLDGTTITDDGRIKAALPTIKTLREEGAKVILMAHLGRPKGKVVPELSLAPVAARLGELLGANVPLAKDTYGEDAQAKVAAMNDGDVVLLENVRFNPEETSKDADERAAYAKKIAALGEAFVSDGFGVVHRAQGSNYDVAADLPAAAGLLVEKEVKALSKATENPERPFTVVLGGSKVSDKLGVIENLLDKANRLVIGGGMVFTFLKAKGYEVGTSLLEEDQLEKVKGYIETAEKNGVELVLPTDVVVNAGFPAGDTPVAPEVVAADAIPADKMGLDIGPESQKLFHDKIVDSKTVVWNGPMGVFEVPEFAAGTKAVAQGLVDATAVGAFTIVGGGDSASAVRNLGFPEDGFSHISTGGGASLEFLEGKELPGLKVLE

SEQ ID NO: 35601 - protein, 182 aa, Kluyveromyces lactis NRRL Y-1140
MSKENQNVVLVSVEGERFVVDRKIAERSLLLKNYLQDLNSGDLHDDNDADDDEDDEEDGDDEIVMPVPNVRSSVLQKVIEWAVHHKDSNFPDEDDDDSRKAAPVDPWDREFLKVDQEMLYEIILAANYLNIKPLLDAGCKVVAEMIRGRTPEEIRRTFNIVNDFTPEEEAAIRRENEWAEDR

SEQ ID NO: 35602 - protein, 392 aa, Elaeodendron orientale
DLEPVNPADVPITAAGALKSYKLAAKAISRLQSLPSGNISLLCDVLVKEVNELMGYDRVMVYRFHDDDHGEVVAEYCRPDLEPYLGLHYPATDIPQASRFLFMKNKVRMICDCLAPPVKVLQDKILAQPLSLSGSSLRSPHGCHAQYMANMGSIASLVMSVTINDDDDDETNNDQQKGRKLWGLVVCHHTTPRFVPFPLRYACEFLIQVFGVQINKEVELATQLKEKHILRTQTVLCDMILRDAPVGILTQSPNVMDLVKCDGAALYYRNKVWLLGVTPTETQIKEIVEWLLEYHSESTGLSTDSLMEAGYPDASILGEAVCGMAAVKITSKDFLFWFRSHTAKEMKWGGAKHDPDDKDDGKRMHPRSSFKAFLEVVKIRSLPWEDVEMDNH

SEQ ID NO: 35603 - protein, 174 aa, Zea mays
MAKQGAKKMKDENKKRLDLLLRIILISNAIYIVVRMAIMHSSFTWKHWIGLMVTSAAYFLPYKQLASMAKPVYSDNGELLDGGFDLSTGGVCEYLYDVIYITVFVQLMSIISEKFWWTYLVIPAFAGYKISGLLRGVFFSGGSEGEVEDEKTRKKREKMEKKASRGKMIKTRTR

SEQ ID NO: 35604 - protein, 433 aa, Pinus sylvestris
MAMAASTMMRSSVTAGSFRENHRPSVAVDAQIRSKITSTDGTVRLPFGSFGSNFFGSTAEFGQGSALQCQSARTLQPVRATATEAPPRVQRSSGKERTKIGINGFGRIGRLVLRVALSKEDIQVVAINDPFIDAKYMAYMFKYDSTHGVYKGSLKIVDDTTLEIDGHRITVNSKRDPSEIPWGNYGAEYVVESSGAFTTTEKASAHLKGGAKKVVISAPSADAPMFVVGVNEGSYKPEMSIVSNASCTTNCLAPLAKVVNEEFGIAEALMTTVHATTATQKTVDGPSMKDWRGGRGAGQNIIPSSTGAAKAVGKVLPELNGKLTGMAFRVPTPNVSVVDLTCRLEKPASYDDIKAAMKAASEGSLKGILGYTDEDVVSNDFVGDARSSIFDAKAGIALSSTFVKLVSWYDNEWGYSNRVVDLISHMALVGSRK

SEQ ID NO: 35605 - protein, 376 aa, Escherichia coli O157:H7 EDL933
MAKQDYYEILGVSKTAEEREIKKAYKRLAMKYHPDRNQGDKEAEAKFKEIKEAYEVLTDSQKRAAYDQYGHAAFEQGGMGGGGFGGGADFSDIFGDVFGDIFGGGRGRQRAARGADLRYNMELTLEEAVRGVTKEIRIPTLEECDVCHGSGAKPGTQPQTCPTCHGSGQVQMRQGFFAVQQTCPHCQGRGTLIKDPCNKCHGHGRVERSKTLSVKIPAGVDTGDRIRLAGEGEAGEHGAPAGDLYVQVQVKQHPIFEREGNNLYCEVPINFAMAALGGEIEVPTLDGRVKLKVPGETQTGKLFRMRGKGVKSVRGGAQGDLLCRVVVETPVGLNEKQKQLLQELQESFGGPTGEHNSPRSKSFFDGVKKFFDDLTR

SEQ ID NO: 35606 - protein, 400 aa, Campylobacter jejuni RM1221
MSDIISIKDIDLAKKKVFIRCDFNVPQDDFLNITDDRRIRSAIPTIRYCLDNGCSVILASHLGRPKEISSKYSLEPVAKRLARLLDKEIIMAKDVIGEDAKTKAMNLKAGEILLLENLRFEKGETKNDENLAKELASMVQVYINDAFGVCHRAHSSVEAITKFFDEKHKGAGFLLQKEIDFASNLIKHPARPFIAVVGGSKVSGKLQALTNLLPKVDKLIIGGGMAFTFLKALGYDIGNSLLEEELLEEANKILTKGKNLGVKIYLPVDVVAAPTCSQDAPMKFVPVQEIPNGWMGLDIGPASVRLFKEVISDAQTIWWNGPMGVFEIDKFSKGSIKMSHYISEGHATSVVGGGDTADVVARAGDADEMTFISTGGGASLELIEGKELPGVKALRSKENE

SEQ ID NO: 35607 - protein, 247 aa, Aquifex aeolicus VF5
MRRLIAANWKMNKTVKETEEYINTFLKFVEHPESREILICPPFTSLYVAGKMLQGTGVKLGAQNCHYEKRGAFTGEISIPMLQEVGCEYVIVGHSERRHIFGESDELIHKKIVACLEMGIRPILCVGEKKEEREAGMTFKVIETQIKLALTGVEEHTDKIDIAYEPVWAIGTGTPATPEDAVEVHTFIRNLINQLNPKNEGKTRILYGGSVNPQNAKEFMKHEEINGLLVGTASLDPESFAKIVYSF

SEQ ID NO: 35608 - protein, 70 aa, Solanum lycopersicum
MGFLVTTLIFVAIGVIASLCARICCNRGPSTNLLHLTLIITATVCCWMMWAIVYLAQLKPLIVPVLSEGE

SEQ ID NO: 35609 - protein, 505 aa, Agrobacterium tumefaciens str. C58
MNIQVQQKAGEAPFKLKYGNYIGGKWVEPKSGRYMDNLSPVTGHKICEVPRSDASDIEFALDAAHKAREKWGKTSITERSNILLRIAQRIEDNLDLIARAETWDNGKPLRETTNADIPLTIDHFRYFAGCIRAQEGTIGEIDNDTVAYHFHEPLGVVGQIIPWNFPILMAAWKLAPALAAGNCVVLKPAEQTPASILIVMELIEDLLPPGVLNIVNGTGLEAGKPLAQSNRIAKIAFTGSTSVGKEIMRYAADNVTNISLELGGKSPNIFFADVMNEDDAFLDKALEGFAFFALNQGEVCTCPSRALVHESIYDRFMEKAIKRVQAISQDDPLNPSTMLGAQASQEQFDKIMSYLEIGKKEGAKVLTGGDRKTLTGDLKDGYYIQPTVFEGNNKMRIFQEEIFGPVVSVTTFKTVEEALEIANDTVYGLGAGVWSRDTNIAYRAGRGIEAGRVWTNCYHVYPAGAAFGGYKQSGIGRETHKMMLDHYQQTKNLLVSYSPNKVGFF

SEQ ID NO: 35610 - protein, 219 aa, Pseudoalteromonas tunicata D2
MLKSRVQYSAATFITSAPDISKLPPDTGIEVAFAGRSNAGKSSSLNTLTDKKIAKTSKTPGRTQLINAFDLGDNMRLIDLPGYGYAKVPIEMKKKWQRSLGEYLEKRKSLKGLVILMDIRHPLKDLDKDLINWAVDSNISTLVLLTKADKFKQGKRKSEVLRVRRELKELNGDITVHAFSSLDGIGLVEVAKHLDNWYLGEVIHQAPEEKEAIEPEQNV

SEQ ID NO: 35611 - protein, 97 aa, Glycine max
  misc_feature (81)..(81): Xaa can be any naturally occurring amino acid
LKPKEQLLQQHLLRVMRILEALDEKGCRIPLTSGDSELAEKLARISRKLRRSGSELSRVVQVLLSVSHVKAKNNGLGISVXRPGSSIIHEQSLGDLC

SEQ ID NO: 35612 - protein, 391 aa, Elatine triandra
DLEPVNPADVPVTAAGALKSYKLAAKAISRLQSFPSGNIPLLCDVLVKEVSDLTGYDRVMVYKFHEDEHGEVIAECRKPDLEPYLGLHYPATDIPQASRFLFMKNKVRMICNCMVTPVKVIQDKRLPQPLSLSGSTLRSPHGCHAQYMANMGSIASLVLSVTINEEDDKIDGDQLLGRKLWGLVVCHHTNPRFVPFPLRYACEFLIQVFGVQINKEVELATQVKEKHILRTQSVLCDMLLRDAPVAIVTQSPNVMDLVNCDGAALYYKKKFWLLGVTPSEAQIRDIGDWILECHSSNTSLSTDSLMEAGFPGASVLGEAVCGMAAIKITSKDFLFWFRSHTAKEIKWGGAKHDPDDKDDGRKMHPRSSFRAFLEVVKWRSLPWEDVEMDAI

SEQ ID NO: 35613 - protein, 246 aa, Kineococcus radiotolerans SRS30216
MTIHDKIIAITGASSGIGEATARHLASRGAAVVLGARRTDRLEQLVEEITAAGGRAAAVRVDVTDPDDLHSLVDRAVEGFGRLDVLVGNAGVSRISPMTDVDVEGWSAMVDVNVKGVLNGIAAALPVFRAQGSGHLVTVVSTSGLKIVPTQAVYAGTKNAVRTIVEGLRQESTDGVLRTTSISPGYVRTEFIDSALDDPRLREQVKQTMAELGIDPTAVARAIAFAIDQPDDVEIGDLTIRPTRQG

SEQ ID NO: 35614 - protein, 391 aa, Elatine triandra
DLEPVNPADVPVTAAGALKSYKLAAKAISRLQSLPSGNIPLLCDILVKEVRDLTGYDRVMVYKFHEDEHGEVIAECRKHDLEPYLGLHYPATDIPQASRFLFMKNKVRMICDCMATPVKVIQDKRLPQPLSLSGSTLRSPHGCHAQYMANMGSIASLVLSVTINEEDDKIDGDQLLGRKLWGLVVCHHTNPRFVPFPLRYACEFLIQVFGVQINKEVELATQVKEKHILRTQSVLCDMLLRDAPVAIITQSPNVMDLVNCDGAALYYKKKFWLLGVTPSEAQIRDISDWLLECHSGNTGLSTDSLMEAGFPGASVLGEAVCGMAAIKITSKDFLFWFRSHTAKEIKWGGAKHDPDDNDDGRKMHPRSSFRAFLEVVKWRSLPWEDVEMDAI

SEQ ID NO: 35615 - protein, 359 aa, Oryza sativa
MPAIADCAADPPLADSYYTLLRLGGDDDDDACTKVTTTPQPVSECELPMIDVGCLTAPTGAAAAAAVGQQHQAEERAACAAAIAAAAAEWGFFQVVNHGVAQELLEAMRREQARLFRLPFEAKSSAGLLNDSYRWGTPTATSLRQLSWSEAFHLPLAGISGKSCNYGDLTSLRDVTREVADAMSRLARALARVLAESLLGHATGERFPEGCDDATCFLRLNRYPPCPFPPDDAFGLVPHTDSDFLTVLCQDHVGGLQLMKGSRWVAVKPIPGALIVNIGDLFQAWSNNRYKSVEHRVMTNATTERYSVAYFLCPSYDSPIGTCREPSPYKAFTFGEYRRRVQEDVKKTGKKTGLSNFLV

SEQ ID NO: 35616 - protein, 125 aa, Aquifex aeolicus VF5
MREIKTPKAPVPVGPYSQAVEVNGFLFISGQIGINPETGKLVEGFKEQVIQIFKNVDAILEEAGLKRENIVKVTIYITDIKKFKELNEIYEDYFKDVSVKPARVTVGVKELPLNAEVEIEIVAVK

SEQ ID NO: 35617 - protein, 391 aa, Endospermum moluccanum
DLEPVNPVDVPTTAAGALKSYKLAAKAISKLQSLPSGNISMLCDVLVTEVRDLTGYDRVMVYKFHEDEHGEVIAECHKPDLEPYLGLHYPATDIPQASRFLFMKNKVRMIYDCFASPVKVIQDKSLSQPLSLCGSTLRSPHGCHAQYMANMGSIASLVMSVTINVDGDEMDNDQQKGIKLWGLVVCHHTSTRFVPFPLRYACEFLIQVFGVQIHKEVGLAKQMREKHILQTQTLLCDMLLRDAPVAIITQSPNLMDLVKCDGAALYFENKFWLLGVTPTEEQIRDIAEWLLKYHSENTGLSIDSLVEAGYPGASVLGDAICGMAAIRIASKDFLFWFRSHTAKEIKWGGAKHDPEEKDDGRKMHPRSSFKAFLEVVKWRSSPWEDVEMDAI

SEQ ID NO: 35618 - protein, 352 aa, Prochlorococcus marinus str. MIT 9313
MQLSSRPSSLVLDHHQNKFLTPWSDPADPHILFPIQPLEQLLVQLGWPDPQAWLIHWQKRGGISLKRPFWHPSTRTDWIWGLGLPLLTLVEGCLGKSDRSLLGITGLPGCGKTSLGCWLEAAAGELGWPIKVISLDDFYWPFPQLDRSMSGNPWRVPRALPGSHDLDLLASVLDTWQSTGHLKAPMFDKALRHGRGDRDGWHLSDPKVLVIEGWILGCLPCKFAEAGQFSDQLVPPLNKLEHDYRLVVQEALNGYVPIWDRLDTLWHLKAIDPSSTRIWKANQESLMQLNRGVCLDQESFEGFVRMILASIPLTCLDGIEADVVATLTPARQLMWVGQRGYQDSSSSDSCIG

SEQ ID NO: 35619 - protein, 702 aa, Bifidobacterium longum NCC2705
MTEFKETELDERAIKMAKVLSADAVEKAGSGHPGSPISLAPVAYTLYQHFIKHDPNDPNWEGRDRFILSGGHASLTQYVQLYFSGYGVTLDDLKNFRGGAATRTPGHPEYGLTPGIEMTTGPLGQGFASAIGFAYGERFQRGLLDPETPKEDSPFYHKIWAICGEGDIEEGISGEAASLAANQKLGNLTVIFDANRIQIEGDTNLVLAEDVLKRFQAYGWYTDEFSFIQPDGSYKEDIEGLADVIAKAEKAAPDQPKLIKVHSLIAWPTPGKTNDPSSHGSKLGTEAVAGLKEALGYDPEENFHVDEEALAHARKVAERGLEAHKEWDEKFDAWRKANPDKAALYDRLKAGELPEGFDKALDDLEATFEVGKGVATRGASGSVLNAIAAVMPELWGGSADLGGSNKTDLKGAATFAPAECATKQWPNCNEFGRQLHFGVREFTMGCITNGILLGSHTRPFGGTFFMFSDYERSAVRLAALMEIPNLYIWSHDSVAVGEDGPTHQPVEHLASFRAIPQLEVIRPADAFETAEAYRYFFEKKNTLPGAMVLTRQGVPVLAETAAKAKDGVKKGAYVLVDTEGTPDVILMASGSEVQWAVAAAKTLAGEGVKARVVSVPSMEWFEEQDAEYKEAVLPAAVKARVSVEAGVAMPWYKYLGSYGKPVSIEQFGLQGDGAQNMIDLGITAEHVVEAAKASIAEVEAAK

SEQ ID NO: 35620 - protein, 391 aa, Galearia filiformis
DLEPVNPADVPVTAAGQLKSYKLAAKAISRLQSLPSGNISLMCDVLVKEVSDLTGYDRVMVYRFHEDEHGEVVAECCRPDLEPYLGLHYPATDIPQASRFLFMKNKVRMICDCQAPAVKVIQDKRLVQPLSLCGSTLRSPHGCHAQYMANMGSVASLVMSVTINGDDDEMHSDQQKRRKLWGLVVCHHTSPRFVPFPLRYACEFLIQVFGVQINKEVELAAQMREKHILQIQTMLCDMLLRDSPLAIITQSPNVMDLVKCDGAALYYKKKFQLLGVTPTEAQIKDIADWLLEYHSGSTGLSTDSLMEAGYQGASILGDAVCGMAAVRITSNDFLFWFRSHTAKEIKWGGAKHDPNDKDDGRKMHPRSSFKAFLEVVKWRSLPWEDVEMDAI

SEQ ID NO: 35621 - protein, 567 aa, Coccidioides immitis RS
MVKKSPFAPIPIPSSNVLSFLFPPGSPLRSATKPIWIDSADPTLQLTTAAALDWVKRLCSGLENFKDQASGQQVVKKGEVVLIFTPNQIFVPVAYLGIVGSGRIFSGINPGYSVNEVVYQMNNTEAKVILVHPSLLDTAVAAARQAGIPTDRIFQFSETEVPMRDGVRDWRELLANLEASRDYQWPELSENEAANTIATINYSSGTTGLPKGVCVSHRNLIANILQSNYIRNALVQYGPEGPPQHRWIGFLPLYHVYGQMMTILHAVRNQVPIYVMKKFVFEDYLRAIQDYKITYLHVVPPIMVMLSKRPETAKYDLSSVLEISCGAAPLSRELQNEVAEKYGVSIKQGWGMTEVTTGAIHVPGGVEDKTGSAGVLDPNCECKLLDDDGNEVPEGEPGEMYIRSPNVSMKYWKNEEATRETMLSDGWLRTGDIAVCRGDWFWIVDRKKELIKVNALQVAPAELEAALLENDDIADAAVVGMKMNDEEFPRAYVVLKDAVKQRPNPLTGEQIQEWIKPRVAKHKWLTGGVELIDEVPKLPSGKIMRKVMREWAKRDAAKFQGLQRAKL

SEQ ID NO: 35622 - protein, 212 aa, Triticum aestivum
MDTAAPGPPREGHRTVCSEPPKRPAGRTKFKETRHPLYRGVRRRGRLGQWVCEVRVRGAQGYRLWLGTFTTAEMAARAHDSAVLALLDRAACLNFADSAWRILPVLAAGSSRFSSAREIKDAVAIAIVEFQRQRPVVSTSETHDGEKDVQGSPTPSELSMSSDLLDEHWFGGMDAGSYYASLAQGMLMEPPSARTWSEDGGEYSGVYTPLWN

SEQ ID NO: 35623 - protein, 381 aa, Bifidobacterium longum NCC2705
MADYYETLGVERGASDDEIKKAYRKLSRKYHPDIAGPEFEDKFKEVNNAYDVLSNPDKRRMYDSGVDPNNPNAGAGGFSGAGFGDMSDVFSTFFGSAFGGGSQGPVPRTQPGRDALASASIDLKTAVFGGTAHVKINTFSLCQECGGSGAQGGAQPVTCPDCHGQGFMQKVVRTMLGQMMTSAPCERCEGHGTIIQNPCPSCMGHGRVRTTRTVGVTVPAGINDNARLRLANQGEVGEGGGAAGDLYIDIRIKADKQFTRDGDDLHCWIQVPMSWAVLGHDLSIDTFDGEKTVSIPAGCQTEDTVTLKGLGVTNIRNKDERGNLIAHVNVLIPTKLNETERGLIEQFAASHDSGATHVSQASRPQAGQKKGFFSKLKDALS

SEQ ID NO: 35624 - protein, 1080 aa, Xanthomonas campestris pv. campestris str. ATCC 33913
MPKRTDLKTILIIGAGPIVIGQACEFDYSGAQACKALRDEGYRVVLVNSNPATIMTDPNMADAVYIEPINWQTVEKIIAKEKPDALLPTMGGQTALNCALDLADHGVLEKYNVELIGAKREAIRMAEDRELFRVAMGEIGLDCPRAEVAHTLEEALDIQTRVGYPTIIRPSFTLGGSGGGIAYNREELIDIVGRGLELSPTTEVLVEESVLGWKEFEMEVVRDTADNCIIVCAIENLDPMGVHTGDSITVAPAQTLTDKEYQRLRDASIAVLRKIGVDTGGSNVQFGISPTTGRVVVIEMNPRVSRSSALASKATGFPIAKVAAKLAVGYTLDELKNEITGGLTPASFEPSIDYVVTKIPRFAFEKFPQADARLTTQMKSVGEVMAMGRTFQESLQKALRGLETGKIGLDPTGLDLGSEDDMAALKRELKAPGPERLFYVGDAFRAGMSVADVYALSFIDPWFLDQIEELISLEQQLADDGMAALDAPRLRLLKRAGFSDARLAELIGTNEEAVRTLRRALKVRPVYKRVDSCAAEFATSTAYLYSTYEDECEALPSNRDKIMILGGGPNRIGQGIEFDYCCVHAALALRDDGFETIMVNCNPETVSTDYDTSDRLYFEPLTLEDVLEIVELEQPKGVIVQYGGQTPLKLARALEANGVPVIGTSPDSIDLAEDRERFQQLVDKLGLKQPPNRIARNADEALVLAREIGYPLVVRPSYVLGGRAMEIVYGESDLARYVRDAVKVSNDSPVLLDRFLDNAVEVDVDIIADKDGNVLIGGVMEHIEEAGVHSGDSSCSLPPYSLSAETQAELRRQVVMLAEGLNVVGLMNTQFAVQVNDAGDDIVYLLEVNPRASRTVPFVSKATGMPLAKIAARCMAGKTLAEQGATKEIVPDYYSVKEAIFPFAKFQGVDPILGPEMRSTGEVMGVGRSFGAAFARAQEAGGIKAPPLGKAFVSVRDPDKQRVLPVAQALVERGFTLVATRGTGAWLQQHGLSCEIVNKVAEGRPHIVDSIKNGEIVYIVNTTEGRAAISDSFSIRREALQHRVTYSTTVAGAKALVHSLEFRGTGPVWSLQELHKELEA

SEQ ID NO: 35625 - protein, 391 aa, Goupia glabra
DLEPVNPADVPVTAAGALKSYKLAAKAISRLQSLPSGNISLLCDVLVKEVSDLTGYDRVMAYRFHDDEHGEVVAERRRPDLEPYLGLHYPATDIPQASRFLFMKNKVRLICDCLAPPVKVIQDKRLAQPLSPCGSTLRSPHGCHAQYMANMGSIASLVMSVTINDDDDEMNSDQQKGRKLWGLVVCHHTSPRFVPFPLRYACEFLIQVFGVHISKEVELAAQMRKSIFCEFKLVLCDMLLRDAPVAIITQSPNVMDLVKCDGAALYYKKKFWLLGVTPTEAQIRDIAEWLLEYHNESTGLSTDSLMEAGYPGASILGDAICGMAAARITSKDFLFWFRSHTAKEIKWGGAEHDPGDQDDGRNMHPRSSFKAFLEVVKQRSLPWEDVEMDAI

SEQ ID NO: 35626 - protein, 1157 aa, Thermococcus kodakarensis KOD1
MDREEMIARFAKFLREYVDDEGNEVYINRLKDLLTVTPKRSLAIDWAHLNSFDPELADELLNNPEEAIASAEDAIQIVLREPPLLVEREFKVHARFYNLPKTLLVKELGSEHINKLIQVEGIITRVSEVKPFVEKAVFVCRDCGNEMVRLQRPYENLVKPAKCDACGSRNIELDVDKSRFLNFQSFRLQDRPESLKGGQMPRFVDAILLDDLVDAALPGDRVLVTGVLRVILEQREKRPIFKKILEVNHIEQLSKEIEELEISPEDEQKIRELAKRKDIVDAIVDSIAPAIWGHRIVKKGIALALFGGVQRTLPDGTKLRGESHVLLVGDPGVAKSQLLRYVANLAPRAIYTSGKSSSAAGLCVAPDSIIKTNLGQFKIGELVEKAIPEKVQDYKSVNAEKLGLYIKTLDGDMRVLRLWKLRAPEKLIRIEGDGLSITVTPETKLLTPNGWVEARNVDGEVVTENGPVKVSKQEIESPHDYVYDLTVEGSHSFIANGFVVHNTAAAVRDEFTGSWVLEAGVLVLADGGFALIDEFDKMSDRDRSAIHEALEQQSYHHDFELLLADGRKVKIGELVDKLIEKNRDRVILGKDTEILPVEDIELLAYDLEKREIVKVKADRVSRHKAPERFIKLRFSNGREITVTPEHPVMVWENGEITEKPAEKITPGDIALGVLRYPIQVDGKFKERYRDMREAEDYQDYLYSRGVVSKIKRTGIYFTVEKARRALPRELVKPLINAGKILRVTQTPKERASFNQKLVRENIIEGYLQRIIERMDELERLSREDPAKALELLPKTQLYYKYGITYGKLKKLAEARNSWAEGIIQSAVAERISLAKRELEEFFKWWNANVNFLKVKCVEEIKNDRWEWVYDVTVEPHHLFVSHGLVLHNTISISKAGITATLNSRTTVIAAANPKFGRFNRHKSLPEQLDLPPTLLSRFDLIFLLLDEPDEKVDASIAEHILKVRRGEAEAVTPKIPYDLLKKYIAYARKNVHPVLSREAMEEIKRYYVKMRKGLRRGDEDGVQPIPITARQLEALIRLSEAHARMRLSETVTREDARAAIEIIEAMMKTIAVDEEGNLDVSILEVGKSSKKINKIEKLVDIIKSLESEGEFGAPEEKVIEAAKQAGIGTKADIEKLLNELKSDGRVYEPRAGFYRVI

SEQ ID NO: 35627 - protein, 588 aa, Oryza sativa (indica cultivar-group)
MAMKSLKLPKTAVLPGFGGIARPQDVQDRSANFTCSRPRAASVTDQEIVHEESGHVLKIPFRRIHLTGDEKHFDTYDTSGPQNISPRIGLPKIRKEWIDRREKLGGPRYTQMYYAKQGIITEEMLYCATRENLSPEFVRSEVARGRAIIPSNKRHLELEPMIVGRNFLVKVNANIGNSAVVSSIEEEVHKLQWATMWGADTVMDLSTGRHIHETREWILRNSSVPIGTVPIYQALEKVNGIAENLSWEVFRDTLIEQAEQGVDYFTIHAGVLLRYIPLTAKRMTGIVSRGGSIHAKWCLTYHKENFAYEHWDEILDICNQYDVALSIGDGLRPGSIYDANDSAQFAELLTQGELTRRAWAKDVQVMNEGPGHIPMHKIPENMEKQLEWCNEAPFYTLGPLTTDIAPGYDHITSAIGAANIGALGTALLCYVTPKEHLGLPNRDDVKTGVISYKIAAHAADLAKGHPYAQAWDDTLSKARFEFRWLDQFALSLDPVTAMSFHDETLPSEGAKVAHFCSMCGPKFCSMKITEDIRKYADEHGYGTVEEAVIQGMNAMSAEFSAARKTVSGEQHGEAGGEIYVPESYTARK

SEQ ID NO: 35628 - protein, 449 aa, Coprinopsis cinerea okayama7#130
MQQQQQQQQQVSLDEWVSNVMQHDPMRVYRARRDAHHRPVTSKYAILGFISSGTYGRVYKAQSINGGELLAIKKFKPDKEGDVVTYTGISQSAIREIALNREINHENVVALREVILEDKSIYMVFEYAEHDFLQVIHHYYQTIRTSIPTAVLKSLIYQLFNGLIYLHASHILHRDLKPANILITSQGVVKIGDLGLARLCYEPLQPLFAGDKVVVTIWYRAPELLMGAKHYNKAIDCWAVGCVMAELASLRPIFKGEEAKLDSKKNVPFQRDQLIKIFEVLGTPDERDWPGVVDMPEYRNMKLLDHFSNRLSDWCHTRIRSPQGYDLLRQLFAYDPDNRLTAEQAIQHKWFHEDPLPTWNAFQSLAQHQIPPCRRITQDEAPSMMPMATQQNTQQAMGGGHIAGGAGAPFSKPGSTASFASLSGGGPYAQSQGGTGGHTAHTRKKARMG

SEQ ID NO: 35629 - protein, 180 aa, Agrobacterium tumefaciens str. C58
MTVIASELSAAIRSIPDYPKPGIIFRDITTLLGNPRAFRRAVDELVQPYAGTKIDKIAGMEARGFILGGAVAHQLSAGFVPIRKKGKLPHTTVRVAYSLEYGVDEMEMHVDAVQPGEKVILVDDLIATGGTAEGAVKLLRQMGAEIVSACFVIDLPDLGGRKKLEDLGVDVRTLVEFSGH

SEQ ID NO: 35630 - protein, 303 aa, Burkholderia mallei ATCC 23344
MDAAAPTSPRSADASRAAPQPTRVRTADRLELACYRWPSTAPSCAAPRATVALVHGLAEHAGRYQAFAERLNAAGIEVVAIDLRGHGRSPGERAWAERFDRYLDDADALVASAARENTPLFLMGHSMGGAIAALYAIERAAARHANLAGLILSSPALAPGRDVPQWMLAMSRFISRVWPRFPALKIDAALLSRDPAVVAANRADPLVHHGSVPARTGAEILDAMRRIAAGRAALRIPVLVYHGTADKLTEPDGSRDFGAHVGSPDRTLTLYEGNYHETMNDLERERVIGALIDWIAARVPARG

SEQ ID NO: 35631 - protein, 147 aa, Pisum sativum
MGFTDKQEALVNSSWESFKQNLSGNSILFYTIILEKAPAAKGLFSFLKDTAGVEDSPKLQAHAEQVFGLVRDSAAQLRTKGEVVLGNATLGAIHVQRGVTDPHFVVVKEALLQTIKKASGNNWSEELNTAWEVAYDGLATAIKKAMT

SEQ ID NO: 35632 - protein, 391 aa, Hirtella bicornis
DLEPVNPADVPVTAAGALKSYKLAAKAISRLQSLPSGNISLLCDVLVKEVSDLTGYDRVMVYRFHEDEHGEVIAECCMPDLEPYLGLHYPATDIPQASRFLFMKNKVRMICDCLAPPVKVIQDKRLAQPLSLCGSTLRAPHGCHSQYMANMGAIASLVMSVTINEDDEEMETGQQKARKLWGLVVCHHSSPRFIPFPLRYACEFLIQVFGIQINKEVELAAQTREKHILRTQTVLCDMLLRDAPVAIITQSPNIMNLVKCDGAALYYRKKFWLLGITPTDTQIKDIVEWLLQYHGESTGLSTDSLMEAGYPGASVLGDAVCGMAAVKITSKDFLFWFRSHTAKEIKWGGAKHDPDDKDDGRKMHPRSSFKAFLEVVKRRSLHWEDVEMDAI

SEQ ID NO: 35633 - protein, 391 aa, Homalanthus populneus
DLEPVNPADVPITAAGALKSYKLVAKAISKLQSLPSGNISRLCDVLVKEVSDLTDYDRVMVYRFHNDEHGEVIAENCRPDLDPYHGLHYPATDIPQASRFLFMKNKVRMICDCLAPPVKVIQDQSLGQSINLCGSALRSPHGCHAQYMENMGSIASLVISVTINEDGSEMDDDQQKARKLWGLVVCHHTSPMFIPFPLRYACEFLIQVFGVQINKEVEMAAQMREKRILQTQTVLCDMLLRDAPVAIITQSPNVMDLVKCDGAALFYRKKFWLLGVTPTEAQVEDIVEWLLEFHSESTGLSTDSLMEAGYPGASTLGHAICGMAAVRISSKDFLFWFRSHTAKEIKWGGAKHDPEDKDDGRKMHPRSSFNAFLEVVKWRSLPWDDVEMDAI

SEQ ID NO: 35634 - protein, 185 aa, Glycine max
  misc_feature (158)..(158): Xaa can be any naturally occurring amino acid
MTRGIKHRQKAKSKKKAKKKNQGSKKEGGSSSSLAPEIPAKVWQPGVDKLEEGEELQCDPSAYNSLHAFHIGWPCLSFDILRDSLGLVRTEFPHTVYFMAGTQAEKPSWNSIGIFKVSNITGKRREPVPKLGTDDTEMDGEDSDSDDDSEEEDEGGAXGPSLQLRKVAHQGCVNRIRSMPQNPHI

SEQ ID NO: 35635 - protein, 391 aa, Hugonia platysepala
DLEPVNLADVPMTATGALTSYKIAAKAISRLQTVPSGSINLLCDVLVKELRELTGYDRVMVYRFHEDDHGEVVAECRSSDLESYLGLHYPATDIPQASRFLFMKNKVRMICDCLASSVKVMQDKSLAEPVSLSGSILRSPHGCHAQYMANMGSIASLVMSVTINEDCNEMESDQQRGRKLWGLVVCHHTSPRFVPFPLRYACEFLIQVFSIQISKEVELEAQRREKHIMQTQTVLCDMLLRDAPLAIMTQSPNVMDLVKCDGAALCCRKNCWLLGLTPTEQQIADIAEWLLEYHGESTGLTTDSLMEAGYPGASVLGNAICGMAAIRITSKDFLFWFRSHTAKEIMWGGAKHDPGDKDGGRKMHPRSSFKAFLEVVKWRSLTWEDVEMDAI

SEQ ID NO: 35636 - protein, 403 aa, Arabidopsis thaliana
MLLPFPATMISEVEQPKEKRSLSSEPPSLMSLPYEIIENILARISKWSYPNLSLVSKSFLSLLSSPQLYKTRSEIGTTEPCLYFCLESANHSSPQWYTLWMKPDETLTGTGTIHDYSLIPLPSSSPVLRTSTVAVGSEIYVIGGHFNRSSSVRIFDCRSNTWRDGPNMTVARSDPVAVLIDQRIYVLGGREMDESDDWFEVFDIKTQTWRALPSFRAGLELRRYIVWPNRYFPRLGDSQTAVRLINVNPNALEGKLYVAAQINDYTYEPKDDTWKVVSKSSIRRVKVWCVIENVMYACHDVFLRWYDYEDRRWREIQGLEELCYHPTRGFSGAERIVNYGGKLVVMWRPVQSDGKDKIEIWCAQIALEKRSKDEIWGKIEWINSVLTVPKLCDLCYSCVVVSI

SEQ ID NO: 35637 - protein, 391 aa, Hymenanthera alpina
DLEPVNPADVPVTAAGALKSYKLAATAISRLQSLPSGNISLLCDTLVKEVSDLITYDRVMVYRFHDDEHGEVIAESCKPGLEPYLGLHYPATDIPQASRFLFMKNKIRMICDCLAPPVKVVQDKRLEQPLSLCGSTLRSPHGCHSQYMANMGSIASLVMSVTINEDDDEMDSDQQKGRKLWGLVVCHHSSPRFVPFPLRYACEFLIQVFSVQISKEVEVAAQMKEKHIFKTQTVLCDMLLRDAPEAIITHSPNVMDLVKCDGAALYYRKKVCLLGVTPTEAQIRDIAEWLLEYHSGSTGLSTDSLMEAGYPNASILGDLVCGMAAVRITSKDFLFWFRSQTDKEVKWGGAKHDATDKDDLRKMHPRSSFKAFLEVVKWRSLPWEDVEMDAI

SEQ ID NO: 35638 - protein, 392 aa, Hypericum empetrifolium
DLEPVNPADVPVTAAGALKSYKLAAKAISKLQSLPSANISLLCDVLVKEVSDLTGYDRVMVYKFHEDDHGEVVAECHRPDLEPFLGLHYPATDIPQASRFLFLKNKVRMICDCYAQPVKVVQYSGLSQSLSLCGSSLRAPHGCHAQYMVNMGSIASLVMAVTINDDDDDEAEADRRKGRKLWGLVVCHHRAPRFVPFPLRYACEFLIQVFGIQINKKVKLEAQMREKHILETQTVLCDMLLRESPVAIVTQSPTVMNLVKCDGAALCYQNTFWLLGVSPTEAQVRDITEWLLEYHAGSTGLSTDSLMEAGYPGASVLGDAVCGMAAIRINSKDFLFWFRSHAAKEIKWGGAKHDPDDKDEGRKMHPRSSFKAFLEVVKWRSLPWEDVEMDAI

SEQ ID NO: 35639 - protein, 255 aa, Bradyrhizobium sp. BTAi1
MTGRFDLRGKVAIVTGGNGGIGLGMARGLADSGADIAVVGRNAAKSKTAVADLAGRGVRAIAVTADVSNQYDVAAMVAQVSRELGRIDILINNAGMSIRKPPHLLELEEWREVIDTNLTSAFLCSKAAYPALKANGGGKIINIGSMLSIFGASFAPAYAASKGGIVQYTRACACAWAPDNIQVNAILPGWIDTDLTRAARQQIDGLHDRVLARTPAGRWGDIDDFAGIATFLSSPASDFVTGTAIPVDGGYSISA

SEQ ID NO: 35640 - protein, 293 aa, Rhodospirillum rubrum ATCC 11170
MLQGSITALVTPFRDGAVDQRAFQDFVAWQIAEGTQGLVPVGTTGESPTLSHDEHKRVVELCVEVAKGKVPVIAGAGSNSTAEAVDFTRHAVKTGADAVLVVTPYYNKPTQEGLYQHFKAVAGAAGDLPVIIYNIPGRSIVDMSVETMARLAHDLPNIKGVKDATADLARPLKTRVVLGPEFIQLSGEDATATAFLAQGGVGCISVTSNVAPRLCAEMQRSWREGDLATCFAIRDKLMPLHDAMFCETSPGPVKYAVSLLGKGSAETRLPMVPISEASRKKVEEALRATGLLA

SEQ ID NO: 35641 - protein, 612 aa, Leifsonia xyli subsp. xyli str. CTCB07
MCGIVGWVSFDRDLTEHRESVDAMTATMACRGPDAEGVWLDRHGALGHRRLAIIDVEGGSQPMSAHTDDGAVTLTYSGEVYNFSELRGELMRRGHRFETRSDTEVVLHGYLEWDEAVAERLNGMYAFAIWDARAEKLVMIRDRMGVKPLYFFTTDDGVLFGSEPKAILAHPLADRAVDLDGLREVVSFAQTPGSAVWCGMREIVPGGVVTVCRAGLREYRYWTLTTRPHTDDLPTTIARVRSLLEDTVGRQLVSDVPRCTLLSGGLDSSAITAFSAAQLAGHGEKVRSFAVDFVGREDDFVADDLRSTPDAPYAREVASHVGSQHETIVLDNDAIADPAVRRAVIAARDNPLSLGDLDASLYLLFQAIRAHSTVALSGESADEVFGGYRWFHQPEVQAAPTFPWMALPVSGSPTRVRDRFTAKITAALDLPAYLRERYTSAIAEVQPLENESAHERRMREICYLHLTRLVRMLLDRKDRISMAVGLEVRVPFCDHRLVEYVYNVPWAMKTFDGREKSLLRAATADLLPESVLQRTKAPYPTTSDPGYARTLIQQSRDLLSADDRVFGLVDRGRLEEITRQDPATMTLDVRNGMETALDLSTWLEIYQPELRM

SEQ ID NO: 35642 - protein, 477 aa, Kluyveromyces lactis NRRL Y-1140
MLRSAAVRRSLSKGEVSSLLSYRYKSSFATALNTAARLVTPKALLNNPVSLVSNEMNTLAKNIVTLIGSGHPLLNRISGYYFEAEGKKVRPMLVLLLSRALSQIPLEERDRIKIDYTDVPEDPVYSKVQHSRLFENVPASISPLHILHGIKPLNPLTKGPEPLPQEFDRARGILPKQRRLAEIVEMIHTASLLHDDVIDHSDTRRGRPSGNIAFTNKMAVLAGDFMLGRATVAISRLRNPEVVELVSNSIANLVEGEFMQLKNTAIDADHTTFNNGTQHIPPPPTKFELTEHEYRVPTSSTTNGTQLSHDQLVDMAFDYYLHKTYLKTAALISKSCRAAAVLSGVRDPIIEECYEFGKNLGICFQLVDDMLDFTISAKDLGKPAGADLELGIATAPVLFAWREDPSLGPLIKRNFSNPGDVEAAALAVKKYDGVGKTNELAKDYCNKALQNLRNGLPNSDARSALEFLTNSVLTRRK

SEQ ID NO: 35643 - protein, 403 aa, Chlamydophila caviae GPIC
MDRLTVRELSPEENKVLVRVDFNVPIKDGKILDDIRIRSAMPTINYLLQKRAAVILMSHLGRPKGTGFEEKYSLQPVVEVLEGYLGHHVPLAPDCIGEVARQAVAQLSPGRVLLLENLRFHRGEEHPEEDPTFAAELSSYGDFYVNDAFGTSHRKHASVYHVPQAFPGRSAAGLLMEKELEFLGQHLLHSPKRPFTAILGGAKVSSKIGVIEALLSQVNNLLLAGGMGFTFLKALGKSVGNSLVEESGIELARRVLKLAEQRNVRIVLPIDVKVAKACEPGVSWSETLIDQGIPADLEGLDIGTKTIQEFCKIIDASATVFWNGPVGVYEVPPFDQGSMAIANCLARHSSATTVVGGGDAAAVVALAGCTSQVSHVSTGGGASLEFLENGFLPGTEVLSPAQD

SEQ ID NO: 35644 - protein, 461 aa, Listeria monocytogenes EGD-e
MSLFSLKKKNHFVPLEIQRQQWFKHFIVAFMSVFICYLTVYLLRNNFKAAQTLLIEQNHFSTTELGMIGLAFSVMYGIGKTILGYVVDGRNAKKIMSFLLGISAIISIIIGILLVAKQATVGILFILWGANGFVQSPGGPASYSTITRWTPKLKRGRWLGFWNASHNIGGALAGIVAFWGATTFFNGGAGGMFIVPGIIAIIIAIICFSVGHDEPEELGWNSAAEIFEEREEQGESETKDLSRFQILCRFVINNPWVWTLCVINIFIYIVRIGIDNWAPVYCIQALGWSTKDAIMTISFFEIGALLGSLSWGWLSDIMKGRRMLCSIIAVVIEFFMLISYSQVTSVYSMYTVLFILGFLVFGPQLLIGVSVIEFVPRNALAVTNGLTGTFAYLFGDSFAKVFLGYIADPTKAGMQIFGYNLHGWGATFTIMFTALIIAGLMMIPVALKQEKIIRQAKVLHL

SEQ ID NO: 35645 - protein, 172 aa, Blastopirellula marina DSM 3645
MGRDNCVWQLPLRPRAADLTNTVADQQTGLVPSLFLKDAAAMPIDLPREPDFAKAGGLVPAIAQDADNGDVLMMAWMNAEAFAETLATNRAVYFSRSRGKLWRKGEESGHVQTVVGIFVDCDADTVLLKVRQAGAACHEGYRSCFFRQITTTDTQVVGERLVDPAEAYRKKP

SEQ ID NO: 35646 - protein, 239 aa, Helianthus annuus
QYGRETRHTGDYENPIHSTGGQYEQEVPQTDEYGNPVRRTDEYGNPVHSTTGGTMGDYGSTGLGQGTGTGGIGTGGYGTTGHHGLGTGVGHTTGGTGTDYTSGGRSTGQTGYQGLGTEPEFGGKTGTFQNQPSATPVGGVGLSSGTGAGVGGTGTGTGILHRSGSSSSSSSEDDGQGGRRKKKGVMQKIKEKLPGGHRQEEQYQSQTTTTTTGGGAGYGETHEKKGMMEKIKEKLPGHH

SEQ ID NO: 35647 - protein, 321 aa, Geobacter sulfurreducens PCA
MILEEARKVIRIEAEALTRLADTIDGEFEKAVRLILGTRGRVVVTGMGKSGLIGQKIASTMASTGTPALFLHPAEGVHGDLGMIMKGDVVIAISNSGETEEVVRILPIIKRLGATLVSMSGNPSSTLAKAGDVFLDISVTEEACPLGLAPTASTTATLAMGDALAVALLIERGFRPEDFALFHPGGSLGKKLLLTVGDLMHSGDAVPLVGSATPIRDALFVITAKGLGITGVCAEDGALVGVVTDGDLRRSLGKGVDILNQPAGEIMTRNPKRINRSELAAKALQVMESHSITSLFVFDDTADNRPVGVIHLHDLLRAGLA

SEQ ID NO: 35648 - protein, 166 aa, Zexmenia serrata
MFPMVTEFMNYGQQTIRAARYIGQGFMITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSIIDDYTIRTILNLPEIKT

SEQ ID NO: 35649 - protein, 225 aa, Triticum aestivum
MDSEHWISRLAAAKRFYAAQLGHSDRAGMEELDMDEEVRPEFACPYCYEDHDVGSLCAHLEEEHPFEPQAAACPVCSEMVTKDMVNHITMQHGYLFKNRRRLRRFIIPGSQALSLRTRDLREAHLQVLLGGGHRSSNNNSTTNISADPLLSSFGLSFPTSDAEQTSKSTLSIPDDATMIKETPAQARKLSIDSSLTSEEREQKRKQASARATFVQDLLLSTLFGD

SEQ ID NO: 35650 - protein, 391 aa, Lachnostylis bilocularis
DLEPVNPADVPVTTAGALKSYKLAAKAISRLQSLPSGNISLLCDVLVKEISDLTGYDRVMVYRFHDDEHGEVIAECRRPDLEPYLGLHYPAIDIPQASRFLFMKNKVRMICDCLAPPVKVIQDKRLSQQLSLGGSTLRSPHGCHAQYMANMGSIASLVMSVTINEDDDEMDSDRERGIRLWGLVVCHHTSPRFVPYPLRYACEFLIQVFGVQVSKEVQLAAQMREKHILQTQTVLCDMLLRDAPVAIITQSPNVMDLVKCDGAALYYRKKFWLLGVTPTEAQIKDIAEWLLECHGGSTGLSTDSLMEAGYPGAAVLDDAVCGMAAVRITSKDFLFWFRSHTAKEIKWGGAKHDPEDKDDGRKMHPVSSFKAFLDVVKQRSLPWEDIEMDAI

SEQ ID NO: 35651 - protein, 391 aa, Leonia glycycarpa
DLEPVNPIDVPVTAAGALKSYKLAAKAISRLQSLPSGNISLLCDVLVKEVSELTGYDRVMVYRFHEDEHGEVIAESCKPGLEPYLGLHYPATDIPQASRFLFMKNKIRMICDCLAPPVKVVQDKRLDQPLSLCGSALRSPHGCHSQYMTNMGSIASLVMSVTINEDDDEMDSDQQKGRKLWGLVVCHHTSLRFVPFPLRYACEFLIQVFGVQINKEVKLAAQMKEKHILQTQTVLCDMLLRDAPVAIITQSPNVMDLVKCDGAALYYGKKFWLLGVTPTEAQIRDIAEWLLEYHSGSTGLSTDSLMEAGYPNASILGDPVCGMAAVRITSKDFLFWFRSHTAKEVKWGGAKHDPDDKDDGRKMHPRSSFKAFLEVVKQRSLPWEDVEMDAI

SEQ ID NO: 35652 - protein, 377 aa, Yersinia pestis CO92
MIKTRAAVAWGPNQPLSVEEVDLMPPQKGEVLVRIVASGVCHTDAYTLSGADPEGVFPTILGHEGGGIVEAIGEGVTSVAVVDHVIPLYTPECGECKYCRSGKTNLCQAIRSTQGKGLMPDGTTRFSKNGQPIFHYMGTSTFSELTVVPEISLAKINKEAPLEEVCLLGCGVTTGMGAVMNTAKVKPGDTVAIFGLGGIGLSAVIGAQMAGASRIIGIDLNTSKFELARKLGATDLINPKDYDKPIQEVIVELTDGGVDFSFECIGNVNVMRSALECCHKGWGESVIIGVAGAGEEISTRPFQLVTGRVWRGSAFGGVKGRSELPGIVQQYLDGKFALNDFITHTMALDQINEAFDLMHEGKSIRSVIHFNHSSESK

SEQ ID NO: 35653 - protein, 391 aa, Maytenus arbutifolia
DLEPVNPADVPITAAGALKSYKLAAKAISRLQSLPSGNMSLLCDVLVKEVSELTGYDRVMVYRFHDDDHGEVVGECCRPDLEPYLGLHYPATDIPQASRFLFMKNKVRMICDCLAPPVKVLQDKRLAQPLSLGGSTLRSPHGCHAQYMSNMGSIASLVMSVTINEDDDETTSDQQKGRKLWGLVVCHHSTPRFVPFPLRYACEFLIQVFGVQINKEVELATQLKEKHILRTQTVLCDMLLRDAPVGILTQSPNVMDLVKCDGAALYYRNKFWLLGVTPTETQITDIAEWLLEYHSESTGLSTDSLMEAGYPDASILGEAVCGMAAIKITSKDFLFWFRSHTAKEMKWGGAKHNPDDKDDGKRMHPRSSFKAFLVVVKRRSLPWEDIEMDAI

SEQ ID NO: 35654 - protein, 392 aa, Maytenus senegalensis
DLEPVNPADVPITAAGALKSYKLAAKAISRLQSLPSGNMSLLCDVLVKEVSELTGYDRVMVYRFHDDDHGEVVAECCCRPDLEPYLGLHYPATDIPQASRFLFMKNKVRMICDCLAPPVKVLQDKRLAQPLSLGGSTLRSPHGCHAQYMTNMGSIASLVMSVTINEDEDETNSDQQKGRKLWGLVVCHHSTPRFVPFPLRYACEFLIQVFGVQINKEVELATQLKEKHILRTQTVLCDMLLRDAPVGILTQSPNVMDLVKCDGAALYYRNKFWLLGVTPTETQVKDIAEWLLEYHSESTGLSTDSLMEAGYLDASILGEAVCGMAAIKITSKDFLFWFRSHTAKEMKWGGAKHDPDDKDDGKRMHPRSSFKAFLVVVKRRSLPWEDVEMDAI

SEQ ID NO: 35655 - protein, 144 aa, Corynebacterium diphtheriae NCTC 13129
MRWLHYPTMTERTLILIKPDGVERGLIGEIIARIERKGLKISALDLRVADRETAEKHYAEHADKPFFGELVNFITSAPLIAGVVEGPRAIEAWRQLAGGTDPVAKATPGTIRGDFALEVSTNVVHGSDSPESAEREISIWFPNL

SEQ ID NO: 35656 - protein, 442 aa, Leptospira interrogans serovar Copenhageni str. Fiocruz L1-130
MYFESKPKIFVIMAGFFDSLKIGFGGASRILNSSFVFSTKTILLLKDLALGDDTFPIRLREAFEELGATYIKLGQLIASAPSLFPDKFVTEMQKCLDQVRPIPYSMITTIIQKELGGTLSDHFLSVEPIPIASASIAQVHSAVTKDGLDVVIKVQRPDIESTLSADLNLIYFVSVLFEKFAPGLSKSGIADMVEQFQTSILEEIDFYKEADNIEEFEKELLSMGETRARVPKVYRELSTKKILTLERFYGAPITDESSVRRYSSDPQKTLTGALEIWFSTLSRSGFFHADVHAGNLMILRDGTVGFIDFGIVGRISPRVWEGLMIFLEGLSLNRTEKIAKGLIQMDSTAKGVDEKKLSKDLEIVFSKMTEMVLKVQMGDLESLDDKKLNAILFEFREISIQNGLKIPKEFGLLIKQILYFDKYVKTMAPDIDLIRDRDKFLI

SEQ ID NO: 35657 - protein, 315 aa, Campylobacter jejuni RM1221
MNTLEIAKEVFEKEAQAILDLAKNLDENFNQAVNLMLNTKGRCIVSGMGKSGHIGAKIAATLASTGTPSFFIHPGEALHGDLGMLTPEDVLIAISNSGETEEILKIIPAIKKRKIPLIVMCGKKNSTLVKQSDIFLNIAVEKEACPLQLAPMSSTTATLVMGDALAAALMKVRNFKPDDFALFHPGGSLGRKLLTKVKDLMVSSNLPIVHPDTEFNDLVDVMTSGKLGLCVVLENEKLVGIITDGDLRRALKTSDKPRFDFRAKEIMSTNPKVVDADAMASEAEEIMLKHKIKEIVVSKENKIIGIIQLYAIGNV

SEQ ID NO: 35658 - protein, 391 aa, Mesua sp. Coode 7884
DLEPVNPADVPVTAAGALKSYKLAAKAISKLQSLPSGNISLLCDVLVKEVCELTGYDRVMVYKFHEDDHGEVVAECRRPDLEPYLGLHYPATDIPQASRFLFMKDKVRMICDCLAPPAKVIQDNGLTQALSLCGSTLRAPHGCHAQYMENMGSIASLVMSVTINDDDDEMASDRQKGRKLWGLVVCHHTGPRFVPFPLRYACEFLIQVFGIQITKEAELAAQIREKHILETQTVLCDMLLRDSPMAIVIQSPNVMDLVKCDGAALYFKEKFWLLGITPTEAQIRDISEWLLDYHNGSTGLSTDSLMEAGYPGASILGDAVCGMAAIRVNSKDFLFWFRSHTAKEIKWGGAKHDPGDKDEGRKMHPRSSFKAFLEVVKWRSLPWEDMEMDAI

SEQ ID NO: 35659 - protein, 244 aa, Helianthus debilis
ANYGGDKQYGRETRQTGDYENPIHSTGGQYEQDVRQTDEYGNPVRRTDEYGNPVHSTTGGTMGDYGSTGLGRGTGGIGTGGYGTTGHQGLGTGVGHTTGGTGTDYTSGGRSTGQTGYQGLGTESEFGGTTGTFQNQPSATPIGGTGLGGGTGAGFGGTGTGTGTGILHRSGSSSSSSSEDDGQGGRRKKKGVMQKIKEKLPGGHSQEGQYRSQTTTTAGGAGYGETHEKKGMMEKIKEKLPGHH

SEQ ID NO: 35660 - protein, 358 aa, Oryza sativa (indica cultivar-group)
MHLARVLVRSFSHAGCRRAVLGGLIASSTRIEELEKIVMGWNALILLRVVAVTALFNIRNRAMLPSPYLFFLDKWTYSCIILHYLSNDVVMLSLFVFMHINRLEITPDKRFLAAAGNPHIRLFDINSNSNHPVISYDSHTSNVMAVGFHCDGNWMYSGSEDGTVRIWDLRTATCQREYESRAAVNTVVLHPNQKELISGDQNGNIRVWDLAANSCSCELVPEVDTAVRSLTVMWDGSMVVAANNRGTCYVWRLLKGTQTITCFEPLHKLQAHDGYILKCLLSPEFCDPNRYLATASSDHTVKIWNVDGFKLEKTLVASSDTTARLWTMSTGEAIRVYTSHHKPVVCCALHDGAESAPS

SEQ ID NO: 35661 - protein, 466 aa, Rhodospirillum rubrum ATCC 11170
MTETSFDVVVLGAGPGGYVAAIRAAQLGLKTAVVEREHLGGICLNWGCIPTKALLRSAEVFRQIRHAGAYGLKVTGAEVDVAAVVKRSRGVAKQLAGGVGHLLKKNKVTVIDGHGRLAGAGKLTVEKDGKTTTLAAKAIILATGGRARTLPGLEADGKLVWTYKNAMIPESLPKRLLVVGSGAIGIEFASFYTDCGSQVTVVEVLERVLPVEDEEISAFAKKSFEKQGMTIKTATTVKALKKSGDEVTATLEKDGKTEEITVDRVIMAVGIAANIEDIGLETVPSIKVERGHVVTDAFCRTGDPGIFAIGDLTAPPWLAHKASHEGVLVAEVIAGKKDLHPLDTMKIPGCTYCHPQVASIGLSEAKAKAKGFTVKVGRFPFVGNGKAIALGEAEGLIKTVFDARTGELLGAHMIGAEVTELIQGFAIAKTLETTEEDLIHTVFAHPTLSEMVHESVLDAYGRAIHF

SEQ ID NO: 35662 - protein, 246 aa, Helianthus debilis
ANYGGDKQYGRETRQTGDYENPIHSTGGQYEQDVRQTDEYGNPVRRTDEYGNPVHSTTGGTMGDYGSTGLGRGTGGIGTGGYGTTGHQGLGTGVGHTTGGTGTDYTSGGRSTGQTGYQGLGTESEFGGTTGTFQNQPSATPIGGTGLGGGTGAGFGGTGTGTGTGILHRSGSSSSSSSEDDGQGGRRKKKGVMQKIKEKLPGGHSQEGQYQSQTTTTTTAGGAGYGETHEKKGMMEKIKEKLPGHH

SEQ ID NO: 35663 - protein, 125 aa, Listeria monocytogenes EGD-e
MAKEIIQTSSAPKALGPYSQAVKVNGLIFTSGQLGINPATGELVVGATKQAEQAFKNLAAVLEEAGSGLDKIIKATVFFKDLNEFKAVNEVYATFFSSDFPARSAFQVAKLPLDAEIEIEVIAEA

SEQ ID NO: 35664 - protein, 440 aa, Rhodospirillum rubrum ATCC 11170
MPIEILMPALSPTMEEGTLAKWLKKEGDPIAAGDVIAEIETDKATMEFEATDEGVLGKILVADGTAGIKVNQPIGILLEEGEDASALVQAAPAKAPDAPAKAAPEPAPVAAASQSDAAPAPAAAAPKRAAGERLFASPLARRIAAAEGLDLGALQGSGPHGRIVRRDVEAALAAGTGKTAEKAVAAPVAPAAPPQAVAAAAPKPVALPDAPHTKVANTSMRKIIARRLTESKQTVPHFYLTVDCKIDALLDLRKSLNARAEKRGDGVKLSVNDLIIKAVALALRKVPAANASWSDEAIVLWSDVDISVAVATPGGLITPIVRKADQKGLATISAEMKDLATRARDGKLKPEEFQGGGFSISNLGMYGIREFAAIINPPQGCILAVGAGEQRPVVEAGALAIATVMSCTLSVDHRVVDGAVGAEFLSAFKILIEDPMAMML

SEQ ID NO: 35665 - protein, 468 aa, Rhodospirillum rubrum ATCC 11170
MPVQILMPALSPTMTEGTLAKWLKKEGDTIAAGDVIAEIETDKATMEFEAVDEGVLGQILIEAGTQNVPVNAPIGILLEEGETIDDVHKPSASAPAPAKDVSLETTPAPAEPRRDPVPADTPLAAGGRAEAGRQEEKRYDKFVTLSVREALRDAMAEEMRRDDKVFLLGEEVAQYQGAYKISQGLLDEFGEKRVIDTPITEMGFAGLATGAAFSGLRPIVEFMTFNFSMQAIDQIINSAAKTLYMSGGQMGCPIVFRGPNGAAARVGAQHSQCYASWYAHCPGLKVIAPWSAADAKGLLKAAIRDPNPVVFLENEILYGQTFEVPDDADFVLPIGKAKVERAGADVTLVAFSRMVGVALEAAKALAGEGIEAEVINLRTIRPLDVETILSSVRKTNRCVTLEEGWPFAGIGAEIGMTIMENAFDYLDAPVIRITGEDVPMPYAANLEKLALPSIEAVVKAAKAACYKS

SEQ ID NO: 35666 - protein, 500 aa, Oryza sativa (indica cultivar-group)
MATRRWRAPSHLRDGRSGGKGGGGDGVGDERGGEEWLRGAGAAATAAGDLHAPVPAAHVGSLERRLTARSEILRTKCHFLDVRTSRRLKALRCREVSIDGSMLGLSQFDSLTKSKAGTTGSADTARIAEGLKSLCASMDLTVFFTFMVARRKEVDALRAELPDTLKHCVDPARFTMVDKQAHFPPPRLLLLYLTSSLPPTQTLAIRIRESGSHRGGGGGGEEGAMAGKEEGRIFVGGLSFHTDERKLADAFRRFGKVVDAQWFGSFCGSFVNQVILIMLERHTQRHRGFGFVTFSDPEAVDSAIKEMHCQELDGRTISVNKAEPKMNTDDTRYESGGGRGEYRGGRGDGPPPGNCFECGRAGHWARDCPNPGGGRSARYSSSKFSAGGRGDRFSGSDRFGDRYMDDRYDGGYREPVDVRDRYGGGRDRYANDRYPSGGDRYVPDRYGGPDRYQPSSYGRERERSYERDGVRGNGGYDRSGPRGGGSYDRGWPKGWYKWWL

SEQ ID NO: 35667 - protein, 242 aa, Helianthus debilis
ANYGGDKQYGRETRQTGDYDNPIHSTGGQYEHDVHQTDEYGNPVRRTDEYGNPVHSTTGGTMGDYGSTGLGRGTGGIGTGGYGTTGHQGLGTGIGHTTGGTGTDYTSGGRSTGQTGYQGLGTESEFGGIQNQPSATPIGGTGLGGGTGAGFGGTGTGTGTGILHRSGSSSSSSSEDDGQGGRGKKKGVMQKIKEKLPGGHSQEGQYQSQTTTTTTAGGAGYCETHEKKGMMEKIKEKLPGHH

SEQ ID NO: 35668 - protein, 266 aa, Ashbya gossypii ATCC 10895
MNKSGNGRPSRTVYLGSIPYDQTEQQILDLCSNVGPVTGLKMMFDPQTGKSKGYAFIEFKDLATSSSAVRNLNGYALGNRTLKCGYTTGGGISEEYSLSNRGELSQVGGMGPQEELAYPNLPEGADVNINMTTPAMVISSELSKLSKPEQFNLLEKLQEMSRNDREAFVALLKQCPQISFVVAELLLTNGISQIDDLTQLAVDQTNGSAASKDSTPQVGEDDMQKLELLKQVLQLTDAEIATLPEDERMSLWDLKQRAMKGEFGPI

SEQ ID NO: 35669 - protein, 240 aa, Helianthus hirsutus
ANYGGDKQYGRETRHTGDYENPIHSTGGQYDQDVRQTDEYGNPVRRTDEYGNPVHTATGGTMGDYGSTGLGQGTGGIGTGGYGATGHQGLGTGVGHTTGTGTDYTSGGRSTGQTGYQGLGTESEFGGTTGTFQNQPSATPIGGTGLSSGTGAGLGGTGTGTGTGILHRSGSGSSSSSEDDGQGGRRKKKGVMQKIKEKLPGGHSQEEQYQSQTTTTTGYGETHEKKGMMEKIKEKLPGHH

SEQ ID NO: 35670 - protein, 406 aa, Bradyrhizobium sp. BTAi1
MEDFYRIRRLPPYVFEQVNRAKAAARNAGADIIDLGMGNPDLPAPPHVLEKLKETLGKPRTDRYSASRGIVGLRRAQAAYYDRRFGVKLNPDTQIVATLGSKEGFANVAQAITAPGDVILCPNPSYPIHAFGFLMAGGVIRSVPSEPTPQFFEAAERAIIHSIPKPLALIVCYPSNPTAYVASLDFYRDLVAFAKKHEILILSDLAYAEVYFDDKNPPPSVLQVPGAMDVAVEFTSMSKTYSMAGWRIGFAVGNERIIAALARVKSYLDYGAFTPVQVAATAALNGPDDCIREMRETYRKRRDTLVEAFGRAGWEIPSPEASMFAWAPLPEAFKGLGSMQFATLMVEKSGVAVSPGVGFGEHGEGYVRIALVENEQRIRQAARGVRRFLESGIETLHNVVPIANRR

SEQ ID NO: 35671 - protein, 814 aa, Glycine max
  misc_feature (329)..(329): Xaa can be any naturally occurring amino acid
  misc_feature (383)..(383): Xaa can be any naturally occurring amino acid
  misc_feature (393)..(393): Xaa can be any naturally occurring amino acid
GKVSHLDLIQNVHKVHQLESFISSNLNQTLVVCSNGRGFYASGEFGESTKINHKMENVEREEEIDPESNPLNEPLLKRNRTLSSNPLALVGEKVSYIESLDYEINENDLFKHDWRSRSRVQVLQYIFLKWLLAFLVGLLTGIIATLINLAVENIAGYKLLAVLKYIHKERYLTGFLYFTGINFVLTFVAAILCVCFAPTAAGPGIPEIKAYLNGVDTPNMFGATTLIVKIIGSIGAVSAGLDLGKEGPLVHIGSCIASLLGQGGPDNYRTKWHWLRYFNNDRDRRDLITCGSSSGVCAAFRAPVGGVLFALEEVATWWRSALLWRTFFXSTAVVVVVLRAFIEICHTGKCGLFGEGGLIMFDVSNVTVRYHVMDIVLVVVIGXIGGVLGSLSXHVLTRSQLLLLSLSVAIFTSACQYGLPFLAKCTPCDPSLSDVCPTNGRSGNFKQFNCPKGYYNDLATLLLTTNDDAVRNIFSTNTPLEYQPLSLVIFFALYCILGLITFGIAVPSGLFLPIILMGSGYGRLLGIYMGPHTNIDQGLFAVLGAASLMAGSMRMTVSLCVIFLELTNNLLLLPITMIVLLIAKTVGDSFNPSIYEIILHLKGLPFMDANPEPWMRNLTVGELVDVKPSVVTLHGVEKVAKIVDVLKNTTHNAFPVMDDGVVPPVVGQANGGTELHGLILRAHLIQALKKKWFLKERRRTEEWEVREKFTWVELAEREGSIEEVAVTSEEMEMFVDLHPLTNTTPFTVLESMSVAKAMILFRQVGLRHLLVVPKYQASGISPVIGILTRQDLLAHNILTVFPHLAISKGREKRN

SEQ ID NO: 35672 - protein, 241 aa, Helianthus mollis
ANYGGDKQYGRETRHTGDYENPIHSTGGQYEQDVRQTDEYGNPVRRTDEYGNPVHSATGGTMGDYGSTGLGQGTGGIGTGGYGTTGHQGLGTGVGHTTGGTGTDYTSGGHSTGQTGYQGLGTESGFGGTTGTFQNQPSATPMGGTGLGSGTGAGFGGTGTGTGTGILHRSGSGSSSSSEDDRQGGRRKKKGVMQKIKEKLPGGHSQEEQYQSQTTTTTGYGETHEKKGMMEKIKEKLPGHH

SEQ ID NO: 35673 - protein, 615 aa, Coprinopsis cinerea okayama7#130
MLFRILDICILCRPVKLLVGTDEHGLKIQQAAAKASTEVLTFCNELSQVFKDLSKKANISYTTFSRTTGDNHKELVAQVWRTLLDKGYIYKGEYEGWYSITDECFYTSAQIVQSPTSTAENPEYVSKETGSKVEWSKEYNYMFRLSMFRDALVKHYSDRSVVQPSQYNSVVLQMLGATEDSSGVELADISISRPRSRLTWGIPVPNDPEHTVYVWFDALLIYLSGVGYQVSGPPAVTGWPPNLQVIGKDILRFHALYLPAILMALGAPSHAALKDLSATQILEKSVGLPKTLLTHAHWTVSQQKMSKSVGNVVDPMQSVDKYGLDIVRFYLARVGGRFRDDVDWSFEQLEKHSKELQSLLGNYLLRITSARITAAAAAGYEQQSEASPHALNLELAREVDALPRRVQELMNNLEVADALSSILDVLKLANKVITDIAPWSKTCSPALVYETRRTALDTLRVTGICLQPFVPETSERLLDALGLAPEDRTWRINVTVQRDDPGLVYIPKGEWREEWPGVRTSQSAGANVTMNFTGVAVYYQAWLWTAPTYLTARVDGGAPVMLDLTDHARLGGEDAVPVPTTEVVVLVASGMLDAQHTLVVSREADHRETIVGSFM

SEQ ID NO: 35674 - protein, 332 aa, Ralstonia solanacearum GMI1000
MTIKIGINGFGRIGRMVFRAAIANFKDIEVVAINDLLEPDYLAYMLKYDSVHGRFDGEVSVDGNTLVVNGKKIRLTAVKDPAELKWGEVGADVVVESTGIFLTKEGAQKHIDAGAKKVIMSAPSKDDTPMFVYGVNHGTYKGEAIISNASCTTNCLAPVAKVLNDKWGIKRGLMTTVHAATATQKTVDGPSNKDWRGGRGILENIIPSSTGAAKAVGVVIPQLNKKLTGMSFRVPTSDVSVVDLTVELEKAASYDEICAEMKAQSQGALKGVLGYTEDKVVATDFRGDARTSIFDAEAGIALDGTFIKVVSWYDNEWGYSNKVLEMARVVAK

SEQ ID NO: 35675 - protein, 675 aa, Ralstonia solanacearum GMI1000
MSAPALHSITSLPTQQMANAIRVLAMDAVQQANSGHPGMPMGMADIAVALWSRHLRHNPANPHWPDRDRFVLSNGHGSMLLYALLHLTGYDLPMSELKNFRQLHSKTAGHPEYGITPGVETTTGPLGQGLTNAVGMALAERLLGQEFNRPGFDIVNHHTYVFLGDGCLMEGISHEACSLAGTLGLNKLIALWDDNGISIDGDVVHWFNDDTPKRFEAYGWNVIRAVDGHNVAAVEAAIAQAKTSDKPTLICCRTVIGKGAPTKAGGHDVHGAPLGGAEIAAAREALAWPHAPFDVPQAVYDAWDARGQGQALEKAWNALFDAYAERYPAEAGQFQRRMRGQLPEAFEQAAAEFIEKCELKAETIATRKASQNTLEAYGPVLPELLGGSADLTGSNLTNWSGSKAVRVDAWGNHVNYGVREFGMSAIMNGIALHGGYIPYGGTFLTFSDYSRNALRMAALMKLRSLFVFTHDSIGLGEDGPTHQSIEHVASLRLIPNMDVWRTADTTETAVAWAAAIARQNGPSCLIFSRQNLPFQARNPATREAIARGGYVLRDATEGKRPDVVIIATGSEVGLAVGAAEHLAAEGIQARVVSVPSTTVFDKQDAAYKASVLPAGVPRIAVEAGVTDFWWKYQVQAVVGIDTFGESAPAGVLFKHFGFTVENVVNTAKSVIAPAV

SEQ ID NO: 35676 - protein, 509 aa, Candida albicans SC5314
MDQQEAPIYYGRSVNKVYNQEFIIDSRFKIVKELGHGAYGIVCSAKYDNGSKKVPDSNNGNASSSANASFVAIKKITNIFSKNILCKRALRELKLLQFFRGHKNITCLYDLDIIPNPMTGEFNEIYLYEELMECDMHQIIRSGQPLSDQHYQSFIYQVLCGLNFIHSADVLHRDLKPGNLLVNADCELKICDFGLARGFSENPDENAGFMTEYVATRWYRAPEIMLSFTNYTKAIDIWSVGCILAELLGGKPLFRGKDYVDQLNQILMILGTPPESTLQRIGSHRAQNYVRSLPITRKASYEELFPDANPLALDLLERMLTLDPRERITVRDALNHKYLELWHDPKEEIECQVKFDFKSFETVDGLDEMKQLIMDEVQKFREFVRKPIEEQQRIQMQLHMQKREEQRQEEEEKELLEQQRQFPAQESMDISQTPYNNLETNIGTPQVEDDYPRPQELDEFTFSNLESSSSMNLFQDMAKPSGEEYIKLEEELGFGLDGAMFNNYCNDHQ

SEQ ID NO: 35677 - protein, 391 aa, Micrantheum hexandrum
DLEPVNPADVPVTAAGALKSYKLAAKAISRLQSLPSGNISLLCDVLVKEVSELTGYDRVMVYRFHEDEHGEVIAECCQPDLEPYLGLHYPATDIPQASRFLFMKNKVRMICDCMALPVKVLQDERLSQPLSLSGSTLRSPHGCHAQYMANMGSVASLVMSVTINDDDDGLDSDQQAGRKLWGLVVCHHTCPRFVPFPLRYACEFLIQVFGVQINKEVELAVQMREKHILQIQTVLCDMLLRDAPVAIITQSPNVMDLVKCDGAALYYRKKIWLLRVTPTEAQIRDIAEWLLESHSGSTGLSTDSLMEAGYPGASVLGDAVCGMAAVRITSKDFLFWFRSHAAKEIKWGGAKHDPDDKDDGRKMHPRSSFKAFLEVVKRRSLPWEDIEMDAI

SEQ ID NO: 35678 - protein, 565 aa, Yersinia pestis CO92
MELEYESKRPLYIPYAGPILLEFPLLNKGSAFTNDERNHFNLHGLLPEAVETIEEQAERAYRQYQDFKNDDDKHIYLRNIQDTNETLFYRLLEAHLSEMMPIIYTPTVGEACEHFSDIYRRARGLFISYPNREHIDDMLQNATKQNVKVIVVTDGERILGLGDQGIGGMGIPIGKLSLYTACGGISPAYTLPVVLDVGTNNPQRLNDPLYMGWRHPRISGDEYYAFVDEFIQAVKRRWPNVLLQFEDFAQKNATPLLNRYRDELCCFNDDIQGTAAVTLGSLIAASHAAGSQLRDQTVTFLGAGSAGCGIAEQIIAQMMSEGLSEIQARARIFMVDRFGLLTDKLPNLLDFQSKLVQKSDDLHHWNLHNDAISLLDVVRNAKPTVLIGVSGQPGLFTEELIREMHSHCARPIVMPLSNPTSRVEARPEDIINWTDGAALVATGSPFPPVSYKEKLYPIAQCNNSYIFPGIGLGVLASGASRVTDGMLMAASRALAESSPLARHGEGALLPNIDDIQAVSKAIAMRVGQAAQLQGVAIVTSEEALSKAIEHNYWQPQYRSYKRTSF

SEQ ID NO: 35679 - protein, 241 aa, Burkholderia mallei ATCC 23344
MSPSSPSFAAPLSDAPRLDACEAVLFDLDGTLADTAPDLAAAVNKMQRSRGIAQTPLDALRPLASAGARGLIGGAFGIAPADAEFDALRDEFLANYATDLCVHTTLFPGIGVLLDDLDARGVRWGIVTNKAARFTDPLVALLGLAARAACVVSGDTASHPKPHPAPLLYAADRLSLAPERIVYVGDDLRDIQAGSAAGMPTVAAAYGYCGDGAAPADWRAQHLVETTDDLQRLLRVLRYNA

SEQ ID NO: 35680 - protein, 391 aa, Microdesmis puberula
DLEPVNPADVPVTAAGALKSYKLAAKAISRLQSLPSRNISLLCDVLVKEVSDLTGYDRVMVYRFHEDEHGEVVAECCRTELEPYLGLHYPATDIPQASRFLFMKNKVRMICDCQAPPVKVLQDRRLAQPLSLCGSTLRSPHGCHAQYMANMGSVASLVMSVTINEDDDEMHSDQQKGRKLWGLVVCHHTSPRFVPFPLRYACEFLIQVFGVQINKEVELAAQMREKHILRIQTLLCDMLLRDSPVAIITQSPNVMDLVKCDGAALYYNNKFWLLGVTPTEAQIRDISEWLLEYHSGSTGLSTDSLMEAGYHRASILGDAVCGVAAVRITSNDFLFWFRSHTAKEMKWGGAKHDPVDKDDGKKMHPRSSFKAFLEVVKWRSLPWEDVEMDAI

SEQ ID NO: 35681 - protein, 321 aa, Aspergillus oryzae
MCIAFFSTAHPQYRLIICNNRDEFLHRPTSRADWWPSPHSHVLSARDLVRPIHPTWLGITKQGRIAVLTNYHEDTCAKAVGKYSRGEVVNSWLALSPDSAQTTQEFVNQWTTNGELANIGGFNLVCGNVMEPLAILASRASETEPILWIADKPGQTVGLSNTDYDDRSWPKVEKGEDAIVDAIAGHVQNQESEDNLIERLLGVLSVDTLPRLSNDAGVQEYIPHLPQSVFIPPIGRDKQARDEAESANQDKREQSPVLPSTPEGTPNRAYLEGLYATQKQTVILVGFDGRVRYFERTLYDDDAQPVSTEARDRSFEFRIEK

SEQ ID NO: 35682 - protein, 391 aa, Neoscortechinia kingii
DLEPVNPADVPVTAAGALKSYKLAAKAISRLHSLPSGNISLLCDVLVKEVSDLTGYDRVMVYKFHEDEHGEVVAEFRRPDLEPYLGLHYPATDIPQASRFLFMKNKVRMICDCLAPPVKVIQDKSLAEPLSLWGSTLRSPHGCHAQYMANMGSIASLVMSVTINEDDDRMDSDQQKGRKLWGLVVCHHTCPRFVSFPLRYACEFLIQVFGIQINKEVQLAAQMREKHILQIQTMLCDMLLRDAPVAIITQSPNVMDLVKCDGAALYYKKKFWLLGVTPTEAQIRDIVEWLLDVHSESTGLSTDSLMEAGYLGASILGDAVCGMAAIRISSKDFLFWFRSHTAKEIMWGGAKHDPDDKDHVRKMHPGSSFKAFLEVVKWRSLPWEDMEMDAI

SEQ ID NO: 35683 - protein, 131 aa, Triticum aestivum
IRHEKIRAAKEKEKELKERLKNEMDKSMFLRKGEEIKSLISQIKELNEDKEAAVDDEKLGDLLRTKPVRKDKGAPGWKFDGYYKKTSIMRQEFDTAGNNDKWFVFTEEEEKVIGDHLAPRSQLQCKSHTQA

SEQ ID NO: 35684 - protein, 392 aa, Ochna multiflora
DLEPVNPADVPVTAAGALKSYKLAAKAISRLQSLPSGKISMLCDVLVKEVHDLTGYDRVMVYKFHEDEHGEVVAECHRPDLEPYIGLHYPATDIPQASRFLFMKNKVRMICDCMESPVKVIQDKKLAQPLSLSGSILRAPHGCHSQYMANMGSIASLVMSIMINDDDDNEMESNHQKPRKLWGLVVCHHTSPKVCPFPLRYACEFLIQVFGVQINKEVEVPAQVKEKHILRTQNVLCDMLLRDTPVAIVTQSPNVMDLVKCDGAALFYKNKFWLLGITPTADQIRDIASWLNEYHNGSTGLSTDSLMEAGYHGASILGGAVCGMAAIRISSKDFLFWFRSQTAKEIKWGGAKHDPNEKDDGRKMHPRSSFNAFLEVVKWCSLPWEDMEMDAI

SEQ ID NO: 35685 - protein, 455 aa, Chlamydophila caviae GPIC
MNIWTRFFQPPKHIKELDDPELVKKQYKYWRIRIFYSMFIGYVFYYFTRKSFTFAMPTLMTDLGFDKAQLGIIGSTLYISYGISKFVSGVISDQSNPRYFMALGLIITGLTNIFFGMSSSILLFALWWGLNGWFQGWGWPPCARLLTHWYSKSERGTWWSVWSTSHNIGGALIPILTGFAIDCCGWRGAMFIPGALCIMMGFVLINRLRDTPQSLGLPAIEKYRKAQKAKKHEKTTADILEEEAEKELSTREILFTYVLKNKWIWLLSFASFFIYVVRMAVNDWSALFLIETKRYVAVKANFCVSLFEIGGLFGMLIAGWLSDKISKGKRGPMNVVFSLGLLFAILGMWYGRDQDMWWLDGTLLFVIGFFLFGPQMMIGLAAAELSHKKAAGTASGFAGWFAYFGAAFAGYPLGKIAQDWGWKGFFIALLSCALIALVLFLPTWNASERSLQTKK

SEQ ID NO: 35686 - protein, 174 aa, Zea mays
MDAFDAIPNHVVIDILNKVADVKTLIRCRSVSKRFNSLAAQSDSLLLQLDQFLGAAEPEPEVNSPVASFFRSIFKSILPIFSRSAKPAETPKSPAQILAGFNRIRNLDVELYGGDANLEKGAAVKWKAEFGETLKSSVIVAFRSATVNASATESPVNAVETDSEFVCGLKTRVV

SEQ ID NO: 35687 - protein, 226 aa, Debaryomyces hansenii CBS767
MFKQMIQVSKRAGVKPQQIRYLSGTSVFNKPAVAADYLTTGGSTQSVWPKGFRLPKPKSWEESGESALSKATKFFFLNEIARGMYVCLEMYFRAPYTIYYPFEKGPISPRFRGEHALRRYPSGEERCIACKLCEAICPAQAITIEAEERMDGSRRTVKYDIDMTKCIYCGYCQDSCPVDAIVESPNVEYSTETREELLYNKEKLLENGDKWEQELQYCIDADAPYR

SEQ ID NO: 35688 - protein, 392 aa, Ochna sp. Davis 31-01
DLEPVNPADVPVTASGALKSYKLAAKAISRLQSLSSGNISMLCDVLVKEVHDLTGYDRVMVYKFHEDEHGEVVAEYHRPGLEPYIGLHYPATDIPQASRFLFMKNKVRMICNCMEPAVKVIQDKKLAQPLSLAGSTLRAPHGCHSQYMANMGSVASLVMSVMINDDDDNEMESNHQKPRKLWGLVVCHHTSPRFVPFPLRYACEFLIQVFGVQINKEVELTAQLKEKHILRTQSVLCDMLLRDTPVAIVTQSPNVMDLVKCDGAALFYKNKFWLLGITPTEDQIRHIASWLNEYHNGSTGLSTDSLMEAGYHGASILGGAVCGMAAIRISSKDFLFWFRSQTAKEIKWGGAKHDPSEKDDGGKMHPRSSFNAFLEVVKWCSLPWEDMEMDAI

SEQ ID NO: 35689 - protein, 425 aa, Rhodospirillum rubrum ATCC 11170
MAEIIDIHAREILDSRGNPTVEVDVLLDSGAFGRAAVPSGASTGAHEAVELRDGDKTRYAGKGVLKAVEAVNGELFSALSGLDATDQLLIDQAMIDLDGTPNKARLGANAILGVSLACAKAAAEEAELPLYRYIGGARSHILPVPMMNIINGGQHADNPIDVQEFMIMPVSAPTVADAVRMGAEVFHALKKKLKDAGHNTNVGDEGGFAPNLASADEALAFIVKAIEAAGYKAGEDIVLALDAASSEFYKDGKYVLAGEGKTLDAEGMVKYYAELCKRYPILSIEDGCAEDDWAGWSLLTAELGAKVQLVGDDLFVTNPLRLAEGIRKGVANSILVKVNQIGTLSETLEAVEMAHKAGYTSVLSHRSGETEDSTIADIAVATNCGQIKTGSLSRSDRLAKYNQLIRIEEELGPVAVYAGASILRG

SEQ ID NO: 35690 - protein, 758 aa, Desulfitobacterium hafniense DCB-2
MEFSRRNFLKTCAISAAMMTVGCTSQTKTIQVDPPEPAPSAPKQIDVDQWVKSVCRYCGTGCGVLIGVKDGKVAAVKGDPDNEGNKGLLCAKGYYLPQVITHSERVTKPLIRKNGKLEPCTWDEAMELVTAKFKESIANNGPDSVAFYGSGQQLAEEGYVANKLFKGAIGTNNIDGNPRLCMASAVGGFTTTFGADEPMGCLEDFEHANVFFIIGSNIAEAHPVLFGRLTDKKKKDPDTKIIIADPRRHRSHEIADISLQFVPGTDMALLHAMAYVIIEEGMADEEFIAKHTSFSNGKEAITFAAYKEFLKEFTPEKAEKVTGLPAAQIQEVARLFGEKGKNTMSMWTMGINQRVAGVWANNLIHNLHLLTGKICKPGSTPFSLTGQPSACGSVRETGALSHLLPGHRVIANEKHRKEVAELWGVPADRISPQAGLHTMELFKACGDGRVKCLYVMCTNPAHSLPNVNAYQEGFEKVFLVVAEAFHPTATTKYADVVLPAAFWCEKEGVYGNTDRRTQHLAKAINPPGEAKPDLDILLDLAQRLGYGELFPFKTPEDVWNEYLKCTTGTHMELATYPALREAHGIQWPVKDHQGNKGAVRRYVAPEDPYVKEGIDFYSAKDHKAVIFARPYLGPAEVVDEEYPYYLTTGRILEHWHTLTMTGKCPTLMRAVPKQYVELNPQDAAELGIKEGDTVRLVSRRGKVEIPVRVGKPGEPRPGLLFALWFEPDPLVNAVTIDAVDAASKEPEFKICAVKIEKV

SEQ ID NO: 35691 - protein, 246 aa, Helianthus niveus
ANYGGDKQYGRETRQTGDYENPIHSTGGQYEQDVRQTDEYGNPVRRTDEYGNPVHSTTGGTMGDYGSTGLGQGTGGIGTGGYGTTGHQGLGTGVGHTTGGTGTDYTSGGRFTGQTGYQGLGTESEFGGTTGTFQNQPSATPMGGTGLGSGTGAGFGGTGTGTGTGILHRSGSSSSSSSEDDGQGGRRKKKGVMQKIKEKLPGGHSQEGQYQSQTTTTTTAGGAGYGETHEKKGMMEKIKEKLPGHH

SEQ ID NO: 35692 - protein, 924 aa, Arabidopsis thaliana
MLEPRGADIPILFLVLVVLPVVAYILLGKWSNISEKRVRANLLAQMAAEEALRAETVVNADRGVRFESVATENRAQRTRTKTVSAGGGAVRAEFDAGARETVAEQKSDSVTATCGVTVVAPVNNNELHVCARCFGPAKTRCSRCKSVRYCSGKCQIIHWRVAHKDECVPVESCSSSSERVSFEKDSVLYDHGMDSTMYSNNTTQAAKGKTSKSSVDFASLGISQNDITPQINTQGRKSVGKQHSSKANRESCRRDSATVFDSSDEAASAGGDNKTSHIKHKSRGNSYAAETNPRRHSVDSSAVQMNGQSFVSGMQESHKHENNLGVRSSFGCPNTQYPSNGTRTATLPRTGINKSGEQSCTETSKKGQVAAVSKTVRSKDTGISEESNGVSSTMGIMKMMGLRNSTKHDDRYKNLKMLFPYEEFLKFFQCEVFDLSPRGLVNCGNSCYANAVLQSLTCTKPLVAYLLRRSHSRSCSGKDWCLMCELEQHVMMLRESGGPLSASRILSHMRSINCQIGDGSQEDAHEFLRLLVASMPSICLERLGGETKVDPRLQETTLVQHMFGGRLHSKVKCLRCDHESERYENIMDLTLEIYGWVEFFQDALIQFTRPEDLDGENMYRCSRCAGYVRARKELSIHEAPNILTIVLKRFQEGRYGKINKCISFPEMLDMIPFMTRTGDVPPLYMLYAVIVHLDTLNASFSGHYISYVKDLRGNWYRIDDSEIHPVPMTQVMSEGAYMLFYMRSYPRPQRGEHNGKAPVHHSQPRNEMKEQRKPVNRFKPRADHKNTESSSSEWSLFTSSDEASFTTESTRDSFSTIDYTDVCHVVDSSSPFAIFNNVYHNVEPSPHNTVACRMFSGTKPETRYFVEQETNHNNTVVLDATPSLYPIPAPYPPHDYYDQSMYVNYETNPEFNNGQDQDRTYSYW

SEQ ID NO: 35693 - protein, 238 aa, Ashbya gossypii ATCC 10895
MAHHHHSCEAEHHDHVPPARTSAQQSLYQWIDVPSMRCLNVVAKGAAASVPAGIIKSNDERYDISRYVESDADCQMLLHIPFTTSCRLYSIILRSAKGGEAGIGCMRHVKIYSNLNQNLDFDTVSELKPSNVLEYPQNVGVYLGGSQAEERGEHSFVEHHLPRHQFQNCHSLTIFVEDTWSGDEDEPTQLCYLELRGESTGLKPESGAALLRTVYEAAPNPAEHVKLESEHERLHLGM

SEQ ID NO: 35694 - protein, 240 aa, Helianthus tuberosus
ANYGGDKQYGRETRHTGDYENPIHSTGGQYDQDVRQTDEYGNPVRRTDEYGNPVHTATGGTMGDYGSTGLGQGTGGIGTGGYGTTGHQGLGTGVGHTTGTGTDYTPGGRSTGQTGYQGLGTESEFGGTTGTFQNQPSATPIGGTGLSSGTGAGFGGTGTGTGTGILHRSGSGSSSSSEDDGQGGRRKKKGVMQKIKEKLPGGHSQEEQYQSQTTTTTGYGETHEKKGMMEKIKEKLPGHH

SEQ ID NO: 35695 - protein, 252 aa, Rhodospirillum rubrum ATCC 11170
MTVRRPLIAGNWKMNGLKAEGQGLARDLAQRLNKAGGVDFDLLLCPPFPLISTVVGAVAGSGIAVGGQDCHAKAKGAHTGDVSAPMLADLGCQFVIVGHSERRADHGETDALVKAKAEAALAAGLIAVICVGETEAQRDAGETLAVVSGQLAGSLPTHADSGKVVIAYEPVWAIGTGRVPTTEDVAKVHGALRKDLVGALGADGNGVRLLYGGSVKPDNAAELMALENVDGALVGGASLKAEDFWAIAQSCA

SEQ ID NO: 35696 - protein, 228 aa, Helianthus maximiliani
ANYGGDKQYGRETRHTGDYENPIHSTGGQYEQDVRQTDEYGNPVRRTDEYGNPVHSATGGTMGDYGSTGLGQGTGGIGTGGYGTTGGTGTDYTSGGHSTGQTGYQGLGTESGFGGTTGTFQNQPSATPMGGTGLGSGTGAGFGGTGTGTGTGILHRSGSGSPSSSEDDRQGGRRKKKGVMQKIKEKLPGGRSQEEQYQSQTTTTTGYGETHEKKGMMEKIKEKLPGHH

SEQ ID NO: 35697 - protein, 286 aa, Glycine max
MFHRWSNSHQQDQGSSELYAESKIKELKGVIGPLSGRSLTYCTDACFKRYLEARNWNVDKSKKMLEETLRWRSTYKPEEIRWHEVAMEGETGKLYRASFHDRQGRTVLILRPGMQNTTSMENQLRHLVYLLENAMLNLPPGQEQMSWLIDFTGWSITNNVPLKLARETINILQNHYPERLAIAFLYNPPRVFEAFWKIVKYFLDNKTFQKVKFVYPNNKDSVQVMKSYFDEENLPKELGGKSIMSYNHEEFSRLMVQDDLKCAAFWGSDGKLSNHIVNGNSASVLK

SEQ ID NO: 35698 - protein, 246 aa, Helianthus neglectus
ANYGGDKQYGRETRQTGDYENPIHSTGGQYEQDVRQTDEYGNSVRRTDEYGNPVHSTTGGTMGDYGSTGLGRGTGGIGTGGYGTTGHQGLGTGIGHTTGGTGTDYTSGGRSTGQTGYQGLGTESEFGGTTGTFQNQPSATPIGGTGLGGGTGAGFGGTGTGTRTGILHRSGSSSSSSSEDDGQGGRRKKKGVMQKIKEKLPGGHSQEGQYQSQTTTTTTAGGAGYGETHEKKGMMEKIKEKLPGHH

SEQ ID NO: 35699 - protein, 795 aa, Vibrio fischeri ES114
MKFSESWLREWVKPAINSEELAHQITMAGLEVDEVAPVAGEFTGVKVGKVVECGQHPDADKLRVTKIDIGEEELLDIVCGASNCRLGLTVAVATVGAVLPGNFKIKKAKLRGVPSHGMLCSFSELGIDVESEGILELPEGTTLGADVRDILELNDVAIDVDLTANRADCFSIRGLAREVGVLNRADVTEPTIAAVATSIEDAVSIEVKATEACPRYLGRVIKNVNAKAETPIWMQEKLRRCGIRSIDAIVDITNYVMLEQGQPMHAFDLAKIDGGIVVRMAEQDEKLTLLDGNEAKLNDNTLVIADQNKALAIAGIFGGQESGVTSETTDIMLECAFFAPDHIRGRARAYGLHTDSSLRFERGVDSTLQAAAMERATQLLVELCGGEVAPVVAVESEADLPKANTVELRRSKLDGLLGHHIPSTDVVEILTRLGCAVESTDTGWTASSPSWRFDIAIEQDLIEEVGRIYGYNNIPNQAPVAALNMNDHKEANQPLKRVRDLLVDRGYHEAITYSFVEPEQQKLIVPEIEPLILPFPISAEMSAMRLSLWTGLINTVVHNQKRQQPRVRLFESGLRFIPEESAENGMRQEMMLAGIIAGTRGEEHWDIATNTVDFFDLKGDLEAVLELTANELAYEFKAAKHPALHPGQTAAIVVDGKEVGFIGTVHPELERKFGLNGRTIMFEIEWDAINTRVIPEAASVSKFPANRRDIAIVADEAIASGDIVAECLASGGELLTSAKLFDVYRGQGVEEGKKSLAIALTLQSVERTLEEADITSAVDAIVAAIGEKFSATLRD

SEQ ID NO: 35700 - protein, 237 aa, Helianthus petiolaris
ANYGGDKQYGRETRHTDEYGNPIHSTGGHQTDEYGNPVRRTDEYGNPVHSTTGGTMGDYGSTGLGQGTGGIGTGGYGTSGYQGLGTGLGHTTGGTGTDYASGGRSTGQTGYQGLGTESEFGGTTGTFQNQPSATPMGGTGLGGGTGAGFGGTGTGTGTGTGILHRSGSSSSSSSEDDGQGGRRKKKGVMQKTKEKLPGGHSQEGQYQSQTTTTTTAGGTHEKKGMMEKIKEKLPGHH

SEQ ID NO: 35701 - protein, 229 aa, Allium ampeloprasum
IRHEILSKNSGIKVETVVVDFSGDLVEGVERIKDAIKGKDVGVLVNNAGVSYPYARYFHEVDDELLRNLIKVNVEGVTRVTHAVLPGMIERKKGAIVNIGSGAAIVIPSDPLYAVYAATKAYVDQFSRCLFVEYKSKGIDVQCQVPLYVATKMASIRRSSFMVPSSDTYAKAALRWIGYEPRCTPYWPHSAIWCLLSLLPESAIDNWRLGFCLGIRTKGQLKDAKKKDL

SEQ ID NO: 35702 - protein, 76 aa, Zea mays
ILAEKGVVVLPDTYANSGGVVVSYFEWVQNIQGFMWAEEKVNDELEKYMSSAFQHMKAMCKSLVLPKCAMTLELRV

SEQ ID NO: 35703 - protein, 391 aa, Pera bicolor
DLEPVNPSDVPVTAAGALKSYKLAAKAISKLQSLPSGNISLLCDVLVKEVGDLTGYDRVMVYRFHEDEHGEVVAECRRPDLEPYLGLHYPATDIPQASRFLFMKNKVRMICDCLAPPVKVIQDSSLCQPVKSLWIYTEIPSWLHAQYMANMGSVASLVMSVTINEDDDEIDTDQRKGRKLWGLVGCHHTSPRFVPFPLKDACEFLIQVFGVQINKEVELAAQMREKHILRTQTMLCDMLLRDDPAAIVTQSPNVMDLVKCDGAALYYRKKFWFLGVTPTEAQTRDIAEWLLEYHSDSIGLISDSLMEAGYPGASVLGNAICGMAAVRITSKDLLFWFRFHTAKEIKWGGAKHDPGDKDDGRKMHPRSSFKAFLETVKWRSLPWEDVEMDAI

SEQ ID NO: 35704 - protein, 700 aa, Corynebacterium glutamicum ATCC 13032
MTTLTLSPELQALTVRNYPSDWSDVDTKAVDTVRVLAADAVENCGSGHPGTAMSLAPLAYTLYQRVMNVDPQDTNWAGRDRFVLSCGHSSLTQYIQLYLGGFGLEMDDLKALRTWDSLTPGHPEYRHTKGVEITTGPLGQGLASAVGMAMAARRERGLFDPTAAEGESPFDHHIYVIASDGDLQEGVTSEASSIAGTQQLGNLIVFWDDNRISIEDNTEIAFNEDVVARYKAYGWQTIEVEAGEDVAAIEAAVAEAKKDTKRPTFIRVRTIIGFPAPTMMNTGAVHGAALGAAEVAATKTELGFDPEAHFAIDDEVIAHTRSLAERAAQKKAAWQVKFDEWAAANPENKALFDRLNSRELPAGYADELPTWDADEKGVATRKASEAALQALGKTLPELWGGSADLAGSNNTVIKGSPSFGPESISTETWSAEPYGRNLHFGIREHAMGSILNGISLHGGTRPYGGTFLIFSDYMRPAVRLAALMETDAYYVWTHDSIGLGEDGPTHQPVETLAALRAIPGLSVLRPADANETAQAWAAALEYKEGPKGLALTRQNVPVLEGTKEKAAEGVRRGGYVLVEGSKETPDVILMGSGSEVQLAVNAAKALEAEGVAARVVSVPCMDWFQEQDAEYIESVLPAAVTARVSVEAGIAMPWYRFLGTQGRAVSLEHFGASADYQTLFEKFGITTDAVVAAAKDSING

SEQ ID NO: 35705 - protein, 391 aa, Peridiscus lucidus
DLEPVNPADVPVTAAGALKSYKLAAKAISRLQSLPSGNISLLCDVLVKEVSDLTGYDRVMVYKFHEDEHGEVVAECCRPDLEPYLGLHYPATDIPQASRFLFMKNKVRMICDCLALPVKVIQDKRLAQPLSLCGSTLRSPHGCHAQYMANMGSIASLVISVTINEEDEEMESSQQRGRKLWGLVVCHHASPRFVPFPLRYACEFLIQVFGVQINKEVELAAQLKEKHILQTQTVLCDMLLRDAPVGILTQSPNVMDLVKCDGAALYYREKFWLLGVTPTEVQIKTIAEWLLEYHSGSTGLSTDSLTEAGYPGASILGDAVCGMAAVKITSKDFLFWFRSHTAKEIKWGGAKHDPSDKDDGRKMHPRSSFKAFLEVVKRRSLPWEDMEMDAI

SEQ ID NO: 35706 - protein, 117 aa, Hordeum vulgare subsp. vulgare
KHMIEDDCADNGIPLPNVNSKILSKVIEYCNKHVQAKPADAAGPGASDALPPADDLKNWDAEFVKVDQATLFDLILAANFLNIKGLLDLTCQTVADMIKGKTPEEIRKTFNIKNDFS

SEQ ID NO: 35707 - protein, 413 aa, Podospora anserina
MGDLQGRKVFKVFNQDFIVDERYTVTKELGQGAYGIVCAAVNNQTNEGVAIKKVTNVFSKKILAKRALREIKLLQHFRGHRNITCLYDMDIPRPDSFNETYLYEELMECDLAAIIRSGQPLTDAHFQSFIYQILCGLKYIHSANVLHRDLKPGNLLVNADCELKICDFGLARGFSVDPEENAGYMTEYVATRWYRAPEIMLSFQNYTKAIDVWSVGCILAELLGGRPFFKGRDYVDQLNQILHILGTPNEETLSRIGSPRAQEYVRNLPFMAKKSFPSLFPNANPDALDLLDRMLAFDPSRRISVEEALEHPYLAIWHDASDEPDCPTTFNFDFEVIDDVNEMRKMILSEVVNFRAQVRTVPGQAGSAGNIQQAPSNVPIPAGGPGQQWTAEDPRPMEYGNQMQGLEAELGGR

SEQ ID NO: 35708 - protein, 391 aa, Petalostigma pubescens
DLEPVNPADVPVTAAGALKSYKLAAKAISRLQSLPSGNISLLCDVLVKEVSELTGYDRVMVYRFHEDEHGEVVAECCRPDLEPYLGLHYPATDIPQASRFLFMKNKVRMICDCMAPPVEVVQDERLSQPLSLCGSTLRSPHGCHAQYMANMGLIASLVMSVTINEDNDEMDGDQQTGRKLWGLVVCHHTSPRFVPFPLRYACEFLIQVFGVQINKEVELAVQMREKHILRTQTVLCDMLLRDAPVAIITQSPNVMDLVKCDGAALYYRKKFWLLGVTPTEAQVRDIAEWLLECHSGSTGLSTDSLMEAGYPGASILGDAVCGMAAVRITSKDFLFWFRSHTAKEIKWGGAKHDPGDKDDGRKIHPRSSFNAFLEVVKRRSLPWEDVEMDAI

SEQ ID NO: 35709 - protein, 515 aa, Podospora anserina
MSKPQPPNLTLEFPSPQPSPGSSVPKMNSVPLLRPALPGGNRSGGRAPRLGLAIPPSPNAKPLSNPGPAPGRPALPTLHLATPMGSSSVVPQEQPQHIKPALSLQSASGGSESSAAHSRSGSFGPFDGRASNPTSAGSQFSALSFAEQYGIGPTRHAGTGDPVSAVGSLYSNASESVGMERENSLHGLESFDKLSLDKARSADVEDLDDEGWRIVSMEKRIVELGSLGEGAGGAVTRCKLKGGNTVFALKVITTNPDPDVKRQIVRELGFNKDCMSEHICRYYGAFVDPSTATISIAMEFCEGGSLDSIYKEVKRLGGRTGEKVLGKISEGVLQGLTYLHSKKIIHRDIKPSNILLCRNGEVKLCDFGVSGEFGTKGDANTFIGTSYYMAPERITGQSYTITSDVWSTGVTLLEVAQHRFPFPADGTEMQPRAGLIDLLTYIVRQPIPKLKDEPEASIFWSDSFKYFIECCLEKDPLRRATPWRMLEHPWMVEMKTKRVNMSKYLTQVWGWDDKK

SEQ ID NO: 35710 - protein, 124 aa, Vicia faba var. minor
  misc_feature (65)..(65): Xaa can be any naturally occurring amino acid
MASTKKITLKSSDGEAFEVDEAVALESQAIKHMIEDDCADSGIPLPNVTSKILAKVIEFCKKHVXAAASDDKPTEDELKAWDADFVKVDQVTLFDLILAANYLNIKNLLDLTCQTVADMIKGKT

SEQ ID NO: 35711 - protein, 428 aa, Aspergillus oryzae
MPIPLLAQGFQEGISSIPYAWTVLKIVPFVLLVAALKYYFGGARNGSERLMHSKVVMVTGGTSGIGASVVHELASRGAQVILLTKHAPSDVFLVDYIEDIRKSTKNQLIYAEQVDLSSLHSIRTFATKWIDNVPPRRLDMVILCGNTAAPSSASRKLTADGLDEEWQVNYLANFHLLSILSPALRAQPPHRDVRVIFTTCSSYIGAKIDPKQIEAACTPDAPAPRGTKNGKNVKKVGAGSKKSKPSLFGASKLALMSFSQSFQKHLNAFERPDKMPPCTRVIVVDPGFSRTPGTRRWLTGGSLWGLLLYLITWPLWWLVLKSPQQGAQSILYAAMEARFGRGTGGWMIKECQEVDFARKDIKDEEAGKLLWQFSEAQIEQKEKESAVKRALAKKEQQEKEKQKNNGASSSKPAAKEQTPGSRRSRKAK

SEQ ID NO: 35712 - protein, 379 aa, Petunia x hybrida
MSSTVGQVIRCKAAVAWQPGKPLVIEEVEVAPPQKMEVRLKILYTSLCHTDVYFWEAKGQNPVFPRILGHEAAGIVESVGEGVTELVPGDHVLPVFTGECKDCAHCKSEESNMCSLLRINTDRGVMIHDGQSRFSINGKPIFHFVGTSTFSEYTVVHVGCLAKINPLAPLDKVCVLSCGISTGLGATLVAKPTKGSSVAIFGLGAVGLAAAEGARIAGASRIIDVDLNASRFEEAKKFGVTEFVNPKDYSKPVQEVIAEMTDGGVDRSVECTGHIDAMISAFECVHDGWGVAVLVGVPHKEAVFKTHPMNLLNERTLKGTFFGNYKPRSDLPSVVEKYMNKELELEKFITHKLPFAQINKAFDLMLKGEGLRCIINMED

SEQ ID NO: 35713 - protein, 391 aa, Phyllanthus epiphyllanthus
DLEPVNPDDVPVTAAGALKSYKLAAKAISKLQSLPSGNISLLCDVLVKEVSELTGYDRVMVYKFHQDEHGEVVAESCRPDLEPYLGLHYPATDIPQASRFLFMKNKVRMICDCQAPPVKVVQDKQIAQLLSLCGSTLRSPHGCHAQYMANMGTIASLVMSVTINEDDEETDNDQQIGRKLWGLVVCHHTNPKFVPFPLRYACEFLIQVLGVQVHREVELAAQTTEKHILQTQTVLCDMLLRDAPVAIVTQSPNVMDLVKCNGAALFYRKKFWMLGVTPTEAQIKDITEWLLEYHGESTGLSTDSLMEAGYPGAAILRYAVCGMAAIKITSKDFLFWFRSHSAKEIKWGGAKHDPGDKDDGRKMHPRSSFKAFLEVVKWRSIAWEDVEMDAI

SEQ ID NO: 35714 - protein, 202 aa, Glycine max
  misc_feature (5)..(5): Xaa can be any naturally occurring amino acid
  misc_feature (13)..(13): Xaa can be any naturally occurring amino acid
  misc_feature (16)..(17): Xaa can be any naturally occurring amino acid
  misc_feature (60)..(60): Xaa can be any naturally occurring amino acid
MKKLXKEYGVSPXTPXXGLFIQGPIFVSFFLAITNIAEKVPSFKHGGASWFIDLSTPDAXCNMQEGMEGNPVAGTMKNVSRGLAVLTVPFTMGFPKAIFCYWVTSNLFSLVYGLVLKVPGVKKTLGIPEIPVAPPTTTSATQSPFSIFPALKQATSATTNGSSSIPDEASEHSNKKISSASVISQRLRSLEKQVKGRKKNKK

SEQ ID NO: 35715 - protein, 113 aa, Vicia faba var. minor
KHMIEDDCADETGIPLPNVTSRILAKVIEYCKKHVEAPKIDEYGMPVDGKDMKKWDAEFVKVDQDTLFDLILAANYLDIKSLLDLTCKTVANMMDGRTPDEIRRTFNIKNDFT

SEQ ID NO: 35716 - protein, 374 aa, Petunia x hybrida
QVIRCKAAVAWEAGKPLVIEEVEVSLLQKMEVRLKILYTSLCHTDIYFWEAKGQNPVFPRILGHEAAGIVESVGEGVTELVPGDHVLPVFTGECKNCAHCKSEESNMCSLLRINTDRGVMIHDDQSRFSINGKPIYHFVGTSTFSEYTVVHVGCVAKINPLAPLDKVCVLSCGISTGLGATLNVVKPTKGSSVAVFGLGAVGLAAAEGARIAGASRIIGVDLNASRFELAKKFGVTEFVNPKDYNKPVQEVIAEMTDGGVDRSVECTGHIDAMISAFECVHDGWGVAVLVGVPHKEAVFKTHPMNLLNERTLKGTFFGNYKPRSDLPSVVEKYMNKELELEKFITHQLPFSDINKAFDLMLKGEGLRCIIHMEH

SEQ ID NO: 35717 - protein, 497 aa, Kluyveromyces lactis NRRL Y-1140
MAGITGITPEFKNSDLIRKGAFVDGQWLETASETFNVTDPATLEVIATLPDQSIEVIHEAIDSAAEAFRLFKKTTPKTRSTWLRNLYNLMMENVDDLAKIITWENGKALSEAQGEVKYAASYFEWYAEEAVRMYGTTIQPNNGSNRAFTVRQPVGVCGIICPWNFPSAMITRKAGAALAAGCTVVVKPDSQTPLSALALAHLAEKAGFPKGVFNVVLTATRTPEFGLALCESPKVKKISFTGSTNVGKILMKQSASTMKKLSFELGGNAPVIVFDDADLEQAVTQTILSKFRGLGQTCVCANRIYVQRTIIDSFAEKLAKQVNEFVIGHGLDSKTTHGCLINENAIKKVEAHVKDALEKGAKTVVAGGRLPELGPNFYAPTVLSHVPSTAVVNKDETFGPLCALIPFDTMEEVVGYANDTELGLASYVFSKNIDTVYTVAEALETGMVSCNTGLFSECTIPFGGVKESGFGREGSLHGIEDYTVIKTITIGNLPAPL

SEQ ID NO: 35718 - protein, 391 aa, Pimelodendron zoanthogyne
DLEPVNPADVPVTAAGALKSYKLAAKAISKSQSLPSGNISLLCDVLVKEVSDLTGYDRVMVYKFHEDEHGEVIAEYHRPDLEPYLGLHYPATDIPQASRFLFMKNKVRMICDCLAPPVKVIQDRSLAQSLSLCGSTLRSPHGCHAMYMTNMGSIASLVMSVAINEDGSEMDDDQQKGRKLWGLVVCHHTSPRFIPFPLGYACEFLIQVFGVQINKEVEMAAQMREKHILQTQTVLCDMLLRDSPMAIITRSPNVMDLVKCDGAALYYRKKFWLLGVTPTETQIKDIAEWLLECHRESTGLSTDSLIEAGYPGASIIGKAICGMAAVRINSKDFLFWFRSHTAKEIKWGGAKHDPDDKDDGRRMHPRSSFEAFLDVVKWRSLPWEDVEMDAI

SEQ ID NO: 35719 - protein, 240 aa, Helianthus petiolaris
ANYGGDKQYGRETRHTDEYGNPIHSTGGHQTDEYGNPVRRTDEYGNPVHSTTGGTMGDYGSTGLGQGTGGIGTGGYGTSGHQGLGTGVGHTTGGTGTDYASGGRSTGQTGYQGLGTESEFGGTTGTFQNQPSATPMGGTGLGGGTGAGFGGTGSGTGTGILHRSGSSSSSSSEDDGQGGRRKKKGVMQKIKEKLPGGHSQEGQYQSQTTTTTTAGGAGYGETHEKKGMMEKIKEKLPGHH

SEQ ID NO: 35720 - protein, 1049 aa, Streptomyces coelicolor A3(2)
MFIQLLQAACLPGAHGDPPPVLVTLGVRADFYDRCLRYPELADALQHRHMVLGPLTTAELREAVTAPARAVGMELEPGLAELIIREVSTDGPRGGCDSHAFRAVGEHDAGVLPLLSHALLATWQRRKAGRLTLAGYRAAGGIQGAVAATAERAWSGLDPAARTAARLLLLRLIRLSEDTQATRRRSTRRRLAEEARDPDKTEESLEALVRARLVTLDADTVEITHEALLHAWPRLRDWIDEDRAGNLLRQRLEEDGLAWEESDRDSALLYRGSRLAQADGWAKSADDTFLTRSAVEFLAAAVRLRRRTVMISRAAVSALVVLALLAVGSAVLAWQQRNDAVFEQVVAEADRVQDTDPSLSAQLDLAAHRLRPDDEDVRNRLISIVNAPLATPLLGHTGAVYLTSFSPDGRILATASYDRTVRLWDVSDPGRPQQLGKPLTGHTSWVSTAVFSPDGRTLASASDDGTIRLWDVTDPGRPRPLGAPLDGHGGTVYLLAFSPDGRTLASAHDDHAVRLWNVADRRAPEALDTLTGSTGAVRSVAFSPDGDTLASGGDDDKVRLWDVSDPRRPEPAGAPLAGHSGLVHSVAFSPDGHTLASGSADDTVQLWDVTDPAGAKPVGAPLTGHSGPVWAVAFSPDGAMLAVSSADSTASLWNVSDPAYPSQVGVPLAGGSGEMYALGFSPDGHTLATGSGDSKVRLWSLPTSDMIGRIGAFRPDGHVLATAARDGRVRLWDVTDPGRPVSLSAPFEPGDGDIRSLVFSPDGGTLAVLVGGRALQLWDVTDPAGPTAHGPPVALSTRYAGPDTLAFSPDGRTLATAHDDRTIQLWNADDPSRPRRLGKPLAGHSGYVNTLAFSPDGRTLASGGADDAVRLWDVTDPAHATRLGAARTGHLGPVNVLAYSPDGHTLASGSDDGTVRLWDVTEPGEGSGGGTTLAGHTDSVVSLTFSQDGDTLASGANDNTVRLWSVTDPAEAAPIGRAMSPNAKTGNFLSFSPVSHMLGVSSGTDTVRLWSLGVDDAIDRICSATRGVLTEEKWHEYLPRLDYEPPCHQ

SEQ ID NO: 35721 - protein, 246 aa, Helianthus praecox
ANYGGDKQYGRETRQTGDYDNPIHSTGGQYEQDVRQTDEYGNPVRRTDEYANPVHSTTGGTMGDYGSTGLGRGTGGIGTGGYGTTGHQGLGTGVGHTTGGTETDYISGGRSTGQTGYQGLGTESEFGGTTGTFQNQPSATPIGGTGLGGGTGAGFGGTGTGTGTGILHRSGSSSSSSSEDDGQGGRRKKKGVMQKIKEKLPGGHSQEGQYQSQTTTTTTAGGAGYGETHEKKGMMEKIKEKLPGHH

SEQ ID NO: 35722 - protein, 236 aa, Helianthus annuus
ANYGGDKQYGRETRHTGDYENPIHSTGGQYEQEVLQTDEYGNPVRRTGQTDEYGNPVRRTDEYGNPVHSTAGGTMGDYGSTGLGQGTGGIGTGGYGTTGHHGLGTGIGHTTGGTGTDYTSGGRSTGQTGYQGLGTESEFRGKTGTGVGGTGTGTGILHRSGSSGSSSSEDDGQGGRRKKKGVMQKIKEKLPGGHRQEEQYQSQTTTTTTGGGAGYGETHEKKGMMEKIKEKLPGHH

SEQ ID NO: 35723 - protein, 195 aa, Blastopirellula marina DSM 3645
MSFDALIFDLDGTLADTMPAHYIAWRATMAKYGISFDEDRFYSLGGCPSQKIVELLAEEQGMVLDSHTVAIEKEEAFLLEIAEVAPIEPVVELVYEYRGRIPMAVATGAMRYVADLILAHVGLADCFDACVTSEDTERHKPHPDVFLEAARQLKVEPEHCRVYEDADLGVEAGRRAGMEVVDVRNFFTPRRITIS

SEQ ID NO: 35724 - protein, 574 aa, Aspergillus nidulans FGSC A4
MDNNGTRTEGPQDAGRKHKKRDMGRAEWSRQMPDKRERNERAEQAKRRKLENGEEVVAPIYATQFSKEDIENEQRRPKKKVAVLIGYSGTGYKGMQLSTTEKTIEGELFTAFVAAGAISKANAADPKKSSLVRCARTDKGVHAAGNIVSLKLIVEDPDIVQKINDHLSPQIRVWGILVANKSFSSYQMCDSRIYEYLIPSHCFLPPHPNTYLGKKLVEIAEKEGDLEAYKARQEEVANYWEDIDERVIKPLLESFPEDIRKPVEKALHMDDDTDGVPETKQTSTERGAKTAPVAEASSEETSAEPEPLDEAEIAFRRQIYEAVKTVKAAYLKARREYRIPATRLARIQQALDKYVGTKNFYNYTIQKQYRDPSAKRHIKSFKLNPEPIIIDGTEWLSLKVHGQSFMMHQIRKMVAMATMVVRCGCDPARINDSYGEFKMAIPKAPGLGLLLERPVFDGYNKKAADLKKEPIDFGKYEEEISEFKQREIYDRIFREEEQTHAFSSFFNHIDHYAQEEFLYVTSGGIAAAKPALGPGESADAKPNDTAQSKRKSQREALAEVEQESEDEQNGTEDN

SEQ ID NO: 35725 - protein, 251 aa, Zea mays
HASAALVTGGSKGIGQAVVEELARLGARVHTCARSAADLEECRRRWAEKGLRVTVSVCDVAVRADRERLVLDTVSGAFDGKLDILVNNAALLLLKPAAEWAAEDYARIMATNLESCLHISQLAHPLLLNASVAGGASIVNVSSIASVLGFPQEVMYSVTKGGLNQMTRSLAVEWACDRIRVNCVAPGVIMTDMGKELPAALVEQERSRIPLRRTGEPEEVASLVSFLCMPAASYVTGQVIFVDGGRTISGA

SEQ ID NO: 35726 - protein, 94 aa, Oryza sativa (indica cultivar-group)
MGFVMEFAENLILRMMEDPGKRDAAQREHVYRMKERCERTKAAWSLPLRPYGFWTFDRFNSQLSWDPQISHAPGRRDPYDDVLHRHSNPAPSSS

SEQ ID NO: 35727 - protein, 588 aa, Actinobacillus pleuropneumoniae serovar 1 str. 4074
MSDKKIKGLEWQEKPLSDNERLKTDSNFLRGTILDDLKDDLTGGFKGDNFQLIRFHGMYEQDDRDIRAERLEEKLEPLKFMLLRCRLPGGIIKPYQWIEIDKFAREHTRYQSIRLTNRQTFQYHGVPKGKLQPMHRLLHSIGLDSIATAADMNRNVLCTSNPIESELHQQAYEFAKKISEHLLPRSRGYLDVWVDGKKVESSDDLLKIEDEPILGKTYLPRKFKTAVAIPPLNDVDVYANDLNFIAIQDENGQLCGFNVLVGGGLSFEHGNTKTYPNVAYSLGFVPLEHTLAAAEGVVKTQRDFGNRSDRKNARVRYTVQNMTLDGFRAEVERCMNIKFEPTRPYEFTERGDRIGWVKGIDNNWHLTLFIESVRITDKPEKPLMTGVLELAKVHKGDFRITANQNLIVANVAEQDKAQIEAIARQYGLIQEISKLRENAMSCVSLPTCPLAMAEAERVLPDFISELDKVLSKHNVADESIITRITGCPNGCGRAMLAEIGLVGKAIGRYNLHIGGDRAGLRISRLYKENITLQEIVNEIDQLVARWATERQTNEAFGDFVIRSNIIAPVVNAHIDFWDATKIIPTTII

SEQ ID NO: 35728 - protein, 648 aa, Aspergillus nidulans FGSC A4
MRWIPSPGGSMLVSRGLLHKIRPSPSAQLPLSVFPSSSFVFGSRCHSGAAVTQKSRMARFPSQQSRPVHATPHVNHNGPIEQNYDTANPAYIRKYLRTYGLTPPRPESYETQKTRCLAQLALKQTPIDKFLYLSTLRKNNVHLFYRLVTDHLRELTPLIYTPVVGEACQRWSEIYQQPEGMYLSWEDRGNLASVIANWPQPNVEITCITDGSRILGLGDLGINGMGIPIGKLALYTTCAGIRPEATLPLTLDLGTSNKALREDPLYLGSRRDKITPDEEREFLDELMAALTERWPGIVIQFEDFKNPFPALERYQDVYTCFNDDIQGTGAVILGGVINAVKRSGVPCKDQRAVFFGAGSAGVGVAKQIVAFFMREGMTEDEARSCFWLVDTKGLVTADRGDKLAEHKVYFARTDNAGQQFKTLEEVVDHVKPSILMGLSTQGGVFTPEILRKMAEWNTNPMIFPLSNPSSKSECDFETAVTNTDGRVLFASGSPFPTMSFTNSAGETKMYYPGQGNNMYVFPGIGLGTILSKAVKVTDSMIYASGEALSKALTAEEIERGLLYPDLTRIRKVSVVVARNVIRAAQEAKVDRETTLRTMDDETLDAWIKSRMYDPHTEVQSLEREVGSILSTLGAPQQFVNGSSDEAKL

SEQ ID NO: 35729 - protein, 224 aa, Brassica napus
  misc_feature (108)..(108): Xaa can be any naturally occurring amino acid
  misc_feature (148)..(148): Xaa can be any naturally occurring amino acid
MAKIWEKHTFSLRFLIDEKKNRVVLAEAGKDFVDVLCGILTLPMGTIVSLLEKHKNPQSSIVGCFHNLHRSVSIMDDDNFQTQACKNLLMHPKSMKEAQCRQLKLNIXDDAAEKTKFFVCPHFMYDETCCKAYNNIRTSTCSCRRTMXHYIHVEEGDEADGCLGNESDGVFLSCRTSSIITDYMKVALNSMGLVLNILNDRGYSGFDKLREMVLDVGFEEILYT

SEQ ID NO: 35730 - protein, 461 aa, Oryza sativa (japonica cultivar-group)
MSSVEMSRAHGSPRSFFPVGNPFRVMFPGGAHLSRKLQELLASYEDALALSLRKLKPEAASDVLTLSWMRLAVDCLSELHTNIANLITDLELPVSDWDDKWVDIYLNSSVKLLDICIALSSELSRLDQGQLLLQYALHVLGSESGVPSQEQLKRAEPSLREWMELVGVRCARLVSCSATLQELAGNLSLMKVKNSAKGKVLMRALYGIESVTVFVCSIFVAVLSGSPKPLVELHVPEKFGWSQAFNDLHTAVSEELTRQLSGGSVAAVKELEEVEACARRLHVLASTSQLEEEAANLANAVSHTEEEVMSDSIAQEGDHHCGLKLADDTTREGGIVISESIAEGGTQEAEMKKDISYEKEVAMVERISYKEHQDSNVKQANGSSDESALVVPERTSVQESKEELLNCISSMSKSAEGLRHGLDSLSKRVGDFFQIVLTGRDALLCNLRISDAASKVAEVSS

SEQ ID NO: 35731 - protein, 388 aa, Debaryomyces hansenii CBS767
MDTCVYERRAEKALDSVNKTLGSQSEAMSHLVEQYSKSGYSRINLLNSLELLFQSILRGGKVVVSGIGKSFKISSKLVATLNSLSIQSAALHASEGLHGDLGIIRDNDTLIFVTASGNTPELLQLLPHIPKSIPIILLTCNRNSKLSNHPQVKSLLYADLPSNLNEESIHGIPAPTVSATLSMVLADATILALSEMLEEDALKRKKLFSMKHPGGSIGADLSHLNENFVKMATGDVASSGRSFSLNTNSSLLSLNQLRKSFDNMNSESSNFSSLVVSDDEDMLDSKALKKNSDVQNLIVPSDPSKRVSITEDELNSTSYVTESKLLKWITLYDFVVCLKADDTHIARAMSCDQIRELYRSEIGDDDCKDEIWELFHLKLVTRFKEVQL

SEQ ID NO: 35732 - protein, 212 aa, Arabidopsis thaliana
METSRNSTNSSLFQWLGLLEDSDQPPDSTPPRVITLLASTLEKMIQKNKKKFHTRHNKADEITMFHGSKAPSLSIYRYTERIHRYAQCSPVCFVAAFAYILRYLQRPEATSTARRLTSLNVHRLLITSLLVAAKFLERQCYNNAYYAKIGGVSTEEMNRLERTFLVDVDFRLYITTETFEKHCLMLQKETVPCDSRKLRTVLGEIACSCQAI

SEQ ID NO: 35733 - protein, 1025 aa, Candida albicans SC5314
MTHRKNYTDTAYTRLKNFVMLFLKKEQLFFFFLFSFFSLSIPPAMLRLRPTIRSLSRNFHRSCINLDAVVVSGTKLANTIRANVAEKVINYNKEHFGDNNKSFENFRFQPSLTILQVGSRPDSSAYVKSKLKAAASSNIKSKLIKLDESISQEDLVEVIERLNKDPKVHGILVQLPLPKHIDESVITNSVATDKDVDGFDHYNVGQLSKRGGTPYFKPCTPNGIMELIKTTGIPLRGKTAVVIGRSDIVGTPVATMLRNEDCTVTVCHRYTQNLPEIVRQADIVVAAVGIAEYVKADWVKDGAIVIDVGINYKDDPTAKRGRRLVGDVDYEEVAKKASFITPVPGGVGPMTVAMLCSNVYDAALIHAKKAHEHGFKPLELNIKDPVPSDIEISRNQKPKKITRVAQELGILDAELEPYGHFKAKVDPKSVIERLDEQAEGSAQDKGNYVLVAGITPTPLGEGKSTTTMGLTQALGAHLGYNAIANVRQPSMGPTFGVKGGAAGGGYAQVIPMDEFNMHLTGDIHAISAAQNLLCAAVDTRMFHESTSKTTSGFYKRLVPIKKGKRSFTPSMLKRLEKLGITKTNPDDLTAEEIEKFAVLNIDPDSITIKRVVDCNDRFVREITIGEGKNEASKYPPRKTGMDITVASELMAILALSNSLKDLRQRVGKLVVGTQRKTGEAITAEDIGCAGAITALLKDAIKPNLMQSLEGTPVFVHAGPFANISIGASSVIADKLALKLTSPSNPINNGETGFVVTEAGFDFTMGGERFFNIKCRASGLKPDAVVLVATSRALKLHGGATDVKPGQPLPAEYVNENLEYLEKGCANLAKQIANIKQYNVPVVVAINQFETDTDAEIKLIQSLALKAGADFAVPSNHWAKGGAGAVELASSVVKAVELAPLEQQKYLYDVNDTVENKLLAITTKMYGASGIELSPLAKKQIETYTKQGYDKLPICIAKTQYSLSHDSSLKGVPTGFTVPIREVRCSAGAGYLYALAAEIMTIPGLPTHAGFMNVEVNDEGEIEGLF

SEQ ID NO: 35734 - protein, 415 aa, Oryza sativa (japonica cultivar-group)
MNRGEFQSSLVQQMIWSGSSTGTATGVGSGGGAGSLMGSLKPCHEDQEASPNMPSLSSPSLIFSQQFQHSSPGLVPMNGTAGAAASLPSLHDGGGGGHESSMPESWSQLLLGGLAGDQERYSATAALLSKGLENWGDHAAAAAASACMVGGMKEEGSMAQAAATAAAAAYSFYGSHLAGDHQHEIQAAAAGGGASNKSQLSQMLMASSPRSCITTSLGSNMLDFSNTAAPPELRSHHHNSDNSSECNSTATGSALKKARVQASSSAQSTLKVRKERLGDRITALHQIVSPFGKTDTASVLQETIGYIRFLLSQIEALSYPYMGDANGTGPMQNGPVGERNPGLFPEYPGQLLNHNGNTGAQQPAAQPEQQGANDDGKKDLRSRGLCLVPVSCTSHFGGDNAADYWAPAPLGGILR

SEQ ID NO: 35735 - protein, 392 aa, Pseudomonas fluorescens Pf-5
MRYSALTQRIAGEGSAAWDIHYRALALREQGGDVLLLTIGDPDFDTPRPVVQAAIDSLLAGDTHYSDVRGNLALRSCIARCHHQRTGQIVDAEHVVVLPGAQCAVFSVAQCLLDPGDEVLVAEPMYVTYEGVFGACGATVVPVPVRAEQGFRLDPQEVAARISPRTRAMLINSPNNPSGASLSLDDWQVLARLCMEHDLWLVSDEVYGDLLYEGQHLSPGGLPRMGGRTATINSLSKSHAMSGWRVGWVIAPPVLVGHLSNLALCMLYGLPDFIQNAAVVALTRELPELPQMREEYRQRRDLVCTLLGQCPGLRPVLPDGGMFVMVDVRRTGLGAQAFAERLLEGYGVSVLAGEAFGPSVVGHIRIALVLDRERLAEACRRIAQCTAQLLAL

SEQ ID NO: 35736 - protein, 280 aa, Corynebacterium glutamicum ATCC 13032
MKIAVIGLGSTGSMALWHLSNIPGVEAIGFEQFGISHGYGAFTGESRLFRMAYHEGSTYVPLLKRARALWSSLSEISGRELFHNFGVLSTGKEDEAPFQRLVESVERYELPHERLTAAQMRKRYPGLDFRDDEAGIVDLQGGALRPELAVFSAIETAKANGAQVRDHQKITSIEDNGDHVVIQAGEETTIVDRVIVTTGSWTSELVPSIAPLLEVRRLVLTWFLPNNPVDFQPENLPCFIRDRDGFHVFGAPCVDGYSIKIAGLDEWGVPLSLDPPMCPR

SEQ ID NO: 35737 - protein, 391 aa, Podostemum ceratophyllum
DLEPVNPSDVPASAAGALKSYKLAAKAISKLQSLPSGNIGLLCDVLVKEVTDLTGYDRVMIYKFHEDDHGEVVSEWHAPELEPYLGLHFPATDIPQASRFLFMKNKIRMICDCMAAPVNVVQDAGLTQALNLSGSTLRAPHGCHAQYMANMGSIASLIMSVTINEDDEELEQQQQAGDELWGLVVCHHTVPRFRAVPAAVRCEFLIQVFGIQINKEVEMAAQMHEKRVLETQAVLCDMLLRDSPVAIMTRTPNVMDLVKCDGAALYHEKRFWLLGITPKETQIRHLMTWLNENHRETTGLSTASLLEAGFPDAMALGDAVCGMVAIRVNSKDFLFWFRSHTAKEIKWGGAKHDADEKDEERKMHPRSSFKAFLEVVKWQSLPWEDMEMDAI

SEQ ID NO: 35738 - protein, 401 aa, Streptomyces coelicolor A3(2)
MADSTASAEPQRPTHPAGRPVYVIGAGPGGLAVAHALRARGLRAVVLERADHVGSSWRRHYDRLRLHTTRRLSALPGLPIPRRFGRWVARDDVVRYLEKYAEYHQLEIVTGVEVFRVERAPDGTGWLLHAAGGRELTGAAVVVATGYNHTPRVPDWPGRDTYTGEFRHAADYRTPAPYAGRDVLVVGVGNTGAEIAVDLVEGGAARVRLAVRTAPHIVRRSTAGWAAQYTGVLCRRLPVALVDRLARPLARISVPDLSAQGLPRPGTGLYSRVAEGAIPVQDVGLIDAVRSGRVEVVAAMDGFEDGKVLLADGTRIAPDAVIAATGYRRGLEGLVGHLGVLDGTGRPVVQGGRTPAAAPGLYFTGFTNPISGMLRELAIDAERIAGAVAKRGAGGVSRLPG

SEQ ID NO: 35739 - protein, 395 aa, Quiina pteridophylla
DFEPVKPYEVPMTAAGALQSYKLAAKAITRLQALPSGSMERLCDTMVQEVFELTGYDRVMTYKFHDDDHGEVISEITKPGLEPYLGLHYPATDIPQAARFLFMKNKVRMIVDCRAKHVKVLQDDKLPFDLTLCGSTLRAPHSCHLQYMENMDSIASLVMAVVVNEGNEDSDGPDPVHPQKRKRLWGLVVCHNTTPRFVPFPLRYACEFLAQVFAIHVNKELELENQIVEKNILRTQTLLCDMLMRDAPLGIVTQSPNIMDLVKCDGAALLYKSKIWRLGVTPTDLQLQEIALWLSDYHMDSTGLSTDSLYDAGYPGALALGDVVCGMAAVRITSKDLLFWFRSQTAAEVRWGGAKHEPGEKDDGRRMHPRSSFKAFLEVVKTRSLPWKDVEMDAI

SEQ ID NO: 35740 - protein, 259 aa, Corynebacterium glutamicum ATCC 13032
MARKPLIAGNWKMNLDHQQAIGTVQKLAFALPKEYFEKVDVAVTVPFTDIRSVQTLVEGDKLEVTFGAQDVSQHESGAYTGEVSASMLAKLNCSWVVVGHSERREYHNESDELVAAKAKAALSNGISPIVCVGEPLEIREAGTHVEYVVEQTRKSLAGLDAAELANTVIAYEPVWAIGTGKVASAADAQEVCKAIRGLIVELAGDEVAEGLRILYGGSVKAETVAEIVGQPDVDGGLVGGASLDGEAFAKLAANAASVA

SEQ ID NO: 35741 - protein, 360 aa, Stackhousia minima
DLEPVNPADVPITAAGALKSYKLAAKAITRLQSLPSGNISLLCDVLVKEVSELTGYDRVMVYRFHDDDHGEVVAECCRPDLEPYLGLHYPATEIPQASRFLFMKNKVRMICDCLAPPVKVLQDKRLTQPLSLGGSTLRSPHGCHAQYMVNMGSIASLVISVTINDDEDEANSEQHRGRKLWGLVVCHHTTPRSVPFPLRYACEFLIQIFGVQINKEVELSAQKKEKHILRIQTVLCDMLLRNAPEGILAQSPNVMDLVKCDGAALYYRNDVRLVGITPTEKQIRDIAEWLLEHHSESTGLTTDSLMEAGYADASILGEAVCGMAAVKITSKDFLFWFRSHTAKEMKWGGAKHDPDDKDGG

SEQ ID NO: 35742 - protein, 405 aa, Corynebacterium glutamicum ATCC 13032
MAVKTLKDLLDEGVDGRHVIVRSDFNVPLNDDREITDKGRIIASLPTLKALSEGGAKVIVMAHLGRPKGEVNEKYSLAPVAEALSDELGQYVALAADVVGEDAHERANGLTEGDILLLENVRFDPRETSKDEAERTAFAQELAALAADNGAFVSDGFGVVHRAQTSVYDIAKLLPHYAGGLVETEISVLEKIAESPEAPYVVVLGGSKVSDKIGVIEALAAKADKIIVGGGMCYTFLAAQGHNVQQSLLQEEMKATCTDLLARFGDKIVLPVDLVAASEFNKDAEKQIVDLDSIPEGWMSLDIGPESVKNFGEVLSTAKTIFWNGPMGVFEFAAFSEGTRGIAQAIIDATAGNDAFSVVGGGDSAASVRVLGLNEDGFSHISTGGGASLEYLEGKELPGVAILAQ

SEQ ID NO: 35743 - protein, 266 aa, Corynebacterium diphtheriae NCTC 13129
MTLPSPSVHAFAVVTGASQGIGRAMARDLARMGHNVLLVARREDVLRELADQLMTDHSVVAEVYPCDLADADDLRGLVAELQGREVNIIVNSAGIASFGPFMDQDWQYESKQFDLNARAVFELTHAVLPGMVARKSGAICNVGSAAGNVPIPNNATYVLTKAGVNAFTEALHYELRKSGVACTLLAPGPVREAVIPDAEKSIVDRVVPDFLWTTYESCSRETLEAMASNRRRVVPGPLSKIMNAVSLVAPTAVLAPVMGWFYAKMA

SEQ ID NO: 35744 - protein, 405 aa, Populus nigra
MGFLCCSGKPSKRLESSSINENNSNIKRKDQTHVTSGSLKMKPYVNNLSKEGESKDDQLSLDVKSLNMKDEISKDRRSNGKQAQTFTFEELAAATSNFRSDCFLGEGGFGKVYKGYLDKINQAVAIKQLDRNGVQGIREFVVEVVTLSLADHPNLVKLIGFCAEGDQRLLVYEYMPLGSLENHLHDIPPNRQPLDWNTRMKIAAGAAKGLEYLHNEMKPPVIYRDLKCSNILLGEGYHPKLSDFGLAKVGPSGDKTHVSTRVMGTYGYCAPDYAMTGQLTFKSDIYSFGVVLLELITGRKAIDQRKERGEQNLVAWARPMFKDRRNFSCMVDPLLQGQYPIRGLYQALAIAAMCVQEQPNMRPAVSDLVMALNYLASHKYDPQVHSVQDSRRSPSRPGLDKDRGQ

SEQ ID NO: 35745 - protein, 103 aa, Kluyveromyces lactis NRRL Y-1140
MSGRGKGGKGLGKGGAKRHRKILRDNIQGITKPAIRRLARRGGVKRISGLIYEEVRNVLKTFLESVIRDAVTYTEHAKRKTVTSLDVVYALKRQGRTLYGFGG

SEQ ID NO: 35746 - protein, 172 aa, Prochlorococcus marinus str. MIT 9313
MDLRHLIQDVPDFPKPGILFRDISPLLRDPDGWDEVMRQLGDLCTELKPDLIVGIESRGFIVGTALATNRKIGFVPVRKPGKLPGDVLGIDYSLEYGSDRLEIHADALQGHPRVLLVDDLLATGGTARATVELIEKAGGDLVGCGFVIELAALGGRQQLPVEIPVKSLIIYS

SEQ ID NO: 35747 - protein, 352 aa, Lagenaria siceraria
MVPPYALDSLYCSEDHWENDDEEEERGFHEQPYSNLTTESSSPILAVAEQDLFWENDELISLFSREKPNELFKTIQIDPSLAAARRSAVGWMLKVNAHYSFSALTAVLAVDYLDRFLSCFHFQRDKPWMSQLAAVACISLAAKVEETQVPLLLDLQVEDSRYLFEAKTIKKMELLVLSTLQWRMNPVTPFSFVDYISRRLGFKEHICWEILWQCERTILSVILESDFMSFLPSVMATATMLHVFKAMEEPTLSVEYDSQLLNILGIDKGNVEECCKLISNASRRNGNQFKKRKIGSIPGSPNGVMDVSFSSDSSNDSWSVASSVSSSPEPLTKKNRANGSMSGDCETFRTLS

SEQ ID NO: 35748 - protein, 406 aa, Populus nigra
MGFLCFSGKSSKRSENSSIDENNSNIKRKDQTQLTSGSMKVKPYVNDSREEGASKDDQLSLDVKSLNLKDEISKDIRNNGNPAQTFTFEELVAATDNFRSDCFLGEGGFGKVYKGYLEKINQVVAIKQLDQNGLQGIREFVVEVLTLSLADNPNLVKLIGFCAEGDQRLLVYEYMPLGSLENHLHDIPPNRQPLDWNARMKIAAGAAKGLEYLHNEMAPPVIYRDLKCSNILLGEGYHPKLSDFGLAKVGPSGDHTHVSTRVMGTYGYCAPDYAMTGQLTFKSDVYSFGVVLLELITGRKAIDQTKERSEQNLVAWARPMFKDRRNFSGMVDPFLQGQYPIKGLYQALAIAAMCVQEQPNMRPAVSDVVLALNYLASHKYDPQIHPFKDPRRRPSHPGLDKDNGRT

SEQ ID NO: 35749 - protein, 580 aa, Ashbya gossypii ATCC 10895
MSADSVNKFNEKTVVQTAYSPSYASPESTGPFRRFVDSFRREDTSRSGDLEDGEINSTDTTKLQQRMRTRHVVMMSLGTGIGTGLLVANAASLHYGGPAGLLIGYLLVSIVSYIMMHAAGEMAVAYPTLPGNFNAYSSIFISKPFGFATVWLFCLQWLTVFPLELITATIVIKYWKVSVNANVFVVIFYLFIICIHFFGARGYGETEFIFNMCKVLMIVGFVIVGILINVGAIGDTGYIGDRYWRNPGSFVSGTPLDKLKGTAYVLVTAYFSFGGMELYALSVNELPNPKTAIPSACKKGVYRILLVYLLTMIMIGFLVPHDSDRLMGSGSNDVHPSPYVLAIEMHGVKVLPHIVNAVILISVISVGNSAMYSAPRLLCALAQQGYAPKQLDYIDREGRPLISLILCAIFGLIAFSAASDNQEKIFIWLAAIAGLSELFTWTSICLSHFRFRQAMKLQGRSLETLGYRAITGQWGSLYAVFFNLLVFIAQFWVALVPIAKKKVDVLSFFQNYMAFPLWLIMFLGYMVYSRNWTLLNPLDKMDLDTHRRVYDVEVLKQEEYEFKERMRNSPWYVKVLNFWC

SEQ ID NO: 35750 - protein, 329 aa, Solanum tuberosum
MAVNGSAPSSGLIVSFGEMLIDFVPTVSGVSLAEAPGFLKAPGGAPANVAIAVTRLGGKSAFVGKLGDDEFGHMLAGILKTNGVQADGINFDKGARTALAFVTLRADGEREFMFYRNPSADMLLTPDELNLDLIRSAKVFHYGSISLIVEPCRSAHLKAMEVAKEAGALLSYDPNLRLPLWSSEEEARKQIKSIWNYADVIQSSDVELEFLTGSNKIDDESAMSLWHPNLKLLLVTLGEKGLNYYTKKFHGSVGGFHVKTVDSTGARDSFVGALLTQIVDHQAILEDEARLKEVLRFSCAFGAITTRKKGAIPALPTESEALTFLKEEA

SEQ ID NO: 35751 - protein, 243 aa, Prochlorococcus marinus str. MIT 9313
MRKPVIAGNWKMHMTCAQAREYTAMFLPLIEATPNDRHVVIAPPFTAISSMAESVGGTRLELSSQNVHWEDDGAYTAEVSPTMLLEHQVRYAIVGHSEPRKYFSESDEQINRRARSAQAHGLIPIVCVGESDEQRERGEAERVIRRQVEQGLEDTDPDKLVVAYEPIWAIGTGKTCEASEANRICGLIRRWVGASELIIQYGGSVKPGNIDELMAMSDIDGVLVGGASLDPESFARIANYQTS

SEQ ID NO: 35752 - protein, 130 aa, Brassica napus
  misc_feature (9)..(9): Xaa can be any naturally occurring amino acid
MTSVWKTKXLPGLNKIFDKDGKKAAAAEFLKSFNKEEIDKEIGDKKTELEPKLVETIEASPPEIKGLIKDKKTSKIKKNSVAVTKFLDDLAKIDFPGAKLVSDAVAKSGTTPLSPAIVFILDKVAPFVPA

SEQ ID NO: 35753 - protein, 275 aa, Corynebacterium efficiens YS-314
MIIKSKEFAMALPTPSHSARALVTGASQGIGLAIARDLARYGHNLILAARRGELLQEIAEELESRHGVIVEVRAVDLADREQRAELIEEIRGREINIIINSAGIASFGPFKDQDWDYETTQFDLNATAVFELTRAVLDGMLERGTGAICNVGSAAGNVPIPNNATYVLTKAGVNAFTEALHYELRGTGVACTLLAPGPVRESVVPESEQSIVDKVVPDFLWTTYESCSAETLRALSRNRRRVVPGPLSKAMNAISTIAPTAVLSPVMGWVYSKMS

SEQ ID NO: 35754 - protein, 209 aa, Zea mays
  misc_feature (199)..(199): Xaa can be any naturally occurring amino acid
MVMQTEMEMERRAYARVGLLGNPSDVYGGRAVSFAVAGLWATVRLRPSDQLLVQPHPRHDLVAFPSLHALVDRLDGGGYYGGVRLLLAICRIFHNHCKHNGIALEDKNFTLSYDTNIPRQAGLSGSSAIVCAALSCLLDFYGVRDKIRVEVRPNLILNAEKELGIVAGLQDRVAQVYGGLVYMDFSQEHMDKLGHGVYXTPPGRDLLPP

SEQ ID NO: 35755 - protein, 651 aa, Exiguobacterium sibiricum 255-15
MAKTFYITTPIYYPSAKLHIGHAYTTVAGDAMARYKRLQGFDVRYLTGTDEHGQKIQEKAKEAGVSEQEFVDGVVEQIKVLWDRLDISYDDYIRTTEPRHKEVVERVFETLLEKGDIYLGEYEGWYSVPDETYYTESQLVDGKSPDSGHPVELVREECYFFRISQYADRLVEYYEANPSFILPESRKHEMINNFIKPGLQDLAVSRTTFDWGVKVPSNPKHVVYVWVDALTNYISSLGYGTDDQGNFDKYWPADVHLVGKEIVRFHTIVWPALLMALDLPLPKQVFAHGWLLMKDGKMSKSKGNVVDPVPMIDRYGLDALRYYLLREVPFGSDGMFTPEAFVERMNFDLANDLGNLLNRTIAMITKYFDGVIPTYAGNVTPFDETLSTLAKETVEKVEAAMEHMEFSVALSHIWQLISRANKYIDETQPWVLAKDESKTDELASSMVHLVGALRHVAIMLQPFMTRSPKEMFRQLGLEGQPMDWTALEQFAAIEEGTKVGAAEPIFPRRDMKEEVEAIVEMMKQASAARVEEETEVEEEDTDARPETTIDVFDQIELRVGEVVTAEKIKKAKKLLKLTVDMGKETRQIVSGIAEWYEPEDLVGRKVIVVANLKSVTLRGELSQGMVLAAEKSGKLELATVPSTMANGASVK

SEQ ID NO: 35756 - protein, 219 aa, Burkholderia sp. 383
MAFLLHQARFYTTVNHLRDLPPTVQPEIAFAGRSNAGKSTAINVLCNQKRLAFASKTPGRTQHINYFSVGPADEPVANLVDLPGYGYAEVPGAAKAHWEMLLSSYLATRSQLCGLILMMDSRRPLTDLDRRMIEWFVPTGKPIHTLLTKCDKLTRQESINALRTAQKGLDAYRDQGVQGKLTVQLFSAMKRVGLDEAHELIESWVRPSVADEKSEPVAQ

SEQ ID NO: 35757 - protein, 476 aa, Pteris vittata
MNGFFKLVSTFQTQAEPAYCGLTTLVVVLNALSVDPGRRWKGPWRWFDESMLDCCEPLENVKKNGITFSKVSCLAQCAGASVQAFRANESSLDLFRSFVETCASSEDHHLVVSYDRQILKQTGTGHFSPVGGYHRHKDMALILDVARFKYPPHWVPLSLLWEALNSVDEATGKSRGFMMITKRAKPTCFLFTLSCKDQRWRAMCKYLLEEVPYLLKSRGFTTVEEVVYTVFGSLPADVASFVKWIVEVKPAVNGPIEKVDRDETERLRYKSKVLQQLRQTRALALITKWMEQNSVNSPEDESLQTAILQACCQGAAAFRGSNCYSNVKCFKKDVKESNVTSNGARGEAVVMSSRVLVDGCEQVIDALVPKRPSSGNVGGGPVLQQDGIDQVTLEENAFHPTTRDLLAVLLLALPPSTWEQIPDLSIHAEISRIVSRKELPHELQLGVEHLFEQAFFVSRSCTEEALTEEALIETKN

SEQ ID NO: 35758 - protein, 306 aa, Ralstonia solanacearum GMI1000
MISFEQAAILAAASAPPVDRYGVIGNPISHSKSPAIHAAFAQQTGQLMRYERIYAELIAFDETVFSFIREGGRGLNVTVPFKLDAYALATSLSLRAESAGAVNTLKFDGDAIFGDNTDGVGLMRDITHNIGNPLAGERVLLLGAGGAARGILLPLLEHKPSRVFIANRTADRAIGLVQRFEAAAKLHEVELVGGGFDDLAVSDVFDVVINATAGSLQAQVPPIEPTVFGPNALAYDMMYGSQPTVFMQFAKRHGARAWDGLGMLVEQAAESFLVWRGMRPDTAPVLQAMREGLQGEAAVAARAHQR

SEQ ID NO: 35759 - protein, 196 aa, Oryza sativa (japonica cultivar-group)
MVVYTQEHVYRHPWDRVTAAAWRKFTDPASRTALSHVADVHTLHRRVDPEAGRLQAARSITVRSPPLPFILRRLLPAAASSPSGAALCHCVETSLVDAPRRAMDVVVRNVSLRGLIEVEERSTYRPHPERPEEWTQFRQETTIRCRPLSALAAVAEKVETRCAERFLQNSAKGREVVERICRYLEAEAAGAASSAI

SEQ ID NO: 35760 - protein, 130 aa, Zea mays
MVRVSVLNDALKSMYNAEKIGKRQVMIRPSSKVIIKFLTVMQRHGYIGEFEYVDDHRAGKIVVELNGRLNKCGVISPRFDVGVKEIEGWTARLLPSRQFGYIVLTTSAGIMDHEEARRKNVGGKVLGFFY

SEQ ID NO: 35761 - protein, 470 aa, Oryza sativa
  misc_feature (48)..(48): Xaa can be any naturally occurring amino acid
MHMMRRLKSIASGRSSVSDPGGDSGTKRPKFDQDGAGDIVIEPHLTDXNAMRVDQESSSSHRDAEASTSTSKNPGRTEEAGADILPKEMNEMTISDDKVDGHNDKESEGVIVNANGTETGQIIVTSIGGQNGKPKQKVSYMAERVVGTGSFGVVFQAKCLETGETVAIKKVLQDKRYKNRELQTMQLLDHPNVVQLKHHFFSTTERGEVYLNLVLEYVSETVYRVAKYYNRMNQRVPILHVKLYAYQMCRALAYIHRVVGVCHRDIKPQNLLVNPHTHQLKLCDFGSAKKLVPGEPNISYICSRYYRAPELIFGATEYTTAIDIWSVGCVLAELLIGQPLFPGESGVDQLVEIIKILGTPTREEIRCMNPNYSEFKFPQIKAHPWHKLFGKRMPPEAVDLVSRLLQYSPNLRCTAVDACAPHPFFDELRDPKTCLSNGRSLPPLFDFSAAELEGLPVELVHRIIPEHMRK

SEQ ID NO: 35762 - protein, 202 aa, Sinorhizobium meliloti
MSGATLEAYLASCTARGDDLSRDVAAVIQRLAKAALDIRKLVNQGALGTAFNGTHGGSNTDGDLQKDLDILCDDQFLTCLQGAPVACYASEELENPVLLDPSARLAVAIDPLDGSSNIDNNVSIGTIFSVLPAAKGPDVDPSQSFLQPGNRQLAAGFFIYGPQTALVLSLGKGTEIFIFSSRLGCFVEAYKSAIIPERAHEF

SEQ ID NO: 35763 - protein, 253 aa, Bradyrhizobium sp. BTAi1
MIRSDLQDGVNRLGDMIAAAKVIVPFTGAGISTEAGIPDFRSPGGLWTRNRPIDFQEFVASQDARDEAWRRRFAMQETFAAARPSRGHRALAALYRAGKIPAVITQNIDNLHQDSGFAPDHVVELHGNTTYARCIGCGQRYEIGWVQQRYAADNAAPDCPACAAPVKTATVSFGQAMPETEMQRATELAQHCDLFIAIGSSLVVWPAAGFPLMAKQAGARLVIINREPTDQDDVADLVIHDDIGEVLGPFLRN

SEQ ID NO: 35764 - protein, 1102 aa, Prochlorococcus marinus str. MIT 9313
MPRRSDLRRILLLGSGPIVIGQACEFDYSGTQACKALRDEGFEVVLVNSNPASIMTDPEMADRTYIEPLTPEVVTRVIELERPDALLPTMGGQTALNLAVELAENHTLERFGVELIGADLAAIRKAEDRQLFKQAMERIGVNVCPSGIASSLKEAEEVGEVINSFPRIIRPAFTLGGSGGGIAYNPEEFAAICKSGLDASPVSQILIEKSLLGWKEFELEVMRDLADNVVIVCSIENLDAMGVHTGDSITVAPAQTLTDREYQRLRDQSIAIIREIGVATGGSNIQFAINPDDGEVVVIEMNPRVSRSSALASKATGFPIAKIAARLAVGYTLDEIINDITGKTPACFEPTIDYVVTKIPRFAFEKFKGSPAVLSTAMKSVGEAMAIGRCFEESFQKAMRSLEIGRAGWGCDRQEPEFTPTEIERLLRTPSPERIMAVRTAMLAGRSDHDIYALSKIDIWFLAKLRHMINIETTHLHGRTLDELDQQSLLCLKQLGYSDRQIAWATGSEELAVRARRELLNIKPVFKTVDTCAAEFSSTTPYHYSTYERPLYRLDSDDQLYKLEPESEVVTDNRAKVMILGGGPNRIGQGIEFDYCCCHASFASQDKGFVTVMVNSNPETVSTDYDTSDRLYFEPLTLEDVLNVIEAERPNGVIVQFGGQTPLKLAIPLLRWLESSIGKSTGTRIWGTSPESIDRAEDREQFEAILRQLQIRQPRNGLARSEKDARAVALRIGYPVVVRPSYVLGGRAMEVVFDEQELNRYMAEAVQVEPDHPVLIDQYLENAVEVDVDALCDSDGVVVIGGLMEHIEPAGIHSGDSACCLPSISLGEQALRTIRLWSEALALALKVQGLINLQFAVQRDEAGDEQVFIIEANPRASRTVPFVAKATGVPLARIATRLMAGETLAAIGLTHEPQPPLQSVKEAVLPFRRFPGADSVLGPEMRSTGEVMGSASSFGMAFAKSEIAAGDSLPIRGTVFLSTHDRDKPALILVAERLIELGFDLTATSGTAQALNRAGLNVQPVLKVHEGRPNIEDLIRSGQIQLVINTPIGRQAAHDDKYLRRAALDYSVPTLTTIAGARAAVEGITALQQQSLSVAALQDIHV

SEQ ID NO: 35765 - protein, 211 aa, Kluyveromyces lactis NRRL Y-1140
MLSKRSLRLVSLTGMVIFVLFFIRHNAESVTRSYVGKESSNLANDAKVESDINNIQEGIAETKSNAVVADTSNAVKNMAGPNGVKDSDFAAEVETYNAEAEYKNILSQSPIVVFSKSYCPFSTRLKNLLKEYEFDPIYTIVELDKHENGAELQKYIGSKTGRSTVPNVIINGISRGGSDEFAGLHEDNSLLQSLKTWAGSTLSVKKAAAAT

SEQ ID NO: 35766 - protein, 423 aa, Corynebacterium efficiens YS-314
MTTHPLTMPIPEYFEEILESVRSDVSGEVAQYIPQLKDADPNPLALAMCTVDGHIYGAGDDEHEFTMQSVSKPFAYALALQEQGPEKVFATVGLEPSGEAFNELSLDGSTNRPMNPMINAGAIAVNQLINGSESSVEDRVEKIRSYFSALAGRELNIDRQLSETEIEGADRNLSIAHMLRNYGIIEDDAHDAVLSYTLQCSVKVTARDLAVMTATLAAGGTQPLTGEKLVDARVARLVLSTMASAGMYDEAGQWLATVGIPAKSGVSGGLVGVLPGQLGLATFSPRLNSQGNPVRGVEIFKALSEDMGLHLMSAELLTQHAVRAIEERGDTTVIQLQGAMNFSAAENFLFTVTDHDFTGEKVVLDISRVPMFRPMGRRLVKEGLRRIRDNGFKVAIYDPEDILPDFDFSDGTKSPQVDDPEEL

SEQ ID NO: 35767 - protein, 453 aa, Ashbya gossypii ATCC 10895
MWRARTMASQEEFYRTQIFGTVFEITNRYADLNPVGMGAFGLVCSAVDTYTQQPVAIKKIMKPFSTAVLAKRTYRELKLLKHLRHENLICLEDIFLSPLEDIYFVTELQGTDLHRLLQTRPLEKQFLQYFLYQILRGLKYVHSAGVIHRDLKPSNILINENCDLKICDFGLARIQDPQMTGYVSTRYYRAPEIMLTWQKYNVEVDIWSAGCIFAEMIEGKPLFPGKDHVHQFSIITDLLGSPPKDVIDTICSENTLKFVTSLPHRDPVPFTERFKNLKPDAVDLLEKMLVFDPKKRITAGDALTHPYLAPYHDPTDEPVADAKFDWNFNDADLPVDTWRVMMYSEILDFHQVPDSQINPNDTFDDQVAAATAAAEAARQQQQQKQQQQKQQQQRHQGVEHGAQHVQLQHGAKQLSADPLVGDSNGGIPLNVSAANETLNNFANQAAQYATDFE

SEQ ID NO: 35768 - protein, 462 aa, Arabidopsis thaliana
MEIFYFVVFGGLAAIVAGLELSKSNKDRINTSSAFNSFKNNYLLVYSLMMAGDWLQGPYVYYLYSTYGFGKGEIGQLFIAGFGSSMLFGTIVGSLADKQGRKRASITYCITYILSCITKHSPQYKVLMVGRVLGGIATSLLFSAFESWLVAEHNKRGFEQQWLSVTFSKAIFLGNGLVAIIAGLFGNYLVDSLSLGPVAPFDAAACFLAIGMAVIISSWSENYGDPSENKDLLTQFKNAASAIASDEKIALLGAIQSLFEGSMYTFVFLWTPALSPNEEDIPHGFIFATFMLASMLGSSIVSRLLAHSSPKVESYMQIVFVISSAALMLPVVTSFLVAPSGVKGGSISFSGCIQLMGFCTFEACVGIFWPSIMKMRSQYIPEEARSTIMNFFRIPLNIFVCLVLYNVDAFPMTVMFGMCSVFLFVASILQRRLMNVAEIHKSRSQEWSAEKEMTSEADPLNP

SEQ ID NO: 35769 - protein, 298 aa, Kluyveromyces lactis NRRL Y-1140
MSSIFKTLSRKDKDGKKNKNNAANSDSNEKQFMNKQRTLLITSRGVTYRHRHLVQDLNSLLPHSRKEPKLDTKKDLGQLNEIAELYNCNNIIFFEARKHQDLYLWLSKPPNGPTIKFYLQNLHTMDELNFTGNCLKGSRPILSFDGRFDSEPHYRLIKELFIHNFGVPPQARKSKPFIDHIMSFSIVDEKIWVRTYEISHEARNNVEYEDKEEDETSLVEIGPRFVMTPILILEGSFGGPKIYENRQYVSPNFVRSQIKQQAAKEAKTRAEAAVERKLKKRESVLAVDPLSNDALFKD

SEQ ID NO: 35770 - protein, 286 aa, Solanum tuberosum
MFRRKNHSNSEQGVEDQQQKVKELRASLGQLSGRSTQFCTDACLKRFLEARNWNVDKAKKMLEETLKWRLSFKPEEIRWNEVAKEGETGKVFKANFHDRHGRTVLILRPGMQNTAALDNQMKHLVYLIENAIFNLPEGQEQMVWLIDFTGWSITNNVPVKSARESINILQNHYPERLAAAILYNPPRLFETFWRIVKYFMDPKTFQKVKFVYPKNKDSAELMKSYFDVDNLPTEFGGTATLNYDHEEFSRLMAQDDVKAQVFGVGQTPPCPGGNGSYSAVEVAPEP

SEQ ID NO: 35771 - protein, 405 aa, Triticum aestivum
  misc_feature (252)..(252): Xaa can be any naturally occurring amino acid
MSPAYATSHIDHLPKMERSVEAFQVDNPYQPVADNTNLPAPDFEEPKFEEDRTAAQVMDASLRDSDFEHLQIIKNEDLEELRELGSGTFGTVYHGKWRGTDVAIKRIKKSCFTGRSSEQERLAQEFWREAEILSKLHHPNVVAFYGVVKDGPGGTLATLTEFMVNGSLRHVLQRKDKCPDLRKRLIIAMDAAFGMEYLHSKNIVHFDLKCDNLLVNLRDHARPICKVGDFGLSKIKRNTLVSGGVRGTLPWXMAPELLNGSSSKVSEKVDVFSFGIVLWEILTGEEPYANMHYGAIIGGIVNNTLRPPVPANCGPEWRRLMEQCWSPDPSQRPAFTEIAARLRSMSAAANQQGQGSGGGQVERRKRNRRLGLGSASGDRWSLLYVLSVCLSVIELRVVSVKILVR

SEQ ID NO: 35772 - protein, 465 aa, Desulfotalea psychrophila LSv54
MTKQLDTIIVGAGLSGLTVAHKLRLKDKLHSLLIIDREEQSGGVIRTHRQDGFISEIGPHGFLDNNPASKLILAETGLDKETVKAPLMDFVRYVYLHDKLNLIEQTPGKIIMAPLISWPAKFRVLADLWKRPLEGDPSIAKWVEHRFGPALLPFIDAIFTGTYAGDYETLTVGSVWPGVRELEKKHGSVIRGLIARWIAKKRTGDKTPMNMPSMTSFAEGMARLPERLSEGLSAEELLLNTDVTAIARGENGWAVKTGTGEEYRATQLVLALPTNEALRLLAPLNTGMPMQKIPEARIASVIMGFKGATLPPGFGFLTPEVEKRFSLGCLFSSNMFPGRAPEGHVVIETLVGGKRHPERLNLDDETIIERALADIRAILDLPNPPVYTRVLRSKSGIPQLEEGYPELLSWRDALVRTYPGLHLCGFGWEGIGLNEMMKAGTRVAEAVLDAGGSASAQAEIKGIYF

SEQ ID NO: 35773 - protein, 486 aa, Pseudomonas fluorescens Pf-5
MIKHWINGREVESREVFTNYNPATGEAIGEVASGGAEEIAQAVAAAKDAFPKWANTPASVRARLMRRLGALIEENVPHLAELETLDTGLPIHQTRNVLIPRASHNFDFFAEVCTRMDGHSYPVDDQMLNYTLYQPVGVCALVSPWNVPFMTATWKTAPCLALGNTAVLKMSELSPLTANELGRLAVEAGIPAGVLNIVQGYGATAGDALVRHPDVRAISFTGGTATGKKIMQTAGLKKYSMELGGKSPVLIFEDADLERALDAALFTIFSLNGERCTAGSRIFIQESVYPQFVKEFAARARRLIVGDPQDPKTQVGSMITQAHYDKVTGYIRIGLEEGATLLAGGLERPANLPAHLARGQFIQPTVFADVDNQMRIAQEEIFGPVVCLIPFKDEAQALQLANDTEYGLASYIWTQDIGKAHRLARGIEAGMVFINSQNVRDLRQPFGGIKGSGTGREGGEYSFEVFAEIKNVCLSMGSHHIPRWGV

SEQ ID NO: 35774 - protein, 331 aa, Kallichroma tethys
MGSIPAANVPRIDVSPLFGDDKEKKLEVAKAIDAASRGSGFFYAVNTGVDLPKLSSETKKFHMSMTDEEKWQLAIRAYNKDHQSQIRCGYYLSIPGKKAVESFCYLTPEFTSEHPRIANPTPMHEVNVWPEEEKHPGFRDFAEGYYRDVFGLSKALLRGYALALDKEEDFFSRHFRLTDTLSSVVLIRYPYIEDYPEPAIKTAEDGTKLSFEWHEDVSLITVLYQSDVQNLQVQTPQGWMDIEPDDTGFLINCGSYMAHITDDYYPAPIHRVKWVNAERQSLPFFVNLGWEDTINPWNPAHADATPDKPSISYGEYLHGGLAGLIKKNGQT

SEQ ID NO: 35775 - protein, 325 aa, Bacillus licheniformis ATCC 14580
MKYTFNEEKEFDIVAIGRACIDLNAVEYNRPMEQTMTFSKYVGGSPANIAIGSSKLGLKTGFIGKIPDDQHGRFIETYMRNTGVDTSQMAVDKDGHKAGLAFTEILSPEECSILMYRDDVADLYLAPSEVNEDYIAKSKMLLVSGTALAKSPSREAVLKAVQLAKKHQVKVVFELDYRPYTWTSAEETAVYYTLVAEQSDIVIGTRDEFDVMENKSGGSNEESVQHLFAHSADLVVIKHGVEGSYAYSKSGDVFRAKAYKTKVLKTFGAGDSYASAFLYGLVSGKDIETALKYGSASASIVVSKHSSSEAMPTVAEIEELIAAQS

SEQ ID NO: 35776 - protein, 335 aa, Chlamydophila caviae GPIC
MKVVINGFGRIGRLVLRQVLKRNSSVDVVAVNDLVPGEALTYLFKYDSTHGRFPADVSYDNGYLVVDGRRIQLLDQRDVQKLPWKDLGVDVVIESTGLFTKKEDAAKHLDSGAKRVLITAPAKGDVPTFVMGVNENAFDPEKDTIISNASCTTNCLAPLAKVLLDNFGIEEGLMTTVHAATATQSVVDGPSKKDWRGGRGAFQNIVPASTGAAKAVALCLPELKNKLTGMAFRVPVADVSVVDLTVRLQKSTTYEEICKAIKNASETNLRGILGYTDQEVVSSDFIGCEYSSIFDAGAGIALTDRFFKLVAWYDNEIGYATRIVDLLEYVAKNSK

SEQ ID NO: 35777 - protein, 146 aa, Corynebacterium efficiens YS-314
MGEHLAAELGLEYKDGDELHPQSNIDKMASGQALDDDDRAWWLVQVGKWLRDRDSGVIACSALKRSYRDLIRTKAPGTIFVHLHGDYDLLLSRMNSREDHFMPSTLLDSQFATLEPLGEDEEAKVFDIALSVDEIVAEAADWVRNR

SEQ ID NO: 35778 - protein, 113 aa, Debaryomyces hansenii CBS767
MFEYIKSWFVSPPVSPVIKAEVQNLIDSNKILIFLKSYCPYCDSTKDLIKSITSDFKVVELNTSANGRTIQDALREMTGQNTVPNIFINRKHIGGNSDLQALQGAGKLKSLVN

SEQ ID NO: 35779 - protein, 452 aa, Bacillus licheniformis ATCC 14580
MLKLFKPAPPIERLPEDQIDSEYKKFRLQVFLGIFIGYAAYYLIRKNFSLAMPYLIEEGFSKSALGFALSALSISYGLSKFVMATISDRSNPRMFLPAGLILSAVISLLMGFVPFFTSSIAIMFIMLFLNGWFQGMGWPPSGRVLVHWFSVSERGNKTAIWNVAHNVGGGLMAPIAVAGVAIFSGITGSATGYEGVFILPALVAIAVAVISYWLIRDTPQSVGLPPIEEYRNDYSSKSKKTFEKELSTKEILFKHVLNNKWVWAIALANIFVYFVRYGVLDWAPTYLSEEKGFDMSKSSVAYFLYEWAGIPGTLLCGWISDKWFKGRRGPAGFVFMAGVLIAVLVYWFNPAGNPMIDMASLIAIGFLIYGPVMLIGLQALDFVPKKAAGTAAGLTGLFGYLGGTLTANALMGVIVDASGWNAGFTLLTASCAIAALIFAMTWNVRGQEVVKH

SEQ ID NO: 35780 - protein, 301 aa, Glycine max
  misc_feature (267)..(267): Xaa can be any naturally occurring amino acid
MPATDYQGSSSPSSLTHFGRSILSLRQEQVHSISMEGSSLEAELESFQQHVTDRFLELTSVVHDDLLSLSWVGKLLHCFLCCQEEFKAILHSHRAQVLRPPLDRMVSEYFERSVKALDVCNAIRDGIEQIRQWQKLLEIVLYALGHQRSIGEGQFRRAKKALIDLHIGMLDDQDSNASIAHRNRSFGRSTGSRDSHSHGNNHSNNNTYHHRSLGHFRSLSWSVSRTWSAARQLQAIGNNIYPPKANELMASGGLAMPVFIMNSAPVXCVMLALVAAIPCQDRGLHVHFTIPRNYSWAAAIL

SEQ ID NO: 35781 - protein, 346 aa, Solanum tuberosum
MMDKKLISLWFESAAKKIGVGVVAIDGTILSNPRHTYITPPGQGFLPRETAQHHHQHILPLVKSALETAGVTPDEIDCICYTKGPGMGAPLQVSAVVVRVLSQLWKKPIVGVNHCVAHIEMGRIVTGAVDPVVLYVSGGNTQVIAYSEGRYRIFGETIDIAVGNCLDRFARVLTLSNDPSPGYNIEQLAKKGEKFIELPYVVKGMDVSFSGILSFIEATAEEKLKNNECSPADLCFSLQETLFAMLVEITERAMAHCDKKDVLIVGGVGCNERLQKMMQIMCSERGGNLFATDDRYCVDNGAMIAYTGLLEYANGASTPMEESTFTQRFRTDEVLATWREKESAIA

SEQ ID NO: 35782 - protein, 455 aa, Vibrio fischeri ES114
MPSYLSMDEFIAACKRPLRRSIRVNILKNSVEEFKQRAAEKQWDLEPVPWCDTGFWITRPESDTVKLGSTAEHMAGLFYIQEASSMMPVTALLKDNDDIEMALDMASAPGSKTTQLAAGMKNQGALVANEFSSSRVKVLCSNIQRCGVSNVALTHFDGRVFGGWLPETFDSILLDAPCSGEGTIRKDPDAMHNWSPESVIEIGDTQRDLIESAFHALKLGGVMVYSTCTLNHEENQNICHHLVEQFGDAVTFEPLGDLFESAEKALTKEGFLHIYPQIFDSEGFFVAKIRKNSSTTPPEVKKRLGKFPFAPASNKEAQAIEAELKSTLQLAIPEDNEFWIRDKEVWAFPKRMKPLIGEMRYHRIGFKLAETHKKGYRWQHEAIMALATADNPTCAELNTEQAREWYMGRDVRPDFSGKGETIVTYKGAVIGLGKWVGNRIKNGLPRELVRDGNLF

SEQ ID NO: 35783 - protein, 141 aa, Chlamydophila caviae GPIC
MEQTLSIIKPDSVGKAHIGEIVAIFEKSGFRIAAMKMVHLSVKEAEGFYAVHKSRPFFQELVDFMISGPVVVMVLEGDNAVVRNREIMGATNPQEAAQGTIRAQFGESIGINAVHGSDSLENAAIEINYFFSKIEIVNSAK

SEQ ID NO: 35784 - protein, 556 aa, Rhodospirillum rubrum ATCC 11170
MYRYDEFDAAIVADRISEFRDQVNRRLSGELDEEAFRPLRLMNGVYLQLHAYMLRVCIPYGEINATQLRRLGAIAQRYDRGYGHFTTRQNIQFNWVALSDIPAVLEELAEVGMHAIQTSGNCIRNTTTDPLAGVAADEVEDPRPWAELIRQWSTFHPEFTFLPRKFKVAITGASHDRAAIRFHDIGLELAPIGGGEIGFKVFVGGGMGRTPRLGRLLRDDLPKQHLLSYIEAILRVYNRQGQRENKYKARIKILVDSLGVEAFRAEVDAEWEAMGRATIDVPEAEIARIQSYFVPQDSAPEDGGLAASRAITKRRASDPAFAGWLDANVHAHKVAGHAGVTISLKPAGGIPGDATTAQLETIADLAERYSKGLLRVTHEQNLLLPHVRQEDLPALWAALVAAGLETANVGRIGDIISCPGLDYCSLATARSIPIAQALSARFADPARLRDIGPITLNISGCINACGHHHAGNIGILGLEKTGNEAYQLVLGGAADETAAIARITGQGFSADAIVGAVETVVDTYIGLRQDGETFIETFRRVGVTPFKEALYGSVAA

SEQ ID NO: 35785 - protein, 184 aa, Ceratodon purpureus
MSATKHGDPRIQYISDSIRAIPDFPHKGIMFRDVTTLLLDHKAFKDTIDIFVERYRDQKIDVIVGIEARGFIFGPPIALAIGAKFVPMRKPRKLPGPVIRQEYSLEYGTDCIEMHVGAIEKDERVVLIDDLIATGGTLGAAIKLLDQVGAEIVECGCLIELVDLKGREKLSGKPLYILVEYEGE

SEQ ID NO: 35786 - protein, 174 aa, Escherichia coli
GEVLMLGYMNPEALDKTIESGKVTFFSRTKQRLWTKGETSGNFLNVVSIAPDCDNDTLLVLANPIGPTCHKGTSSCFGDTAHQWLFLYQLEQLLAERKSADPETSYTAKLYASGTKRIAQKVGEKGVETALAATVNDRFELTNEASDLMYHLLVLLQDQGLDLGKLIDNLKNRH

SEQ ID NO: 35787 - protein, 145 aa, Glycine max
MAGRVALAAVLLCTAAAMAAAQSASNVRATYNFYNPEKINWDLNTASAYCATWDAGMSLAWRSKYGWTAFCGPAGPTGQASCGKCLQVTNTATGAQITARIVDQCSNGGLDLDYDTVFSKIDTNGVGMQQGHLTVNYQFVDCGDN

SEQ ID NO: 35788 - protein, 130 aa, Zea mays
MVKTSVLNDALNAINNAEKAGKRQVLIRPSSKVIVKFLRVMQKHGYIGEFEEVDDHRNGKIVIQLIGRINKTGVISPRYNVQLRDMEKWVVKLLPSRQFGFIVLTTSAGIMDHEEARRKHVAGKILGFFY

SEQ ID NO: 35789 - protein, 682 aa, Candida albicans SC5314
MNPSNNSDEEDQADYDDKEDDDISDEEPVNPADEEDLKDYVPGGYHPCYIGEEYKNGKYTLVRKLGWGHFSTVWLARDNDKHCHVAMKVVRSAKHYTETAIDEIKLLDKVTTSDIHHPGHQHVIQLLDTFTHKGPNGVHVVMVFEVLGENLLGLIRRYKHRGIPVVFVKQIAKQLLSALDFLHRQCGVIHTDLKPENILIEIGDVEQIVKLVEEENLQRKLQRKLSRTASKTSTPISATPNSSFSNHANTTTTTTTTTAKKISINDSIISPNTSSTALTSSNSFINHSPSLGRSGRRTRRTTLITGSQPLPSPLRSFNKSFTNVYGLSSSTTNTPVRNISINSNNFSFINNSNTTANTTTNGLATTTEDHEEDGENQTLNNSLSSMSITNSHSNSNSYQPTATTNVDPVQIPQESNYSLDDSSANVVEDIINDNELISVKIADLGNACWTNHHFTDEIQTRQYRAPEILIGYYWGASSDLWSFACLIFELLTGDYLFDPRDGKSYKKDDDHIAQIIELIGPFPNQMLKESYYAREFFNSRYELRRIMKLKPWGLQDVLIEKYKFPLNDAIEISEFLLPMLKLKPEERADAGGMLNHPWLRDALGLENVVLERPVGGSGEDIPGWSREISTTTQQSMCSNNHNHNNTHNNNYNHQADQELQSQQSRKYSNASSFGHKSQPFYH

SEQ ID NO: 35790 - protein, 484 aa, Zea mays
RPRAWTASIHSAQHPHLVSRHREAEAAAAGLAGRSFASFSPPPPTPRLASSSALPSPRRQRQRGRIKRSPSARVRTIATASPLLDKTNGGCCVLRSARRLAPSPPPSLDPSPPAVATRRSVRVAPAAKRGPGSGGGRLVARSAVAAKADEAAAAAGSKSGGHELLMFEALREALIEEMNLDPTVCVMGEDVGHYGGSYKVTKGLAEMFGDLRVLDTPIAENSFTGMGVGAAMKGLRPVVEGMNMGFLLLAYNQISNNCGMLHYTSGGQFKIPVVIRGPGGVGRQLGAEHSQRLESYFQSIPGLQMVACSTPYNAKGLMKAAIRSENPVVLFEHVLLYNLKEKIPDEEYICCLEEAEMVRPGEHVTILTYSRMRYHVMQAAKTLVNKGYDPEVIDIRSLKPFDLHTIGNSIKKTHRVLIVEECMRTGGIGASLRSAIIDNFWDYLDAPIMCLSSQDVPTPYAATLEDATVVQPAQIVAAVEQICQ

SEQ ID NO: 35791 - protein, 1577 aa, Ashbya gossypii ATCC 10895
  misc_feature (426)..(426): Xaa can be any naturally occurring amino acid
MASVGLEKVNILGRDSIHVGYDLRAHIARTVFESCVSSTYVVVSDANVARVPYHEALCAALEEGLPARSRMLRYVVQPGETYKTRETKGEIEDFMLAEGCTRDTVVLAVGGGVIGDMVGFVAATFMRGVRFVQVPTSLLAMVRSSMVGKTTVYTRTVKIFIGSFWQPEFVFVDVKWLKTLPRREFINGMSEVIKTACIWNAAEFMRLEMHASMFLQVVNSSKQVKVDTKGGPTSLSYTNITQILDHVFQLVLESIKVKAHVVSSDERESGLRNLLNFGHSIGHAYEALLTPQALHGECVSIGMVKEAELSRYLNILSPTQVARLTKVLSAYGLPTSVNEGWFRELTLGKRTPLEVLLRKMSIDKKNDGSNKKVVLLETIGKCYGTSAHVVSDTDLRFVLTDEALVYPFTEVRSSTGHTIVPPAYKXIANRPLILAALGKGKCRIRNLLHSDDTKHMLEAVQQLNAATISWEDNGDTVVIDGHGGRTLTASDLPLYLGNAGTASRFLASVASLVCPEGNRDSVILTGNARMQERPIGPLVESLRLNGVRVDYLNREGSLPIKVHAESKFRGGRINLEASISSQYVSSILMCAPYAEEPVTLSLDGKPISELYIEMTIRMMEKFGIKVEKSNDELYTYHIPRGQYVNPAEYVIESDASSATYPLAFAALTGTTVTIPNIGHDSLQGDSRFACDVLKPMGCTVQQTATSTTVTGPEPGTLKPLEHVDMEPMTDAFLTACVVAAAAHSPESKCKNIITITGIANQRVKECNRILAMVTQLSKFGVTAEELPDGIQVHGVEQLSQLKVPDAVETYDDHRVAMSFSLLAGMVNYGQAPSSCRPIKILERRCTGKTWPGWWDVLHSRLGATLDGNEPLPEKENDIRKSVVLIGMRAAGKSTVGRWCAEALGYKLLDLDDEFQTYFGMGTVKEFVAQNGWESFRSKETDLFGHVLNKYSRSGYVISTGGGIVETASSRKLLQDFAATGGVVLHLYRDIDETIKFLRTDPTRPAYIEEVRGVWDRREKWYHLCSSYSFFSPHCSTTAEFEGLRRVFSKFIRRITGMLEVEVPVKRSTFVCLTFQNLLPEMERIKEAVYGCEAVEVRVDHLENYSQDFVLKQLTALRLATDSLPIVFTIRTKKQGGKFLDNDYSTLEDLLTVGLKAGVEFLDLELTLPSPIHQRILNKRYKTRIIGSHHDFSGEFSWEHPEWEHRYAQALAMQVDAIKFVATAKGFGDNLSLEEFRSKHTDKPLIAINMRECGKLSRVLNTILTPITSDVLPQAAAPGQLTLRQINELYASIGGLRPKKMFVVGSPIGHSRSPILHNTGYNSLGLPYTFDKFETDSAEIVKKSLLSREDLGGIAVTIPLKQDIMQYLDELTDSAKCIGAVNTIIPKKDGRFIGHNTDWLGIKNSLIANGVPEHVNTAGLIVGSGGTARAAAYAFHEMQCSTIYMINRTTSNLTELQKSFPQEFNIHVIESLEQIEQLSEPVGIAVSCVPSDKPLDDALSQKLSAFLSRPSATNFIPTILDAAYKPLVTPVLKLASEVHGWRPVSGAQMLVHQGVAQFEIWTGFKAPFAPVYDAVTQE

SEQ ID NO: 35792 - protein, 278 aa, Medicago truncatula
MAKGKHTHPRSQVKKLSTLILLTLFMLTLVIIVLLALGILYLPNTTDDSLITDRRKIYESLAEKKEQWTEILSWEPRAFVYHNFLSKEECEHLINLAKPFLAKSSVVDSKTGKSTESRVRTSSGMFLKRGKDKIIQNIERRIADFTFIPVENGEGLQVLHYGVGEKYEPHYDYFLDEFNTKNGGQRVATVLMSDVEEGGETVFPAAKANFSSVPWWNDLSECARKGLSLKPKMGDALLFWSMRPDATLDASSLHGGCPVIVGNKWSSTKWMHLEEYKV

SEQ ID NO: 35793 - protein, 358 aa, Solanum tuberosum
MSCYKGKYADELIKNAAYIGTPGKGILAADESTGTIGKRLSSINVENVESNRRALRELLFCTPGCLQYLSGVILFEETLYQKTAAGKPFVEVMKEAGVLPGIKVDKGTVELPGTDGETTTQGLDGLAERCQKYYEAGARFAKWRAVLKIGANEPSQLAINDNANGLARYAIICQQNGLVPIVEPEILVDGAHDIQKCADVTERVLAACYKALNDHHVLLEGTLLKPNMVTPGSESPKVAPEVIAEYTIRALQRTMPPAVPAVVFLSGGQSEEQATVNLNAMNKLQTKKPWSLSFSFGRALQQSTLKAWGGKEENVQKAQAAFLTRCKANSDATLGKYAGASNLSEGASESLHVKDYKY

SEQ ID NO: 35794 - protein, 338 aa, Arabidopsis thaliana
MRETKKEEEEVEEEEAMNALAATNRNFKLAARLLGLDSKLEKSLLIPFREIKVECTIPKDDGTLASFVGFRVQHDNARGPMKGGIRYHPEVDPDEVNALAQLMTWKTAVAKIPYGGAKGGIGCDPSKLSISELERLTRVFTQKIHDLIGIHTDVPAPDMGTGPQTMAWILDEYSKFHGYSPAVVTGKPIDLGGSLGRDAATGRGVMFGTEALLNEHGKTISGQRFVIQGFGNVGSWAAKLISEKGGKIVAVSDITGAIKNKDGIDIPALLKHTKEHRGVKGFDGADPIDPNSILVEDCDILVPAALGGVINRENANEIKAKFIIEAEIIQLIRTRMRS

SEQ ID NO: 35795 - protein, 478 aa, Listeria innocua Clip11262
MEHQKRSPFPKDFLWGSASAAYQIEGAWDADGKGKSVWDEYVRIPGTTFKGTNGDVAVDHYHRYKEDVKLMAEAGLKAYRFSIAWTRIFPNGKGEVNEAGLKFYDNLIDELLKYDIEPLVTLYHWDIPQALFDEYGGWESRQVIEDFTNYSTTLFKRYGDRVKYWVSLNEQNIFVGMGYGQALHPPKVSDPKRMYAVNHIANLANASVIKAFHEIVPDGKIGPSFAYTPHYPIDTDPKNVQAADDAEELNSYFWMDMYAFGRYPKAVWKYLEENDIAPVIEDGDMELLASAKPDFMGVNYYQSATVAYNPLDGVGQNNEMNFTGKKGSTKETGVPGVYKKVVNPFVKTTNWDWTIDPKGLQIALRRINSRYALPILITENGLGEFDKLVDGEVNDDYRIDYLSAHATAIRDAISDGVDMLGYCTWSFTDLLSWLNGYQKRYGFVYVDRDVEDDAPMTRIPKKSYYWYKQVIETNGADL

SEQ ID NO: 35796 - protein, 159 aa, Solanum tuberosum
MKKVILKLEYFDEKIKQKAMKKVSGLEGVESISIDSKDKKLTITGNIDPVSLVSKLRKLCHTDIVSVGPAKEPEKKKDDGAKKDEGAKKDEGKKDDAKKGDDKKGGDDKKKEEAPPVMKAFPAPMLYHYQHPYQHYQPPVPAYYHHRSVEEDPNSCVIC

SEQ ID NO: 35797 - protein, 204 aa, Oryza sativa (japonica cultivar-group)
KVINRRKMQLLGVACLLIASKYEEICPPQVEELCYISDNTYTKDEVLKMEASVLKYLKFEMTAPTTKCFLRRFLRAAQVCHEAPVLHLEFLANYIAELSLLEYSLICYVPSLIAASSIFLAKFILKPTENPWNSTLSFYTQYKPSDLCNCAKGLHRLFLVGPGGNLRAVREKYSQHKYKFVAKKYSPPSIPAEFFEDPSSYKPD

SEQ ID NO: 35798 - protein, 205 aa, Glycine max
IPLWNRRDSSTQTSVLHNLVVGTPVISATYDQLQKSARYLPGPATQCQYSTTTSKQMRLGTNISETVKRKLSLGAHILRVGGVEKVFKQFFSVEDGEKLLKVSQCYLSTTSGPLAGFLFISTDKVAFCSERSMKIFSQKGHMLRIRYKVVIPLKKIKCVNQSQNIQNPTQKYIEIVTEDNFDFWFMGVLKYQKTFKYLEQAVSQA

SEQ ID NO: 35799 - protein, 507 aa, Yarrowia lipolytica CLIB122
MNATQPESHIVQWLTWTQDTIGFGTLAATVLLIALLYDQFSYVKSKGSIAGPPLKMWPIIGPFLDSINPDFEKYKAQWASGALSCVSVFHKFVVLASDRDLTRKIFNSSAYVKPCVVDVAIKILRPTNWVFLDGKAHVDYRRGLNGLFTNRALSMYLPIQEGIYDTYFDKFVEMSKDGHVPYMPIFREINCALSLRTFCGNYITEEQIKEIAHDYYLVTAALELVNFPIILPFTKAWYGKKAADKVMDIFAKCAQMAKDHIKAGGDVTCTMDAWIAIMNGRDFDSDHGTVPNKKIRKFTNKEISETIFTFLFASQDASSSATTWLFQIVADRPDVYAKIREEQLAVRGGDPNVPLSLELTEKMTYTNMVVKECLRLRPPVIMVPYVAKKDFPISDTYTVPKGSMIIPTVYPSLHDPEVYERPDEFVPERWLPDGDGTKNAKNWLVFGTGPHYCLGQKYALMNFTNMIGKACMNLDFTHKVTPLSEKVRVFATIFPDDDCLLQFKKRE

SEQ ID NO: 35800 - protein, 251 aa, Pseudomonas syringae pv. phaseolicola 1448A
MRRPMVAGNWKMHGTRASVAELIEGLGKQVLPGSVDIAVMPASLFTNQVIEGLRATSIIVGAQDAAIQAEQGALTGEIASSQLADAGCKLVLVGHSERRQLIGEQDDVLNKKFAAIQASGLTPVLCIGETLEERKAGQTLEVVGRQLDSVIAEFGVSALINAVIAYEPVWAIGTGLTASPQEAQEVHAAIRAHLAKENAEVAQGVRLLYGGSVKAANAVELFSMPDIDGGLIGGASLNADEFGAICRAAGN

SEQ ID NO: 35801 - protein, 522 aa, Oryza sativa (indica cultivar-group)
MAISLITSLLFSLPQQWQPVVLTGLLPVIVSLVLLARKGRLKMPPGPEQVPLLGNLHQLAGPQPHRALRDLARVHGPVMRLRLGKASAVVLTSAEAAWEALRGHDLDCCTRPVSAGTRRVTYGMKNVAFAPYGAYWREVRKLLMVELLSARRVKAAWYARHEQVEKLLSTLRRAEGKPVALDEHILSLSDGIIGRVAFGNIYGSDKFSQNKNFQHALDDVMEMLSGEGSSAEDLQLPAAVGRLVDRLTGFAARRERIFRQLDSFFEMVIEQHLDPNRAPPENGGDLVDVLIDHWKKNEPRGTFSFTKDNVKAIIFSTFVAGIDTNAATILWAMSELARKPRVLKKVQAEIRAAVGVNGRVQPDDITKLSYLRKVVKETLRLHPPTPLLLPRETMRHIQISGYDVPAKTRIYVNAWAIGRDPASWPDEPEEFNPERFEANEIDFKGEHPELMPFGTGRRICPGMAMAMANVEFTLANLLFAFQWSLPEGTTPDNVCMEEEGRLVCHRKTPLVLVPTVYRHGLE

SEQ ID NO: 35802 - protein, 264 aa, Triticum aestivum
MMKYGVTEKKLQLLQDVSGVFRPGVLTALMGITGAGKTTLLDVLAGRKTGGYIEGTIRIAGYPKKQDTFSRISGYCEQSDIHSPNLTVHESLQFSAWLRLPSNVNSRQRDMFIDEVMDLVELTGLKNAMVGIAGATGLSAEQRKRLTIAVELVASPSIIFMDEPTTGLDARAAAIVMRTVRKTVDTGRTVVCTIHQPSIGIFESFDELLLMKRGGQIIYSGSLGPLSRNTRYSLAIFKIYLTILHQIPLLSRIGFQWNGRRKST

SEQ ID NO: 35803 - protein, 416 aa, Zea mays
MGGVGEGDAWADQEQGNGGGSRGVGGGGGEAKRSEIYTYEAAWHIYAMNWSVRRDKKYRLAIASLLEQVTNRVEVVQLDEASGDIAPVLTFDHQYPPTKTMFMPDPHALRPDLLATSADHLRIWRIPSSDDAEDGAASANNNNGSVRCNGTQQPGIELRSELNGNRNSDYCGPLTSFDWNDADPRRIGTSSIDTTCTIWDVEREAVDTQLIAHDKEVYDIAWGGAGVFASVSADGSVRVFDLRDKEHSTIIYESGSGGSSGGGSNSGAGDGGTASPTPLVRLGWNKQDPRYMATIIMDSPKVVVLDIRYPTLPVVELHRHHAPVNAIAWAPHSSCHICTAGDDMQALIWDLSSMGTGSNGSGNGNGNTAAGAAAEGGLDPILAYTAGAEIEQLQWSATQPDWVAIAFANKLQILRV

SEQ ID NO: 35804 - protein, 251 aa, Vitis amurensis
MDSDHEEFSASSSSSSSRTNPNSSDSLLPLQCIGHKRKAGRKKFRETRHPIYRGVRQRNGNKWVCEVREPLKKSRIWLGTFPTPEMAARAHDVAALALRGRFATLNFPDSAWRLPRPKSSSAEDIQVAALEATKAFNPTAPPSSSLASALDNMSGVADSKKVLETSPNVESPKLKSQRMVLEVSPVDTKRSEKVGDGSTTVFMDEEAMFNMQGLINSMAVGLLLTPPAMCKGFSWDDATDSHIDLSLWNDD

SEQ ID NO: 35805 - protein, 253 aa, Vitis amurensis
MDLDRESSASSSSSTSSPSRANPVSSDSRCPSRCISHKRKTGRKKLRKTRHPIYRGVRQRNENKWVSEVREPSKKSRIWLGTFPTPEMAARAHDVAALALRGHFASLNFPDSAWRLPRARSSSAGDVQFAAIQAAKAFQQPPSSSSSTPFVMDNMSAGSRKILETSSIVDTPQLKSQKKVEGVSSVDSKSWEKAGDGFPTAFVDEEAVFNMPGLIDSMAEGLLLTPPAMCKGFSWDDAVSHIDLSLWIHDFLP

SEQ ID NO: 35806 - protein, 64 aa, Glycine max
GNSKKIDIHTRLMRRYKSVPTWWFYIILAANIALIIFICEYYNESLQLPWWGVLLACAISIFRT

SEQ ID NO: 35807 - protein, 239 aa, Vitis amurensis
MESERDQSSPSSSSSSSQTKCSISSSPVHKRKAGRKKFRETRHPVYRGVRQRNGNRWVCEVRDPKNKSRIWLGTFPTPEMAARAHDVAALAFRGDFAALNFPDSTSRLPRAKSSSARDIQVAALAAAMAFRPAAPSSSSSYISHVTACSEELETSCSEDSPQLESRKKVVGVTLEDSESSQSAPHGSSTVFMDEEALFNMPGLINSMAEGLLLAPPTMLGGFSWDDTTSYTDLSLWNDD

SEQ ID NO: 35808 - protein, 249 aa, Medicago truncatula
MVCKVTPNSGQKNSEVETATSLKRTKRKDKNFIDLSERKDQWTEVLSSEPRASMYHNFLSKEECEHLINLAKPFMQRSLVVDGVTGQGILNSVRTSSGTFLERGKDKIVQNVERRIADITSIPIENGEGLQIIHYEVGQKFEPHYDYNFNWRITNNGGPRVATVLMYLSDVEEGGETVFPNAKPNFNSVSKYHPGKGLVVKPKMGDALLFWSVKPDGSLDTASLHGGSPVIRGSKWASNKLLHLTEFKV

SEQ ID NO: 35809 - protein, 322 aa, Medicago truncatula
MFYVKITSILICDKRTLKLYKQRVSGPQVTYNNSCHRFCYHPTPRRQKMTSKVMRSQQYPTFINSGEKNNKVERKTGLLVLLTERKDENIINLTERKDQWTEILSSVPRASMYHNFLSKEECEHLINLAKPFMARSLVVDGVTGEVKESSSRTSSGMFLDRGKDKIVQNIERRIADITSVPIENGEGLHVIHYGVGQKCEPHYDYTSDGVVTKNGGPRVATVLMSDVEEGGETVFPDAQPNFTSVSKCSGDGLSVKPKMGDALLFWSMKPDGTLDTSSLHGGSPVIRGNKWASTKWLHLRECKLSGTTHAEKVTLVPTNMLP

SEQ ID NO: 35810 - protein, 355 aa, Arabidopsis thaliana
  misc_feature (42)..(42): Xaa can be any naturally occurring amino acid
  misc_feature (160)..(160): Xaa can be any naturally occurring amino acid
LPFHAPSKDLISLVFSFSLSLSHSLNEISISSRKKKNPDQKXITTMSSSAKKQTLFISTLIISWYSSNIGVLLLNKFLLSNYGFKFPIFLTMCHMSACAILSYISIVFLKLVPLQHLKSRSQFLKVATLSIVFCASVVGGNISLRYLPVSFNQAVGATTXPFFTALFAYLMTFKREAWVTYGALVPVVAGVVIASGGEPGFHWFGFIMCISATAARAFKSVLQGILLSSEGEKLNSMNLMLYMSPVAVIALLPVTLFMEPDVISVTLTLAKQHQYMWILLLVNSVMAYSANLLNFLVTKHTSALTLQVLGNAKGAVAVVISILIFQNPVTVMGIGGYSITVLGVVAYGETKRRFR

SEQ ID NO: 35811 - protein, 358 aa, Mycobacterium leprae TN
MATLQVDAVVLVGGKGTRLRPLTLSAPKPMLPTAGLPFLTHLLSRIAAAGIEHVILSTSYRDAVFEAEFGDGSKLGLQIDYVIEESPLGTGGGIANVIDQLRHDTVMVFNGDVLSGVDLGQLLGFQRTNFADVTLHLVRVGDPRAFGCVSTEDGRVTAFLEKTQDPPTDQINAGCYVFERNVIDRIPRGREVSVEREVFPTLLSDADVKVCGYVDATYWRDMGTPEDFVRGSADLVRGIAPSPALGGHRGEHLVHDGAAVSPGAVLIGGTVVGRGAEIGPGVRLDGAVIFDGAKVEAGSVIERSILGFGVRIGPRALIRDGVIGDGADIGARCELLRGARVWPGVSIPDGGIRYSSDV

SEQ ID NO: 35812 - protein, 174 aa, Triticum aestivum
  misc_feature (107)..(107): Xaa can be any naturally occurring amino acid
  misc_feature (157)..(157): Xaa can be any naturally occurring amino acid
MAPAVMASSATTVAPFQGLKSTAGLPVSRRSSGSLGRVSNGGRIRCMQVWPIEGIKKFETLSYLPPLSTEALLKQVDYLIRSKWVPCLEFSKVGFVFREHNSSPGYXDGRYWTMWKLPMFGCTDATQVLNKLEEVKKEYPDAYVRVIGSDNLRQVNXASLIASRPPGCEESGKA

SEQ ID NO: 35813 - protein, 377 aa, Coleochaete scutata
MADGEEVSALVCDNGSGMVKAGFAGDDAPRAVFPSIVGRPRHQGVMVGMGQKDAYVGDEAQSKRGILTLKYPIEHGIVTNWDDMEKIWHHTFYNELRVAPEEHPVLLTEAPLNPKANREKMTQIMFETFSVPAMYVAIQAVLSLYASGRTTGIVLDSGDGVTHTVPIYEGYALPHAILRLDLAGRDLTDYMMKILTERGYAFTTTAEREIVRDIKEKLAYVALDFEQEMQTAQNSSSLEKSYELPDGQVITIGSERFRCPEVLFNPALIGMESAGIHETTYNSIMKCDVDIRKDLYGNIVLSGGTTMFPGIADRMSKEITALAPSSMKIKVVAPPERKYSVWIGGSILASLSTFQQMWIAKSEYDESGPSIVHRKCF

SEQ ID NO: 35814 - protein, 377 aa, Mesostigma viride
  misc_feature (308)..(308): Xaa can be any naturally occurring amino acid
MADEGEVSALMCDNGSGMVKAGFAGDDAPRAVFPSIVGRPRHQGVMVGMGQKDAYVGDEAQSKRGILTLKYPIEHGIVTNWDDMEKIWHHTFYNELRVAPEEHPVLLTEAPLNPKANREKMTQIMFETFNVPAMYVAIQAVLSLYASGRTTGIVLDSGDGVTHTVPIYEGYALPHAILRLDLAGRDLTDYLMKILTERGYSFTTTAEREIVRDIKEKLAYVAIDYEAELATANTSSSIEKSYELPDGQVITIGNERFRCPEVLFNPGYVGMESAGIHETTYNSIMRCDVDIRKDLYGNIVLSGGSTMXPGIADRMSKEITALAPSSMKIKVVAPPERKYSVWIGGSILASLSTFQAMWIAKSEYDESGPSIVHRKCF

SEQ ID NO: 35815 - protein, 378 aa, Scherffelia dubia
MADGDGEVSALVCDNGSGMVKAGFAGDDAPRAVFPSIVGRPRHQGVMVGMGQKDAYVGDEAQSKRGILTLKYPIEHGVVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAIMRLDLAGRDLTDNLMTILMERGYNFTTTAEREIVRDIKEKLCYVALDYEQEMANSLTSSQNEKNYELPDGQQITVGNERFRCPEVLFQPGLLGQESVGVHETTFNSIMKCDVDIRKDLYNNIVLSGGTTMFPGIADRMSKEITAVAPSSMKIKVVAPPERKYSVWIGGSILASLSTFQQMWIAKAEYDESGPSIVHRKCF

SEQ ID NO: 35816 - protein, 452 aa, Pseudomonas fluorescens Pf-5
MAYDFDLYVIGAGSGGVRCARFAAGFGAKVAVAESRYLGGTCVNVGCVPKKLLVYGAHFAEDFEQASGFGWSLGEANFDWATLIANKDREINRLNGIYRNLLVNSGVTLHEGHAKLIDPHQVEVNGQRYSAKHILIATGGWPQIPDIPGREHAISSNEAFFLNELPKRVLVVGGGYIAVEFAGIFHGLGADTQLLYRGELFLRGFDGAVRKHLQEELTKRGLGLQFNADIERIDKQADGSLEVTLKDGRKLVADCVFYATGRRPMLDNLGLENTGVKLDKRGFIEVDEQYQSSEPSILAIGDVIGRVQLTPVALAEGMAVARRLFKPEQYRPVDYQMIPTAVFSLPNIGTVGLTEEQAREAGHKVQIFESRFRPMKLTLTDCQERTLMKLVVDADSDKVLGCHMVGPDAGEIVQGLAIALKAGATKRDFDETIGVHPTAAEEFVTMRTPVAG

SEQ ID NO: 35817 - protein, 255 aa, Bacillus cereus ATCC 10987
MKKKIGLLAMVIALMAIATGCSEVNQPITPKSTGIWNEYFVYPLSQLITYFANLFGSNYGLAIVVTTLIIRFALLPLMIKQTKSTKAMQSLQPEMVKLKEKYSSKDQATQQKLQQEMMQLYQKNGVNPLAGCLPIFIQMPILFAFYHAIMRTAEIKQHSFLWFDLGHADPYYILPIVAAITTFIQQKLAMAGTAGQNPQMAMMIWLMPIMILIFAINFPAALSLYWVVGNIFGIAQMYFIKGPEIKASKAEGSGK

SEQ ID NO: 35818 - protein, 509 aa, Mycobacterium avium subsp. paratuberculosis K-10
MTLPTAAELRARAADALRSLGAHVELGAPDAHGLPASTPITGEVLFTVAPTTSDQAEHTITQATQAFSEWRRTPAPVRGALVARLGELLRAHRDELAALVTLEVGKITSEAAGEVQEMIDICQFAVGLSRQLYGRTIASERPGHRLSETWHPLGVVGVITAFNFPVAVWAWNAALALVCGDTVVWKPSELTPLTALATQALIARAAADVGAPPGVSAVVLGDRELGELLVDDERVALVSATGSVRMGRAVGPRVAARFGRVLLELGGNNAAVVTPSADLDLAVRAVVFAAAGTAGQRCTTLRRLIVHRSVADEVVARVVSALRRLPIGDPFEPGTLVGPLIHETAYRDMVGALESARADGGEVIDGDRRHPFAVEHPSSYYVAPAVVRMPAQTPIVATETFAPILYVLTYDRLDDAIALNNAVPQGLSSAIFTTDLREAERFLDESDCGIANVNIGTSGAEIGGAFGGEKQTGGGRESGSDSWKAYMRQSTNTVNYSGALPLAQGVEFG

SEQ ID NO: 35819 - protein, 90 aa, Zea mays
  misc_feature (47)..(47): Xaa can be any naturally occurring amino acid
AGAGGCGEKGSQADAKRLRPQDLLDMLEDDTDMAAVDDLASVMRSLXEEIASFDEATEALAPAPGQQPELGFLLEASDDELGLPPTGAAS

SEQ ID NO: 35820 - protein, 133 aa, Zea mays
MASTGRSMLLSLLLFAVTLSLLEMYRAKFASSELMTIAGGFVCSLLFLLLLTFIGNYQEASGDRTGWGAVVVAQLVALIVAGTVHRVCITTCFLFSAGLLYEVDKLSGMILARSESKGGGRLLKHRMQTTERC

SEQ ID NO: 35821 - protein, 375 aa, Arabidopsis thaliana
MVTKAEKQFAKNFNIDDLPDVPAGLPPHLKAQQTRVVSKNNAPAHTASAIYSGTYVSSTEEDDNVKLGNFYDNFKVDVVSLTKTDMEFDMIGIDAAFANAFRRILIAEVPSMAIEKVFIAYNTSVIIDEVLAHRMGLIPIAADPRLFEYLSEHDQANEKNTIVFKLHVKCPKNRPRLKVLTSDLKWLPNGSELLRESENKTSKLKTYTSFSCSQDSLPEFANNPITPCDLDILIAKLAPGQEIELEAHAVKGIGKTHAKWSPVGTAWYRMHPEVVLRGEVEDELAERLVNVCPQNVFDIEDMGKGKKRATVAQPRKCTLCKECVRDDDLVDHVDLGSVKNHFIFNIESTGSLPPEVLFTEAVKILEAKCEAITDF

SEQ ID NO: 35822 - protein, 487 aa, Oryza sativa (indica cultivar-group)
MAPDVEAPLLAASSKPAAAAVASPPRRNKYPFFCAVLASMTSVLMGYNVAVTSGAQIFMAEDLGVSDAQIEVLSGAINIYSLVGALLAGWTSDRLGRRLTIVLTNGFFLAGPLVMSLAGGYAALMAGRFVAGIGVGYALVIAPVYAAEISPASSRGLLSSLPEIFINGGVMLSYVSNFAFSGLPVHLSWRLMFAAGVVPTVFLAAGVLTMPESPRWLAMKGRRGEARVVLDRTSDTPAEAEQRLQEIEDVVAAAGSVAGNGNGGGGAWKEVATKPGVRRVLAVVLTLQFFQQASGIDSVVLYGPRVLAAAGVASNTLLLGLNVVFGVAKASSILVAMALTDRVGRRPLLLASTGGMTASLVALGSVFAAFGGARDDAAVAAGAAVAVVVAFVCAFSVGIGPLAWVYSSEILPLRLRGQGAGVGTAMNRVVSGVVTMTFISLYGAITMAGAFYLYAAIAAASFVFIYACLPETRGRSLEDMEELFHTK

SEQ ID NO: 35823 - protein, 140 aa, Francisella tularensis subsp. holarctica
MTKQRTLSIIKPDAVEKNVIGEIYSRFEKAGLRIIAAKMKHLSKAEAEGFYAVHKDRPFFSALVEFMISGPVMIQVLEGENAIAKNRELMGATNPKEAKAGTIRADFADSIDANAVHGSDAEDTAAQEIRYFFSDTEIFG

SEQ ID NO: 35824 - protein, 434 aa, Pseudomonas syringae pv. phaseolicola 1448A
MNSKVDEPPHLLRQRDQFVPRGIVTAHPLVIDRAQGSELWDVDGKRYLDFVGGIGVLNIGHNHPNVVAAIQAQLTKVTHACFQVASYQPYLDLAKRLSHLIAGQSGIDHKAVLFTSGAEAVENAVKIARAHTNRPAIISFRGGFHGRTLLGTTLTGMSQPYKQNFGPMAPEVFHTPYPNEYRGVTSEVALAALHELLATQVAPERVAAILIEPMQGDGGFLTAPVEFMKALRALTEQHGIVLIVDEIQSGFGRTGKWFGFEHSGIQPDLVTVAKSLAGGMPLSGVVGRAEIMDAPLPGGLGGTYGGNALSCAAALAVIDTYEQDNLLARGEQLGQHLRAGLLKLKDRYTCIGDVRGTGFMLAMELVKNDAARSPDADLNQKIIDQARIGGLLVIKCGVYRNVLRFLAPLVTTEQQIDEALTILDAALARVLKSS

SEQ ID NO: 35825 - protein, 688 aa, Oryza sativa
MGRNGSVKRTSSSGAAAAFTANPRDYQLMEEVGYGAHAVVYRALFVPRNDVVAVKCLDLDQLNNNIDEIQREAQIMSLIEHPNVIRAYCSFVVEHSLWVVMPFMTEGSCLHLMKIAYPDGFEEPVIGSILKETLKALEYLHRQGQIHRDVKAGNILVDNAGIVKLGDFGVSACMFDRGDRQRSRNTFVGTPCWMAPEVLQPGTGYNFKADIWSFGITALELAHGHAPFSKYPPMKVLLMTLQNAPPGLDYDRDRRFSKSFKEMVAMCLVKDQTKRPTAEKLLKHSFFKNAKPPELTMKGILTDLPPLWDRVKALQLKDAAQLALKKMPSSEQEALSMVGPNFSDEVAAFCGRTSTTAANSDGKGDFSFEAFDFGENNVDTKIMPNGYENARSENSSSPSTSKQDPESKYWRSTSGQKQQTSGTPAVHSGGVNSSTTEKGHGVERDATVQLASDKLRTETRRATNLSGPLSLPTRASANSLSAPIRSSGGYVDSLGDKSKRNVVEIKGRFSVTSENVDLAKVQEVPLSSLSRKSPQASPLKKSASVGDWLVNTKPMSNSHHVKELCNSSVSSSILIPHLENLVKQTMFQQDLIMNVLSSLQQNEKVDGVLSGISPQLRNTDSDTMVGSVNSEKERSLLVKISELQSRMITLTDELIAAKLKHVQLQQELNALYCREEIEDIRDDDNEET

SEQ ID NO: 35826 - protein, 438 aa, Streptomyces coelicolor A3(2)
MSELAYPYEAPASQALFDRAAAVTPGGVNSPVRAFRAVGGTPRFMVSGTGPYLTDADGREYVDLVCSWGPMILGHAHPEVIAAVQEAVARGTSFGTPAEGEVALAEAMVERVAPLEEVRLVSSGTEATMSAIRLARGFTRRTKVIKFAGCYHGHVDSLLAAAGSGVATFALPDTPGVTGAQASDTIVLPYNDLDAVHAAFAAHPGEIACVITEASPGNMGVVPPLPGFNQGLKDACAANGALFVSDEVMTGFRTSLAGWFGVEGVVPDLMTFGKVMGGGFPAAAFGGRADVMAHLAPAGPVYQAGTLSGNPVATAAGLAQLRLLDDAAYDTVDAVSAQIQALVTEALTKEGVAHTLQNASNMFSVFFTDRPVVNYEDAKAQESFRFTAFFHSLLANGVYLPPSSFESWFVSTAHDERAVQRIADALPAAARAAAEATA

SEQ ID NO: 35827 - protein, 460 aa, Oryza sativa (indica cultivar-group)
MASGGGDARRRKEEGEEDGFSSDGGDTTDAESSDERAGAGAGRRAVPGANPILSRLAVSRNPSPLAAATAAPGVCLLRFAWESAAGSLVGAVVGYGKGLVTTKGFKGSFADAASSAKIFAVLAGVQSLVACTLRQLRGKDDVLNAGVAGCCTGLALSFPGAPQTMIQSCLTFGTFSYIIEMLNKQEPALARPSITGTKDLKAGHRVLPPFTLPLPQEAMEVDDVDTVSEFLGKHFVKVELRHSRRNNRIVSHFRNKGLLIMFQTMEARLIKVIKHINAFFYHVSLHKRLRLSQVTSSSLMVLQALHFFPQNFQISNYGQVLPALHFFPHSFQIPYRYASPFAPSSFCNILQGNFTLGHRDQGSLVTLGRSQVVKFALARGASLLHRQVVKFIFVVRVSLLQAVKCVLVEVQVRLGGSLLFSGHLGVSVLLFNFIARFGAGLLEVPLLELGSSLKKNVSRF

SEQ ID NO: 35828 - protein, 518 aa, Hyphomonas neptunium ATCC 15444
MIFDRVKPLDAILATAEKKGLQRTLGAFQLTMLGIGAIIGTGIFVLTSEAAQKAGPGMMISFLIAAAVCAVAALCYAELASMVPVSGSAYTYTYAVMGELLAWMVGWALILEYAVAASAVSVGWSGYFVGLLASWGIVLPDALVMGPYAGGIMNLPALLIALLITCLLMIGTTESARVNAVLVAIKVTALTVFIVLTLPVIKGANFEPFTPNGWFGAGHGAGLGIVGAAASIFFAYVGFDAVSTAAEETKNPQKNVPIGLIGSLGICTIFYLLVAAGAIGAMGSQPVNGPAGEILAPGTPALAAQCQSLLAMGQEPLVCSREALAHVLREIGHERLGDMIGIAAFLALPSVILIMLFGQTRIFFVMARDGLLPEFLSKIHPKWKTPHIVTMITGSVVAVFAAFLPVGQLADISNSGTLFAFFMVAIAVLILRRKQPERHRPFRTPMVWIVAPLAIFGTLGLYLNLPTEAKLVLPVWGSIGLVVYFLYSRGKSHVGRGIIDVHEDDPDAPPQPVPPIRD

SEQ ID NO: 35829 - protein, 924 aa, Synechococcus sp. RS9916
MADRDSPSTEQQADGVIDLNQLFPFPLDDFQLEAIDALNQGHSVVVSAPTGSGKTLVGEYAIHRAIAHGQKVFYTTPLKALSNQKLRDFREQFGAENVGLMTGDLSVNREARVVVMTTEIFRNMLYAEAEEGNDPLADVEAVVLDECHYMNDSQRGTVWEESIIHCPPSVQLVALSATVANAGQLTDWIERVHGPTRLVLSDFRPVPLQFSFCSAKGLHPLLNEAGTGLHPNCKVWRAPKGHKRKGRSPKPPQPEAPPISFVVAQMAERAMLPAIYFIFSRRGCDKAVRDLGVQCLVTAEEQARIAARLKAYTAANPEAVRDGLHADALLRGIAAHHAGVLPAWKELIEELFQQGLVKVVFATETLAAGINMPARSTVIASLSKRTERGHRPLMASEFLQMAGRAGRRGLDSKGYVVTVQSRFEGVREAGQLATSPADPLVSQFTPSYGMVLNLLARHDLAKARELVERSFGRYLASLDLVEEEEILTQLRLQLGQLQGTSGDVPWEDFEDYEKRRGRLREERRLLRILQQQAEETLANELTLALQFASVGTLVSLKAPQLRGGVTPAVIVDKLDGPGQFPLLLCLTQENVWLLVPCQAVVSLHAELSCLQVDGVTTPDLHRAGELRHGDQQSGGLALAVAHMAQRHDMTTPQYDLAGEVLSQARLVKELEDDLETHPAHRWGDRRQLKKHRRRMEELEIEISERQQLLHHRANRHWEIFLALIEILQHFGCLDELQPTEIGRTVAALRGDNELWLGLALMSGHLDDLPPAELAAVFEAISTEVNRPDLWSGFPPPPRAEEALHDLMGIRRELLRAQERCNVVVPAWWEPELMGLVEAWANGCAWNDLIANTSLDEGDVVRIMRRTVDLLAQVPYCEAISEQLRSHARQALRAINRFPVAEADDLLKAAAAEAAGLNPATERAA

SEQ ID NO: 35830 - protein, 222 aa, Brassica napus
MAEPSPSGSAIEPRSINPHSDPSLTANVRAEIDTSSPFVSVREAANRFGGFGFWRPHSSEPLQDNVREGEIMELKTQAAALQNVLMVKECETLEVMKELEETKATVIELNSKLQQKKNESLTEEVQSHIKPAGVVLQDLNKAKMNLCKRTLDLSGLRRSVEVLSKQLKEEKAALEKTRERVMHKSLKVISLEEEEEAKKGETSEKDLENNALRMINEVKRLG

SEQ ID NO: 35831 - protein, 393 aa, Listeria innocua Clip11262
MKISKRLQNLPDQFFSSLVEKVGKKVAEGHDVINLGQGNPDQPTPKHIVEAMKTASENPMNHKYSLFRGKQELKQAVADFYAREYNVTIDPNTEVAILFGTKTGLVELPMCLMDPGDVMLLPDPGYPDYLSGAVLGEVQFETMPLIAENDFLPDFNKIPEEIAKKAELMYLNYPNNPTGAVATTHFFEETVAFAKENNITIAHDFAYGGIGFDGKKPISFLETPGAKEVGIELYTLSKTYNMAGWRVGFAVGNKDVVEAINLIQDHMYVSLFPGIQDAAIEALTGDQTCVQELNARYESRRNAFIAACDKIGWEAIAPAGSFFAWMPVPKEFTSSEFADYLLNEVSVAVADGSGFGTFGEGYVRVGLLMDEKRLEEAVARISKLHLFDKVAQN

SEQ ID NO: 35832 - protein, 303 aa, Triticum aestivum
VTLSNKFVQKSRLPPVRNSRVFGDPRVRAVYRGDLSDGRQIAVKMLKDFKTDGEDFINELASISRTSHVNVVTLLGFCLEGTKRALIYDYMPNGSLERYAFKDGSEGGNTLGWEKLFEIAVGIARGLEYLHRGCNTRIVHFDIKPHNILLDQNFCPKISDFGLAKLCLNKESVISIGGARGTIGYIAPEVYSKQFGAVSSKSDVYSYGMMVLEMVGARDKNISPNTESSSQYFPQWIYEHLDEYCISASEINGEITEVVRKMIVVGLWCIQLSSTDRPTMTRVVEMLEGSTTGLELATKVLLS

SEQ ID NO: 35833 - protein, 272 aa, Yersinia pseudotuberculosis IP 32953
MTRYLNKDTTVCISLAARPSNFGTRFHNFLYDALDLDYLYKAFTTNDLAAAIGGVRALGFRGCAISMPFKEAVIPMVDEMDPSAKAINSVNTLVNTGGYLKAYNTDYIAIAKLLQEYQVPVDNVFALRGSGGMAKAVAFALKNAGFKQGYIIATNEKTGKQLAEQSGYIYRPDMQNIQADMLINATPVGMAGGADADKLAFTETEVDRAKIVFDVVALPAVTPLIRYAQTQGKTVITGAEVFAIQAVEQFVLYTGIRPSQALFEQAAAYARG

SEQ ID NO: 35834 - protein, 533 aa, Oryza sativa (japonica cultivar-group)
MIPVVVVLHRCAVSSSWPDRVFEAKHIAGAGEQDMQDDLPDDLTASQYIGYDKFLGGLLQEGFDEVSCRSRYQFARYHKNFTRIPSSYLLERLRRQEALQKKCGPGTKSYKQAVKLLRSSQGVNMTTDCNYLFLTVHAGLGNRMLEIASAFLYALLTNRILLLDRYQEIGDLFCEPFPGTSWLMPSDFPLNYGEFTQSSPESYGNMLQNKVVGDNTDQSLAGSRPPYVFLYLDGNYEFHDKLFFCEDDQQFLQDVPWLIMRTDMYFIPSLFLIPSYQDELSRLFPEKDAVFHHLARYLFHPTNSIWYSVKGYYRSYLAKANKTVGIQIRIFEKEGILQKNGRFPYVLEQILSCAQNEKLLPEISMKDEAEAPTAPKNNQTIAVLTTSLSSWYSDQIQKKYSEHPTVDGTRVEVYQPSHEEYQRSKNKKHNMKALAEIYLLSMTDVLITSGFSTFGYAAQGLSGLTPWIMFRSENHAMPDPPCRRAMSIEPCFHQAPFYDCKAKRNADLGKMVPFVRHCEDVSWGLKVVNQTQW

SEQ ID NO: 35835 - protein, 480 aa, Idiomarina baltica OS145
MSSLTKQDCFIEGHWVPTEKRFAVTNPANGEVITEVADADGDLTKRAINAAEVALAKWRATSTQERAALLRKWYQAIMDNKQALGELMSAEQGKPVPEAVGEVEYGASFVDWFAGEAERINGDILPITDNSKRVMVIKQPVGVCAAITPWNFPNAMITRKVAPALAAGCTIVVKPPQLTPLSSLALAQLASEVGIPDGVINILPTTDSKTVGEILATSKQVRKLSFTGSTGVGKILMKQCAENVKKISLELGGNAPFIVFDDADLDAAAEQLMACKFRNGGQTCISANRVLVQDSVKEEFIKKVVSKVKALNVGPGDKEDVDLGPLIDQDAVDKVQRLVISAKSDGAEIEEGGSVMTDLGDLFYAPTVISGVTQDMEITQEEIFGPVIAISSFETEEEAIQQANDTPFGLASYFAAKDTARIFRVSEGLEYGMVGVNTGGISHAYNPFGGIKESGIGREGSKYGIDEYLEIKTITLGGLE

SEQ ID NO: 35836 - protein, 1432 aa, Shewanella sp. ANA-3
MIELKIDNHSVTAEPNDNLLQAARKAGIAIPSLCDPTDATRQLGTAPNADKQDCNLCLVQIENTDASLRCVKACETPAEAGLKVITQSAYLTKQRQAALSTILSDHFADCEAPCQQACPAGVDVQSYLYHIAQGDHTQAIKVIKDTLPLPLSIGRVCPAFCESECRRGLVDDPIAIRQLKRHAADLDLADDEQGNSYQPPRLADTGKKIAIIGAGPAGLSAGYYLSNQGHNVEIFEAMPKAGGWLRYGIPEYRLPKAILDKEIELLCRNGLTIHTDTRLGHEIHLAQLVADFDVVCLAIGAQKAVPMNYKGSALAGCYLGVDFLKDHCLDKQLKLGKKVAVIGGGNTAIDCARTAVREGCDVTLIYRRTRAEMPAEAYEVHEAEVEGVKFHFLTNPIENHSDDNGRVQSVTFSKMTLGEADTSGRRAPVDTGETFTEAFDTVIAAVSQAPDLSFMQDPMGQLSQGELALSRWNTLIGCEQTMSSGVEKLFVMGDARRGPATAVAAIGDGRKAAIAIDKMLKIGLSCDLHAHAFNSVKTIPSALIPSALKQTETSSKAGSTLYPHTPRQLRLKMPELTALQRLLNYSEVELGFPADAAMQEAARCLECACQANTDCKLRDYATDYGVEAKSLATENARHFSVDKSAPFIQFDANRCISCGKCVDVCQQQSGHCAIQFSQDSYQALPQEMTQHMERRAPRVGFSASMADSHCVQCGNCVQVCPTGALVDARDKRQGDCTELKTASTICTYCGVGCRLDLKIDPNANRIRHIEGNKDSVVNQGMLCVKGRFGFDFIHSDKRLTTPLIRKNGELQPSSWPEAIAYVAKRLTEIKQKDGSNALASLASAKATNEDNFVLQKFVRSVLGTNNIDHCARLCHSSTVTGLQQSIGSGAMTNDIPSIKDSDVIFILGSDTTCAHPIIASKIQQAVMQHGARLLVADPKRVGIAEKAELYVAHRPGTDVMLLNAIMAEIIRHDWQDKAYIAERTEGIEALYAELAKDDYSLENAALITGVKAEDIARLARTIGTAEKTAVYYAMGITQHTTGHDNVTAISNLQLLCGNIGVSGAGINPLRGQSNVQGACDMGALPNYFTGYQKVTDLHARMRFENHWQTRLSGEIGVTATHMMHDIAKGKIKALYVMGENPVLSDPDQAHVLNALSQIEFLVVQDIFLTETAELAHVVLPAAAFVEKRGHFTNTERRVQRLEQALASPGEALPDWQIVQAVANAMGANWDYTNEEAIWREINELTPQYRGIRWDRLSANAEGQISQGIQWPCPDETHPGTPIMHQSQFTRGLGLFTPVSYRLPAEMPCNEYPLTLSTGRLLEQFHTGTLTRKTPGLDLLGAPKVMISVYDAEQLGINNGDKLRLTTRRGEIEIDAFVTKRAQAGVLFLPFHFVEAAANKLTINALDPVAYIPEYKVCAVRAEKVTARVSEPA

SEQ ID NO: 35837 - protein, 312 aa, Thermus thermophilus HB8
MTDLEAPLRRFEEALSELVQSDVLFIRLIHQDLVTAGGKRIRPRLVFLASRALGGAPFELELALAVELLHSATLLHDDLIDDAETRRGKEAAFRKYGNAVSVLSGDFLLSRLLHVIAKTGRMELVERFAEVAKTLSEGEVLQFQVAALEDYSLENYERIITAKTAVLMALATEGPALLLGAESGVREALYRYGLLYGQAFQMRDDYLDLMGTPEVLGKPVGGDLREGKATLIPLLLMERYPEVREVLRRRAREAGDLERVRALARESGAAEEAVRRIRERAEAAAQALEALPPSPFREALRELALKEAERVR

SEQ ID NO: 35838 - protein, 404 aa, Frankia sp. EAN1pec
MRAVVWHGVGDIRLDTVTEPKIEQPTDAVVRITTAAICGTDLHFVRGTVPGMKPGLIIGHEGVGVVEEVGQSVRNFRRGDRVLLSAVLGCGSCTYCRSGYFAQCDDINPYGRRTGSAFYGAPRDNGSFDGLQAEYARVPYAHTNLFRLSDSISDDQAIPLSDIYPTGYFGAVIAEVSDGDVVAVWGCGPVGQFAVLSSFQRGAARVIAIDGHADRLDRAQALGAEVVNFNEEDPVEAILDLTRGIGPDRAIDAVGVDAESPKSGPAAARAREQDDQHREELRQIAPETHAHNGHWKPGDAPTQAHSWAVESLAKAGTLGIIGVYPPTDRFFPIGTAMNKNLTINMGNGNHPRYIPKLLDMVESGVVHPQKMVTQHEPMRDVLAAYEEFDLRRPGWLKVALDLTS

SEQ ID NO: 35839 - protein, 157 aa, Triticum aestivum
MAKKRKRSSDALAPAAVEKPDDSAPERPERTLFGFKDSSDEPASKDAGPFFRNKEKVLITCSRRIIYRYRHLMQNVVSLLPHAKKDSKVESKQSKGSALNELVELRSCSSCLFFECRKQKDLYLWMVKSPAGPSVKFLVNAVHTMEELKLTGNHLKG

SEQ ID NO: 35840 - protein, 756 aa, Arabidopsis thaliana
MTENGVVTGGGHTVMVGVKFDESSNELLDWALVKVAEPGDTVIALHVLGNEIVDRADNSSLVSIVKNFDSVLEVYEGFCKLKQLELKLKLSRGSSTRKILVKEAKMCSASKVVVGISRRFHTIHSSVSVAKYLARKVAKDCWVLAVDNGKVMFQKDGSSSIIHHSKGKSDARRNTLSSFFQMPVTLRKNTKVVNHSEVEEEEAEEDHSNGQSLRRSLVYACLGNCSVRDMNSLPTPGNLSRSSSCNGDQDDNADLHKAMALVPAKFPEDLTPFITMLVKELPEFRPGWPLLCRVASSDVLASAPRSSSFRKIPVVQWVLKLPARTNSVVGSSDTKQIGFDSSESEENDKLSSSNVERQAIVPDESMIVKCSLDHSSGRFPENVEGLQARISTSCQFFTYKELVSVTSNFCADNFIGKGGSSRVFRGYLPNGREVAVKILKRTECVLKDFVAEIDIITTLHHKNVISLLGYCFENNNLLLVYNYLSRGSLEENLHGNKKDLVAFRWNERYKVAVGIAEALDYLHNDAPQPVIHRDVKSSNILLSDDFEPQLSDFGLAKWASESTTQIICSDVAGTFGYLAPEYFMYGKMNNKIDVYAYGVVLLELLSGRKPVNSESPKAQDSLVMWAKPILDDKEYSQLLDSSLQDDNNSDQMEKMALAATLCIRHNPQTRPTMGMVLELLKGDVEMLKWAKLQVSNPLEDSMLLKDEKLRRSNLQSHLNLAFLDMEDDSLSMGSMEQGISVEEYLKGRTSRSSSFN

SEQ ID NO: 35841 - protein, 346 aa, Synechococcus sp. RS9916
MSIALLGRSAADLEQWAVAQGQSSFRGRQLHDWLYAKGARDLNGITVLPKVWRAALQEQGVVVGRLQEQLRSVASDATTKLLLGTEDAETIETVGIPTDQRLTVCVSSQVGCPMACRFCATGKGGLQRSLATHEIVDQVLSIREVMDRRPSHVVFMGMGEPLLNIDAVLEAIRCFNDDLGIGQRRITVSTVGVPRTLPKLAELAMERLGRAQFTLAVSLHAPNQQLREELIPTAHAYPFEALLDDCRHYLAITGRRVSFEYILLGGLNDHPAHAEELADRVGGFQSHVNLIAYNPIEEEEFQRPSAERIAGFRRVLERRGVAVSLRASRGLDQNAACGQLRRQNKP

SEQ ID NO: 35842 - protein, 159 aa, Zea mays
DTPLSRLADSSSSVNAIATNPPLGDFLSIVSAGLYAVYITLIRKKLPDEKEGQGQVSMAQFLGFLGLFNMLFFFPVALVLNFAKLEPFHRLTWEQAGLVVGKGLIDNVLSDYLWAKAILLTTTTVATAGLTIQVPIAAIVDTLTVMLLIYWTMLEPLPS

SEQ ID NO: 35843 - protein, 1012 aa, Desulfovibrio gigas
  misc_feature (193)..(193): Xaa can be any naturally occurring amino acid
MLIKRRAFLKLTAAGATLSAFGGLGVDLAPAKAQAATMALKTVDAKQTTSVCCYCSVGCGLIVHTDKKTNRAINVEGDPDHPINEGSLCAKGASTWQLAENERRPANPLYRAPGSDQWEEKSWDWMLDTIAERVAKTREATFVTKNAKGQVVNRCDGIASVGSAAMDNEECWIYQAWLRSLGLFYIEHQARIXHSATVAALAESYGRGAMTNHWIDLKNSDVILMMGSNPAENHPISFKWVMRAKDKGATLIHVDPRYTRTSTKCDLYAPLRSGSDIAFLNGMTKYILEKELYFKDYVVNYTNASFIVGEGFAFEEGLFAGYNKETRKYDKSKWGFERDENGNPKRDETLKHPRCVFQIMKKHYERYDLDKISAICGTPKELILKVYDAYCATGKPDKAGTIMYAMGWTQHTVGVQNIRAMSINQLLLGNIGVAGGGVNALRGEANVQGSTDHGLLMHIYPGYLGTARASIPTYEEYTKKFTPVSKDPQSANWWSNFPKYSASYIKSMWPDADLNEAYGYLPKGEDGKDYSWLTLFDDMFQGKIKGFFAWGQNPACSGANSNKTREALTKLDWMVNVNIFDNETGSFWRGPDMDPKKIKTEVFFLPCAVAIEKEGSISNSGRWMQWRYVGPEPRKNAIPDGDLIVELAKRVQKLLAKTPGKLAAPVTKLKTDYWVNDHGHFDPHKIAKLINGFALKDFKVGDVEYKAGQQIATFGHLQADGSTTSGCWIYTGSYTEKGNMAARRDKTQTDMQAKIGLYPGWTWAWPVNRRIIYNRASVDLNGKPYAPEKAVVEWNAAEKKWVGDVPDGPWPPQADKEKGKRAFIMKPEGYAYLYGPGREDGPLPEYYEPMECPVIEHPFSKTLHNPTALHFATEEKAVCDPRYPFICSTYRVTEHWQTGLMTRNTPWLLEAEPQMFCEMSEELATLRGIKNGDKVILESVRGKLWAKAIITKRIKPFAIQGQQVHMVGIPWHYGWSFPKNGGDAANILTPSVGDPNTGIPETKAFMVNVTKA

SEQ ID NO: 35844 - protein, 194 aa, Medicago truncatula
MAAGDIDLKGKKRPVVVVVVNGDGRMVEMEKNGLWFGYGLQLTTERRQRRWSSEDDSEKKKLSCILSFINYLVKFKDQHSMDGISSSKFEKLPYTLYHRFTTMFDVTESRRLPPEKMNLLISYVLVLTLFSDDFRTDYRDIVKDLRMSTLTLRPIFEHLGCKFISSQKVSYATLPIPLTFSQIKKRKRKNKNKL

SEQ ID NO: 35845 - protein, 408 aa, Ashbya gossypii ATCC 10895
MLSSVRNPALAKVKTSLLRTLSTTGAVRAEAVESAGADEEVEIRLPETSFEGYMLDVPELTYKVTKGNLLQMYKDMIVVRRMEMACDALYKAKKIRGFCHLSVGQEAIAVGIENAITKRDTVITSYRCHGFTYMRGASVRAVLAELMGRRTGVSYGKGGSMHMYTDGFFGGNGIVGAQVPLGAGLAFAHQYKNEDVCAFALYGDGASNQGQVFEAFNMAKLWNLPAVFACENNKYGMGTAASRSSAMTEYFKRGQYIPGLKVNGMDILAVYQASKFAKHWCVSGKGPIVLEYETYRYGGHSMSDPGTTYRTRDEIQHMRSKNDPIAGLKMQLLDLGIASEEEIKAYDKAARKYVDEQVELADAAPAPEAKMSILFEDVYVPGTETPTLRGRINDDTWDFAKKGFAFRD

SEQ ID NO: 35846 - protein, 174 aa, Medicago truncatula
MVEEMTAEQLAEKKRNTDVALGTKKSKKMHDKLADMKRDEEPEAKKNLDEKMKNVEVKETALANTEAHVTRHIPPYNSSATTPQEAYVLDKIILAEEWNYLQDIYYSLQKEVAADFSLYPSFIRNRINRLKKIEVETQREEKIRGERKVCPIHFSFNFRGLYFSILSLLLQQVP

SEQ ID NO: 35847 - protein, 554 aa, Corynebacterium efficiens YS-314
MAHERAGQLAQPEDLIDIAEVVTAYFTRIPDVENPDQQVAFGTSGHRGSSLDSAFNEHHILATTQAIVDFRNQRSSNWVGPIFIGRDTHALSEPAMISALEVLLANDVEVLVDAAGGYTPTPAVSHAILRHNKDVRWGTAGPSYPLADGIVITPSHNPPRDGGFKYNPTNGGPADADATDWIADRANELLRGGLADVKRVPVNGVLDERAGRYDFKGTYIEDLPNVINIEAIREAGVRIGADPMGGASVDYWGAIAETHGLDLTVVNPHVDATFRFMTLDSDGKIRMDCSSPHAMASLIANRDKFDVATGNDADADRHGIVTPDAGLMNPNHYLAVAIDYLFANRPGWSENTAVGKTLVSSSMIDRVVASLGRTLVEVPVGFKWFVPGLISGEIGFGGEESAGASFLRMDGTTWSTDKDGIILNLLAAEIIAVTGKTPSQRYAELAEQYGAPAYARTDAEANREQKAILKALSPEQVTATELAGEPITAKLTEAPGNNAAIGGLKVTTENAWFAARPSGTEDKYKIYAESFKGEEHLRQVQEEAQALVSQVLGQ

SEQ ID NO: 35848 - protein, 133 aa, Medicago truncatula
MESPDPKSKKKAKTNKKMVTEPVHEPVQAKIEVVSSDPSKMPPFIGYFTSGFDPVKSSSGTDVQVYRNKVMHKRTELVVSPAGSSVEFVGTSYEGEAVAAARNPATYMLGVFDKESQTLKIVPIGGNKIGTKS

SEQ ID NO: 35849 - protein, 294 aa, Arabidopsis thaliana
MDQYEKVEKIGEGTYGVVYKARDKVTNETIALKKIRLEQEDEGVPSTAIREISLLKEMQHSNIVKYDDVVHSEKRLYLVFEYLDLDLKKHMDSTPDFSKDLHMIKTYLYQILRGIAYCHSHRVLHRDLKPQNLLIDRRTNSLKLADFGLARAFGIPVRTFTHEVVTLWYRAPEILLGSHHYSTPVDIWSVGCIFAEMISQKPLFPGDSEIDQLFKIFRIMGTPYEDTWRGVTSLPDYKSAFPKWKPTDLETFVPNLDPDGVDLLSKMLLMDPTKRINARAALEHEYFKDLGGMP

SEQ ID NO: 35850 - protein, 309 aa, marine gamma proteobacterium HTCC2143
MNHDFSAFLMQTKTRVDQLLGEHLGSFSSSYAAVDSGIYLTRLQQAMHYSLINGGKRIRPVLVYATAAAITTDVSPVVTANLDRIACSIEMIHAYSLIHDDLPAMDDDDLRRGQPTCHRAFDEATAILAGDALQARAFELLTELTECPPHIHLNLLRILTQASGQRGMVGGQLIDLESVDKPIDVQQLETIHRLKTGALIRASIAMGATLTGADRQQLEQLDCYGDAIGLAFQVHDDILDIEADTATLGKTQGADIALNKPTYPSLLGIDGAKAKAAQLHQQSLTAIEHFDANALLLRELSGYIISRSH

SEQ ID NO: 35851 - protein, 563 aa, Arabidopsis thaliana
MHGDVSKWEGYADWRNKAALRGRHGGMLAASFVLAVEILENLAFLANASNLVLYLKNFMHMSLARSSSEVTTFMATAFLLALLGGFLADAFFSTFVIFLISASIEFLGLILLTIQARRPSLMPPPCKSSAALRCEVVGGSKAAFLFVGLYLVSLGIGGIKGSLPSHGAEQFDEGTPKGRKQRSTFFNYYVFCLSCGALVAVTFVVWIEDNKGWEWGFGVSTISIFLSILVFLLGSRFYKNKIPRGSPLTTIFKVLLAASIVSCSSKTSSNHFTSREVQSEHEEKTPSQSLTNSLTCLNKAIEGKTHHIWLECTVQQVEDVKIVLKMLPIFGCTIMLNCCLAQLSTYSVHQAATMNRKIVNFNVPSASLPVFPVVFMLILAPTYDHLIIPFARKVTKSEIGITHLQRIGVGLVLSIVAMAVAALVELKRKQVAREAGLLDSEETLPITFLWIALQYLFLGSADLFTLAGLLEFFFTEAPSSMRSLATSLSWASLALGYYLSSVMVPIVNRVTKSAGQSPWLGEKLNRNRLDLFYWLMCVLSVVNFLHYLFWAKRYKYISTGSIS

SEQ ID NO: 35852 - protein, 848 aa, Rhodobacter sphaeroides 2.4.1
MQKIEPISDFDRITPTAAISLKTHGFRAKCLQRLVRLDLPVPVTVALPATTVRAIAAGHPVDCPAILADFGPTPLVSVRPSPENPDWGGPATVLNIGMNAARHAALARIHGEEAADAIYLGFIQSYAIHVARLDPEMFETGGSSSEALRAALHAWAEEMDEPFPQDPAQQLSEVLRSMARAWEGTTARLLRQAKGAPAEARLGLVVQEMAQDLGQGISGSGVIQFVDPATGVPQVTGRFFNRSRAWHGKAETLYLTQDPRGPSLEERAPEIFAALCRHGSVCRARLREEMQIEFTIEDSHLSVLDAVKVQRSSRAGLRIAVALADDQVITRSEALLRVEPRALSELLHPQVDPRGRRDRFARGIAASPGAAVGRIVFSSQAAQASAARGEPCILVRRETSPEDIRGMNCAAGVLTERGGVTSHAAVIARGLGLPCVVGASEIRLDARERRLVAPDGRVFREGDLITVDGTAGEALAGEAAMLAPALDSCFRKLLSWADEMRDIGVRANADTPADALVARQFEAQGIGLCRTEHMFFTDDRLVVMREMIFADSATDRAAALARLLPMQRADFVQLFEIMQGHPVCIRLLDPPLHEFLPHSREGLLELAEALDRPLSEVTRRVEAMAEFNPMLGMRGVRLGVAIPEIYDMQAQAIFEATLEVAGRGDPVVPEIMIPLVSARREVELVKTRIDAVAAAVHTKYGREFAYRLGVMVETPRAALRAGEIAQHAAFLSFGTNDLTQMTYGLSRDDAGRFMNTYVQSGVFPEDPFHILDVDGVGELLLIGAERGRATRPDLVVSICGEHGGDPESIEFCRRAGFDYVSCSPYRVPLARLAAAHLAIRSREQPNAS

SEQ ID NO: 35853 - protein, 332 aa, Oryza sativa (japonica cultivar-group)
MSTTNHYQHIKSNKPVLGKARKLKDLMLKSDNRICADCGAPDPKWASANIGVFLCLKCGDVHRALGPDVSKVLSVTLDDWSDSDIDSMLEIGGNSYANSIYESFLPKDHPKPKMDSTMEYRTKFIRAKYETQDFLKPSLRITSKGSFDATNAVKSVTSSISSASGKHVADDTREFVGELNITVVRGIQLAVRDMLTSDPYVVLTLGEQKAQTTVKPSDLNPVWNEVLKISIPRNYGPLKLEVYDHDTFSADDIMGEAEIDLQPMITAVMAFGDPSRVGDMQIGRWFMTKDNALVKDSTVNVVSGKVKQEVHLKLQNVESGEMELELEWVPIP

SEQ ID NO: 35854 - protein, 141 aa, Cryptococcus neoformans var. neoformans JEC21
MRKYFHVIPLPFPLEKLRFLAFAVGRSASSTLQVYLFLSKLQNYVYTYENISDMSAPTSIPALDEASKKELESFLEQEQAKAKLQASIHELTNTCWNTCITGGISSKFSKSEAQCLENCVDRFLDSSLYIVRQIEAQKQQI

SEQ ID NO: 35855 - protein, 247 aa, Oryza sativa (japonica cultivar-group)
MASGRYMAYSPSPSTTPHSPRIPGLRAASSAVADQEKYLAELLAERHKLSPFIPVLPNSVRLLNQEILRVSTLLENASLLNQSGLEHGSPLTTGGLYSNGAAADMNGWTSAFQSEGSPAYSWRGGSQGSSSGLIVKKTMKVDIPVDKYPTEDMMRGKPGYEHLNEPLHILVEAELPVEIIDTRLIQARDILEDLLKPVDESQDFFKKQQLRELAMLNGTLREEGMQRSGSASPFHNSLGMKRAKTRG

SEQ ID NO: 35856 - protein, 453 aa, Treponema denticola ATCC 35405
MYDLIVLGGGPGGYVAAIKAGRAGLKTALIEKNRLGGTCLNKGCIPTKYLLHTAEVFGSFAENDLGLSGENLKYDIKAIYEKKNAVVDKLVGGIEKLIENAGVDFYNGEGKITSKSSVSVNGKELEFKNLIIATGSSVFAPPIAGIETAMTSDDILGKEPVDFKSVIIIGGGVIGIEFATVYANLGKEVTIVELEKTILPPFDRDIAMQQAIVLKKRGVKIINGAMVTKIEKTGCTFTLKEKEESITADAVIVCIGRIAEIKDIGLDSAGIEYDKRGIITDACMKTNVEGIYAIGDAVKGNVMLAHNAENQGHLVVENIVNNTKHEKQDVIPSCVYSTPEIAGVGLSEKEAEAKGITVKIGKVPMGSNGKSVLSGLDVGFIKVLFNEEDRIVGCQMMCDSATDMIGAIGTLVTNKAKRENILKSMYPHPTVVEAFYEAVEDVEKSATHMIYKK

SEQ ID NO: 35857 - protein, 671 aa, Oryza sativa (japonica cultivar-group)
MFGRARCSTSAPAAGERRALPVDPLSLPRLLVSAATTPGAAAPAVSTLHAAALKLGVLPSSLPASNALVSAYSLSGLLPCALRAFSLIPHPSTGSYTAILSALSRHGRPREALSLFSAAAVARPDAELLSCVVSCCRRASASLPARAAHAYGVKTAPLLAFYASAGPALVALYAMCGRVSAAKRIFDRMDGEDVVSWNAMIGGFAGAGMNGEAWDCFREMRARGVRGNARTAVAVLGACDLESGRQVHGHMVRNHGDSGSNAILWNALMNMYSRVGCVDNAEHVFFEIERKDVVSWNVMIGAFAKNGHGERALELVDAMLRCGMQPDSVTFTTLLMACCHCGLVDEGLALFERFVENSALIPTMEQCACIVDLLSRAGRFREAAGFIDQMPIRPNAVVWGALLSGSRMHHDVDHAQIAFEKLVQLEPDNPGNFVTMSNIYAKAGMVEDAKRVRMMIDREELVKPSGQSRVQAIHHDLSTVLQSAATLMHPLPTVHLVSTIGYGQGLFTKRGFKGLFSTQGPLPRHLAHNINLSDQSFAVLSGVHCLVVCLLRRLRGKDDIVNAGIAGCCTSLALSFPGDRSPARSRRWSAGVVPQVDGGGGDDDGTGPKPRGRGRADREETWCPDLEKTFHSEADGGGGRQRWLGLEMFAPALSPVTKRPASNSSGSPMSG

SEQ ID NO: 35858 - protein, 276 aa, Paulinella chromatophora
MRLPSMRFRPLLALTLALCLTVLTACGGGSKAVDRSNVTYEDIVNTGKANDCPNLPESARGSISLNESKRYQLRGMCLHPTEVFVKGEPANKRQEAQFVAGKILTRYTSSLDQVYGDLSVSGDTLTFKEKGGFDFQPITVLLPGGEEIPFTFSTKKLEAKAQGAAISTSTDFEGTYRAPSYRTSNFLDPKGRGLTTGYGAAVGLPSADNEELSVENVKRYVDGSGKMSLFINKVDSETGEFAGVFSATQPSDTDMGGKEAVDVKITGQLYGRLEEV

SEQ ID NO: 35859 - protein, 327 aa, Oryza sativa
  misc_feature (133)..(133): Xaa can be any naturally occurring amino acid
  misc_feature (229)..(229): Xaa can be any naturally occurring amino acid
MAVYIAREATKLWRKVCAEIAVELQLLFEKWRLLLAGLVFQYIHGLAARGVHYLHRPGPLLQDLGFMALPELGQDKGYVSESVFTFIFISFLLWSFHPFIYHSKRFYTVLLWRRVLAFLVASQFLRIITFYSXQLPGPNYHCREGSKMATLPPPHNVLEVLLINFPRGVLFGCGDLIFSSHMIFTLVFVRTYHKYGSKRLIKILAWLMAIIQSLLIIASRKHYSVDVVXVAWYTVNLVVFFIDNKLPEMPDRTNGSSLLPVTVKDKDGRTKEELHKLEKDCKMKEEFHKLLNGNTVDSTDRRQRVQMNGKHGEDINHTLSDATPNGT

SEQ ID NO: 35860 - protein, 1483 aa, Arabidopsis thaliana
MTVLWFVSLILLISILLVAVKHSKRRWVRQPPSPPGLPIIGNLHQLGELPHQSLCKLSKKYGPVMLLKLGRVPTVIVSTPETAKQVLKDYDLHCCSRPSLEGTRKLSYNYLDIAFSRFDDYWKELRKLCVEELFCNKRINSIQPIKEAEMEKLIDSIAESASQKTLVNLSDTFLSLNVNVICKAVFGVNFQGTVLNNDKFQDLVHEALEMLGSFSASDFFPYVGWIVDWFTGLHARRERSVRDLDAFYEQMIDLHLQKNREESEDDFVDLLLRLEKEEAVLGYGKLTRNHIKAILMNILLGGINTSAITMTWAMAELIRNPRVMKKVQSEIRAQIGKNNKTRIISLDEINHLSYLNMVIKETCRLHPVAPLLVPREVISEFKINGYTIQPKTRLHVNVWAIGRDPEIWKDPEEFLPERFMDCDIDVKGQDYELLPFGSGRRICPAVYMGITTVEFGLANLLYHFDWKLPEGVAVEDIYMDEASGLTSHKKHDLLLVPVKSLVERRRLFCEISMKLYPRTSSGLFSLQSLLKSGFSPTLNSIDRFLRYLYRLQKFNCILQFYSQLDSKQININHRIYSIVSWAFLNLNRYEDAEKFINIHISKASIFPRTHMLDSLIHGFSITRDDPSKGLLILRDCLRNHGAFPSSLTFCSLIYRFVEKGEMDNAIEVLEMMTNKNVNYPFDNFVCSAVISGFCKIGKPELALGFFESAVDSGVLVPNLVTYTTLVSALCQLGKVDEVRDLVRRLEDEGFEFDCVFYSNWIHGYFKGGALVDALMQDREMVEKGMNRDVVSYSILIDGLSKEGNVEEALGLLGKMIKEGVEPNLITYTAIIRGLCKMGKLEEAFVLFNRILSVGIEVDEFLYVTLIDGICRKGNLNRAFSMLGDMEQRGIQPSILTYNTVINGLCMAGRVSEADEVSKGVVGDVITYSTLLDSYIKVQNIDAVLEIRRRFLEAKIPMDLVMCNILLKAFLLMGAYGEADALYRAMPEMDLTPDTATYATMIKGYCKTGQIEEALEMFNELRKSSVSAAVCYNRIIDALCKKGMLDTATEVLIELWEKGLYLDIHTSRTLLHSIHANGGDKGILGLVYGLEQLNSDVCLGMLNDAILLLCKRGSFEAAIEVYMIMRRKGLTVTFPSTILKTLVDNLRSLDAYLLVVNAGETTLSSMDVIDYTIIINGLCKEGFLVKALNLCSFAKSRGVTLNTITYNSLINGLCQQGCLVEALRLFDSLENIGLVPSEVTYGILIDNLCKEGLFLDAEKLLDSMVSKGLVPNIIIYNSIVDGYCKLGQTEDAMRVVSRKMMGRVTPDAFTVSSMIKGYCKKGDMEEALSVFTEFKDKNISADFFGFLFLIKGFCTKGRMEEARGLLREMLVSESVVKLINRVDAELAESESIRGFLVELCEQGRVPQAIKILDEISSTIYPSGKNLGSYQRLQFLNDVNEEEIKKKDYVHDFHSLHSTVSSLCTSGKLEQANEFVMSVLSCMPR

SEQ ID NO: 35861 - protein, 187 aa, Pneumocystis carinii
MKSKEAPLNQKGIPTAPFVDKIEDYVTSQEQVEPTLRQFQKLIAKYRFMEISFQRHTAGLLEKIPEMDKTLQMLRFLESKKENKEPFETYFELDDTLYAKAVIPPTNKADIWLGVKANVMIEYPIPEAIEFLLSKLASAKESLKQYEEDLEFVRENITTLEVNIARIYNWVYLIYNIKKKANMNNRM

SEQ ID NO: 35862 - protein, 237 aa, Synechococcus sp. RS9916
MDLQTQMKHAVAAAAVDQIKDGMVLGLGSGSTAALMIQGLGAKLASGELKDIVGVTTSFQGEVLAAELNIPLLSLNAVDRIDLAIDGADEVDPGFQLIKGGGACHVQEKLVAARAERFVVVVDSTKLVDRLNLGFLLPVEVLPGAWRQVQQQLAAMGGTAELRMAQRKAGPVVTDQGNLVLDVKMNGGIADPAALELAINNIPGVLENGLFVNLADEVLVGEVNGDVAGVRSLERRA

SEQ ID NO: 35863 - protein, 431 aa, Idiomarina baltica OS145
MSNSLQQAIQFDQQHIWHPYTSMTDPLPCYHVKSASGCEIELSSGEILVDGMSSWWAAIHGYNHPQLNAALHAQADKMSHVMFGGLTHQPAINMVERLIDLTPAPLDRVFIADSGSVSVEVAIKMALQYWFSIEQPKKNQLLTIRGGYHGDTFAAMSVCDPVNGMHHMFRHALCNQHFVERPAVEFDDEWEPSSLSSIQQELEQHHTEIAAVIIEPVVQGAGGMRFYHPEYLTQLRELCNHYDVLLIADEIATGFGRTGQLFGCDHAGIVPDIMCVGKALTGGYMTLAATVTHAKVAEAIGQGQGGGALMHGPTFMGNPLACAVANASLSIIQSGDWKTQVPRIECQLREELGPLKRHPSVADVRVLGAIGVVELNKPVNVARTQALFVELGVWIRPFGRLMYIMPPYCISAQQLSKLTHAIAVYLETTTN

SEQ ID NO: 35864 - protein, 298 aa, Triticum aestivum
MSMCEKDQNFHWAYDLFHDPFAAPNSYYGHPNGYSDSSYCDYNYARDASHPDETYLHSSALTCDMYNPQVGMYHPGNVGGQEHEAVYVDPSSSSSYPESDDCFEMEEEVGKRFYPMVPVPHVPKINGEIPSLDEATMDHERLSDRLRLYELTENKVKGDGNCQFRALSDQLYQTPDHHEFVREQIISQLKSNREAYDGYVPMAYDEYLEKVSRNGEWGDHVTLQAAADKYGVKIFVMTSFKDTCYIEIQPKVQKSNKVVLLSFWAEVHYNSIFPQNDAPRLHHTAKKRRWWPFSQHHH

SEQ ID NO: 35865 - protein, 1072 aa, Medicago truncatula
MMRIEGIQKRLVSGAYNRGLTSLEKKLQNELAEILKTEELMWFQRSRAKWLADGDRNTRYYHLKTVNRRRRNNVVMLRNSEGEWIDNPTILQRLVNDFYKNLFTNNNTGGRWFQTDVTYPQIDVADMEKLVLPIGDGEVKRALFSMNPWKAPEPDGFPAGFFQQSWDVVGKNICEFVRDVWREPDKISTVNKTDICLIPKINQPEFVSQFRPISLCNTIYKIVSKVVVGRLKEYIPHIVSPHQTGFVPGRSIHENIVVAQELAHSMNRMRGRTGYFVIKVDLAKAYDMLNWDFIWRTLKEIGFPDVLIDLIMHGVTSVETNVKWNGARTEYFRPQRGIRQGDPISPYLFVLCMDKLSHLITHEVNQGRWKALRAGRRGPVISHLMFADDLLLYGEATTSQMKCVTDTLKTFCDLSGQQVSQEKTSMLFSKNVHRGVRQQLLLLCGFKETSFLGKYLGVPLLGRAPKRADFQYVIDQVNGKLAAWKTNQLSFAGRVTLAKSVIEAVPIYPMMTNIIPKACIDEIHKIQRQFISGDNENNKRYHAVSWETVSKPKVFGGLGLRRLNVMNKACIMKLGWSIYSGSTSLWAEVMRGKYQRSDILAELFIAKPSDSSLWKALVKLWPALERNIFWSIGDGKSVGAWSQMWIEERLCVSELEIDIPQQCKEMKVADLVDFNGNWNFELLNQWLPYDVVQRIMTIAVPDENDGNDKQMWSGSSNGKFTIASAYHMLSKFDNDAQDEIWLKLWKIRAPERIKHFMWMLYHGRLLTNLRKHKMGIGNPMCRFCHDEIESEIHVLRDCPKATALWLCVVDNAARTSFFEGDLSNWINFNLFTNVYWNHNVEWRDFWATACHAIWNWRNKETHNDNYQRPLHAKNIIMSYVNDYHNAIAKSVIVTSQLRHLEEVGWKEPPIGWVKINTDGACKDGSIAGCGGLIRGSQGEWLAGFSKFLGKCDAFIAELWGVLEGLRCAKRMGFTAVELNVDSLVVVNIITSGKESNARGRSLVQKIRKLLQMEWEVKVKHSYREANRCADALANIGCIMENGMMFYESCPTQINHLLAADQAGVTFPRLIKM

SEQ ID NO: 35866 - protein, 482 aa, Bacillus halodurans C-125
MHTQVVQERMLISDQWQHGQQSIEVIDPGTNHVIATVPAATEADAKAAIEAAKEGAEIARQMPIHERAAILKRTAEIVTRDRELFAQTIAKEGSKTIREARSEVRRCIETLTLSGEEAKRLHGETIPFSQMPGHERRVGYFYRFPIGIIVAITPFNDPLNLVAHKIGPAIAAGNSLIIKPSSFTPLSALRLVKALEEAGLPKKIVQVITGHGSVIGPTLTKHRDVRLISFTGGYETGEKIARSAGVKKLAMELGSNSPTIVLQDAELMEAVASCVSGAFCAAGQNCIGVQRIYVEQSVFNSFIQSFVAQTKQLRLGDKQSEETDIGPMISEKEAKRIERWVEEAKEEGARVLTGGRRTGAYFEPTVLTNVSPSSRLAKEEAFAPIVIIEGVHSLTEAIARANDVDFGLQAGLFTNNLTAAFSAIEKLEVGGIMVNDSSDVRIDAMPFGGIKKSGLGREGVRYAIEEMTEQKVVAFHLPEHKI

SEQ ID NO: 35867 - protein, 118 aa, Triticum aestivum
  misc_feature (7)..(7): Xaa can be any naturally occurring amino acid
  misc_feature (14)..(14): Xaa can be any naturally occurring amino acid
  misc_feature (18)..(18): Xaa can be any naturally occurring amino acid
  misc_feature (26)..(26): Xaa can be any naturally occurring amino acid
  misc_feature (31)..(31): Xaa can be any naturally occurring amino acid
  misc_feature (41)..(41): Xaa can be any naturally occurring amino acid
  misc_feature (44)..(44): Xaa can be any naturally occurring amino acid
  misc_feature (85)..(85): Xaa can be any naturally occurring amino acid
  misc_feature (89)..(89): Xaa can be any naturally occurring amino acid
  misc_feature (92)..(92): Xaa can be any naturally occurring amino acid
  misc_feature (115)..(116): Xaa can be any naturally occurring amino acid
CFVSVPXYTGFLPXLFWXGHGKLARXMTLLXAFCDYLGNAXKDXVSAPRPCSPPVRRVTATEDEKENAMEYGLPSSHALNTVCLXGYMXHYXLTYGPCDGFTIATGLSLAFMLVXXIG

SEQ ID NO: 35868 - protein, 295 aa, Bacillus halodurans C-125
MNIGRIVTAMVTPFNEQDQVNLEATCQLVNELIANGSDALVVGGTTGESPTLTTDEKMALFHTVVEAAGGRVPVIAGTGSNNTRASIELSKKVEDLGVDGIMLVTPYYNKPSQEGLFQHFKAISESTSLPIMLYNIPGRSGVNLDAETTLRLAELRNIVSIKEASGNLDQIAEIIEHSPADFSVYSGDDSLTLPLLSIGGTGVVSVASHIIGNEMQEMVQLFLSGQVERAAAIHRKLLPLMKTLFMTPNPTAVKAALELKGLPVGHVRLPLVPLTAEEQRQLELAINPQFNMFVS

SEQ ID NO: 35869 - protein, 246 aa, Staphylococcus epidermidis ATCC 12228
MKKPDIQQLKDIVNNSNQIVFFTGAGVSVASGIPDFRSMGGLYDEISKDGQSPEYLLSIDHLHDNKESFINFYHERLLIADKKPNIVHQWIAQLENQQKSLGVITQNIDGLHEDAGSHNIDELHGTLNRFYCINCYEEYSKSYVMTHHLKYCEKCGNVIRPDIVLYGEMLNQKTVFKALDKIQHADTLIVLGSSLVVQPAAGFVSEFKGDNLVIINRDATPYDHTASLVIHDDMTSVIEEIVNSNS

SEQ ID NO: 35870 - protein, 582 aa, Cryptococcus neoformans var. neoformans JEC21
MTMELLKVLHHEASQLFPNCIRSSPVACIVLYSFGGIAILLFSVYLWLWPFQYAKLYFRNLPGPPSDSWFWGVVPTLIKSPPSVPHSMWTDEYGPTVRYRVALGAQRFLTIDPTALNYILSHADLFPKPSRVRKALSDLLGNGLLTAEGHTHKKQRKALNPSFSPAAVRGMIPVFYDKAYELKAKLLGIIEGDETEQASPTPCKEEDEVEGGKKIDVMKYLGKTTLDVIGIVGFSYDFKALSEPRNELSEAYSKMFQAGMDANFWDFLRGAIPLVNKLPNKRATEIAARKAVTLRISKKIVEDKKREVMSAHSEGLEKREDIGDDLLSILIKANMASDVKPEQKLSDEEVLDQITTFMLAGNETSSTALTWILYSLTQHPECQTRLREEVLAVPDDRPSLETLNNLPYMDAVIREALRLHAPAPGTMREAKEDTVIPLSMPVIGRDGKQIDSVKINKGTMVFIPIITVNTSPAIWGPDARVFNPDRHLKTSSDSFGGANMHVPGVWGNMLSFLGGARNCIGYKLALAEISTILFVLIRSFEFQELKSKPEVEKKASVVMRPRIKGEESAGLQMPLMVKPLLM

SEQ ID NO: 35871 - protein, 321 aa, Triticum aestivum
  misc_feature (114)..(114): Xaa can be any naturally occurring amino acid
  misc_feature (195)..(195): Xaa can be any naturally occurring amino acid
  misc_feature (203)..(203): Xaa can be any naturally occurring amino acid
  misc_feature (225)..(225): Xaa can be any naturally occurring amino acid
  misc_feature (245)..(245): Xaa can be any naturally occurring amino acid
  misc_feature (279)..(279): Xaa can be any naturally occurring amino acid
SDDTKAPFGVVGGATGNLRLNWGGGRARFPHITCVGVHSEYGAQSVALSGGYIYDEDHGEWFLYTGCGGRHLSGHKRTNRELSSDQIFEGVGGALFLTRKNAYPLRVVGSHKEXLSSYAPETGVRYDGLYKIEKCWKNIGVQDTYNVCMYLFVRCDNEPSPWTRDLHGDRTGPLPNIRDLQCATDITERARSPSXHYVEYEGXKCVNSPPISKKRAQSGDSECDXQFKMSHKRAHIPIKERLLKXFGCPMCQNVMKDPLPPPVVKSLKTCFTSAFGNRXSIRKKAGAAPLCGPKYVKNCPPRPINFGISWEPPRYLSYFSL

SEQ ID NO: 35872 - protein, 600 aa, Magnaporthe grisea 70-15
MALTRLGLTLTRSSRLALRPSYSSPLPQQLRRAPSGLRQISTSQIRMSTIASFKIPKVVNEPNQHYEKGSPSREGLTAALSALKQKGAVEVPIVVGGKEIKTSSTGTQVNPADHQTVIATYSKASPEDVSRAIDEALAAKKDWESLPFNDRAAIFLKAADLISTKYRYDIMAATMLGQGKNAWQAEIDSAAELCDFLRFNVQYAEEMYAQQPAHNSPGVWNRVEYRPLDGFVYAVSPFNFTAIAGNLPGAPALLGNVVVWKPSDFAIASNWLLYNILLEAGLPKGVIQFVPGDPEEVTRVVLSHRQFAALHYTGSTAIFRKLYGQIGAGVAEGKYASYPRIVGETGGKNFHLVHHSADLENAVIQTVRGAFEYQGQKCSATSRLYVPKSMWPRFRERLAEEVKKLKIGDPGDHGNFIGPVIHEGSFKKLSGVIDEAKNDSKLKLVAGGKYDSSKGYFVHPTIYETTDPAHKLLSQELFGPVLVAYAYDDDLHGDPAAAFGKICETVDSTSEYGLTGAVFAVDRAAVRFAEDKLRNSAGNFYVNCKSTGAVVGQQPFGGGRASGTNDKAGSMNLLGRFVSTRSLKEEFNATTSVLYPSNQV

SEQ ID NO: 35873 - protein, 332 aa, Ralstonia metallidurans CH34
MTIKIGINGFGRIGRMVFRAAAANFKDIEVVAINDLLEPDYLAYMLKYDSVHGRFDGEVSVEGNTLVVNGKKIRLTAVKDPSELKWGEVGADVVIESTGIFLTKEGAQKHIDAGAKKVIMSAPSKDDTPMFVFGVNHETYKGEAIISNASCTTNCLAPVAKVLNDKWGIKRGLMTTVHAATATQKTVDGPSNKDWRGGRGILENIIPSSTGAAKAVGVVIPQLNKKLTGMSFRVPTSDVSVVDLTVELENPAKYEEICAEMKAQSQGALKGVLGYTEDKVVATDFRGDARTSIFDAEAGIALDGTFIKVVSWYDNEWGYSNKCLEMARVVAK

SEQ ID NO: 35874 - protein, 659 aa, Ralstonia metallidurans CH34
MADAIRVLAMDAVQQANSGHPGAPMGMADMAVALWGRHLKHNPVNPHWPDRDRFVLSNGHGSMLIYALLHLTGYDLPIEELKNFRQLHSKTAGHPEYGITPGVETTTGPLGQGITNAVGMALAERLLGEEFNRPGFDIVNHHTYVFMGDGCLMEGISHEACSLAGTLKLNKLIGFWDDNGISIDGDVVHWFADDTPKRFEAYGWNVIRAVDGHDVAAVDNAIALAKASDKPTLICCRTVIGKGAPNKAGGHDVHGAPLGGAEVLATREALGWTHAPFEVPQDAYLAWDAKPNGHALEKAWDALFDAYAEVHPYEAGEFKRRVRGELPGAFDAAVDAYIAKCEEKAETIATRKASQNSIEALAPVLPELLGGSADLTGSNLTNWSGTQAVRFDSWGNHINYGVREFGMSAIMNGIALHGGYIPYGATFLTFSDYSRNALRMAALMKIRSLFVFTHDSIGLGEDGPTHQSIEHVASLRLIPNMDVWRTADTTETAVAWAQSIRRENGPSCLIFSRQNLPFQKRDDVTRANIARGGYVLRDGTNPRKKRPDAVIIATGSEVGLAVGAADALAVEGVHVRVVSVPSTSVFDKQDAAYKASVLPAGVPRIAVEAGVTDFWWKYQVQAVVGIDTFGESAPAGVLFKHFGFTVENVADTVRATLAQ

SEQ ID NO: 35875 - protein, 324 aa, Ralstonia metallidurans CH34
MREPDGGKTAILAEAGGIPGTDPALRRGTQAWTEWLIPGVGTTLGEITLLAAACSPYQQIEIGESAHFGRIFRLDGRVMSTEADAWIQHELMVAPMAATHGAPRSALVVGGGDGGSAFELLRIPTMREVVVAELDGEVVRLAREWLRGIHQGALDEPGDPRLSLAIGEGLGLMEAFARAGRQFDLIVYDLTEADDGSPAAALFSPHGLHTARRCLAPGGAMSLHLGPPLHRPETARRLLARLRHVFRHVAPLTTFVPAYGALWGIALASDALDIAAQPADKIATRLQQWQLEHKLRAYHAYLHPALFVHPRHVQAIFDSGSRPA

SEQ ID NO: 35876 - protein, 437 aa, Mycobacterium avium subsp. paratuberculosis K-10
MHFARHGPDITPPIITRGHGVTIYDDRGNSYLDGLSGLFTVQVGHGRAELAEAAARQAGTLAFFPLWGYATPPAIELAERLAGYAPGDLNRVFFTTGGTEAVETAWKLAKQYFKLTGKPGKHKVISRAVAYHGTTQGALAITGLPRYKAPFEPVTPGGFRVPNTNFYRAPEAFANDPKGFGLWAADRIAEAIEFEGPDTVAAVFVEPVQNAGGSIPPPPGYFERVREICDRYDVLLVSDEVICAFGRIGSMFACADFGYVPDMITCAKGMTSGYSPIGAMIASERLFEPFDDGDTMFPHGYTFGGHPVSAAVGLVNLDIFEREGLNDRVRTLAPTFRATLEKLYDLPIVGDVRGEGFFYGVELVKDRATKQTFTDSERRALLGRVGAALFEAGLYCRTDDRGDSVIQLAPPLISGQAEFDTIEAALRGVLSDECRRL

SEQ ID NO: 35877 - protein, 450 aa, Mycobacterium avium subsp. paratuberculosis K-10
MARGSRRGLLVGLTAASVGVIYGYDLSIIAGAQLFVTEDFGLSTRQQELLTTMAVIGQIGGALFAGVLANAIGRQRSVLLILSGYAVFALLAAFSVGLPMLLTARLLLGLTIGVTVVVVPVYVAESAPTAVRGALLTAYQLAIVSGLIVGYLSGYLLADTHSWRWMLGLACVPAVLLLPLVFRMPDTARWYLLKGRVDDARRALLRVEPVARVDDELAEIDRAVSEEAASLPAMLAEMVRSPYRRATVFVVVLGFLIQITGINAIIYYSPRIFEAMGFTGNFALLALPALVQVAGLVAVGTALLLVDRVGRRPILLCGTAMMIVADVVLVAVFGRGPGGVIAGFAGVLLFIFGYTMGFGSLGWVYASESFPSRLRSIGSSTMLTSNLVANAIVAAVFLTLLHSLGGAGTFAVFAVLAVVAFAFVHRYAPETKGRQLEDIRHFWENGGRWD

SEQ ID NO: 35878 - protein, 515 aa, Yarrowia lipolytica CLIB122
SRRNPPEKKYSSVVIRHKHRPSSHIQLHTMSKLTVNTDLSDSEDEVLQKNEESLDDYCPGGYHPVKIGEKFANGRYVIVRKLGWGHFSTVWLARDTQNNDRHVAMKVVRSASHYTETAIDEIKMLERVSSKNPDHPGKAHVVGLYDSFKHVGPNGTHYCMVFEVLGENLLGLIRRHQFAGIPVKLVKQITKQVLLGLDYLHRECGIVHTDLKPENVLIEIGDVEKMLKLAEEEDRAAVETKKTKPGSRTGRRSRRQSLITGSQPLPSPLRSNASFFNDLTMTKMVEEVRLDDDHEKKTSNQLSKSPTSVSPTKPRTALAEELISVKIVDLGNACWVEHHFTNDIQTRQYRSPEVLLGSFWGASSDIWSMSCLVFELLTGDYLFEPQTGSKYSKDDDHIAQIIELLGKIPTSVLQTGKWTSEYFNDKGELKKISKLKDWPLEAVLHEKYNHSKEEAKLLASFLLPMLQMDPQQRADAGGMSNHRYLDDASGLSDIKVDRKCGRSGIDIVGWASEAK

SEQ ID NO: 35879 - protein, 560 aa, Arabidopsis halleri subsp. gemmifera
MASSTASISDTEAWKDLKGHVEDIKKTHLRDLMTDANRCQSMMMEFDGLLLDYSRQRATVETVDKLLNLAKAAQLTEKISRMFNGEHINSTENRSVLHVALRAPKDAVIKADGKNVVPEVWNVLDKIKEFSEKIRSGSWVGATGKPLKDVIAIGIGGSFLGPLFVHTALQTDPEALESAKGRQLRFLANIDPVDVARNINGLNPETTLVVVVSKTFTTAETMLNARTLREWITAALGASAVAKHMVAVSTNLALVEKFGIDPNNAFAFWDWVGGRYSVCSAVGVLPLSLQYGFSVVEKFLKGASSIDQHFQSTPIEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGRVLATHVRKQLHSSRTQGTTLEGFNYSTTTLLIRYLETSSEPQM

SEQ ID NO: 35880 - protein, 261 aa, Yarrowia lipolytica CLIB122
MSPIASLESAYKAGDYEKVEQLLLPLKVDMAKSGLLTSPNSSGHSKADLEAARTALEIGALSAVNLGKEAEFTRFVAQSRQFYGIQGLSASPHESKIVALYLLLLLSQNEIAQFHTELESLDFDTVENDKFLSFPIKLERWIMEGAYDRVWKAITNKDAVPSSEFLCFADPLVFAIRGEIALCAEKAYTSLPLNNARHLLFFDSDQGVVDFVQEQPGWEIHGERITFPGVISEDATLNSRKVTEKLIGNSLEYAKEMEQII

SEQ ID NO: 35881 - protein, 560 aa, Arabidopsis halleri subsp. gemmifera
MASSTALISDTEAWKDLKGHVEDIKKTHLRDLVTDANRCQSMMMEFDGLLLDYSRQRATVETVDKLLNLAKAAQLTEKISRMFNGEHINSTENRSVLHVALRAPKDAVIKADGKNVVPEVWNVLDKIKEFSEKIRSGSWVGATGKPLKDVIAIGIGGSFLGPLFVHTALQTDPEALESAKGRQLRFLANIDPVDVARNINGLNPETTLVVVVSKTFTTAETMLNARTLREWITAALGASAVAKHMVAVSTNLALVEKFGIDPNNAFAFWDWVGGRYSVCSAVGVLPLSLQYGFSVVEKFLKGASSIDQHFQSTPIEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATHVRKQLHSSRTQGTTLEGFNYSTTTLLKRYLETSSEPQM

SEQ ID NO: 35882 - protein, 493 aa, Treponema denticola ATCC 35405
MSTKVCLVLTEKTIEKNLSALEKYKKFIDIAELRVDYLNQSEILYLRNFPERAGIPCILTVRRKSDGGNFTGGEGARMTIFARGLAFANADPIKNFSYIDLESDFDSSGIEEAARAFDIKIIRSLHSKVPVKNIVKTVEGLSRFETDIPKLAFTANCLNDVSELFKASKLIKNQEYILSVMGPYGLSSRILSNKLNSQIVYTFTPEYIKKNKLEQELIDPETLEELYGFSKIDEETSLYGVIGKDVNTSLSPQIHNKGFKRKNLNSVYIPISAVSSKEALDFANLLKIKGLSVTAPFKSEIIPLINSISEASKFIGAVNTLVSENKKWFGYNTDVDGFQQALMEFLNEKDLRKYKVAIIGAGGAARAVAEVISSLHGKACIFNRTAEKAKNIAEKYKFKWALLDPINIKQLHAFSELIIQTTNAGMEPDIYMDPLNFYTFTGKEKVFELIYRPETTKMLKRARTAGCQVCNGYKMLEYQAYHQFKAFAGKEYL

SEQ ID NO: 35883 - protein, 239 aa, Treponema denticola ATCC 35405
MDTSQLKERVAYHAIDTLFSEGKIFDGMKIGLGTGSTAMPAVHRLAQLLSSGKLKKIYAVPTSFQTSIECEKLGIPIYSLSSQQIGGSLDLAIDGADEIDPDKNLIKGGGAALLKEKIIAYNSKEFVVIADERKKVKSMGKGFALPIEIIPEARLSITKALEAQGIEVFLREGVKKMGPVVTDNGNFIIDVKWPKAADVDPKALEESLNKITGVVENGFFTKNTPRVFIVHQDGNIEDL

SEQ ID NO: 35884 - protein, 788 aa, Idiomarina baltica OS145
MQENVLWYQQLGMQDVNRVGGKNASLGEMISNLAGAGVEVPGGFATTADAYNEFLEQSGLNDKIYELLDGLDVNDVNKLTEAGRTIRQWIIDTPFQPAFEADIKQAFSQLSEDNDEFSFAVRSSATAEDMPDASFAGQQETFLNVRGLDAVMEAIKHVFASLFNDRAISYRVHQGYDHRGVALSAGVQRMVRSDIASSGVMFTIDTESGFDQVVFVTSSYGLGEMVVQGAVNPDEFYVHKPTLNAGRPAVLRRNLGSKKIQMVFSEDRAHGKQTLIEDIDSAKSQTFSITDAEAEELARQALIIEKHYGRPMDIEWAKDGIDGKLYIVQARPETVQSNQKGQAIERFALQDTSAVVCEGRAIGQRIGKGVARVLDSIEEMDKVQPGDVLVTDMTDPDWEPIMKRAAAIVTNRGGRTCHAAIIARELGIPAVVGCGNATQLISNGQAVTVSCAEGDTGYIYEGELDFEVTESRVDAMPDLPLKIMMNVGNPDRAFDFAGLPHAGVGLARLEFIINRMIGVHPKALLNFDDQPDALKATISTMIAGYESPREYYVARLAEGISTLAAAFAPERVIVRMSDFKSNEYANLVGGSQYEPDEENPMLGFRGASRYISEEFRDCFALECEAIKRVRNEMGLSNIEIMIPFVRTLEEGRQVIDLLEEQGLKQGENGLRVIMMCELPSNALLADKFLDMFDGFSIGSNDLTQLTLGLDRDSGLIAHLFDERNDAVKALLEMAIKAAKARGKYVGICGQGPSDHPDFAQWLVEQGIDSVSLNPDTVIETWMYLSEQL

SEQ ID NO: 35885 - protein, 378 aa, Glycine max
MGIRSVFDGGELRREVEKSGIDPKFIPKIWKHILISAKDEDWDWEKQVPSLPSSAYSLLRSNFKTPLSSSIHSVFHSADNLTTKLLIQLHHNHGPFVEAVIMRYDTRLGKYAGQPRPGGLRATLCISSQVGCKMGCNFCATGSMGFKNNLSSGEIVEQLVHASTFSQIRNVVFMGMGEPLNNYSAVVEAVRIMTGLPFQLSSKRITISTVGIIHAINKLHDDLPGLNLAVSLHAPAQDIRCQIMPAARAFPLGKLMDSLQVYQRKSLQKIFIEYIMLDGVNDEEHHAHLLGKLLETFQVVVNLIPFNSIGTLSQFKPTSEQKVSNFQKILRGTYNIRTTVRKQMGQDISGACGQLLVNISDKSLGTAVPLTDIEDIVI

SEQ ID NO: 35886 - protein, 464 aa, Zea mays
MVNGEQRADAECTRASLLGRYEIGRTLGEGNFGKVKYARHIATGGHFAIKILDRSKILSLRIDDQIRREIGTLKLLKHPNVVRLHEVAASKTKIYMVLEFVNGGELFDKIAIKGKLSEHEGRRLFQQLIDGVSYCHDRGVYHRDLKPENVLVDRKGTIKISDFGLSALPQHLGSDGLLHTTCGSPNYIAPEVLQNRGYDGSLSDLWSCGVILYVMLVGCLPFDDRNLVVLYQKIFKGDCQIPKWLSPAAQDLLKRILQPNPMKRINVAGIREHEWFKKDYVPAVPHDDDEDVLPSPAPSIKEPIDEPAQEKCTPINAFQLIGMASSLDLSGFFEEEDAAQRKIRFTSTHPPKDLFDKIESVVMEMGFKVHRGAGKLKVLKNSKCSRNSRNPSSLLVCTEVFELGPSLYVVELRKSHGDSTLYRQLCERLSDELGACKTDQIARTESSSDDLSSLDGEAFPLSGF

SEQ ID NO: 35887 - protein, 222 aa, Glycine max
MAAAATAAAATGTLLPHALLNHRSPPPPQLLALSSSFRRLSLSTSHRRTTHLVAHSDAGAVEPEPVSEPAPEGEPVAASADSEEGEAEGAVALAEEEEEPAPRPKPIKFGEIIGILNKQFIEEAEKVKVLPDLKPGDIIELRMQRPNKRRLSLFKGIIIAKHKSGVHTTIRVRRIIAGVGVEITFPIYSPRIKEIKVIRHKKVRRAKLYYLKYKLPRFSTFK

SEQ ID NO: 35888 - protein, 330 aa, Arabidopsis thaliana
MVGGRGGVGGGGGNRVEADQWLVTSEKLLASSDLQGAKTFAIRACEADPTRAEAADYILAICDILLAGETRLGDSNLPDWYAVLRLGRLAQNPEHVATQYRRLALLLNPSVNRLPFADRALKIVSDAWFVLSDPFKKSFYDRELQLSQLGQSGFHPQTQSHQNFQWEPSSSTAVYPPPRSQSQAGTSADTMATSFWTACPYCFVLFEYPKAYEECTLKCQECRRAFQAVTIPKPPVDKKDDEDVYFCSWALFPLGFSGEFQAPSWSPISPLFACPLQKLDGEPKKRKEPGPPRIYYDDDDIYVAISDGDDAGDDGDWQDVVQVNKKTNVG

SEQ ID NO: 35889 - protein, 177 aa, Triticum aestivum
LLSHGLSGYKNLSPSHKLDVLNSLCDEALSSEKLRTRIEAREGVARQKIRAATEKEKELKERQNDMAKTMGGEIAGNEEANNIFCQIKEAKEVKQAAMNELEERGCVLRPTPVMVDKGVAYWKLDGYCDNNTNILRQEFDKEATMKNQDKWFMFSEDEQKVVENHVTTRVPAPMEKG

SEQ ID NO: 35890 - protein, 76 aa, Glycine max
MVVTQVQLDRAKDIRRELEMEIIEEHTVMEYSKVSKKCEKCGHGEATYYTRQMRSTDKGQTTFYACTGCGHPSQEN

SEQ ID NO: 35891 - protein, 416 aa, Saccharomyces cerevisiae
MTTNEEFIRTQIFGTVFEITNRYNDLNPVGMGAFGLVCSATDTLTSQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFAEMIEGKPLFPGKDHVHQFSIITDLLGSPPKDVINTICSENTLKFVTSLPHRDPIPFSERFKTVEPDAVDLLEKMLVFDPKKRITAADALAHPYSAPYHDPTDEPVADAKFDWHFNDADLPVDTWRVMMYSEILDFHKIGGSDGQIDISATFDDQVAAATAAAAQAQAQAQAQVQLNMAAHSHNGAGTTGNDHSDIAGGNKGQRSCSCK

SEQ ID NO: 35892 - protein, 638 aa, Polaromonas sp. JS666
MAKTRLTVDTNDLASRITRAPFPGSAKIYIEGSRPDIRVPFREVTLTDTMVHEGAGEPRREANPPLRLYDASGVYTDPASPIDITRGLPPLRGAWINERADTEALPGISSAYGRERLNDPALAALRMAHAPVPRRAKAGANVSQMHYARKGIITPEMEYIAVRENLVRAQLAERLATERMPKKGHSFNASIPEQITAEFVRDEVARGRAVIPNNINHPESEPMIIGRNFLIKVNANIGNSAVTSSIEEEVDKLVWSIRWGADTVMDLSTGENIHETREWILRNSPVPIGTVPIYQALEKVNGKAEDLTWEIFRDTLIEQAEQGVDYFTIHAGVRLAYVPLTANRLTGIVSRGGSIMAKWCLSHHKESFLYERFDEICEIMKAYDVCFSLGDGLRPGSIADANDEAQFAELHTLGELTQIAWKHDVQVMIEGPGHVPLQLVKENVDKQLEACFEAPFYTLGPLITDISPGYDHISSAMGAANIGWYGTAMLCYVTPKEHLGLPNRDDVKQGLIAYKIAAHAGDLAKGYPGAQMWDNAVSKARFEFRWEDQFRLAIDPDTAMAYHDETLPKENAKVAHFCSMCGPKFCSMKISQEVREFARLNPASTTLAAPGVIAIKQIDSGFEEKAKEFREGGSEIYS

SEQ ID NO: 35893 - protein, 446 aa, Pediococcus pentosaceus ATCC 25745
MAKKNYSQADIRQMAKDENVRFLRLMFTDLFGIIKNVEVPISQLDKLLDNKLMFDGSSIDGFVRIEESDMYLYPDLSTWMVFPWGSEHGKVARIICEVYSNDRKPFVGDPRNNLIRVLQEMKDAGFTDFNIGPEPEFFLLKLDENGKPTTNLNDKGSYFDLAPVDLGENCRRDIVLELENMGFDVEASHHEVAPGQHEIDFKYADALTAADNIQTFKLVVKTVARKYNLHATFMPKPMDGINGSGMHLNMSLFNKEGNAFYDEKGDLQLSQNAYWFLGGLLKHARSYTAVCNPIVNSYKRLVPGYEAPVYVAWSGSNRSPLIRVPSSKGLSTRFEVRSVDPAANPYLAIASVLEAGLDGIRNKIEPEDSVDRNIYRMNIQERNEEHITDLPSTLHNALKEFQNDDVMRKALGDHIFQSFLEAKKLEWASYRQEVTQWERDQYLEMF

SEQ ID NO: 35894 - protein, 344 aa, Agrobacterium tumefaciens str. C58
MEQAMPKTSDTEYLSFPILLGDIGGTNARFSILIDSFAEPVHLTTVKTAEYPGIDDAIQQAVLDKTSLQPVSTILAIAGPIEGDEIPLTNCHWVVKPKDMLAKLGLKDVIVINDFEAQALAIAALDDDNREPIGSGKKDMLASRVVLGPGTGLGVAGLVYARHMWFPVPGEGGHIDIGPRSARDYVVFPHIETIEGRVAGEQILCGRGLVNLYRAICKADGIEPVFSDPADITSQGLSGQNAQAKETLSLFSTYLGRVAGDLALIFMAKGGVYLAGGISQKIIPALKSPEFRAAFEDKAPHSALMRTIPTFVVTHPQAALSGLATYARTPADFGLALDGRRWRA

SEQ ID NO: 35895 - protein, 529 aa, Zea mays
MAMMDKWTGLGSALASMLFLWSMVQNHLPAAFGYRLSTWGNKLASLFSPYLEITISEYGAERFRRSDFFLAAEAYLSDACSRRARKLRADLGKDSKNLQVSVDDNDEVTDDFSGATIWWYASKQLARSQVISFYPGEDERRFYRVVFHRRHRDLVVDEYLPHVLEEGRAVTVRNRQRRLFTNNPSGSWNSYRGKSVWSHVPFEHPATFDTLAMDPDDKEDILDELRAFRDAKAYYTKVGKPWKRGYLLYGPPGTGKSTMIAAMANFLDYDVYDLELTAVKNNTELRKLFIETTGKSIIVIEDIDCSVDLTGKRKDDKKRASAEADDKPKTPTDPDKDEGSKVTLSGLLNFIDGLWSACGGERIIIFTTNHKDKLDPALIRRGRMDRHIEMSYCRFRTFKVLAKNYLDVEEPHELFGQIEKLLEETDMSPADVAENLMPMSKKKKRRDANACLESLVEALKQAKEDAAAAAAAKALADARAAKEEAEEAKEKEAKEKDEATNSKGAADPAGKDTKMSNGDVTVNKEGGDE

SEQ ID NO: 35896 - protein, 1526 aa, Nostoc sp. PCC 7120
MMSLINLDLVISAVTSIANPVIKEKILRSETVIKLLQQFNLDPEHPPADFSGVYAYTLVEYGVGKPKAFLELFRQEAIKQAFRKALDHNNPSILLSEVDTFLDACTLGDEIRSLELDVRREVAAFATVFIEVAKRSRTPADVLMNQQIGSLHKRIAGIQEQLERLPTLEGIRTEIARLAAQNYPALTPTATENQCRAIALAQQMRGWFETLGYRLEKYEIWAEEYFEWIINVPVRRSYDRILVRGVAGEVRLSDVMALCQSVNQQKTDEGWLVSTRRISRAARDEVKKEENRHLDCFTFDELIDLDADFSGYLDWLEAEIKRRKIDQKYVPLACTKEEIDPVTKRRIGISRYEAEDGWIDGYIDLWLDDPAKEHISILGEFGTGKTWFVFHYAWTALQRYKDAQRRGVERPRLPLVITLRDFAKALNVENVLAGFFFTQHNIRLNSEVFDQLNRMGKLLLIFDGFDEMAAKVDRQQMINNFWELAKVVVPGSKVILTCRTEHFPEAKEGRALLNAELQASTNKLTGETPQFEVLELEKFNDEQIRQVLLYQAEEATVEQIMGNSQLLDLARRPVMTDLILEALPDIEAGKPIDMSRVYLYAVRHKMERDIKAERTFNSLADKLYFLCELSWEMLSTDQMSLNYRLFPERIRRLFGSVVQEEKDLDHWHYDMMAQTMLVRNADGDYTPAHRSLLEFFVAYKFAAELGALARDFTEVGQAQSGLDSSTASIDYTWSGYFSRQLDSTGCREVIAPLRQFKSEFLDKLRETFGKAKLTKAVIDLLLPMLDDNEPLIKIIEATRGRTEDEVNYVGGNAATLLVKLNKMVLEGRDLSHTVIIGADFTNTSLRCVNFTEANLAYSVFTKILGSVLTVAFSPDGKLFATGDSGGIVRFWEAATGKELLTCKGHNSWVNSVGFSQDGKMLASGSDDQTVRLWDISSGQCLKTFKGHTSRVRSVVFSPNSLMLASGSSDQTVRLWDISSGECLYIFQGHTGWVYSVAFNLDGSMLATGSGDQTVRLWDISSSQCFYIFQGHTSCVRSVVFSSDGAMLASGSDDQTVRLWDISSGNCLYTLQGHTSCVRSVVFSPDGAMLASGGDDQIVRLWDISSGNCLYTLQGYTSWVRFLVFSPNGVTLANGSSDQIVRLWDISSKKCLYTLQGHTNWVNAVAFSPDGATLASGSGDQTVRLWDISSSKCLYILQGHTSWVNSVVFNPDGSTLASGSSDQTVRLWEINSSKCLCTFQGHTSWVNSVVFNPDGSMLASGSSDKTVRLWDISSSKCLHTFQGHTNWVNSVAFNPDGSMLASGSGDQTVRLWEISSSKCLHTFQGHTSWVSSVTFSPDGTMLASGSDDQTVRLWSISSGECLYTFLGHTNWVGSVIFSPDGAILASGSGDQTVRLWSISSGKCLYTLQGHNNWVGSIVFSPDGTLLASGSDDQTVRLWNISSGECLYTLHGHINSVRSVAFSSDGLILASGSDDETIKLWDVKTGECIKTLKSEKIYEGMNITSVRGLTEVEKATLKTLGAVENREI

SEQ ID NO: 35897 - protein, 322 aa, Hyphomonas neptunium ATCC 15444
MEGSVLVGDVGGTNVRFALAARRNGALSIEHFQKFQGDDFESFEDALKQYLDKTGVRATVACFAMAGPVRDQKVTLTNRAKWQVSSTGLEARFGFEAVRLINDFQAMARSVPEFSVSSFEEILPGTSQTGAPMLVAGPGTGFGVATLLAGANGQWSVVSGEGGHMAYAPRTDIEHDLARLLARDHGYVSNELVASGSGLEEVHRAFCEIFDRDCLNLSPETMRQRADDGDEMFQTLIEVRALAVMGAAGDLVLANGALGGVVLAGGVSERISEFLKTPLARQRFTSRGPMSDYLETCPVWLMRDASAPLIGAAAYFEQPSRI

SEQ ID NO: 35898 - protein, 446 aa, Frankia sp. EAN1pec
MTQASSAHPENREHVFYSWAAQETTHPLVVAGAEGSWFWDKGGTRYLDFSSQLVNANIGHQHPAVVEAVVAQARELTTVGPQHAHAVRSEAARLIAERAPGDLDQVFFTTGGAEATENAVRLARLATGRNKILAAYRSYHGSTGGSITLTGEPRRWASEPGIPGVVHFFGPYPYRSSFHAADAAQEGERALAHLAEVIELEGPSAIAAVILEPVVGTNGILVPPDGYLAGVRELCDAHGILLIADEVMSGFGRCGEWFAIDHWNVVPDLICFAKGVNSGYVPLGGVIISQRIADLFARRPYPGGLTYSGHLLACAAAVASIRAFESEDILGRARALGSEVIGPQLAKIAARHPSVGEVRGLGVFWAVELVRDRVTREPLVPFNAAGAAAAPMAAVTAACRERGLWPFTHFNRVHVVPPCTTSPEDVSLGLSILDEALAVADGCYTG

SEQ ID NO: 35899 - protein, 232 aa, Magnaporthe grisea 70-15
MAQNQDVFQYSMSSNSAWAGYKAHQNPNFFPKLASGQWPQILWLGCSDSRCPETTILGLQPGDVFVHRNIANIISATDINTSAVIEYAVMHLKVKHVVLCGHTACGGANAALGDSRVGGVLDTWLTPLKAVRQANAAELDAISDAKDRVVRIAEMNVEAGVKVLMANANIQDAIQERGLQVHGCIFDLASGRMKDLGYGNAAKGPQSGDGEVVRGRHATLVFRGGNASMTAR

SEQ ID NO: 35900 - protein, 326 aa, Synechococcus sp. RS9916
MGSDLHQCQSGVRGRGCMASPRVLVVAGTHGNEINAPWLLDQWQQQPDLIDACGLEVVPVIGNPAAREQGRRYLDRDLNRSFRPDLLEQAAAGTSAVDREMARAQSLVRAYGPKAPKPCSLALDLHSTTAAMGSSLVVYGRRPADLALAAGVQQRLGLPVYLHEADLAQQGFLVERWPCGVVIEIGPVPQMVLTSRIVEATRLSLQACLEVVAEASQGRWTGPQSLLVHRHLGSVDLPRDDQGRPLACVHPSLQGADWRLLMDGDPLFLKADGSEILYDGPSGRVPVFINEAAYGEKGIALSLTERERWPLERSAPEALTALLRAS

SEQ ID NO: 35901 - protein, 381 aa, Schizosaccharomyces pombe 972h-
MSDDSHLETKVVTDGTTGEKKTISYEPCRVLGSGSFGVVIQAKLVGTPGFIAVKRVLQDKRYKNRELQIMRAISHPNIIKLIAFFHTHNPSKDETHLCLLLEYMPETVFDDMRWYTRRRKSIPNLSIKLYAFQLFRALAYLHSTGVCHRDIKPQNLLVDYKTGILKLCDFGSAKVLVPSEPNVSYICSRYYRAPELVFGATHYTTKIDVWSAACVIAELFIGRPLFPGDSSVEQLVEIIRVLGTPSYHEISVMNPNYVNHSLPNVRPHTLESVMPHNCTKNAMDLLHKMLTYVPSKRISAIEVLTHPFFDELRDPNCMYHCSRDEGTIERHLPPLFNFNLAELSIRPNLNKAILPPHVYESLDVDINNFEPIVVKQADADS

SEQ ID NO: 35902 - protein, 103 aa, Schizosaccharomyces pombe 972h-
MSGRGKGGKGLGKGGAKRHRKILRDNIQGITKPAIRRLARRGGVKRISALVYEETRAVLKLFLENVIRDAVTYTEHAKRKTVTSLDVVYSLKRQGRTIYGFGG

SEQ ID NO: 35903 - protein, 136 aa, Schizosaccharomyces pombe 972h-
MARTKQTARKSTGGKAPRKQLASKAARKAAPATGGVKKPHRYRPGTVALREIRRYQKSTELLIRKLPFQRLVREIAQDFKTDLRFQSSAIGALQEAVEAYLVSLFEDTNLCAIHGKRVTIQPKDMQLARRLRGERS

SEQ ID NO: 35904 - protein, 1367 aa, Magnaporthe grisea 70-15
MSTETSPRAVRFSQGEDERLMRPFVLGADSGNSHSSGELSSPDLHHMVETPDEMGSLTRYVDVTSHGGSHVSLATNGSARSHRNSGGESTAAGYTNGGATPRPAQRPMGPARTPSNTYQPPRKPTAQQTPSYLHTSTSDLRNGSRMRNGYGQQEKEYVRSLRAQHYGGDYFVSYSNGSQLGASSGDGYPDSDSEGETPSSEAPYDDAYDQNVIMIDSNEDTAPSEEELKDPASRERLEWHGMLEAVLTGDVVRQEKKRLIAGTGEDLGKLQRGAELWMGIRARVCGRHLSVQRRMVEETRATLARMIDEVIDFSVKGESTAGKSAAEQIAEVLEKIDKIEGQYPTRNALLAVHTSANTERFQEACDAVYTWTNINYLINTELTILRNWVGNHELDFTRAREKSPNGHHGLSDESSFMDRLMKEEGLKSLHDHEEDEGDRKSRRNGMLHRVGKTIEKAKEALVEQHQVFKKRQMSLDMDELLMLLGFPARLIEEIIKVRLAYTKRMKESAQQNPMMQDNMIAQFQTLLKLAIRIKQEAAKLSEPQPGWELPPCIDESFDQVVLDALKYYFKMLNWKLGGNKNTFKEAELLFQEWGFANEIASHLYRGDIEVAEQFSSLTYKTLNRLAITFEKELQRRPKETPSEMSKRYKQVLESVRVRQRMLQRFSRMLNDNYENASDFSINFRPDKMQEFFLRLQETGHFQVYTGSLEHEGLLVIASPSLANRESEIQSLIGTTAYDEIVQDATNPYILIMRPEGQLGWWGPKIQLSVREEPVELKMGHLRLIAGGSQTRLSNAKQNFLATIEMHLDLLIEQRSNLPKVNARLMEIRKVQYKLSNTFMDSVEIIRNNTKGLGLQDLIQTCFIFATEFGQRSLLYLDSNRRQMNNIKLTKLALDWVGFVCDDCQSSDRKAFKWAVLALEFAMVMTRGRHILALGEAEFVKLRLKVAGCMSLLISHFDIMGARSTVAAQAEKLKLEAMVGQMRRMDHNMMDDQEAIRYVRNHRLSGLNLIDEARKEIALERSALGRVLEVSNEVDRSLAYLSSTATNFTMRWQQGHFVGGGTFGNVYAAMNLDTGHLMAVKEIRLQDPKLIPSITGAIKDEMRVLESVDHPNVVSYYGIEVHRDRVYIFMEFCSGGSLASLLEHGRIEDESVIMVYALQLLEGLAYLHEIKIAHRDIKPENILLDHNGIIKYVDFGAAKVIARQGRTLANQDLMSAATKPNKSMTGTPMYMSPEVIKGENPGHFGAVDVWSLGCVILEMATGRRPWANLDNEWAIMYNIAQGNPPQLPTPDQLSPEGIDFLKCCFARDSTKRATALELLHHKWIMTIRDRIVPQQPPTPSDTSSSSAQNTPNPASSSKGGGASSDGYY

SEQ ID NO: 35905 - protein, 286 aa, Aspergillus oryzae
MLKLSTILGSLFYLLPIYIFLIAPALRQFFPPAEEDLTFDPDDDAADLEGPILNDTILSLDDGIEPTCAPDNYRVHLLRRDPLVIYIEDFLSSEEADHLVELGQETYTPSIIYDGTTEKVDPNTRLSDRALLPRTNTVRCLENRAKAFQGWRPHLYIERMWAQRYNASGHYRHHYDWAGSSARGGDRASTFMVYLGDECTGGGTNFPRFKRPRDEKWCRFVECENEAEGVTFRPVKGNAIFWENLRPDGSGYLETWHAAFPVTEGTKVGLNIWSWYQAPRRRRIFC

SEQ ID NO: 35906 - protein, 506 aa, Triticum aestivum
  misc_feature (215)..(215): Xaa can be any naturally occurring amino acid
  misc_feature (254)..(254): Xaa can be any naturally occurring amino acid
MALAILARRRAAEAVARRAHAPGAAALSAWRAYAAAAAAEESDVVVVGGGPGGYVAAVNAAQLGLKTTCIEKRGTLGGTSLNVGCIPSKALLHSSHMYHEAKTSFAHHGVKISNLEVDLPAMMAQKDKAVAGLTKGIEGLFKKNKVTYVKGFGKLTSPSEVSVDLVDGGNTVVKGKNIIIATGSDVKSLPGITIDEKKIVSSTGALCLSGMPQKXVVIGAGYIGLEMGSVWNRLGTEVTVVEFAPDIVPSMDGXEIRKQFQRMLQKQKMKFMLKTKVVGVDTSGDGVKLTLEPAAGGEQSILEADIVLVSAGRTPYTAGLGLDAIGVEMDKAGRILVDKRFMTNVSGVYAIGDAIPGPMLAHKAEEDGVACVEFLAGKEGHVDYDLVPGVVYTHPEVASVGKTEEQVKASGIAYRVGKFPLMANSRAKAIDDAEGMVKVVADKETDKILGVHIMAQNAGEIIHEAVLGLQYGASSEDVARICHAHPTVSEALKEACLQTHSKAIHI

SEQ ID NO: 35907 - protein, 163 aa, Agrobacterium tumefaciens str. C58
MMGVSGSGKSTVAEGLAEKLGIAFIEGDKLHPKSNVDKMSEGIPLTDDDRWPWLDLIGAELRNGSEGKGVLVSCSALKKIYRDRLREATGGPLAFVYLDGSLELLSRRMGERKGHFMPLSLLQTQLATLEVPTGEPGVVTVSIDSTPEEIVANALAGLKTLKF

SEQ ID NO: 35908 - protein, 481 aa, marine gamma proteobacterium HTCC2143
MSTAASVHKSALKQQRTTLQITLVAALGGLLFGYDTGVIAGSQLYFTEYFNFTAAEQGWAVSSALYGCLMGALAGGYLANRISRKYTLILGAVLFVVSAWGSGFADTLDQLVIYRILGGLGVGLASLAAPMYIAEISPAKNRGRMVSYYQLAVVIGFFVVFLATYFIGGGDTQNMATERLALLHEHNVTQGWRVMFWSELLPATAFFLLLFTVPHSPRWLMLKGRTDEAEAVLARITSSPQEAASELSDIRASLENRSSPNLTVLFTKGIGFALFLGVMLSIFQQVTGINAILYYGAEIFSNALGYGPEDALKQQLWLGAVNLLFTFVAIYKIDSWGRKPLFIAGAVGMCVGLSILGLSIYVQQMGIISLLAVLLFVGSFAMSMGPVVWVILSEMFPNNVRSVAMSIAVAAQWLFNALVANSFPLVNQSALNQDGFNGALPYFIFAGFCVVAMIFVWKLVPETKGKTLEEMEALWSIKDKG

SEQ ID NO: 35909 - protein, 461 aa, Polaromonas sp. JS666
MPSNTSSLIDLDRAHLIHPVAPWRKHEQRGVTVLESGHGAWLKDAAGNELLDAFAGLWCVNVGYGQESVVQAATEQMRKLPYATGYFHFGSEPAIQLAAKLVEIAPPSLKHVYLTLGGSEAIDAAVRLIVHYYNATGRPGKKQFISLERGYHGSSSTGAGLTALPVFHRGFDLPRPEQHYIASPYLYRSPEGSTAQSVIDASVQSLRAKVASLGADNVAAFFCEPIQGSGGVIVPPTGWLKAMRQACTELGILFVVDEVITGFGRTGPMFACQAEGVEPDLMTMAKGLTSGYAPMGALMMSGAVYAGIADGAAPGVPIGHGATYSAHPVSAAIALEVIRIYQEGGMLAHAQKVAPHFAQGLDALTAHPLVGEARHRGLLGALELVSNKTTKAGFDPALGLSDLLFETGYRNGLVFRSFGDNILGFAPALCYTEGEFSQLFERLEKTLDEVLAVPDVRRALG

SEQ ID NO: 35910 - protein, 177 aa, Triticum aestivum
  misc_feature (114)..(114): Xaa can be any naturally occurring amino acid
  misc_feature (170)..(170): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWXTMWKLPMFGCTDATQVINEVEEVKKEYPDAYVRIIGFDNMRQVQCVSFIAFKPPGXCEESGKA

SEQ ID NO: 35911 - protein, 129 aa, Cryptococcus neoformans var. neoformans JEC21
MPAEYVLTNDAPPPLPGIYTQAVRAGNYVYTSGSVGMTKEGNMVKGTIQDRTRQVIQNLEAVLKGANMNLSNVVKANIYLSNLSRDFVAVNEVWKDIMPEPKPARTCIGVAELPAGGTDVEIEFVAYDG

SEQ ID NO: 35912 - protein, 359 aa, Ostreococcus tauri
MAVERSRGAVAGAFALVIAAGLSTAIGSAFVFCSARANTKALARSLGASAGVMIYVSFAEIYGVKSVEAFTEVCDGDGACGMRYASLCFFGGLTFMYALDAVVHELPSVGRRARKWWRGRTSSSDEEVPDTPRGEQRNDIFCIHGDLETHVRNVTEMEKGMARSETQSDDSANTDDDRTTAPEDNVMSVGVGNVDMTDVHHKPLEAKQLRNMGVLTAIAIGLHNFPEGLATFVAALEDTKLGAALAVAIAIHNIPEGICVAMPIYYATGSKWKGFWWSFVSGLTEPVGALVGYGVLKGNDMSPAAFGSLFALVAGMMVFISVKELIPTALKYDPHDEVVTTYVFVGMALMALSLVLFAL

SEQ ID NO: 35913 - protein, 498 aa, Polaromonas sp. JS666
MQAFDPNQISVPTGHFINGALVGDARAETVAVRRPSDGQVYAQLPLADEALVDRAVEASWKAWRSGDWARRAPRERARVLRRWADLVEADAPTLGLIEAVGSTRPVRDVMAWDIPFTAEGLRFFAEYADKIGGEVAATQHSQLGMTIAEPYGVVGAITPWNFPLVMVSWKVGAALAAGNAVVLKPSELTPFSSLRLAELAVQAGVPADIFNVVQGYGHVAGDALSRHQRIAKMTFTGSTRTGSSIMATCAQYGPKPVTLELGGKSPQLVFDDAPDIDKLAALIAGAITGNAGQVCVAGSRLIVQRGIAEALTERVSARFAAHRPGPTWDTDATLPPIISAAQGQRIGGIVGRAKEAGAVVRCGAGFADIAQARQGGSYYLPTLLEGVDSSNPAVREEIFGPVLTVQTFDEEEEGLALAEHECYGLAAGVHTADISRALRAVRKLEAGTVWVNRYGRSNDFVIPTGGYHQSGIGKDLGRQAVEANLRFKSVLVDFAAPV

SEQ ID NO: 35914 - protein, 377 aa, Photobacterium sp. SKA34
MTTQQQKPPLLWLNVAVFSVTLLVAIIGVPLYAYQYGFDWTQILMLVIAFSFCGMSITAGYHRLWSHKTYQANAMLRFIFAIGGAFALQNSILHWSSDHRIHHRHVDNNDKDPYSAKKGFFYSHIGWMLRDYQASRYHDYDNCRDLQKDKIVMWQHKYYLLLAIGTNFGIPLAFGLIHGDIWGALLLVGFLRLVLSHHTTFFINSLAHIWGSQPYTDRNTARDNGLLAFLTFGEGYHNYHHIFENDYRNGICWWQFDPTKWLIKSCSWIGWTRNLKVTPADRIEKTKAKMQFKRIQQQLSKMPNNVVRLTQLQQEYEALITKISDYYQAKKRLLDMEKQKIASSYDNFEFIQQYKSMQARLEQQRRAWKGLMQQYTM

SEQ ID NO: 35915 - protein, 400 aa, Silicibacter pomeroyi DSS-3
MSFLSATLSRVKPSPTVAMTAKAAELKAGGRDIIGLSAGEPDFDTPQNIKDAATAAIAAGKTKYTAPDGIIELKQAVCAKMQRDHGLSYTPAQVSVGSGGKQTLYNALMATLNPGDEVIIPAPYWVSYPDMVLLGGGTPVVVETALESAFKLTPAQLEAAITPRTKWFIFNSPSNPTGAGYSRDELKGLTDVLMRHPHVWVMSDDMYEHLAYDGFAFCTPAQVEPGLYERTLTCNGTSKAYAMTGWRIGYAAGPVGLIAAMRKIQSQSTSNPCTISQWAAVEALNGTQEFLAPNNALFKRRRDLVLSMLNAIEGIDCPTPEGAFYVYPSIAGLIGKTTPKGTRIDSDETFCTALLEEADVAVVFGAAFGLSPNFRVSYAASDAALTEACTRIQRFCASLT

SEQ ID NO: 35916 - protein, 235 aa, Brassica rapa
MSSQICRSASKAARSLLSSAKNARFFSEGRAIGAAAAVTASGKMPLYASNFARSSGSSKSWITGLLALPAAAFMVQDQKVFAAEMERTFIAIKPDGVQRGLISEIISRFERKGFKLVGIKVVVPSKDFAQKHYHDLKERPFFNGLCDFLSSGPVIAMVWEGEGVIRYGRKLIGATDPQKFEPGTIRGDLAVVVGRNIIHGSDGPETAKDEINLWFKPQELVSYTNNAEKWIYGDN

SEQ ID NO: 35917 - protein, 112 aa, Brassica napus
MLAVHRPSSAVSDGDTVQIPTMVQKRFPSLSRDATAARFHTHEVGPNQCCSAVIQEISAPISTVWSVVRRFDNPQAYKHFLKSCSVIDGDGGNVGSLRQVHVVSGLPAASST

SEQ ID NO: 35918 - protein, 342 aa, Streptomyces avermitilis MA-4680
MRVGVLTGGGDCPGLNAVIRGVVRKGVQEYGYDFVGFRDGWRGPLEGDAVRLDIPAVRGILPRGGTILGSSRTNPLKLDDGIRRIKENLAKQEVDALIAIGGEDTLGVAARLTDEYGVPVVGVPKTIDNDLSATDYTFGFDTAVGIATEAIDRLHTTAESHMRVLVCEVMGRHAGWIAIHSGLAGGANVILIPEQRFDVDQVCAYVTSRFKASYAPIVVVAEGAMPKDGQMVLKDESLDSFGHVRLSGVGEWLAKEIEKRTGKEARTTVLGHVQRGGTPSAFDRWLATRFGLHAIEAVRDGDFGKMVALRGTDIVRVPIAEATAKLKTVDPKLYEEVGVFFG

SEQ ID NO: 35919 - protein, 346 aa, Borrelia burgdorferi B31
MKVLGIETSCDDCCVAVVENGIHILSNIKLNQTEHKKYYGIVPEIASRLHTEAIMSVCIKALKKANTKISEIDLIAVTSRPGLIGSLIVGLNFAKGLAISLKKPIICIDHILGHLYAPLMHSKIEYPFISLLLSGGHTLIAKQKNFDDVEILGRTLDDACGEAFDKVAKHYDMGFPGGPNIEQISKNGDENTFQFPVTTFKKKENWYDFSYSGLKTACIHQLEKFKSKDNPTTKNNIAASFQKAAFENLITPLKRAIKDTQINKLVIAGGVASNLYLREKIDKLKIQTYYPPLDLCTDNGAMIAGLGFNMYLKYGESPIEIDANSRIENYKNQYRGKNNEKNFSNA

SEQ ID NO: 35920 - protein, 345 aa, Bacillus subtilis subsp. subtilis str. 168
MYDTIVIGAGQAGISIGYYLKQSDQKFIILDKSHEVGESWKDRYDSLVLFTSRMYSSLPGMHLEGEKHGFPSKNEIVAYLKKYVKKFEIPIQLRTEVISVLKIKNYFLIKTNREEYQTKNLVIATGPFHTPNIPSISKDLSDNINQLHSSQYKNSKQLAYGNVLVVGGGNSGAQIAVELSKERVTYLACSNKLVYFPLMIGKRSIFWWFDKLGVLHASHTSIVGKFIQKKGDPVFGHELKHAIKQKEIILKKRVIAAKQNEIIFKDSSTLEVNNIIWATGFRNPLCWINIKGVLDQEGRIIHHRGVSPVEGLYFIGLPWQHKRGSALLQGVGNDAEYIVKQMNGE

SEQ ID NO: 35921 - protein, 304 aa, Zea mays
  misc_feature (252)..(252): Xaa can be any naturally occurring amino acid
  misc_feature (298)..(298): Xaa can be any naturally occurring amino acid
MADAKQQQAAAPTGVWKTIKPFVNGGASGMLATCVIQPIDMIKVKIQLGEGSAAQVAKTMYANEGLGSFYKGLSAGLLRQATYTTARLGSFRVLTNKAIEANDGKPLPLVQKAFIGLTAGAIGACVGSPADLALIRMQADSTLPAAQRRHYKNAFHALYRITADEGVLALWKGAGPTVVRAMSLNMGMLASYDQRVELFRDKLGAGEYQTVIGASAISGFCAAACSLPFDYVKTQIQKMQPDATGKYPYTGXSLDCAMQTLEDRWANLRSTPASPVYCGRIAPHVMMTWLFLNQIQKXQKKIGI

SEQ ID NO: 35922 - protein, 327 aa, Arabidopsis thaliana
MAIARTGVYVDDYLEYASTFPAELQRLLNTVRELDERSQSLINQTRQQTKYCLGLASQSSKKGNGNHYNNGGLDEEETIEKMRKEIESSQENALSLCTEKVLLARQAYDLIDSHVKRLDEDLNNFAEDLKQEGKIPPDEPSVLPPLPIVPKAEKRKSFYGTPQPKKIDYRDRDWDRDRDFELMPPPGSNRKDLMPIEEQPIDPNEPTYCVCHQVSFGDMIACDNENVSLLSQHLIIYFLIAKEVNGFTIHALASHLRPDSKGNGTAPPADSSHSHTNIICTCEKFREERCFTEQTHFCFRGNAVFGTSKLNFYKAKSIPKHMSKWIH

SEQ ID NO: 35923 - protein, 530 aa, Mycobacterium leprae TN
MACSVQMPALGESVTEGTVTRWLKQEGDTVELDEPLVEVSTDKVDTEIPSPAAGVLTKIIAQEDDTVEVGGELAVIGAPSEAAAAAPAPRPEPKAQPEPAASSQPAAPAQQPSGAATATPVLMPELGESVTEGTVTRWLKKIGDSVQADEPLVEVSTDKVDTEIPSPVAGVLVSITTNEDTTVPVGGELARIGVTLDSIATPAPAPRAESVPSRPTPARKEANGAPYVTPLVRKLATENNIDLAKVIGTGVGGRIRKQDVLAAAEQRKQQQAPTSAPSAAAPTPTPVLAHLRGTTQKVSRIRQITAKKTRESLQATAQLTQTHEVDMAKIVGLRAKAKAAFAEREGVNLTFLPFIAKAAIDALKIHPNINASYNEDTKEITYYDAEHLGFAIDTDKGLLSPVIHYAGDLSLAGLARAIVDIAARARSGNLKPEELSGGTFTITNIGSQGALFDTPILVPPQAAMLGIGAIVKRPRVVIDASGNESIGVRAICYLPLTYDHRLIDGADAGRFLTTIKHRLEEGAFEADLGL

SEQ ID NO: 35924 - protein, 182 aa, Oryza sativa (japonica cultivar-group)
MATGNGEAAVVEKEGEGTMVPEALEKKVVLDAAEKEEEEKDSEAEAEAEARISKLVGDMIDNVCADHGIPLPKVDIKTVRKMAEYMNKHFAITNKEELKIWDEGFINELDGDEDKYSLFKIIRASERVGFYGLLDLASDMVARKIKAGKAIDEIRKFLGVEKDFTKEEEEKIRRENAWAFEE

SEQ ID NO: 35925 - protein, 497 aa, Francisella tularensis subsp. holarctica
MYVLRIHRVIMDFLTEKQNREIEEYAVSQSLNLIENASDEIVKLICNKFDKQSKVLVIAGSGNNGSDGIAAAIKLFNKGYDVDIYRVFPKGNRDNQNYYAKFSNLKDPLRELTNISDYDVVIDAIFGIGLDRNIDGHILEIINAINQNSKYTLAIDVPSGLGAFNAKVYGQAIQANETITFLADKQGLHTGDGLDYAGKVTVKELIDSSNIKLSQSEYQVYKNHIQDINLANILRKKKNTNKGTYGNLAIIGGNVGMNGALQLAGKSALYSGCGKVSMISLDRGFRADISIPELMTKPLEIISKNLEIFSALAIGVGFDTTDESQQILELIIGNITQPIIFDADALNIIATNQQIREKFIQLENKIITPHPAEAARLLGCTIQKIQNDRFDAVRALAKKYNATVVLKGAGSLICKDDEIYINTTGNQGMAVAGQGDVLSGIIGAFLAQGLDILSASRLAVYIHGLAGDNLAKKLGGYIGIFPSGVAEEVCEVLNLFI

SEQ ID NO: 35926 - protein, 370 aa, Saccharomyces cerevisiae
MNIQSNNSPNLSNNIVSKQVYYAHPPPTIDPNDPVQISFPTTEVVGHGSFGVVFATIIQETNEKVAIKKVLQDKRFKNRELEIMKMLSHINIIDLKYFFYERDSQDEIYLNLILEYMPQSLYQRLRHFVHQRTPMSRLEIKYYMFQLFKSLNYLHHFANVCHRDIKPQNLLVDPETWSLKLCDFGSAKQLKPTEPNVSYICSRYYRAPELIFGATNYTNQIDIWSSGCVMAELLLGQPMFPGESGIDQLVEIIKILGTPSKQEICSMNPNYMEHKFPQIKPIPLSRVFKKEDDQTVEFLADVLKYDPLERFNALQCLCSPYFDELKLDDGKINQITTDLKLLGFDENVELGHLSPDELSSVKKKLYPKSK

SEQ ID NO: 35927 - protein, 492 aa, Polaromonas sp. JS666
MPLTLSQTDLLRQQNFINHQWQDAQSGARLPVSDPATGLDFAHVPDSGAADALAAVDAAHAVFPAWRARSARERAQFLKRWHALILANQHDLGRLISREQGKPLAEGVGEVAYAASYVEWFAEEATRTYGDMIPEPARGRKLMVVKEPVGVVAAITPWNFPAAMIARKIAPALAAGCTVVAKPAEDTPLTSLALVLLAQQAGLPPGVLNMVTASREKTPEVVDVWLADARVRKITFTGSTPVGKHLARESAGTLKKLSLELGGNAPFIVFDDADIDAAVNGLMVAKFRNGGQTCVCPNRVFVQDAVHDAFVEKLRARVGALKVGPASAPDSQIGPMINARAVEKIERHVADAVAKGARIAVGGQRMEGAAYASPNYYAPTVLTGAHSGMACSLEETFGPVVPVTRFGSEAEVIAAANDTPFGLAAYFYSSNIARVWRMADALESGIVGINEGALAAEVAPFGGVKESGYGREGSRYGLEDYMHTKYLCQGLV

SEQ ID NO: 35928 - protein, 399 aa, Triticum aestivum
  misc_feature (64)..(64): Xaa can be any naturally occurring amino acid
FRCPSESHSIVYSWNESVGKFNQSFFHIHFAHASDFVETKQSTEGKWSHGKTMPVKNVQALAAXAAELTEEAIKRYIRPARADDVVVAAHGDNSSQSIPVIDLGRLLDPRSYQLEAARLRSACEEWGFFQVKNHEIPDTVLENMRNDLEHFFRLPLDEKNRFGQLPGDLQGYGQAFVESEHQTLDWCDRLYLVTQPPHDREMRPWPTTPVSFRESIESYSSELMRVTGSLMAIIARNLGVDLPSDTYVSQALRMTYYPACPVAHDKVLGISPHSDISMLTLVWELNMVGGLQIKRQDAWVPVKPHPKALVVNVGDFLEIMTNGKYQSIEHRVTVNPHKERMSISAFHLPKFDMSVGPLSEIVGAELKKYKTLRVDEVAKVVFSSKLDGKKTKDYAMLRV

SEQ ID NO: 35929 - protein, 391 aa, Mycobacterium avium subsp. paratuberculosis K-10
MGESGPVVIDPRRHDAVLFGVGDALGSALASQLGQIGVGTAAFAADGPAAAADRLRVRPGRCVVVAGDPAAVEAARTAGFALVIGLAPVGRDGDGLRGAGADAVVAELEQITVRTGDRRMSQLPDASQALTGGADGLAGRHPAVFFDFDGTLSDIVDDPDAARPVAGATAALTRLAARCPVAVLSGRDLADVTKRVGVLGIWYAGSHGFELTAPDGSHHQNDDAAAAIPVLAQAAGRLRDELGAIPGVVVEHKRFGVAVHYRNAARDRVGEVAAAVRAAGRHDALRVTTGREVIELRPDLDWDKGKTLHWVIEHLRRSGSGALTPVYLGDDITDEDAFDAVRGGPVQGVPILVRHNDDGDRATAALFALDSPARAAEFTERLADQLERGEG

SEQ ID NO: 35930 - protein, 315 aa, Salmonella enterica subsp. enterica serovar Typhi str. CT18
MNITIATLSELLVEFLAKKENQGFSSPGEFWGPYPSGAPAIFADQVAKLGFRSLLFSCVGNDAFGVMNITRLSRDGVNVQGISVLPNATTGSAFVSYRSQAQRDFIFNMPDSACGLLSADHLDETLLRQYRHFHIMGSSLFSFRLIDAVRKAISIVKENGGTISFDPNIRKEMLKIREMSQAFEYILDYTDFFLPSDGELDYFGLSKSRDEEKIVARLHKRGIAHVIIKRGARGASYYSKDEQHHVAGYPVKVVDPTGAGDCFGATFVSLFLAGYSVPDALAHANAAGSLAISARGPMEGTSTLAQIKELMRQQN

SEQ ID NO: 35931 - protein, 865 aa, Oryza sativa (indica cultivar-group)
MVPPSAAAAVARARTLLCVPATARAPREMAAELAAAAALGADVAELRLDRLAGFAPRRDLPVLLAQPRPLPALVTYRPKWEGGEYEGDDEPRFEALLLAMEMGAEYVDIELKVADKFMKLISGKKPETCKLIVSSHNFENTPSTEELENLVAQIQATGADIVKIATTATEIVDVAKMFQILVHCQEKQVPIIGLVMNDRGFISRVLCPKFGGYLTFGSLEKGKESAPAQPTVTDLINVYNIKQIGPDTKVYGIIGKPVGHSKSPILHNEAFRSVGLNAVYVPFLVDDLANFLNTYSSPEFAGFSCTIPHKEAAVRCCDEVDPIAKDILEPFNKSRVTFVSNNFVQDIGAVNTIIRKPNGKLVGYNTDYVGAISAIEDGIRASQPTDTTTSPLAGRLFVVIGAGGAGKALAYGAKEKGARVVIANRTFARAQELGNLLGAPALTLAELENYHPEEGMILANTTAIGMHPNVNETPLSKQALKSYAVVFDAVYTPKETRLLREAAECGATVVSGLEMFIRQAMGQFEHFTGMPVVDCKFRALANSLVNPDAMKAAGITAHKARLWLHERSGDLIEFHPRSGRGMQPGHGGALYHFGTSGAAVAAATAVTHPLALGSVRYSSSSVGLGNGSKEIGLQNWGADDSGLVSSIRYVIKVRLQMQLAGQRGNLVGMGTIFTQMVQVEGPRSLYLGLAPALTRSVIYGGLRLGLYEPCKYVCNYAFGSTNFAFKFASGVIAGALATALTNPTEVLKVRSQMSPSRTSTIGVLKKIVAEEGVKALWKGVGPAMARAGCLTASQMATYDEAKQRECKGARVYRNGFHCGYQVVVTEGVTSLYKGGFATFARLGPQTAITFVVCEKLRELAGMTAI

SEQ ID NO: 35932 - protein, 535 aa, Yarrowia lipolytica CLIB122
NKNSRQECSGIYNKEDWGGKHDVYIEFTPEKLDTDDWLAFAIFEYRDVDKMGSDIPGDTGIKKYVCDQQAIDSNLCTKEQEGTYIIPKEGEVETYAKIETHRVNLREPETYRYDVSKTGYYCIATFSNDDNYKGKIFIQSAYGYLPGSQIPKHPFYGILSICYLVAFLLWMFSYWQHRQDVLPVQNYITGIFGFLVVEVMFVWSYYDIVNETGDSPGSKAFLVIVSILNSMRNAFTFFLLLIVCLGYGVVKPTLGNLMWKCQALGGIHFVFTLIFTIALYLMDPVDASNVILFLIIPLSITLTTFYIWILSSLTATTKYLVERKQHVKAQMYRNLWWILLGSVIVICGFFFFNALIMTSGSMTDTIVSEWKYRWFLFDGWVNVIYFIDFLLIAFIWRPTANNKRFAMSTELAQDENDAQEFEIGSLAGSDDEDDDEERNVGGIPQENPFGDHNRTSIDSMPDDVDLTRSDTKATLSGVYQKKDKEGASSSKSPEIEATDDATLFALDDEDEDDQQGESSRKKKGKGGEEEEGLLG

SEQ ID NO: 35933 - protein, 401 aa, Brucella melitensis 16M
MEKMTTENARKFRPATELVHAGSLRSGFAEMSEALFLTQGFLYPTAEAAEARFKGEDPGFIYSRYANPTTDMFEKRMCALEGAEDARATASGMAAVAAAILCQVQAGDHVISARAVFGSCRYIVETVLPRYGVEVSIIDGSDVANWKAAVRPNTKVMFLESPSNPTLEIIDIAAVAQIANEAGAKLIVDNVFATPLFQKPLELGAHIVVYSATKHIDGQGRCLGGVVLSDREWIETTLQDYFRHTGPGLSPFNAWIMLKGLETLSVRVRQQTQSAAAIADFLAGKPGVKRVIYPGRADHPQTDIIAKQMTGGSTLIALELEGGKEAAFKFENALQIFSITNNLGDTKSLITHPATTTHKNLSNEAKAELGISDGLLRVSVGLEDTDDLLEDVEVALKVARG

SEQ ID NO: 35934 - protein, 346 aa, Zea mays
  misc_feature (94)..(94): Xaa can be any naturally occurring amino acid
MGRRSNLATWLLALVVLALALFARPCAAAQIKTTDTRWSFQLPLPSGLRGAESLAFDGKGEGPYAGVSDGRVLKWGGTTVGWTTFAHSANYRKXIPLCTAGVVPSEETESMCGRPLGLQFHAKTGDLYIADAYLGLMRVGPGGGEAEVLATGAGGAPFHFVNGLDVDQSTGDVYFTDSSATYPRRFNTEIMMNADATGRLLRYDARTKSVAVLKAGLPYPNGVAVSRDGAHVVVAHTVPCQAFRYFLSGARAGQYDLLADLPGYPDNVRRDGKGGYWVALNQEKQRLDATPATAPVKHLVGVRLNADGEEVEELTAAKGVTLSDVAEMKGKLWLGSVELEYVGLVA

SEQ ID NO: 35935 - protein, 356 aa, Atriplex nummularia
MAAPVCCLPNDDLASRLVQKIAQTVEDEIPEQFLHKDGFPEAKDVPELWTRSLLIDFSLLSSGDQDEIVKFRSALSNWGCFLVKNHGIEGSFLEEVIEVSRKFFSLPFEEKMKYYTDDIFQGYDTDAVCQGLDQQKMNWNDRLFLTMYPKSKGNLKAWPQNPSNFSEIVDEYSKELINLTKGLYKAAAKSLNVREDSFCLEKEGVILSRFTLYPKCPRPKNVLGSKPHLDGSVFTIVLADQEGLEVQKDGQWFKVPVIPGALFVNFGDFGEVLTNGIYKSTMHRVATHSAKDRLSVTAFCTMDATQELTPLTELVTANRPPLYKKFKVYEYKEGVCCKCGPGENAIDAIKLDFPIL

SEQ ID NO: 35936 - protein, 149 aa, Zea mays
AMMLETVAAVPGMVGGMLLHLRSLRRFEQSGGWIRALLEEAENERMHLMTFMEVAKPRWYERALVITVQGVFFNAYFLGYLLSPKFAHRVVGYLEEEAIHSYTEYLKDLEAGKIEKRPAPAIAIDYWRLPANATLKDVVTVVRADEAHH

SEQ ID NO: 35937 - protein, 329 aa, Brassica napus
MVLPSSTPFPPTGKKAKASPEYNFPVIDFSTHDRSKLSEKIVKACEVNGFFKVINHGVRPEIISRFEHEGEEFFNKPESEKLRAGPASPFGYGCKNIGFNGDLGELEYLLLHANPTSVADKSETISHDDPFKFSSATNDYIHAVKDLACEIIDLTAENLWGQRSSEVSELIRDVRSDSILRLNLYPPAPYALRGVSQIGFGEHSDPQILTVLRSNDVDGLEICSQDGLWVPVPSDPTCFYVLVGDCLQALTNGRFTSVRHRVLANTAGKPRMSAMYFAAPPLEAKISPLPEMVSPANPRRYNSFTWGDYKKATYSLRLGVPRLEFFKTS

SEQ ID NO: 35938 - protein, 160 aa, Shigella flexneri
DPDAEPYWRDVGTLEAYWKANLDLASVVPELDMYDRNWPIRTYNESLPPAKFVQDRSGSHGMTLNSLVSGGCVISGSVVVQSVLFSRVRVNSFCNIDSAVLLPEVWVGRSCRLRRCVIDRACVIPEGMVIGENAEEDARRFYRSEEGIVLVTREMLRKLG

SEQ ID NO: 35939 - protein, 403 aa, Brucella melitensis 16M
MTDATTVHPLYDTYNRAALRFERGEGIWLITEDGERYIDFAAGIAVNSLGHSHPHLVETLKTQAEKLWHLSNVYEIPAQEKLGRRLVESTFADKVFFTNSGAEALECAIKTARRYQYVSGHPERFRIITFEGAFHGRTLATIAAGGQAKYLEGFGPKVEGFDQVPFGDEAALRAAITPETAGILLEPIQGEGGLRAFPEEFLRLVRQICDENGLLLLLDEVQTGVGRTGKLFAHEWAGIRPDIMAIAKGIGGGFPIGACLATAEAAKGMTAGMHGTTYGGNPLGMAVGNAVLDVVLADGFMENVQATALVMKQGLASLVDRYPNVVSEIRGRGLLMGLKCVVPNTSLIQALRDEHILSVGAGDNVVRLLPPLITTPEEAREALKHIETAVERLSIANPISKTV

SEQ ID NO: 35940 - protein, 391 aa, Shewanella sp. ANA-3
MAIINMSDLDLQGKRVLIREDLNVPVSNGVVTSDARLRASLPTIELALAKGAAVMVMSHLGRPTEGEYNSEFSMQPVVDYLAKALSCPVRLATDYLDGVEVAVGEVVVFENVRFNKGEKKNDEALSKKMAALCDVYVMDAFGTAHRAEASTNGVGLHAPIACAGPLLAQELEALGKALDNPARPLVAIVGGSKVSTKLTVLESLSGIVDQLVVGGGIANTFIAAAGHNVGKSLYEADLIDEAKRLVANAQSRGGDIPVPTDVVVAGEFSPTAAATLKAVNEVGDSDMIFDIGPDSAEALAKIIESAGTIVWNGPVGVFEFDQFGEGTKRIAQAIADSKAFSIAGGGDTLAAVDKYDIADKVSYISTGGGAFLEFLEGKELPAVAMLKQRGA

SEQ ID NO: 35941 - protein, 176 aa, Borrelia burgdorferi B31
MKNKTEYYDQFISKIPNFPKKGVLFYDITSVLLKPEVYSSLINEVYSFYNFKKIDCIAVVESRGYLIGAPLSLKMQLPLVLIRKEGKLPREVFSEEYELEYGFGRIEVHKDDVRTYSNILLIDDILATGGTLKSSAILLERAGGKVKDIFCFIELCAINGRQSLESYEVNSLVRYN

SEQ ID NO: 35942 - protein, 160 aa, Shigella boydii
DPDAEPYWRDVGTLKAYWKANLDLASVVPELDMYDRNWPIRTYNESLPPAKFVQDRSGSHGMTLNSLVSGGCVISGSVVVQSVLFSRVRVNSFCNIDSAVLLPEVWVGRSCRLRRCVIDRACVIPEGMVIGENAEEDARRFYRSEEGIVLVTREMLRKLG

SEQ ID NO: 35943 - protein, 224 aa, Colwellia psychrerythraea 34H
MSSTKIHLTKAAFTISAPDIRRLPADSGIEVAFAGRSNAGKSSALNTLTNQRGLARISKTPGRTQLINVFEVAENRRLIDLPGYGFAQVPLAMKKKWQKALGEYLEKRQCLKGLVVLMDIRHPLKDLDMDLIQWAADSDLPVLALLTKCDKLSQGKRSSEVLAVKKALSSLNADIQVQAFSSLKYTGKEQADAIICQWLEQEAQEYELPEEDDFDDSDEFTEEE

SEQ ID NO: 35944 - protein, 127 aa, Saccharophagus degradans 2-40
MPNKAIIHSDKAPKAIGTYSQAVKVSDTVYLSGQIPLIPETMEMIEGDFAAQATQVFKNLQAVCEAANGSLKNIVKLNIYLTDLSNFPIVNEVMSQFFEQPYPARAAIGISELPKGALVEADGIAVI

SEQ ID NO: 35945 - protein, 348 aa, Triticum aestivum
MGGLSMDQAFVQAPEHRTKANLADADGIPVIDLSPLAAGDKAGVDALAAEVGRASQDWGFFVVVRHGVLAETVARALEAQRAFFALPADRKAAVRRDEAAPLGYYESEHTKNVRDWKEVFDLVPREPPPPAAVADGELVFENKWPEDLPRFREALEEYAEAMEELAFKLLELIARSLGLRPDRLRCFFKDQTTFIRLNHYPPCPSPDLALGVGRHKDAGALTILYQDDVGGLDVRRRSDGEWVRVRPVPDSYVINVGDIIQVWSNDRYESAEHRVSVNSQKERFSMPYFFNPGSDAMVEPLEEMVSDERPARYDAYNWGNFFSTRKNSNFRKLDVENVQIAHFRKDRS

SEQ ID NO: 35946 - protein, 215 aa, Schizosaccharomyces pombe 972h-
DPYHVSISAVLTRESSKYEKGKVIKDLSYLNRDLSRVIMIDTNPESWSKQPDNAIAMAPWTGNPKDKELVGLIPLLEFIAIMDIKDVRPVLKSYQGKNIPLEYARREEKLRTKLIEDWNEKKKKGSSFLFGGRSVSEEPPKLIIDIQRERQKAAYAEFKKYIDENGPKMLEEEKAREAEQKTSIFNLLFHPEEVQQQQLEQMQQQQFSPETNASK

SEQ ID NO: 35947 - protein, 409 aa, Streptomyces avermitilis MA-4680
MSEQTQERGRTAARRVVVVGAGMAGVQTAVALREQGFTGGVTLIGAEPHQPYDRPPLSKAVLLGKAEGSAFDVDFEALGIELQLGREALGLRPEDHELDTDSGPVPYDVLVAATGAEPIQLPGAEGVPGVHLLRTLDDAERLRPVLAQQHDIVVVGAGWIGAEFATAAREAGCAVTVVEAADRPLAGALPAEVAAPMTAWYGDSGARLLTHARVERIEPGAVVLDNGSRVPAGAVVVGIGARPATAWLVGSGIALGAHQEVLADNHLRTSLPDVYAVGDCASFPSGRYEARLLVHHWDNALQGPRTVAANIIGEAPAAYDPVPYFWSEQFGRFVQYVGHHATADATVWRGDPEGAAWTVCWLREGRLVALLAVGRPRDLAQGRKLIESGAPMNPELLADASRPLKAAVV

SEQ ID NO: 35948 - protein, 263 aa, Schizosaccharomyces pombe 972h-
MSIPEVSSHDSCLNDCHSVNSEEQAKPVCCLELNAHKDGIKVVDTSNDASTFSNSPLVPDNFGVVYPGIIYRSACPRASNFNFLESLHIRTIISLRQEEYSEEDLHYFTKHHINYYHIAMPGSKHRKNDCISSSSNPDISDVDDLVRKTLQLLLNKENWPVLLHCSRGKHRTGIVIGCLRALMNWPVGNRLQEYISFSHPKEREVDEEYIQNFSSDPSLKSSLNDLKRYISDSSSELADVVLSSESPTVQAATVNETCRSPGS

SEQ ID NO: 35949 - protein, 448 aa, Sulfitobacter sp. EE-36
MTETLDLIVIGAGMAGVNAAKKAARAGWSVAIVDELPYGGTCALRGCDPKKMLRAGAEAVDAARLLSGKGVAGDTRIDWPALMKHKESFTDPVPENMEDGLKKAGVQTLHGSTRFTAADRIEIDGHGAITFGHALIATGAKPRPLDFPGAERLIDSTDFLNLSNLPKRIIFVGGGYISFEFAHIAAPAGAEVTILDHGARQLKLFDPDLVDMLLERSRAAGIEIISETTPEKIEAAGKAQRIFYGKDGNTHVKEADLMVHGAGRMPAVDELNLSAAGIETEHGGVKVSPWLQSTSNPRVYAAGDAAASPGKPLTPVAVFEGKIATSNMLKGKQTEPDYTGVPSVVFTIPELARVGMLEEEARETGDVEVSFTDTSGWFSQKRLGETHAGAKIISNSEGKILGAHMFGPDYAELINIFSLAIKLGLTVDQIKTMPAAYPTGASDIGSML

SEQ ID NO: 35950 - protein, 405 aa, Corynebacterium glutamicum ATCC 13032
MKGRPNVLAIVLAGGEGKRLFPLTEDRAKPAVPFGGTYRLIDFVLSNLVNSGFLKIAVLTQYKSHSLDRHISLSWNVSGPTGQYIASVPAQQRLGKRWFTGSADAILQSLNLISDEKPDYVIVFGADHVYRMDPSQMLDEHIASGRAVSVAGIRVPREEATAFGCIQSDVDGNITEFLEKPADPPGTPDDPDMTYASMGNYIFTTEALIQALKDDENNENSDHDMGGDIIPYFVSRNDAHVYDFSGNIVPGATERDKGYWRDVGTIDAFYECHMDLISVHPIFNLYNSEWPIHTTSEGNLPPAKFVRGGIAQSSMVSSGSIISAGTVRNSVLSNNVVVEEGATVEGAVLMPGVRIGKGAVVRHAILDKNVVVRDGELIGVDQVRDAQRFKVSAGGVVVVGKNQVV

SEQ ID NO: 35951 - protein, 334 aa, Streptomyces avermitilis
MTTVALKPATMAQALTRALRDAMAADPAVHVMGEDVGTLGGVFRVTDGLAKEFGEDRCTDTPLAEAGILGTAVGMAMYGLRPVVEMQFDAFAYPAFEQLISHVARDAQRTRGAMPLPITIRVPYGGGIGGVEHHSDSSEAYYMATPGLHVVTPATVADAYGLLRAAIASDDPVVFLEPKRLYWSKDSWNPDEPGTVEPIGRAVVRRSGRSATLITYGPSLPVCLEAAEAARAEGWDLEVVDLRSLVPFDDETVVRVGARTGRAVVVHESGGYGGPGGEIAAGITERCFHHLEAPVLRVAGFDIPYPPPMLERHHLPGVDRILDAVGRLQWEAGS

SEQ ID NO: 35952 - protein, 368 aa, Mycobacterium leprae TN
MTSGFLEFTVSLSAHPVTDAERESILAEPGFGKYHTDHMVSIDYIDGRGWHDARVIPYGPIQLDPSAIVLHYAQEVFEGLKAYRWADGSIVSFRPDANAARLRSSARRIAIPELPDELFIDSLCQLIAVDNAWVPRVGGEEALYLRPFIFATEPGLGVRPAKQYRYLLIASPVGAYFKGGINPVTVWVSMEYVRASPGGTGAAKFGGNYAASLLAQTEAAANGCDQVVWLDAVERRFVEEMGGMNIFFVLGSGGSARLVTPELSGSLLPGVTRASLLQLAIDAGFSVEERKIDIDEWQKKAAAGEITEVFACGTAAFITPVSRVKYGDTEFTIAGGAPGEVTMALRDTLTGIQRGTFADTHGWMARLG

SEQ ID NO: 35953 - protein, 869 aa, Saccharomyces cerevisiae
MTESAIDDQRFNLTKELQRHSCRDQGKITQKDDALDFISYSSFQSSFNTDQKSANNGSTVRRSIRSIFRRAAELPRVHMGPLTYSHGINELVNKKLRKDCDLSTLCRVLQRGIRMIRMTRRRRKFYEFKLINNNGQIIWKDGSKYLELDSVKDIRIGDMASTYQEEVDPKRLRSDSKLWITIIYKVSNKLKALHVVALNELDFNTFLSCICGLVKLRRELMESILLPDNSQFARIHWQITVSEKEEDEKKDTLSFADVKKLCDKFHIYVSTGQLLEFFQLADINHNGLLNYFEFEKFIKILKNRKEVNMIWSKFTKPPHSHLSFENFFQFLITEQHEQVDRQTAWSYFIKYREPTQLTMGQDGFTKFLKEQPYLVEVKEELYSKPLNHYFIASSHNTYLLGKQIAETPSVEGYIQVLQQGCRCVEIDIWDGENGPVVCHGFLTSAIPLKTVIRVIKKYAFITSPYPLIISLEINCNKDNQKLASLIMREVLAEQLYFVGTRTDKLPSPRELKHKILLKSKKTSEATRGLSVNEPFPSSFSSSYESANEQELRMKDDSTNSSSATNSSSMQRIKRIGLKKHVDIINDVSNISGIHGIKFRNFSLPESKTIAHCFSLNERKVEYMIKDKHLKLSLDKHNRRYLMRVYPHVLRYKSSNFNPIPFWKAGVQMVATNWQTNDIGQQLNLAMFQILDHQPDGSFKSGYVLKPKKLLPVVTKAKMIPLIYEHFENGSDPVTVKIRILSTQLLPRLNDTSPSRNNTNSFVKVEFHTDDEPTMPISIDKGTRISATEASTKSSQGNGFNPIWDAEVSITLKDTDLTFIKFMVISEETQIASVCLKLNYLRMGYRHIPLFNMEGEQYIFCTLFIHTQIL

SEQ ID NO: 35954 - protein, 330 aa, Triticum aestivum
  misc_feature (142)..(142): Xaa can be any naturally occurring amino acid
  misc_feature (144)..(145): Xaa can be any naturally occurring amino acid
  misc_feature (147)..(148): Xaa can be any naturally occurring amino acid
  misc_feature (152)..(153): Xaa can be any naturally occurring amino acid
  misc_feature (158)..(158): Xaa can be any naturally occurring amino acid
  misc_feature (160)..(161): Xaa can be any naturally occurring amino acid
  misc_feature (164)..(164): Xaa can be any naturally occurring amino acid
  misc_feature (166)..(166): Xaa can be any naturally occurring amino acid
  misc_feature (168)..(168): Xaa can be any naturally occurring amino acid
  misc_feature (172)..(172): Xaa can be any naturally occurring amino acid
  misc_feature (175)..(175): Xaa can be any naturally occurring amino acid
  misc_feature (178)..(178): Xaa can be any naturally occurring amino acid
  misc_feature (183)..(183): Xaa can be any naturally occurring amino acid
  misc_feature (187)..(187): Xaa can be any naturally occurring amino acid
  misc_feature (189)..(190): Xaa can be any naturally occurring amino acid
  misc_feature (194)..(194): Xaa can be any naturally occurring amino acid
  misc_feature (197)..(198): Xaa can be any naturally occurring amino acid
  misc_feature (210)..(210): Xaa can be any naturally occurring amino acid
  misc_feature (213)..(213): Xaa can be any naturally occurring amino acid
  misc_feature (217)..(217): Xaa can be any naturally occurring amino acid
  misc_feature (223)..(223): Xaa can be any naturally occurring amino acid
  misc_feature (253)..(253): Xaa can be any naturally occurring amino acid
  misc_feature (262)..(262): Xaa can be any naturally occurring amino acid
  misc_feature (267)..(267): Xaa can be any naturally occurring amino acid
  misc_feature (270)..(270): Xaa can be any naturally occurring amino acid
  misc_feature (275)..(275): Xaa can be any naturally occurring amino acid
APPSVPFGPIALSPSAGVLNYGQGLFEGLKAYRKTDGSVLLFRPEENAIRMKNGSDRMCMPAPTVEQFVDAVKQTVLANKRWVPPTGKGSLYIRPLLIGSGAILGLSPAPEYTFLIYVSPVGNYFKEGLAPINLIIEVNFSXGXXPXXWILXXGGENXIXXTIXLXCXKGTXELXKGXKGYFXMSLXFXXPVPXQIXXEEVFFSCNIFRXVKXQCLXSTPAIXKGTILPGIPRGKVSFESCREAKAYKVEERXCSVNELLEXADEVXCTXGNSLXVGFTPVGEPLPYKGRRGDCDANQGVGVVSQQLYTSLTSLQMGHTEDRMGWTVQLN

SEQ ID NO: 35955 - protein, 279 aa, Zea mays
MGVKQVLVRPRYGDEDVVDQSPPPPMSSSPCGRYVLHRVCRFDTLAGVAIKYGVEVADVKRANGLTTDLQMFAHKTLRVPLHGRHAPSPPSSSPSHAAREWTKNAASLDPLLKLKPPRSTVSPSMSLLLQGCHGLTPAPKGDLNLTDECAQGHHRKAGSLSSTLLPRRAGQGLALRPKSGGRADTNGIHQDLLAAWVPSYGDGLRAVKRSSSAPEFQDSDSVSLASAWLKSKWNLKPDYAFTLALFDGISKPLLDSIPKPLLDNIPNSIVAWRNKAARD

SEQ ID NO: 35956 - protein, 677 aa, Mycobacterium leprae TN
MDDRRLRTLPNEAYWIAVCGLLAFVVASARADSRGSGGTNNILQADHSMARAVHLMRHRGPDELSTWSDPDIDGFSGGVAFGFNRLSIIDIAHSHQPLRWGPPETPNRYILVFNGEIYNYLELRDELVIRHGAAFATDGDGESIVAGFHYWGTEILTRLRGMFAFALWDTIAHELFCARDPFGIKPLFMATGTNGTAVASEKKCLLELAEVIRFDTQIDTRALQHYTVLQYVPEPETLHRGVHRLESGCYARIRPEQLDPATTRYFVPQFAATPITSSTEQTRYGEITAVLADSVAKHMRADVTVGSFLSGGIDSTAIAALAIRHNPRLITFTTGFEHEGFSEIDVAAASAEAIGARHIVKVVTPNEFVAALPEIVWYLDEPIADPALVPLFFVAREARKHVKVVLSGEGADELFGGYRIYREPLSLKPFDYLPGPLRRSMGKVSKSLPEGMRGKNLLHRGSLTLEERYYGNARNFSEAQLQAVLPRFHTGWTHTDVTAAVYAESVGWDPVARMQHIDLFTWLRGDILAKADKMTMANSLELRVPFLDPEVFAVASRLPMQAKITRTTTKYALRRALESIVPAHVLHRPKLGFPVPIRHWLRAGELLEWAYALVNSSQAEHLVNLAAVHRMLDEHRGGISDHSRRLWTVLIFMLWHAIFIEHSVVPQISEPQYPVQP

SEQ ID NO: 35957 - protein, 464 aa, Francisella tularensis subsp. holarctica
MEAQKEYKRIVYLIATIAALGGLLFGLDQGFIGNAGDTLNKLYGLDAKVAGSFNAILATGSILGTICSGFFTKFFGRKNTLMIAGFAFLAGALVSSFLPPINILTFCRFLLGFGVGLASFATPLYLAETAPTKIRGSISTLFQLMITFGIFLISLTNIIIVMCLGHQKISLALMFSVIAFFAFLMFVGCFFLPKSPRWLLSKGKDQEAYKVLTRLRAAHEIDTEIAETKKVLKTDHGSVVESLAKKYFWKILLVGVIIQMFQQLVGINMMIYYAPHFLSNVGLNVLIAALAVYLVNFLSTFPAIKWVEKWGRKKLLTVGAVVMMSSLVVSAVCFYFIKHTQDPADFIKYVLLISCLVYIFGFACSWGPVAWIICSEIFPIKTREIGMTVTTVVNWTFAGFVIANSNVIMTKVAFGDVIIFLVYAAFCLAAIFFLKMFVPETKGVSLEKIEDNLISGKKLRDLGQ

SEQ ID NO: 35958 - protein, 459 aa, Francisella tularensis subsp. holarctica
MQTEKINFVVVRVAIIAALAGLLFGMDIGYVNGSLHFISETFGLSVEQSGHVSSVLLLGAACGALFSGFLSKRYGRRKVLLIAAAIFSIFTIVGMLAPNYQIFISSRFILGIAVGIASFIAPLYLSEIAPKEFRGALIALYQLMITIGLFLVFLTNSALERTGSWRVMLTVLAIPSVIMFFGCLTLPRSPRWLILKGNDNEAALVLKKIRSSEAEALEEHNEIKQTTHRSVSVFSLLKQKFFIKVVLLGIALQAFQQFTGMNAFMYYSTDIFKLAGFTNPSTSTIVIGLLNMLTTFLAIKYVDKFGRKPILYFGLSLLIISCIIVGFIFKTHFVYGQAMVLSQTLQWTALIFCLLFIFGFAISMGPVIWILCSEIQPIEGRDFGVTASTMSNWICNAIIGNFALTWLTFHPDSTFFGFAISCIICILFVKFFIPETKDVSLEEIENNLRSGKSLAKIGR

SEQ ID NO: 35959 - protein, 237 aa, Zea mays
  misc_feature (68)..(68): Xaa can be any naturally occurring amino acid
MSSAVEAISCPKVDVPAGPEPREPAKEAAPPAEHCDTAPNGKCAPRCHGEEEADEDEDEEEEEKAPKXIDLGPMDDESLRRWKEQLLGGVDLNSVGETLEPDVKIMSLSILSPGRPDIVLPLPVEPNGKGVWFTLKEGSPYRLKFTFSVSNNIVSGLRYTNTVWKTGLKVDRAKEMLGTFSPQLEPYTYVTPEDTTPSGMFARGSYSARTKFLDDDRKCYLEINYTFDIRREWPSTS

SEQ ID NO: 35960 - protein, 525 aa, Mycobacterium avium subsp. paratuberculosis K-10
MAESPPTEVPEPPARPVLVVDFGAQYAQLIARRVREARVFSEVIPHTATIEEIKARQPRALVLSGGPSSVYEPGAPQLDPAVFDLGVPVFGICYGFQAMAQALGGTVAHTGTSEYGRTELKVLGGELHSGLPGVQPVWMSHGDAVTAAPDGFEVVASSPGAVVAAFENRARRLAGVQYHPEVMHTPHGQQVLSRFLHDFAGLGADWTAANIAGVLVEQVRAQIGDGHAICGLSGGVDSAVAAALVQRAIGDRLTCVFVDHGLLRAGERAQVQRDFVAATGANLVTVDAADTFLQALAGVTNPEGKRKIIGRQFIRAFEGAVRDVLGDKPVEFLVQGTLYPDVVESGGGSGTANIKSHHNVGGLPGDLKFTLVEPLRLLFKDEVRAVGRELGLPEEIVARQPFPGPGLGIRIVGEVTATRLDTLRRADSIAREELTAAGLDSLIWQCPVVLLGEVRSVGVQGDNRTYGHPIVLRPVTSEDAMTADWTRVPYEVLERISTRITNEVPEVNRVVLDITSKPPGTIEWE

SEQ ID NO: 35961 - protein, 571 aa, Ostreococcus tauri
MGYVPPHLRGGGDANANASAGDGRDHGRGSGHRDDRGPPPGRRLDDRDAARGDGRGGGAARGGAHAPVFAAWRPSARAEALTTAQATEIRERLGVTVDVEDGEPEAPSAIESFEDMELKRDILADIKFREYDKPSPIQAQAIPVILSGRDVLGCAETGSGKTAAFSIPMIQHALNQAPLRQGDGPFAIVMAPTRELAQQIETEAKTFTRSSKGFRTAIIVGGTNMSEQRSMLRGGVQIVVATPGRLIDHLQQGNTNLARVSFVVLDEADRMLDMGFEPQIREVLMNLPKPHQTLLFSATMPVEVEALAADYLNKPVKVKVGQTSAPTANVSQQLEKVVDAEKVDRLVTMLISEQREAQKLGHSMPMTVVFVERKHRADEIAELLNAENVSAAALHGGRSQGEREAALHDYKTGRCSVLVATDVAARGLDVKGVAHVVNLDLPRNFEDYVHRIGRTGRAGMSGRSTSFYTDRDSFIVAQIKRALMELEAGNAFAFATGREARAKEREEARAWREGKQHEAAVVETEGGVTITVEDKFKHMMVSAPVAAPGAAAPAAGVADDAWGDGSDDDAW

SEQ ID NO: 35962 - protein, 664 aa, Shewanella sp. ANA-3
MSSRKVLANAIRALSMDAVQKANSGHPGAPMGMADIAEVLWNDFLKHNPNNPKWVDRDRFILSNGHGSMLIYSLLHLTGYDLPIDELKQFRQLHSKTPGHPEYGYTPGVETTTGPLGAGISNAVGMAIAEKTLAAQFNREGHEIVDHYTYCFLGDGCLMEGISHEACSLAGTLGLGKLIAFWDDNGISIDGHVEGWFTDDTPKRFESYGWHVIANVDGHDSDAIRAAIEAAKAVTDKPTMICCKTIIGFGSPNKSGSHDCHGAPLGDAEIAAAREFLGWPHAPFEIPADVYAGWDAKEAGNAREAAWNDKFAAYAAAYPELAAEYERRVLKGELPADFEAKAQAFIQECQAKGEGIASRKASQNAIAAFGAVLPELLGGSADLAGSNLTLWAGSRGIQEDPAGNYVYYGVREFGMSGIMNGVSLHGGFINYGATFMMFMEYARNAVRMSALMGIQNIFVYTHDSIGQGEDGPTHQPVEQLANLRMTPNMAVWRPCDAAETAVAWKAAIERRHAPTSLVFSRQNLKAQARTAEQLANVAKGAYVLQDCAGTPEYILIATGSEVQLAVEAAAALTEQGKQIRVVSMPSNTEFDKQDAAYKESVLPKAVTKRIAIEAAHTDFWYKYVGFEGTVVGMTTFGESAPGNVLLKHFGFTVENVLNAAKSLG

SEQ ID NO: 35963 - protein, 269 aa, Saccharophagus degradans 2-40
MTSSFGKLAAGFKNLLGSNKSAAPASDNKKAVEVVSEETLKAHALPFSIPLEYGVGTKVNDTPSVTICEDFLTQAEVFQIIKAAGDKMQRARVSSGKEGIESAGRTGSNCWVAHDHNKVTHALAKRISKLVGISLQNAESFQVIHYGVSQEYSSHFDAWEFNTERGERCMARGGQRLVTCLIYLNDVPAGGGTGFPELDLEVQAKKGRMVIFHNCYPGTNYRHPHSLHGGLPVEEGEKWAVNLWFREADYWAGTKKAAAPARKKYGKVM

SEQ ID NO: 35964 - protein, 424 aa, Mesorhizobium loti MAFF303099
MNEMNQASHHVVVVGAGFGGLELTHALAGQPVRITMIDKRNHHLFQPLLYQVATTALATSEVAWPIRHLLRKRKDVTTLLANVTGVDRAGKRVLLDDGSAVAYDTLVLATGARHAYFGHDEWEPFAPGLKTLEDATTIRRRILLAFEQAERETDPAKREALLTIAIVGGGPTGVELAGTIVELAHDTLRGEFRNIDTRQTRVVLIEAGDRILANFAPKLSDYASKALERLGVTVELGRAVTRCDAEGVVFGDKQLAARTILWAAGVAASPAAEWLGAKADRAGRVLVEPDLGVPGSPEIFVIGDAALVLRPDGRPVPGVAPSAKQEGRHVAATIKARLGGDNTARPFHYKHAGDLATIGKRAAAIDFGWIKLTGWLAWWLWGIAHIYFLIGFRNRLAVSLSWLWIYVTGQRSARLITQGDDDKT

SEQ ID NO: 35965 - protein, 379 aa, Zea mays
  misc_feature (367)..(367): Xaa can be any naturally occurring amino acid
MSTTGQIIRCKAAVCWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIYHFLGTSTFSEYTVVHSGQVAKINPEAPLDKVCIVSCGLSTGLGATLNVAKPKKGQSVAIFGLGAVGLAAAEGARIAGAGRIIGVDLNPKRFEEAKKFGVTEFVNPKEHDKPVQQVIAEMTNGGVDRSVECTGSIQAMIQAFECVHDGWGVAVLVGVPSKDDAFKTHPMNLLNERTLKGTFFGNYKPKTDIPGVVEKYMNKELELEKFITHTVPFSEINKAFDYMLXGESIRCIITMGA

SEQ ID NO: 35966 - protein, 216 aa, Citrus sinensis
MVSAQISSSSEHDGINETQVVLNVYDLTPVNSYTYWFGFGIFHSGIEVHGKECGFGAHDFPVSGVFEVEPRSCPGFIYRASNLLGRINMPPSEFRTFIECSASEYHGDAYNLISKNCNHFTDDIAWRLTGKHVPGWVNRLARLGALCGCLLPESLQATTVKQLPEYHDCTEEDGSESLSTATPRESTEMDDNDQEKLLVTSSAGTGEVAFVREATK

SEQ ID NO: 35967 - protein, 464 aa, Schizosaccharomyces pombe 972h-
MAPISKVFDYLVIGGGSGGLASARRAAKHGAKVALIEASGRLGGTCVNYGCVPKKIMWNIADLVAKMKTAKQNGFPNSQLGSFDWGMIKRKRDAYIGRLNGIYERNVNKDGVAYISGHASFVSPTEVAVDMNDGSGTQVFSAKYILIAVGGHPIWPSHIPGAEYGIDSDGFFELESQPKRVAIVGAGYIAVELAGVFAALGTETHMFIRQSKFLRKFDPIISDGIMDHFQHIGINVHTNSLEFKKVEKLPSGELCIHQQDGSTFNVDTLLWAIGRAPKIQGLRLEKAGVKTLPNGIIIADTYQRTNVPTVLSLGDVCGKLELTPVAIAAGRRLSDRLFGGIKDAHLDYEEVPSVVFAHPEAGTIGLTEQEAIDKYGESQIKVYNTKFNGLNYSMVEQEDKVPTTYKLVCAGPLQKVVGLHLVGDFSAEILQGFGVAIKMGATKSDFDSCVAIHPTSAEELVTLV

SEQ ID NO: 35968 - protein, 154 aa, Zea mays
  misc_feature (28)..(28): Xaa can be any naturally occurring amino acid
LADARSLGRCSAVSRRFSALVPLVDDAXLAVLKSVLLAVLKPFAHCDAKSASPQKHAQQHHSPAQVLRNFSSIRSLRMELPVSDVGTDDGVVLRWKAVFGSTLQSCVILGGTRVDRAAAAGPSHAPYYDPPAGDDYGGSIPESLYTNGGLKLRV

SEQ ID NO: 35969 - protein, 639 aa, Brucella melitensis 16M
MGKTLDSFLIYSYVNVTLAKTVKLDHTKQRGAIRGRMAGRWAGTLAACTKDGAIRGEDMAKKVTGQSAAAVDSAKVAPTGEARPAVEKIWLKSYPAGVPHDINLSAATSISDMISASCRQFANSPAFTCMGKDISYKELDDHSRALAAWLQSRGLVKGDRVAIMMPNILQYPITFTAVLRAGFVVVNVNPLYTPRELEHQLNDAGAKALVVLENFATTVEKALPSINVPNILVASMGDMLGFKGHIVNLVVRRVKKMVPAWNIPGHVRFKDALAQGRAKSFNPVPVQGCDIAFLQYTGGTTGISKGAMLTHSNILANVEQMNLWMDVAFRNKGKPKALNFVCALPLYHIFALTVNAMIGMKLGARNILIPNPRDIPSFVKELKKYPVHIFPGLNTLFNGLINNPDFQTLDFKPLILTLGGGMAVQRPVAERWQHMTGCHITEGYGLSETSPVACANALDATEFTGTIGLPMPSTDVVIRDDDGSDLPLGKVGEICVRGPQVMKGYWNRPEETARAIMADGFFRTGDMGFMDERGYTKIVDRKKDMILVSGFNVYPNEIEEVAAEHPGVLESAAVGIPNEHSGEVVKLYVVRRDPELTEDEVKAFCAERLTNYKRPREVEFRESLPKSNVGKILRRELRD

SEQ ID NO: 35970 - protein, 256 aa, Citrus sinensis
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRTRKNQLMYESINELQKKEKAIQEQNSMLFKQIKEREKIFRAQQEQWDQQNQGPNMPPPLPPQQHQIQHPYMLFHQPFPFFNMGGLYQEDDPMAMRRNDLELTFEPVYNCNLGCFAA

SEQ ID NO: 35971 - protein, 658 aa, Arabidopsis thaliana
MVANNNTSSNRRKRIITEGDIATLLLRYDMETILRMLQEISYCSETKMDWNALVKKTTTGITNAREYQLLWRHLSYRHPLLPVEDDALPLVMAASYVLSESDILDDSTVEAPLTINIPYALPEGSQEPSESPWSSRGMNINFPVCLQKVTSTEGMNGNGSAGISMAFRRKRKRWSAEEDEELFAAVKRCGEGNWAHIVKGDFRGERTASQLSQSFCSVSYSLVLCITTCLCIIIYILLTMNGGYYLPSFVLLEVVALYRRSTTLVITLEIYLLSSSLVWTWGFSPFFRVRIPATDSLDDMSNSLLAIIEEDALVWLPLACLNQKLAYLFNCGGTAFYAGLMPTTSSCTITETEANGGSSSQGQQQSKPIVQALPRAGTSLPAAKSRVVKKTTASSTSRSDLMVTANSVAAAACMGDVLTAASGRKVEPGKTDAPRVPKTKPVKHASTVCMPQPSGSLSMPKVEPGTSVAASIRSLANGKLKPVMASSSSNKPPLIAPRSEGSSMLSASAPLASLSRIVSNQRVFAGSVPATEIVTCKPDGGQKGQARGNEASSSAAIQPHQITSRNLEISQGKQATQAQSPNLLPRKVPVVRTAVHCATNQKLMDKPSDQTVVPIRGAGSQSKAKGEVNSKVGPVIKVSSVCGKPLEVATVAGTGQGV

SEQ ID NO: 35972 - protein, 532 aa, Brassica napus
MAGGGAPAPKADEPQPHPPKDQLPNISYCITSPPPWPEAILLGFQHYLVMLGTTVLIPTALVPQMGGGYEEKAKVVQTILFVAGINTLLQTLFGTRLPAVIGASYTFVPTTISIILSGRFSDTSNPIDRFERIMRATQGALIVASTLQMILGFSGLWRNVVRFLSPISAVPLVGLVGFGLYEFGFPGVAKCIEIGLPELLILVFVSQYLPHVIKSGKNVFDRFAVIFAVVIVWIYAHLLTVGGAYNGAAPTTQTSCRTDRAGLVGAAPWIRVPWPFQWGAPSFDAGEAFAMMMASFVALVESTGGFIAVSRYASATMLPPSILSRGVGWQGVAILISGLFGTGAGSSVSIENAGLLALTRVGSRRVVQIAAGFMIFFSILGKFGAVFASIPGPIIAALYCLFFAYVGAGGLSFLQFCNLNSFRTKFILGFSVFLGLSIPQYFNEYTAIKGYGPVHTGGRWFDDMVNVPFSSEPFVAGMVAFFLDNTLHKKDSSIRKDRGKHWWDKFRSFKGDTRSEEFYSLPFNLNKYFPSV

SEQ ID NO: 35973 - protein, 549 aa, Brucella melitensis 16M
MARDATKLEATVAKLKKHWAESAPRDMRAAFSADPGRFGRYSLCLDDLLFDWSKCRVNDETMALLKELAVAADVEGRRAAMFAGEHINNTEDRAVLHVALRDTSSKEVLVDGHNVLPDVKHVLDRMAAFADGIRSGALKGATGRKITDIVNIGIGGSDLGPVMATLALAPYHDEPRAHFVSNIDGAHIADTLSPLDPASTLIIVASKTFTTIETMTNAQTARKWVADTLGEAAVGAHFAAVSTALDKVAAFGIPEDRVFGFWDWVGGRYSVWSAIGLPVMIAVGPDNFRKFLAGAHAMDVHFRDAPLEKNLPVMLGLIGYWHRAICGYGSRAIIPYDQRLSRLPAYLQQLDMESNGKSVTLDGKPVSGPTGPVVWGEPGTNGQHAFFQLLHQGTDTIPLEFIVAAKGHEPTLDHQHEMLMANCLAQSEALMKGRTLDEARAQLQAKNLPASQVERIAPHRVFSGNRPSLTLIHDMLDPYTLGRLIALYEHRVFVEAQIFGINAFDQWGVELGKELATELLPVVSGKEGASGRDASTQGLVAHLHARRKA

SEQ ID NO: 35974 - protein, 218 aa, Zea mays
EAQCERPLRSPKQAPIHLENQEPQNVNLSDNAKMDILVPDIQPDVEVASDLVTITNEEKVDETPSVVAPAAEIMPLQDINSEENALVNDVEERSKEEHPSTDNLKGSKRRSSFSAKPEYPENGSKNSPALPSYMAATQSAKAKLRGNSSPRLSSDSAEKNGFTRRHSLPSPNNGKIISHSPRTQRPTHACGKDGAKGDKAMLSSRDASERPLKAEWRR

SEQ ID NO: 35975 - protein, 266 aa, Glycine max
SNNALDFDGVICDSCGESSLSALKAAKVRWPGLFDGVDSTTENWIIDQMHTVRPVVETGYENVLLARLLLESRVPSIRKSSVSEGLKVEDILENWFKLKPLIMEDWHENREELIDLFGKVRDDWLERDLTGSIGAYTLYPGTAGALRFARSRVYVVTTPQSRFADALLRELAGVTIAPERLYGLGTGPKVEVLKKLQKMPEHQGLTLHFVEDRLATLKNVIKEPELDNWNLYLVNWGFNTQKEREEAQANPRIQVIELSDFSSKLK

SEQ ID NO: 35976 - protein, 367 aa, Magnaporthe grisea 70-15
MPFTYSVAASYIGKDRPYDPATHVFHFNPHHRIQPNNNKRLRPESGQDAFFVSRVGDTGGVALGVADGVGGWMDSGVDPADFSHGLCGNMASVAYAHRPSAPPAGAQDQQLPSAPAASPPLTARRLLQLGYDAVCADRSIPAGGSTAVVALLQPEGTLEVANLGDSGFVQLRANAVHAASTPQIHAFNTPFQLSVIPPGIMARMAMFGGAQLSDMPRDAEVTRHGLRHGDVLVFASDGVWDNLFNQDILRVVCSSMAAVGAWEATDSGTKVAADLTPFTRPDVVAADQGAKAKPVVTLQSLIATEITAAAKAASVNRKLDGPFAKEVKKYFPRDNWRGGKVDDICVVVAIVSEGSAAASEPKLKSRL

SEQ ID NO: 35977 - protein, 429 aa, Arabidopsis thaliana
MVNSCENKIFVKPTSTTILQDETRSRKFGQEMKREKRRVLRVINQNLAGARVYPCVVNKRGSLLSNKQEEEEGCQKKKFDSLRPSVTRSGVEEETNKKLKPSVPSANDFGDCIFIDEEEATLDLPMPMSLEKPYIEADPMEEVEMEDVTVEEPIVDIDVLDSKNSLAAVEYVQDLYAFYRTMERFSCVPVDYMMQQIDLNEKMRAILIDWLIEVHDKFDLINETLFLTVNLIDRFLSKQNVMRKKLQLVGLVALLLACKYEEVSVPVVEDLVLISDKAYTRNDVLEMEKTMLSTLQFNISLPTQYPFLKRFLKAAQADKKCEVLASFLIELALVEYEMLRFPPSLLAATSVYTAQCTLDGSRKWNSTCEFHCHYSEDQLMECSRKLVSLHQRAATGNLTGVYRKYSTSKFGYIAKCEAAHFLVSESHHS

SEQ ID NO: 35978 - protein, 126 aa, Staphylococcus aureus subsp. aureus COL
MKIINTTRLPEALGPYSHATVVNGMVYTSGQIPLNIDGHIVSADVQAQTKQVLENLKVVLEEAGSDLNSVAKATIFIKDMNDFQKINEVYGQYFNEHKPARSCVEVARLPKDVKVEIELVSKIKEL

SEQ ID NO: 35979 - protein, 427 aa, Frankia sp. CcI3
MPSIEAVGAREILDSRGNPTVEVEVVLEDGTLGRAAVPSGASTGAFEAVELRDGDNRYGGKGVTKAVAAVIDRIGPAIMELEATEQRLLDATLIDLDGTPGKSALGANALLGVSLAVAKAAAASSGLPLFRYLGGPTAHLLPVPMMNILNGGAHADTNVDIQEFMIAPIGASTFAESLRWGAEVYHALKSVLKARGLATGVGDEGGFAPSLPTNREALDLIAEGIDKAGFALGTDIALALDVASTEFYADGSYTFEGNSRSAEYLSDYYAELVSAYPIVSIEDPLAEDDWDGWVALTERLGGKVQLVGDDLFVTNPERLARGIALKAANALLVKVNQIGTLTETLDAVNLAHRSGYRAMMSHRSGETEDTTIADLAVAVDCGQIKTGAPARSERVAKYNQLLRIEEELDDAARYAGAAAFPRRRQAG

SEQ ID NO: 35980 - protein, 395 aa, marine gamma proteobacterium HTCC2143
MKGKTMSNEREFGIVVYGATGYTGRLVADYLNRQYGVNGDINWAMAGRSQSKLEAVRDELGIAADLPLIVADAADAASVKSMVGRCSVVLTTVGPYQLYGNELVAACAAAGTDYVDLCGEPGWMSEMIGAHHETAKTSGARIVFSCGFDSIPFDLGVFFLQQVATQTLGQKVACVKGRVRGSKGGWSGGTLASFKATMAAAAKNPELINVLDNPFALTPGFIGADQPPGTEPIYDNSIESWVAPFVMATINTKNIHRSNFLLDHQYGADFVYDEMIITGPGDDGEAIANAIASDTSMANDQTQPGEGPTKEQRETGFYDILFVGENDKGESVRISVYGDMDPGYGSTSKMIAESAISLLKTPSDSSGGVLTPASAMGSNLVERLQKNAGLTFKIE

SEQ ID NO: 35981 - protein, 411 aa, Sinorhizobium meliloti 1021
MAATEILNRADIVKAPQVRLAPQPEKPSLIGLLRDDIAKLLAEKGVPERQVKMRVSQLWHWLYVRGVSDFDEMSNVSKDMREMLKEHFTIARPDIVEEQVSGDGTRKWLLRFPPRGAGRPVEIETVYIPEEGRGTLCISSQVGCTLTCSFCHTGTQKLVRNLTAEEILSQLLLARDRLGDFPERDTPQGAIVPAEGRKITNIVMMGMGEPLYNFENVKTALLIASDGDGLSLSKRRITLSTSGIVPEIYRTGEEIGVMLAISLHAVRDDLRDMLVPINKKYPLKQLMEACRAYPGLSNARRITFEYVMLKDVNDSLEDAKELVKLLKGIPAKINLIPFNPWPGTNYQCSDWEQIEKFADFINQAGYASPIRTPRGRDILAACGQLKSESERMRKVDRLAFEAMMIANHGED

SEQ ID NO: 35982 - protein, 337 aa, Triticum aestivum
  misc_feature (80)..(80): Xaa can be any naturally occurring amino acid
  misc_feature (134)..(134): Xaa can be any naturally occurring amino acid
  misc_feature (143)..(143): Xaa can be any naturally occurring amino acid
  misc_feature (182)..(182): Xaa can be any naturally occurring amino acid
  misc_feature (221)..(221): Xaa can be any naturally occurring amino acid
  misc_feature (265)..(265): Xaa can be any naturally occurring amino acid
  misc_feature (291)..(291): Xaa can be any naturally occurring amino acid
MAASLQAAATLMPAKIGGRASSARPSSHVARAFGVDAGARITCSLQSDIREVASKCADAAKMAGFALATSALLVSGASAXEGAPKRLTFDEIQSKTYMEVKGTGTANQCPTIDGGVDSFPFKAGKYEMKKFCLXEPNSFTVKXAEGIQKNEPPAFQKTKLMTRLTYTLDEMEGPLEVGAQRXTLNSKEKDGIDYAAVTVQLPGGERVPFLFTVKQLVATGXKPRELQRGPSLCPSYRGFVFPRPKGARGGSTGYDNAVALPAGGXRGDEEELAKENVKNASSSTGNITLSXVTKSKPETGEVIGVFESVQPSDTDLGAKAPKDVKIQGVWYAQLESN

SEQ ID NO: 35983 - protein, 190 aa, Treponema denticola ATCC 35405
MTIAKIRCRLFIMKDKIIDAAIRRVPDFPKKGILFYDITGILVNPEVFSYCLDKMTEMYKDKKVDAVAAIEARGFIFAAPFAYKMGIPLILIRKKGKLPGETYSASYDLEYGQASVEVHKTDVVKGQKVLLLDDLIATGGTLNAARSILEEGGAKVVGFCGVVGLPFLNYSKVLGDLPVKTLIEYDSEKI

SEQ ID NO: 35984 - protein, 258 aa, Solanum tuberosum
MSHFGRSGPPDIKDTYSLLVLNVTFRTTADDLFPLFDKYGKVVDVFIPRDRRTGDSRGFAFVRYKYQDEAQKAVEKLDGRVVDGREIMVRFAKYGPNAERIDKGRILEPVQRTKGRSRSRSPRPRHRDHRDKDSRRRSRSRSRSRSKGRYDRDQYRGRDRDNRHRSRSRSPDYHKGRGRGKYDEDRRSRSRSHGRSASPARRSPSPRRSPSPRRITPPRDASPDGRNHKDRSPTPKSISPRGRRAGSRSPLPRSDADD

SEQ ID NO: 35985 - protein, 175 aa, Oryza sativa (japonica cultivar-group)
MAPSVMASSATTVAPFQGLKSTAGMPVARRSGNSSFGNVSNGGRIRCMQVWPIEGIKKFETLSYLPPLTVEDLLKQIEYLLRSKWVPCLEFSKVGFVYRENHRSPGYYDGRYWTMWKLPMFGCTDATQVLKELEEAKKANPDAFVRIIGFDNVRQVQLISFIAYKPPGCEESGGN

SEQ ID NO: 35986 - protein, 422 aa, Photobacterium sp. SKA34
MKDETLSIHSGYETDPTTKSVATPIYQTVAYEFDDAKHGADLFNLEVPGNIYTRIMNPTNDVLEKRMAALEGGIAGLVVSAGSAAINYAILTLAQAGDNIVSTPQLYGGTYTLFAHMLPSQGIEVRFAKDDKPESMAALIDKNTKAVYCESIGNPSGNVIDLERVSQLAHDQGVPVIVDNTVATPVLCKPIEFGADIVVHSLTKYVGGHGTTLGGVIVDSGNFPWAQYKDRFPVFSQPEPSYHGVIYNEAFGEAAFIGRARTVPLRNTGAALSPMNAFMLMQGLETLALRMERHTENALKVAQYLVNHDQVSWVNYAGLPDSDYYELAQKYTKGKPSAILSFGLKDGYEAGVSFYDALGLFKRLVNIGDAKSLACHPASTTHRQMTSEEQCQAGVHPEMIRLSIGIEHIDDIIADLEQALKA

SEQ ID NO: 35987 - protein, 372 aa, Catharanthus roseus
MADKENCIRVTRLAKKRAVEAMAASEQQRPSKKRVVLGELKNLSSNISSIQTYDFSSGPQKQQKNKNKRKAKESLGFEVKEKKVEEAGIDVFSQSDDPQMCGAYVSDIYEYLHKMEMETKRRPLPDYLDKVQKDVTANMRGVLIDWLVEVAEEYKLLPDTLYLTVSYIDRFLSMNALSRQKLQLLGVSSMLIASKYEEISPPHVEDFCYITDNTYKKEEVVKMEADVLKFLKFEMGNPTIKTFLRRLTRVVQDGDKNPNLQFEFLGYYLAELSLLDYGCVKFLPSLIASSVIFLSRFTLQPKVHPWNSLLQHNSGYKPADLKECVLIIHDLQLSKRGSSLVAVRDKYKQHKFKCVSTLTAPPSIPDEFFEDI

SEQ ID NO: 35988 - protein, 350 aa, Hyphomonas neptunium ATCC 15444
MKQTLLLLPGDGIGPEVVAQARRIAEALVPDVQIEEGLVGGASFDAHGTPLTDETLDRARKASAVLLGAVGGPRWTATARDKRPEAGLLALRKGLDVFANLRPAFCFPALVDASSLKKDRVEGLDLMIVRELTGGVYFGQPRGIDEEGGLRRGYDTAIYTHPEVERVARIAFDIARGRNGRVTSVEKSNVMESGLFWRQEVTLAHAELGAGVELAHMYADACAMELVRAPKQFDVILADNLFGDILSDAAAMLTGSIGMLPSASLGAPGTPGLYEPVHGSAPDIAGQGIANPCAAILSLEMALRWSLGKEKAADTLLAAVGKALDRGARTRDLGGDLSTRAMADAVLNAL

SEQ ID NO: 35989 - protein, 505 aa, Polaromonas sp. JS666
MSTLRRIAGQCPSPDTSQIPSCQDPNLMTYPNTQLFIAGEWQEAADGRSLAVFNPATGKEIGRVAHAAKVDLDRALAAAQQGFETWRKVPAFERSKIMRRAAGLMRERAGEIAAVLTQEQGKPLAEAKVEAMAAADIIEWFAEEGFRVYGRVVPSRNLATRQLVLKDPVGPVAAFTPWNFPINQAVRKLSAALATGCSIIVKAPEETPAGPAALIQAFADAGIPAGVIGLVYGNPAEISGYLIPHPVIRKITFTGSTPVGKQLAALAGQHMKRVTMELGGHAPVIVAEDADVELAVKAAGGAKFRNAGQVCISPTRFLVHESIRNDFAAALVKHAQGLKVGDGLGEGIQMGPLANPRRLTAMAEFTQDAVQRGAKVAAGGERIGDLGNFWAPTVLTDVPLDAKVFNDEPFGPMAAIRSFNTLDEAIAEANRLPFGLAGYAFTRSLKNAHALSQHVEVGMLWINQPAAPWPEMPFGGVKDSGYGSEGGPEALEAYLNTRAVSIMNV

SEQ ID NO: 35990 - protein, 1118 aa, Arabidopsis thaliana
  misc_feature (558)..(558): Xaa can be any naturally occurring amino acid
MTTTSEISLQEEYVTDAVDHRGLDARRSNTGRWRAALFIIGVEVAERFAYYGIGSNLISYLTGPLGESTAVAAANVNAWSGIATLLPVLGAFVADAFLGRYRTIIISSLIYVLGLAFLTLSAFLIPNTTEVTSSTSSFLNVLFFFSLYLVAIGQSGHKPCVQAFGADQFDEKDSQEKSDRSSFFNWWYLSLSAGICFAILVVVYIQEEFSWAFGFGIPCVFMVISLVLFVSGRRIYRYSKRRHEEEINPFTRIGRVFFVALKNQRLSSSDLCKVELEANTSPEKQSFFNKALLVPNDSSQGENASKSSDVEDATALIRLIPVWFTTLAYAIPYAQYMTFFTKQGVTMDRTILPGVKIPPASLQVFIGISIVLFVPIYDRVFVPIARLITKEPCGITTLKRIGTGIVLSTITMVIAALVEFKRLETAKEHGLIDQPEATLPMSIWWLIPQYLLLGLADVYTLVGMQEFFYSQVPTELRSIGLALYLSALGVGSLLSSLLISLIDLATGGDAGNSWFNSNLNRAHLDYFYWLLAIVSAVGFFTFLFISKSYIYRRVDRVXFPNAKTSLQEEYVIDAVDHRGFSARRSITGRWRAAWFIIGVEVAERFANYGIGSNLISYLTGPLGQSTAVAAANVNAWSGISTILPLLGAFVADAFLGRYITIIIASFIYVLGLAFLTLSAFLIPNNTEVTSSPSSFLNALFFFSLYLVAIGQSGHKPCVQAFGADQFDEKNPQENSDRSSFFNWWYLSMCAGIGLAILVVVYIQENVSWALGFGIPCVFMVISLVLFVLGRKSYRFSKTRQEEETNPFTRIGRVFFVAFKNQRLNSSDLCKVELIEANRSQESPEELSFLNKALLVPNDSDEGEVACKSRDVEDATALVRLIPVWLTTLAYAIPFAQYMTFFTKQGVTMERTIFPGVEIPPASLQVLISISIVLFVPIYDRVLVPIGRSITKDPCGITTLKRIGTGMVLATLTMVVAALVESKRLETAKEYGLIDQPKTTLPMSIWWLFPQYMLLGLADVHTLVGMQEFFYSQVPTELRSLGLAIYLSAMGVGSLLSSLLIYLIDLATGGDAGNSWFNSNLNRAHLDYFYWLLAVVSAVGFFTFLFISKSYIYRRVDVV

SEQ ID NO: 35991 - protein, 426 aa, Pseudomonas syringae pv. syringae B728a
MSKTNESLMQRRHAAVPRGVGQIHPIFAASAKNATVTDVEGREFIDFAGGIAVLNTGHLHPKIIAAVQEQLTKLSHTCFQVLAYEPYVELCEKINAKVPGDFDKKTLLVTTGSEAVENAVKIARAATGRAGVIAFTGAYHGRTMMTLGLTGKVVPYSAGMGLMPGGIFRALYPCELHGVSVDDSIASIERIFKNDAEPKDIAAIIIEPVQGEGGFYVAPKAFMLRLRELCDKHGILLIADEVQTGAGRTGTFFAMEQMGVAADLTTFAKSIAGGFPLAGVCGKAEYMDAIAPGGLGGTYAGSPVACAAALAVLDIFEEEHLLERCKAVGEQLVTSLKAMQAKYPVIGEVRALGAMIAVELFEDGDSHKPNAAAVAQVVAKARDKGLILLSCGTYGNVLRVLVPLTAEDELLKRGLAILDECFAEIA

SEQ ID NO: 35992 - protein, 480 aa, Pseudomonas syringae pv. syringae B728a
MQLKDSTLFRQQAYINGQWLDADGGQSIKVNNPANNEILGTVPKMGAAETRRAIEAADKALPAWRALTAKERGNKLRRWFELMIENQDDLGLLMTLEQGKPLAEAKGEITYAASFIEWFAEEAKRVYGDVIPGHQPDKRLIVLKQPIGVTAAITPWNFPAAMITRKAGPALAAGCTMVLKPASQTPFSALALAELAERAGIPAGVFSVVTGSAGDIGAELTGNPIVRKLSFTGSTDIGRQLMAECAKDIKKVSLELGGNAPFIVFDDADLDKAVEGAMISKYRNNGQTCVCANRIYVQDAVYDAFAEKLKAAVGKLKIGNGLEEGVTTGPLIDDKAVAKVKEHIADAVSKGATVLTGGNSLEGSFFEPTILVNVSKDAAVAREETFGPLAPLFRFKDEAEVIAMANDTEFGLASYFYAQNMSRVFRVAEALEYGMVGINTGLISNELAPFGGIKSSGLGREGSKYGIEDYLEIKYLCLSV

SEQ ID NO: 35993 - protein, 424 aa, Mesorhizobium loti MAFF303099
MTAIIDIVGREILDSRGNPTVEVDVVLEDGSMGRAAVPSGASTGAHEAVELRDGGARYLGKGVLKAVEAVNGELFEAIGGMEAENQIHIDQTMIELDGTPNKSRLGANAILGVSLAVAKAAADAAGLPLYRYVGGTKAHILPVPMMNIINGGAHADNPIDFQEFMILPVGAPTLREGVRWGSEIFHTLRKKLKDAGHNTNVGDEGGFAPNLKSAPVALDFIMESIEKAGFKPGEEIALGLDCAATEFFKDGNYVYEGEKKTRDPKAQAKYLAKLAADYPIVSIEDGLAEDDWEGWKYLTDLIGKKTQLVGDDLFVTNTARLRDGIRMGVANSILVKVNQIGSLTETLDAVETAHKAGYTAVMSHRSGETEDSTIADLAVATNCGQIKTGSLSRSDRMAKYNQLIRIEEELGKQARYAGKSVIKG

SEQ ID NO: 35994 - protein, 100 aa, Triticum aestivum
MGSGSFLKLLANNFDVLAGPLVSLAYPLYASVRAIETKSPVDDQQWLTYWVLYSFITLFELTFAPLIEWLPFWSYAKLFFNCWLVLPCFHGAAYVYDHFV

SEQ ID NO: 35995 - protein, 415 aa, Colwellia psychrerythraea 34H
MTKSTWFDTSIENALVTHESPEDEQGYFVYQLDALKAHLAALQQQDVIKLWFAVKANPLSKIIQTLDSEGFNFDVASSGELAQVLAQGIDPSRILNTGPAKSKKQLTAFIKQGVNTFVVESLNQLNWLNEAVLEQEQSLKSVEKPKVLLRVQLQWHEGEKNPLGGNSLTPFGLSVSEWQNIHVDSYPALDLCGLHIFQWGNMLSNEKMFSLWSQMITPLTDLASSIGMTLEVLDLGGGLGIDYLGEGQALSWSQVIEDLAIIKAKAGVKELWLELGRFAVAEYGYYVVPVVDRKMNYNQDQLVLAAGINHLLRPAITDQPFPVQILREGFVAEDDSMQAFDLHGPLCTSMDKLGHLQLPKDTAVGEQLVFGYCGAYGFTESMPFFLCHELAAEYVYQNGTLTQIRAALPASSYLA

SEQ ID NO: 35996 - protein, 363 aa, Zea mays
MEMTGSLPGPSVQARVAAGRHAPVPPRYLRPDLAADVVVADDATTIPIIDFQRLLLVDPEESARLHAACQDWGFFQKKMCTQLINHGVPDDVMEAMKASIQSFFALPAEAKQQYRQQAGQLEGYGQLFVVSEDQKLDWADVLYLNTQPPEHRNLSFWPAGESFRQTLDTYSAAVKHVADRLLGAMYMNLGLQLSIMDMDPERGAGIQSVRMNYYPPCAEAADKVLGFSPHSDSDLLTLVLQVNQLQGLQIQRPPDGGGAWAWLPVTPLQGAFVVNVGDVLEIFTNGRYRSVEHRALVNAHTERLSIAAFHSPSIHATIGPLPELLGDQEVPKYKTLDHQSFITLFFSAKLQGKSFLERMKKLS

SEQ ID NO: 35997 - protein, 803 aa, Catharanthus roseus
MRILIQEMLIRTLFFFYLIISSLEFTPENNYLINCGSFNDTSIDDRIFLADNLNSTVLSTPETIFANSSNSNSVLDLYKSARIFNGSSQYNFSINKKGWHWIRLHFFPFPISNEKFNLSSAKFSVFAQNFTLLKDFQPLNNVPVVKEFSLNVNSNNLLLKFTPSRNSLAFLNGLEVISLPDELIPFSIGNQNLEKNALETVVRVNMGNVTVSSKDDPLGRIWLSDYNYLSNVNLVVFVSNIHLVNYTKGEEKVSENIGPSSVYGTGTKLHSVFDPNTQINATWLFNVDSGFGYFIRFHFCNLLNPIPNNNFFFNVFLNSEFVVKDLNLSTSGAPMYKDVVVVTNVVPQIRISVGPSNVRNSYPDGILNGLEIMKISTSDGSLAAVDADFPSSSSSSKLKVWIIVSLAIGISLILVVFTVVFLFRRRKRHVMIHSTPDHLTEEDDSNSSIFSRSKIGYRFPLAVVQEATDNFSENRVIGIGGFGKVYKGVFKDGTKVAVKRGISCSSSKQGLSEFRTEVELLSQFRHRHLVSLIGYCDEKNEMIIIYEFMENGTLRDHLYGSDKPKLNWRKRVEICIGSAKGLHYLHTGTMKRIIHRDVKSANILLDENLMAKVADFGVSKTGPDHFDQTHVSTAVKGSFGYLDPEYLTMQKLTEKSDVYSFGVVMLEILTGRPVIDPSKPREMVNLVEWAMKCSRKGEEIVDSDIVNEVRPESLIKFQETAEKCLAERGVDRPTMGDVLWNLECALQLQGKQKENEQPEEMRDVSATEISLGSMADLAAVSMSKVFSELVKAQGTRSEFGSAP

SEQ ID NO: 35998 - protein, 342 aa, Pfiesteria piscicida
MPGREATPPSRSLAHLPLACYYIAGGIGDTCAALVSHPFDTVKVRQQVSGELDIRSRRAPQGLGALVQTFRAIVVADGVFGLYQGLSASVLRQSVFSTLRHGGYATCAVALAGYHLEAPARDTAKLPPHPSLALNAWQAVGCGVLAGSLAAFIANPFDIALIRMQADGHWPPQQRRNYRSGLHAVGTIASAEGAARLWRGCGPTVSRAALITATQLPTYHAAKASLLRAAPGCWKGGDDPKLHLSASLASAACATLATCPVDVIKTRIMNMQRADAGGAQYSSALDRAVRTARTEGVLGLYKGLLPTFARLAPHTVVLWQVQELVLRTLWASVLRHHDAAAA

SEQ ID NO: 35999 - protein, 535 aa, Carboxydothermus hydrogenoformans Z-2901
MGEPIWLKSYEEGVPHSLNYPDKTIAQIVDEIAAKMPNHKALIFYQKEITYGELKLYTDLLAAALARDGVKKGDRVALMSPNTPQYVITYLAVQKIGAILVQVNPMYVERELLHILNDSGAKVIVAMRNLYPRIKAVQNQTNLEKIILFDFSPYDVPDDAVDFEAYVKSAAGYTVEYPPIDYLNDPAVLQYTGGTTGIAKGAILTHRNILANPMQVTAWMTSCEFGKEVVLGVLPFFHSYGMSVAMNFSLINAGTLVLLPRFEINEVMNTIKKYRPTVFPGVPTMYIAINNYPNAGSYGIDSIKECISGSAPLPVEVALKFEELTGGHLVEGYGLSEASPVTHCNPLGGKRKVGSIGLPFPDTEAKIVDPENYERELPIGEIGELAVKGPQVMKGYWNMPEETARVLKDGWLYTGDIARMDEDGYFYIVDRKKDMIIASGYNIYPREVEEVLFEHPKIKEAVVVGVPDEYRGETVKAFVVLKDGETATAEEIIAFCKERLAAYKVPKKVEFREELPKTAVGKILRRQLREEELRK

SEQ ID NO: 36000 - protein, 342 aa, Pfiesteria piscicida
MPGREATPPSRSLAHLPLACYYIAGGIGDTCAALVSHPFDTVKVRQQVSGELDIRSRRAPQGLGALVQTFRAIVVADGVFGLYQGLSASVLRQSVFSTLRHGGYATCAVALAGYHLEAPARDTAKLPPHPSLALNAWQAVGCGVLAGSLAAFIANPFDIAPIRMQADGHWPPQQRRNYRSGLHAVGTIASAEGAARLWRGCGPTVSRATLITATQLPTYHAAKASLLRAAPGCWKGGDDPKLHLSASLASAACATLATCPVDVIKTRIMNMQRADAGGAQYSSALDCAVRTARTEGVLGLYKGLLPTFARLAPHTVVLWQVQELVLRTLWASVLRHHDAAAA

SEQ ID NO: 36001 - protein, 260 aa, Oryza sativa (japonica cultivar-group)
MLNLHTIRMSIPSLHRSSPYRCALLKRKRSCIRACSSEDDGSDASSSLGGDKRQQEVLAKIAMLQAQKVRITSFLDERSAYLTKFAKDADTEFDLIGQNAMKELDEVGDQIMERLDSKMQAFEETAEVQRQEIEMNERVLEDFEDWIEKEKNEGMFFKSLGKVKPRNKKKLTVKPIPKLEAQKVKDIAKESAGSKTRMNIYLGLMAILGLTIANAVFATPEVEWRKVAALGLIFIGLVAQVIYEQDISSPEAEKKGGKEE

SEQ ID NO: 36002 - protein, 436 aa, Catharanthus roseus
MATRNVVQVPQQNRDAAPAGMKQKNMAGEGKIRRALGDIGNLVTVRGVEGKPLPQVSRPITRSFCAQLLANAQAAAVAENNKKCKAVNVDGAADGGIIPKGARKPAQKKAATIKPKPEAVIEISSDSEQVKKEKKPSKKDAPTLTSTLTARSKAACGLSKKPKDQIIDIDAADADNELAVVEYVEDIYKFYKIAENESRVHNYMDSQPEINDKMRAILIDWLIEVHHKFELNPETLYLTINIVDRYLAVQTTLRKELQLVGMSAMLIASKYEEIWAPEVNDFVCISDRAYSHQQVLVMEKRILGGLEWNLTVPTPYVFLVRFIKASVPDSNMENMVYFFAELGMMNYSVAMMYCSSMIAASAVYAARCTFNKTPSWDDTLKLHTGFSEYQLIDCAKVLVNLHAMAADNKLKVIFRKYSSLERGSVALLPPAKSLLA

SEQ ID NO: 36003 - protein, 306 aa, Catharanthus roseus
MADKENCIRVTRLAKKRAVEAMAASEQQRPSKKRVVLGELKNLSSNISSIQTYDFSSGPQKQQKNKNKRKAKESLGFEVKEKKVEEAGIDVFSQSDDPQMCGAYVSDIYEYLHKMEMETKRRPLPDYLDKVQKDVTANMRGVLIDWLVEVAEEYKLLPDTLYLTVSYIDRFLSMNALSRQKLQLLGVSSMLIASKYEEISPPHVEDFCYITDNTYKKEEVVKMEADVLKFLKFEMGNPTIKTFLRRLTRVVQDGDKNPNLQFEFLGYYLAELSLLDYGCVKFLPSLIASSVIFLSRFTLQPKVHPW

SEQ ID NO: 36004 - protein, 461 aa, Mesorhizobium loti MAFF303099
MPIEILMPALSPTMEEGNLSKWLKNEGDKVVAGDVIAEIETDKATMEVEAVDEGTLAKIVVPAGTEGVKVNAVIAVLAVEGEDTDKAGEGIGEEPAKAETASPAPVAAKSEAAAPVAAAPKTEIAADPDIPAGTEMVSTTVREALRDAMAEEMRRDGDVFVMGEEVAEYQGAYKITQGLLQEFGPRRVVDTPITEHGFAGVGVGAAMAGLKPIVEFMTFNFAMQAIDQIINSAAKTLYMSGGQMGAPIVFRGPNGAAARVAAQHSQCYAAWYSHIPGLKVVMPYTAADAKGLLKAAIRDPNPVIFLENEILYGQSFDVPKLDDFVLPIGKARIHKQGKDVTIVSFGIGMTYAVKAEAELRGLGIDAEIIDLRTIRPLDLDTIIASVKKTNRLVVVEEGFPQSSVGDHIANQVSQRAFDFLDAPVITIAGKDVPMPYAANLEKLALPNVGEVIEAVKAVTYR

SEQ ID NO: 36005 - protein, 453 aa, Mesorhizobium loti MAFF303099
MPINITMPALSPTMEEGNLSKWLVKEGDKVSPGDVIAEIETDKATMEVEAVDEGTVAKLVVPAGTEGVKVNALIAVLAAEGEDASAAAKSGGGAAPAKAEAPKADAPKAEAPKAEPAAAAAPKAEPAPVANGHAAGERTFASPLARRIAKEAGVDVSAVTGTGPHGRVVKADVDAAIAGGGAKAALAAKAPAGAPAAPAPAVKPMSDDQVLKLFEQGSYELVPHDNMRKTIARRLVEAKSTIPHFYLTLDCELDALLALRTQINAAAPMKKTEKGDVPAYKLSVNDMVIKAMAMALKAVPDANASWTETAMVKHKHADVGVAVSIPGGLITPIIRKADEKTLSTISNEMKDLASRARSRKLKPEEYQGGTTAVSNLGMFGIKDFAAVINPPHATILAVGAGEERAVVKNGELKIATVMSVTLSTDHRAVDGALGAELLVAFKRLIENPMGMLV

SEQ ID NO: 36006 - protein, 136 aa, Glycine max
  misc_feature (121)..(121): Xaa can be any naturally occurring amino acid
ASSLISSPAATTVNRAGAGLVAPFTGLKSMAGFPTRKTNNDITSIASNGGRVRCMQVWPPIGKKKFETLSYLPYLDDAQLAKEVEYRVKKRLMPYLEFEVKHDCVYREHNRSPRCYNRLYXTMIKLAMFSCTEACQ

SEQ ID NO: 36007 - protein, 208 aa, Brucella melitensis 16M
MTQKNGPLRVGIGGPVGSGKTTLTEKLCKAMRDKYSVAVITNDIYTQEDALILARRQALSEDRIIGVETGGCPHTAIREDASINLQAVVEMTRRFPDLDVVFIESGGDNLAATFSPDLADLTLYVISVCQGEEIPRKGGPGITRSDFLVINKSDLAPYVHVDLEVMEADAMRMRAKRPFGFTDLHRGKGVQEIIDFIVENGGLEPRSN

SEQ ID NO: 36008 - protein, 160 aa, Shigella dysenteriae
DPDAEPYWRDVGTMKAYWKANLDLASAVPELDMYDRNWPIRTYNESLPPAKFVQDRSGSHGMTLNSLVSGGCVISGSVVVQSVLFSRVRVNSFCNIDSAVLLPEVWVGRSCRLRRCVIDRACVIPEGMVIGENAEEDARRFYRSEEGMVLVTREMLRKLG

SEQ ID NO: 36009 - protein, 378 aa, Bacillus subtilis subsp. subtilis str. 168
MKAVTYQGIKNVVVKDVPDPKIEKSDDMIIKVTSTAICGSDLHLIHGFIPNMQEDYVTGHEPMGIVEEVGSGVTKLKKGDRVIIPFNIACGECFFCKNQLESQCDQSNDNGEMGAYFGYSGQTGGYPGGQAEYLRVPFANFTHFKIPESCEEPDEKLSVIADAMTTGFWSVDNAGVKKGDTVIVLGCGPVGLFAQKFCWLKGAKRVIAVDYVNYRLQHAKRTNKVEIVNFEDHENTGNYLKEITKGGADVVIDAVGMDGKMSDLEFLASGLKLHGGTMSALVIASQAVRKGGTIQITGVYGGRYNGFPLGDIMQRNVNIRSGQAPVIHYMPYMFELVSTGKIDPGDVVSHVLPLSEAKHGYDIFDSKMDDCIKVVLKP

SEQ ID NO: 36010 - protein, 342 aa, Corynebacterium glutamicum ATCC 13032
MMSRLQTEGAGNDHDHYEAVIIGGGQAGLATAYYLMRAGVQTLILDDQPASGGAWLHVWPSLHLFSTSDFSNLPGWPMPKFDGFPTSSHVVDYLTEYERRYEIPVSRSVSVDKVDFVNGAFHLQSGTRSWIAKNVVAATGTWSAPFVPTFPGKFSGTHWHSSNYPGVHPFVGQRIAIVGGANSGAQIAAELSEVSEVTWFTRDKPRWMPDDVDGRELFRRNRLRALAIQRGERDPGPDSELGDIVMLPEVRRARDSGKLFATPMFGSLDEIRADHLIWCTGFRPAIRPVRQLLKHGQPKVPGLYLVGYGDWTGPGSATITGVGLYAKRAAKEIAASVGKVVK

SEQ ID NO: 36011 - protein, 315 aa, Escherichia coli W3110 [sequence omitted]

SEQ ID NO: 36012 - protein, 133 aa, Glycine max
  misc_feature (30)..(30): Xaa can be any naturally occurring amino acid
SYVGPPPPYFSFSEALRQVKLIGVPYGLRXQQLQDLWNQADADGNGVIDFEEFKQKIWNSTCPEHVLENLNGCTEDCNTEQEQEAIGFKVKNAMLYPREVEKGLWPEDYSLSDHARLTAVFSPARMRCSASQN

SEQ ID NO: 36013 - protein, 160 aa, Shigella flexneri
DPDAEPYWRDVGTLKAYWKANLDLASAVPELDMYDRNWPIRTYNESLPPAKFVQDRSGSHGMTLNSLVSGGCVISGSVVVQSVLFSRVRVNSFCNIDSAVLLPEVWVGRSCRLRRCVIDRACVIPEGMVIGENAEEDARRFYRSEEGIVLVTREMLRKLG

SEQ ID NO: 36014 - protein, 440 aa, Staphylococcus aureus subsp. aureus COL
MKTYDLIVIGFGKAGKTLAKYAASTGQHVAVIEQSPKMYGGTCINIGCIPSKTLVHDGLEGKSFEASYNRKNDVVNALNNKNYHLLADDNNIDVLDFKAQFKSNTEVNLLDQHDDIVDSITAPHIIINTGATSVIPNIKGLDQAKHVFDSTGLLNISYQPKHLVIVGGGYIALEFASMFANLGSKVTVLERGESFMPREDQDVVAYGITDLENKGIALHTNVETTELSSDNHHTTVHTNVDNFEADAVLLAIGRKPNTDLALENTDIELGDRGEIKVNAHLQTTVPHIYAAGDVKGGLQFTYISLDDYRIIKSALYGNQSRTTDNRGSVPYTVFIDPPLSRVGLTSKEAAAQHYDYTEHQLLVSAIPRHKINNDPRGLFKVVINNENNMILGATLYGKQSEELINIIKLAIDQNIPYTVLRDNIYTHPTMAESFNDLFNF

SEQ ID NO: 36015 - protein, 422 aa, Crocosphaera watsonii WH 8501
MTHTILPEKPTQSFDPQHFDTYVMHTYGRFPIAIERGEGCRLWDTNGKEYLDFVAGIATCTLGHGHPALVKSVSEQIRSLHHVSNLYYIPQQGELAQWMIENSCADKVFFCNSGAEANEAAIKLIRKYAHTVLDFLEQPVILTAKASFHGRTLATITATGQPKYQQDFEPLMPGFAYIPYNDIKAVEHAIADMDEGNRRVAAIMLEPLQGEGGVRPGEIDYFLRLRKICDENNILLVFDEVQVGVGRSGKLWGYENLGVEPDVLTSAKGLAGGVPIGAMMCKEFCNVLTPGTHASTFGGNPLASAAALTVLKTIEEDNILQNVQARGEQLRTRLRAIAQKDPTLFIDVRGWGLINGIEINEEMSITSIDIVKAAMDEGLLLAPAGPKVLRFVPPLIVTEEEINEAAEKLETAISEVCAAAVN

SEQ ID NO: 36016 - protein, 294 aa, Escherichia coli W3110
MIKKIFALPVIEQISPVLSRRKLDELDLIVVDHPQVKASFALQGAHLLSWKPAGEEEVLWLSNNTPFKNGVAIRGGVPVCWPWFGPAAQQGLPAHGFARNLPWTLKSHHEDADGVALTFELTQSEETKKFWPHDFTLLAHFRVGKTCEIDLESHGEFETTSALHTYFNVGDIAKVSVSGLGDRFIDKVNDAKENVLTDGIQTFPDRTDRVYLNPQDCSVINDEALNRIIAVGHQHHLNVVGWNPGPALSISMGDMPDDGYKTFVCVETAYASETQKVTKEKPAHLAQSIRVAKR

SEQ ID NO: 36017 - protein, 238 aa, Triticum monococcum
MGRGKVVLQRIENKISRQVTFAKRRNGLLKKAYELSLLCDAEVALVLFSHAGRLYQFSSSSNMLKTLEKYQRYIFASQDAAVPTTDEMQNNYLEYMELKARVEVLQRSQRNLLGEDLAPLSTIELEQLEGQVGKTLRQIRSRKTQVLLDEMCDLKRKEQILQDANMTLKRKLGEIELEATPDPPQQPQQQQMWQGDRGVPPHTPPQPEHFFQALERYPSLQPVFRGMDVNQPPPAWMA

SEQ ID NO: 36018 - protein, 333 aa, Arabidopsis thaliana
MSTYYNDHLAAAEKDISSSNFCNLVDASVMLYDEEHRDLLPKKVNSRCQAKTKKQEKESDKRFFDLFPKKRRTSVVTVRNPEQNQQNLHRVSTSSSLLDLNTIPGDSSDPRNELQGLLSSSSSSFLGDYERKTPQNASSSSTLLAEYNTEMANPPNPNSETSLKRKHSDSEPKKAKTPYSWKGREAPEWLVKMMGTMQGSEGPRLIYEKTLTETDVKPVQSRLLMPFNTLIRNDFLTPVELRILLELEDDTDGVGATLVDPWEVKWGVILKKREMKKYSGKGSLNYAIICGWNDIVEANVLEKDDDISIWSFRRGRNGILSFALVLPPPPDMA

SEQ ID NO: 36019 - protein, 274 aa, Zea mays
  misc_feature (112)..(112): Xaa can be any naturally occurring amino acid
MAVHGGDYLRRFVAETEWYNEVVLNAVAPGDWWRGLPHPVQSWMRNCVGGYLLYFISGFLWCFVIYYWKRHAYIPKDAIPTNEAMKKQIAVASKAMPFYCALPTLSEYMIEXGWTRCYFNISEMGFSAYLCYMAMYLIFVEFGIYWMHRELHDIKPLYKHLHATHHIYNKENTLSPFAGLAFHPLDGILQAIPHVLALFLLPTHFRTHIALVFLEGVWTTNIHDCIHGKVWPVMGAGYHTIHHTTYRHNYGHYTVWMDWMFGTLREPDDILKKA

SEQ ID NO: 36020 - protein, 302 aa, Ralstonia metallidurans CH34
MTADQNSQPNTAEPADSVDRYVVVGNPISHSRSPAIHAAFARQTGEAVQYDRLEAPLDAFADTMREFLAGGGHGFNVTVPFKLEAYDLADRLTPRAEAAGAVNTMWIEDGLIHGDNTDGIGLVRDIQDNLDVLLEDKRILVLGAGGAAMGAMLPLIECRPARIVVANRTASRASDMVEEFVEAADQYNVELWAGGLDALDALSEDERCDVVINASSSSLQGEVPPVPEHLLGEGVLAYDMMYGAQPTVFLAYAAKCGARTADGLGMLVEQAAEAFYNWRGVRPSTAPVLAELRAALQAEAAR

SEQ ID NO: 36021 - protein, 512 aa, Rhodococcus sp. RHA1
MHIPFTVTDFLERGAAGFPDSVAVIDEPEQPGESVGQVTFRELAHRVCAWQAGFDRLGIRVGERVAVVSHNSARLLELLYAVPASGRICVPINFRLSPAEVDYIVGDCGASVLLVDPELEEALSGIKVRHRFVLGKHTDADLMRFDTEPAPWASPTEESTATINYTSGTTARPKGVEMTHRNLWVNAVTLAMHTRAWERDVYMHTLPMFHCNGWGMPFGMAGLGAKQIVLRKVDGGEILRRVEEHGVTLMCGAPAVWNAVLEAARSWQGEIPGRDRVRVVCAGAPPPSRTIARLSSELGWELQQIYGLTETSPLLTFNRSLPADDGLDLEERAHRLTRAGLPALGARLHISNSGEVLARSNVVMNGYWNNPEATDEALRDGWFHTGDGGMIDGEGQLTISDRKKDVIVTGGENVSSIEVEECIFSHPGVTQVAVIGVPDEKWGETVKALVVTTGPSTVSEAEIIAHCKQHLAGYKAPTSVEFRDSIPHTATGKIQKFKLRAPYWEGSTRGVN

SEQ ID NO: 36022 - protein, 323 aa, Salmonella enterica subsp. enterica serovar Typhi str. CT18
MNLEKINELTAQDMAGVNATILEQLNSDVQLINQLGYYIISGGGKRIRPMIAVLAARAVGYQGNAHVTIAALIEFIHTATLLHDDVVDESDMRRGKATANAAFGNAASVLVGDFIYTRAFQMMTSLGSLKVLEVMSEAVNVIAEGEVLQLMNVNDPDITEENYMRVIYSKTARLFEAAAQCSGILAGCTPEQEKGLQDYGRYLGTAFQLIDDLLDYSADGEHLGKNVGDDLNEGKPTLPLLHAMRHGTPEQSAMIRTAIEQGNGRHLLEPVLEAMTTCGSLEWTRQRAEEEADKAISALQILPDTPWREALIGLAHIAVQRDR

SEQ ID NO: 36023 - protein, 172 aa, Zea mays
MAASATAARPLAGTAVPLPLSTRTRPARVALLSLIPPAPAQRLALRRGAWLSPPERSRSVRCLAAMSPEMRATLDKVVGSSKVVLFMKGTKDFPQCGFSHTVVQILRSLDVPFETLDVLANEALRQGLKEYSSWPTFPQLYIDGEFFGGCDITVEAYKSGELQETLEKAMCS

SEQ ID NO: 36024 - protein, 465 aa, Silicibacter sp. TM1040
MTTITNHLPTAELQALDAAHHMHPFTANGGLAQKGARIITRAKGVTLTDSEGHEILDAMAGLWCVNIGYGRDELAEVAARQMRELPYYNTFFQTTHVPVIALAAKIAELAPDNLNNVFFAGSGSEANDTNIRMVRHYWAMKGKPTKSVIISRKNAYHGSSVGSGSLGGMSAMHAQGGLPIPDIHHINQPNWWAEGGNTDPEDFGLQRAQELEKAILELGEDRVAAFIAEPVQGAGGVIVPPASYWPEIQRICDKYEILLIADEVICGFGRTGNWFGSETMGIRPDIMTIAKGLSSGYAPIGGSIVSDEVAAVIAQDEFNHGYTYSGHPVAAAVALENLRILEEENVLDHVRNVAAPYLKEKWEALTAHPLVGEAKIVGMMGSIALTPNKATRAAFEAEAGTVGFICRERCFANNLVMRHVGDRMIISPPLVITPEEIDTLIARATKSLDECYTELQAQGLLKSAA

SEQ ID NO: 36025 - protein, 666 aa, Streptococcus pyogenes M1 GAS
MMKKPFYITTPIYYPSGKLHIGSAYTTIACDVLARYKRLMGHEVFYLTGLDEHGQKIQTKAKEAGITPQTYVDNMAKDVKALWQLLDISYDTFIRTTDDYHEEVVAAVFEKLLAQDDIYLGEYSGWYSVSDEEFFTESQLKEVFRDEDGQVIGGIAPSGHEVEWVSEESYFLRLSKYDDRLVAFFKERPDFIQPDGRMNEMVKNFIEPGLEDLAVSRTTFTWGVPVPSDPKHVVYVWIDALLNYATALGYRQANHANFDKFWNGTVFHMVGKDILRFHSIYWPILLMMLDLPMPDRLIAHGWFVMKDGKMSKSKGNVVYPEMLVERFGLDPLRYYLMRSLPVGSDGTFTPEDYVGRINYELANDLGNLLNRTVAMINKYFDGTVPAYVDNGTAFDADLSQLIDAQLADYHKHMEAVDYPRALEAVWTIIARTNKYIDETAPWVLAKEDGDKAQLASVMAHLAASLRLVAHVIQPFMMETSAAIMAQLGLEPVSDLSTLALADFPANTKVVAKGTPIFPRLDMEAEIDYIKAQMGDSSAISQEKEWVPEEVALKSEKDVITFETFDAVEIRVAEVKEVSKVEGSEKLLRFRVDAGDGQDRQILSGIAKFYPNEQELVGKKLQIVANLKPRKMMKKYISQGMILSAEHGDQLTVLTVDSSVPNGSIIG

SEQ ID NO: 36026 - protein, 459 aa, Bacillus subtilis subsp. subtilis str. 168
MIGNSSKDNFGQQQKLSRGLKNRHIQLMAIGGAIGTGLFLGSGKSIHFAGPSILFAYLITGVFCFFIIRSLGELLLSNAGYHSFVDFVRDYLGNMAAFITGWTYWFCWISLAMADLTAVGIYTQYWLPDVPQWLPGLLALIILLIMNLATVKLFGELEFWFALIKVIAILALIVTGILLIAKGFSAASGPASLNNLWSHGGMFPNGWHGFILSFQMVVFAFVGIELVGLTAGETENPQKVIPKAINQIPVRILLFYVGALFVIMCIYPWNVLNPNESPFVQVFSAVGIVVAASLINFVVLTSAASAANSALFSTSRMVYSLAKDHHAPGLLKKLTSSNVPSNALFFSSIAILIGVSLNYLMPEQVFTLITSVSTICFIFIWGITVICHLKYRKTRQHEAKANKFKMPFYPLSNYLTLAFLAFILVILALANDTRIALFVTPVWFVLLIILYKVQTQQRT

SEQ ID NO: 36027 - protein, 175 aa, Triticum aestivum
MAPAVMASSATTVAPFQGLKSTTGLPISRPSGSAGLSNVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 36028 - protein, 312 aa, Coccidioides immitis RS
MASEQPQVPANGNSAPTDFAVKAGLAQMLKGGVIMDVVNAEQARIAEEAGACAVMALERVPADIRAQGGVARMSDPSMIKEIMNAVTIPVMAKARIGHFVECQILEAIGIDYIDESEVLTPADHLYHVIKHPFKAPFVCGCRNLGEALRRIQEGAAMIRTKGEAGTGDVVEAVKHMRTVNSEIARARSILTSSTNPEVELRAYARELECSYELLKETAEKGRLPVVNFAAGGVATPADAALMMQLGCDGVFVGSGIFKSGDPRKRARAIVQAVTHYNDAKKLAELSENLGEAMVGISVQEMSDKEKLAKRGW

SEQ ID NO: 36029 - protein, 361 aa, Carboxydothermus hydrogenoformans Z-2901
MAVGILTGGGDCPGLNAVIRALVKTLQQKLPEEKIIGFLDGFRGAIENRSVPLTTKDVVGLLPKGGTILGTSNRDNPFKFPVSVNGTLEFHDVSDTVIENLHKNNIEVLFVIGGDGSLSIAHELSQKGVKVIGIPKTIDNDLDATDFTFGFDSAVRTATKALDMLHTTAESHHRIMVLEVMGRYAGWIALYSGLAGGADVILIPEIPFNWDAVCRKIQQRKAEGKHFSIVVVAEGAYPEGGERVIARYVKESTDPARLGGIGQVVADHLSRCTGLESRVTVLGHLQRGGGPTPFDRILATRFGVAAVNTWLQGNYNVMVAFLGGRVTTVPLSEGIKKLKLVPVDSELIVTAKAIGISFGDE

SEQ ID NO: 36030 - protein, 263 aa, Triticum aestivum
  misc_feature (51)..(51): Xaa can be any naturally occurring amino acid
SGGPLTWPPTLPSKDIPPAGSTRQEKDGERQGDHRDSTHHAVHPGVQPQHXHHNHNHHHRVLAGVGVGMGCGAEAVVAAAGTAGMRCREHDCEVPAEVARHHEHAEPGSGQCCSAVVQHVAAPAAAVWSVVRRFDQPQAYKRFVRSCALVAGDGGVGTLREVHVVSGLPAASSRERLEILDDESHVLSFRVVGGEHRLKNYLSVTTVHPSPAAPSSATVVVESYVVDVPAGNTIEDTRVFIDTIVKCNLQSLAKTAEKVAAVS

SEQ ID NO: 36031 - protein, 204 aa, Staphylococcus epidermidis ATCC 12228
MSNPIKIGIGGPVGAGKTQLIEKVVKRLAKEMSIGVITNDIYTKEDEKILVNTGVLPEDRIIGVETGGCPHTAIREDASMNFAAIDELLERNDDIELIFIESGGDNLAATFSPELVDFSIYIIDVAQGEKIPRKGGQGMIKSDFFIINKTDLAPYVGASLDQMAKDTEVFRGNRPFAFTNLKTDEGLEKVIEWIEHDVLLKGLT

SEQ ID NO: 36032 - protein, 337 aa, Bacillus halodurans C-125
MKTVEQTSPTMTSEKARWIYQKMVEIRMFEDRVHDIFSKGEIPGFVHLYAGEEAIAVGLCAHLDHNDYITSTHRGHGHCIAKGCELDGMMAEIYGKSTGLCKGKGGSMHIADLDRGMLGANGIVGGGFTLAAGAALTAKFKQTGGVAVCFFGDGANNQGTFHEGINLAAIWDLPVVFVAENNGYGEATPFHYASACEQITDRAKGYNIPGVKVDGKDVVAVYEVAREAVERARRGEGPTLIECITYRNYGHFEGDAQTYKTGREKEEHTEERDAITLFEKYALSNNLLTEEAIQTVRHEVEQSVDRAVDFANASDYPQPEELLTDVYVSYDHEGRNG

SEQ ID NO: 36033 - protein, 344 aa, Bacillus halodurans C-125
MTRKISMSNAINEAMQLAMRQDEHVILLGEDVAGGAEVDHLQDDEAWGGVFGVTKGLVQEFGRDRVLDTPISEAGYVGAAMAAAATGLRPIAELMFNDFIGSCLDQVLNQGAKLRYMFGGKAQVPVTIRTMHGAGFRAAAQHSQSLYAMFTAMPGIKVVVPSTPYDAKGLLLSAIEDNDPVIFFEDKTLYNTMGEVPEGHYTIPLGKADIKRRGDDLSVVAIGKQVHTALTAADLLAKKGIEVEVIDPRSLSPLDSETILTSVEKTNRLIVIDEANPRCSMATDIAALVADEGFDFLDAPIKRITAPHTPVPFSPPLEDLYLPTPENVIQAVSELLGNSSLQSV

SEQ ID NO: 36034 - protein, 410 aa, Bacillus halodurans C-125
MAVEVVMPKLGMSMKEGTISVWNKKEGDMVAKGEAIVSIQSEKIETEIEAPADGTLLKVVVQEDQSVPPGTVIGYIGEPNEQLDQSKSLEKQQADSHAEKATEGAVFDVEKPSSKGATVSSSPVARKMALKAGINLENIVGTGPGGRITKADVEKAIAEQRVEPSEAKRSNSDVTEKGMQDGAKITPASAMRQVIATRMHGSLMQSAQLTMNMKADVTDLMALREEVNHTVQTRYGMKLTVTDFIARAVVLALQEHSNMNSAYIDEHIVTYEYVHLGMAVSLTQGLVVPVVQHAEALSVVELSKQIKSLSEQARTGKLQSDQLTGSTFTVTNLGVYGVDHFTPILNPPEAGILGVGAATDAPVFQGGDWQTRAMLPLSLTFDHRIVDGAPAAEFLQTIKQFLEKPTHLLL

SEQ ID NO: 36035 - protein, 373 aa, Glycine max
MWLVLAVANEGVAVAKRAAPKPVSKKVIVKPKPSEKVTDIDASPDKKRVLKDKKKEGDANPKKKSQHTLTSVLTARSKAACGITNKPKEQIIDIDASDVDNELAAVELAAVEYIDDIYKFYKLVENESRPHDYIGSQPEINERMRAILVDWLIDVHTKFELSLETLYLTINIIDRFLAVKTVPRRELQLVGISAMLMASKYEEIWPPEVNDFVCLSDRAYTHEHILTMEKTILNKLEWTLTVPTPLVFLVRFIKASVPDQELDNMAHFLSELGMMNYATLMYCPSMVAASAVLAARCTLNKAPFWNETLKLHTGYSQEQLMDCARLLVGFHSTLENGKLRVVYRKYSDPQKGAVAVLPPAKFLLPEGSASQHS

SEQ ID NO: 36036 - protein, 459 aa, Bacillus halodurans C-125
MDRVAIVGGGPAGYVAAITAAHRGKQVTLIEQKKLGGTCLNEGCMPTKSLLESAATYDKVKHASDYGIKGPVDEMRIEWGQVQARKNQIVHQLVKGIDYLLKKHKIELLEGTASFQSAHELLVQTERGQQTIEANRIIIATGSEPTPLPFAPFDREWVISSEQAMSLPIQPESMIIVGGGVIGCEFASIYGRMGTKVTIIEMADRLLFGEDHDICKVLMEELKRQGVEIYPSTVIKEMQRDRKQVVVERDGQVEVLTGDYVLVAIGRKPRLQEIGLERIGVDFTSRGITVNEHMQTTIPHIYACGDVIGGIQLAHVAFHEGSVAAKHLCGEPIQVRYEAVPRCIYTSPEIATVGLTETQARENYGHVRIGEYPFAANGKALIVNETIGKVKVVVEPEYEAIVGLTIVGPHATELIAQGTLMVHNELTLDSLESFIAAHPTVSEAVHEAVLQALGQAVHV

SEQ ID NO: 36037 - protein, 258 aa, Xanthomonas oryzae pv. oryzae KACC10331
MAHQLKLRMDPARARWVPAVAGVLRLSTRLCARVNERCSKTAGPRTCDPSAMSLLIEQARYHLSAHNARQLPDDGGYEVAFAGRSNAGKSSALNALTRQNALARVSKTPGRTQQLVFFQIQPERYLVDLPGYGYAKVPQDLQAHWQAFIDRYFRTREALRGLVVVMDIRHPLKDYDLQMLGYAAERGLPAHGLLTKADKLGRGQQMQTLQKVKKEVTSRFGDSVTVQTYSGQSRQGVDELRGIVGGWLGLIAEPLAEH

SEQ ID NO: 36038 - protein, 556 aa, Rhodobacter sphaeroides 2.4.1
MYSYTDFDEAFVRTRVAQFSEQVRRRIDGSLTEDEFKPLRLMNGLYLQLHAYMLRVAIPYGTLDSRKMRQLAMIAERWDKGYGHFTTRQNIQFNWPKLGDVPEILSALADVGMHAIQTSGNCVRNVTADHFAGAAADEIEDPRPVAELLRQWSTDHPEFQFLPRKFKIAITGSPNDRAVTKSHDIGLRMVRNADGEPGFEVIVGGGLGRTPMIGRVVRDFLPKADLLPYVEAILGVYNELGRRDNKYKARVKILVHETGLEPLREIIEERFLETRAEFGGQDMALLAEIERAFAPPAFRQAPTAAYDDFYRADPIFRAWADTNLARHRNADYAIVTISLKAHGATPGDATAEQMRVMADLAERYGHDELRISHEQNVILPHVHKADLPAVHAALAQAGLATANVGLISDIIACPGMDYCALATARSIPVAQEIATRFDTLDLEHEVGPLKIKISGCINACGHHHVGHIGILGLDRAGVENYQITLGGDGTETAAIGEKTGPGFAYDEIVPAVERIVRAYLEIRSEPSETFLDTLRRVGHAPFKAALYEAEGKQDAA

SEQ ID NO: 36039 - protein, 181 aa, Rumex obtusifolius
MASSIMSSATVARPSAAQATVIAPFTGLKNIATFPTTRKSSDLSFPSNGGKVRCMQVWPPEGKIKFETLSYLPPLSEADLLAQINYLLINGWVPCLEFDVGPGAVYREHHHSPGYYDGRYWTMWKLPMFGCTDATQVVAELEEAKKAYPHAFVRIIGFDNVRQVQCVSFIAYKPPRAEGTY

SEQ ID NO: 36040 - protein, 394 aa, Crocosphaera watsonii WH 8501
MSKIETRTEPMVLNMGPHHPSMHGVLRLIVTLDGEDVVDCEPVIGYLHRGMEKIAENRTNVMYVPYVSRWDYAAGMFNEAITVNAPEQLADVKVPKRAQYIRVIMLELNRIANHLLWLGPFLADVGAQTPFFYIFREREMIYDLWEAASGMRLINNNYFRIGGVAVDLPYGWIDKCEDFCDHFDPKVDEYEKLITNNPIFRRRVEGIGTITREEAINWGLSGPMLRGSGVQWDLRKVDHYECYDDFDWEVQWETAGDCFARYLIRIREMRESVKIVRQALKAIPGGPYENLEAKRMMEGKKSEWNSFDYQHIAKKVAPTFKIPEGEHYVRMESGKGELGIFIVGSNDPFPWRWKIRAPDFNNLQILPHLLKGVKVADIMAILGSIDVIMGSVDR

SEQ ID NO: 36041 - protein, 245 aa, Rhodobacter sphaeroides 2.4.1
MRKLAAGNWKMNGTEADLGEIDALLAAHPSPRCEMLICPPATLVARMAGRAAQGLMVGGQDCHPKTSGAHTGDVSAAMLADAGASHVILGHSERRADHGETDSLVRLKAEAAWGAGLVAIVCVGETEAQRDAGQTLDVIGAQLAGSVPEAATAANTVIAYEPVWAIGTGRTPTTAEIAEVHAFLRARLAERFSDAEGFRLLYGGSVKPSNAAEIFAVPNVDGALVGGASLKAADFGGIVAALSAA

SEQ ID NO: 36042 - protein, 447 aa, Chromobacterium violaceum ATCC 12472
MISLFKPAPHLPPLPDAQQHGLYRRLRWQIFLGIFIGYAGYYLVRKNFSLAMPYLVEQGFSRGDLGFAMSGVAIAYGLSKFLMGAVSDRSNPRVFLSAGLVLSAAVFLLMGFAPWATSSVGVMFVLLFLNGWFQGMGWPACGRTMVHWWSQKERGGVVSIWNCAHNVGGGLIGPLFILGMGWFNDWRAAFYVPAAAAIGVAVFAWLTMRDTPQSCGLPPVEAYRNDYPEDYSDKHEQELTAREIFRKYILPNKLLWYIALANVFIYLLRYGVLDWAPTYLKEVKHFSVDKSSWAYFLYEWAGIPGTLLCGWMSDKLFRGNRGATGVFFMALVTLATVVYWLNPAGNPTVDMLALIAIGFLIYGPVMLVGLHALELAPKKAAGTAAGFTGLFGYLGGSVAANAVVGYTVDHFGWDGGFALLIGSCVAAIVLLALTTWHGHQQGKLASA

SEQ ID NO: 36043 - protein, 177 aa, Sinorhizobium meliloti 1021
MNIIQQLEAEQAAKIAAKRTLPEFSPGDTVRVNVRVVEGNRTRVQAYEGVCIARSGGGINESFTVRKISYGEGVERVFPVYSPLVESVDVVRRGKVRRAKLYYLRDRRGKSARIVENTGTRARKLNDAERQAVVEEKARIEAEKVAAAQALAAEKAAAEAAEAKAAEEAKAAEAAAE

SEQ ID NO: 36044 - protein, 409 aa, Rhodococcus sp. RHA1
MAGATAVTALRDQGFSGRVCLIGAEEHLPYERPPLSKEFLGGEMPEDRLLVHSRETYEEQDIELLLGRRAIRLCPADGAVELEGGERVGADRVLLCMGVRPRPVGVPGGTLPGVHYLHDLEDAWALQTVIERGVPVVVVGEGFIGSEVASTLAEQGADVTLLMAGDLPMPVLGAEASGWILDQHRSNGVDVRARSPLQAIRGRDRVESVELSDGTVLPAGAVVVGIGSEPVVDLATDVGITVDNGILVDGLSRTSVPGIYAAGDLARFPSPTFGRSIRVEHWQNAQLQAAKAVEGMLGHGDRDIEPYDDIPWAWTKQYGNQWEIAGRPGPDMQVIRRGVPGSTDGALWIFSAHGRVQGAVVVNRRRELRAVRRALEQGPIFTNDTIRDESVDLRAALSDTDAARHEKTA

SEQ ID NO: 36045 - protein, 377 aa, Frankia sp. CcI3
MVCLRGGRGGGGTLSCRRATVADGAPAQWASRDGWNEAMTATDTVTPSDNRAPRDNREPTTGPVPRRADPANSRGNATRPRSMAKAHAEQIVMVVTIVVPLVALAVAIPAMWGQWISWRDVVLAVVFYGITGHGVTIGFHRYFTHRGFRTSRPVRIALAVAGNMAIEGPVIRWVADHRRHHAFSDTEGDPHSPWRYGPGTWSLIKGLWHAHVGWLFDVEQTDQRRFAPDLLDDPDIMKVSRSFALCAFASLALPAVIGGLWGGSFAAALEAFFWAGLVRIALLHHVTWSVNSICHVLGSRPYRSRDRSTNVWPLALLSMGESWHNLHHAEPTSARHGVRPWQIDTSFYLIKMMETVHLVWDVRWPDPARLAAKRATA

SEQ ID NO: 36046 - protein, 413 aa, Photobacterium sp. SKA34
MASTSISVKPEMATFSLKLKKKLLLLGPAFIAAIGYIDPGNFATNIEAGSAFGYQLLWVVLWANLMAMFIQYLSAKLGIVTGKNLAEHLRDHLPKWAIGPYWIQAEIIAMATDLAEFIGAAVGFQLLFSITLMEGAIITAIVTMAILLLSNKSQKPLEVVIATLLLVVAVVYVIELFFAHPATGEMIKGLAIPTMNSSHQIYLAAGILGATVMPHVIYLHSALFKNTYGETKAKRLKSTRLDVLIAMVIAGFVNIAIVAMAAAVFHYSGNQDIAEIETAYKTLTPLVGQAASTLFAISLIASGLSSTVVGTMAGDVVMQGFVKFKIPLLLRRVVTMIPSFIVIGLAINTTEILVMSQVVLSFGIALAIIPLLIFTNNEKLMGEFKNNKYVSYAGVVIIALVVALNIYLMMTLS

SEQ ID NO: 36047 - protein, 328 aa, Salmonella enterica subsp. enterica serovar Typhi str. CT18
MSHLALQPGFDFQQAGKEVLEIEREGLAELDQYINQHFTLACEKMFNCTGKVVVMGMGKSGHIGRKMAATFASTGTSSFFVHPGEAAHGDLGMVTPQDVVIAISNSGESSEIAALIPVLKRLHVPLICITGRPESSMARAADVHLCVKVPKEACPLGLAPTSSTTATLVMGDALAVALLKARGFTAEDFALSHPGGALGRKLLLRVSDIMHTGDEIPHVNKHATLRDALLEITRKNLGMTVICDESMKIDGIFTDGDLRRMFDMGGDMRQLGIAEVMTPGGIRVRPGILAVDALNLMQSRHITSVLVADGDQLLGVLHMHDLLRAGVV

SEQ ID NO: 36048 - protein, 878 aa, Rhodopirellula baltica SH 1
MNANSPSTPESLPPRPATVEPDLDRDTLAEEYFELLAYEPYPVQEEALLAYFTGNTQRTEGGPAAQHGVLVCAPTGTGKTLIAEAAVYEALRTGKRMYYTTPLIALTDQKLDELRESAVRWGFSPDQVGLVTGNRSVNPDAPVLVVVAEILLNRLLNPEAFEFDDVTCVVMDEFHSFNDYERGVVWELTLGLLPKHVRTLLLSATVGNSMAFTSWLRNAHGRNLQLVQGTERKVPLQYEWVEDDLLNEFCEKISAGDDEERRTPALLFCFSRSMCWTNAEMLKGKSLIDKARQKELSDILNASDFTNGVGPKLKQILMRGVGVHHAGILPRYRRIVEELFQKKLLSICVCTETLAAGINLPARSVVLPSLLKGPRDKKKLVDIASAQQIFGRAGRPQFDDRGYVFALAHEDDVKINRWRQKYDSIPEDTKDPGLLKAKKQLKKKMPKRRAGESYWTQTQFEQLQVAKSADLSSRGKVPWRLLAYLLSKDQNVQPIRELVGRRLMTPSQIDVAQKDLNRMLITMWSGGYIELQPPPRIAPERKPTPKGTKPGQPKPGANEPEPVATGGLFGELLDEMRAAEPEAKPEQSAEENQTVDDAEALAKRGYELEDYRPETAKPTVRLERLVQLKSVNPLFGVFMADQLADADEQERIAALESMLEVPGSVAKFARMPSYDIIPPGALAQNRLDALLLQRGLATMEELGGGKEEEEEEVKDRGFGRVMFEEPRVWPLTIGEKLLRLFRDEFPKVDDVRVRPVWIVGELLEFGGDFNKYVTARKLQKEEGILFRHCLRMILLCDEMANVPPKGTTVETWEDWLDDIADTLTEACRKIDPQSTDEILSQSESPLTDDLTGGRRNTGSKNTKPLISESAENEEQSTP

SEQ ID NO: 36049 - protein, 1054 aa, Bacillus subtilis subsp. subtilis str. 168
MKQASAIPQPKTYGPLKNLPHLEKEQLSQSLWRIADELGPIFRFDFPGVSSVFVSGHNLVAEVCDEKRFDKNLGKGLQKVREFGGDGLFTSWTHEPNWQKAHRILLPSFSQKAMKGYHSMMLDIATQLIQKWSRLNPNEEIDVADDMTRLTLDTIGLCGFNYRFNSFYRDSQHPFITSMLRALKEAMNQSKRLGLQDKMMVKTKLQFQKDIEVMNSLVDRMIAERKANPDENIKDLLSLMLYAKDPVTGETLDDENIRYQIITFLIAGHETTSGLLSFAIYCLLTHPEKLKKAQEEADRVLTDDTPEYKQIQQLKYIRMVLNETLRLYPTAPAFSLYAKEDTVLGGEYPISKGQPVTVLIPKLHRDQNAWGPDAEDFRPERFEDPSSIPHHAYKPFGNGQRACIGMQFALQEATMVLGLVLKHFELINHTGYELKIKEALTIKPDDFKITVKPRKTAAINVQRKEQADIKAETKPKETKPKHGTPLLVLFGSNLGTAEGIAGELAAQGRQMGFTAETAPLDDYIGKLPEEGAVVIVTASYNGAPPDNAAGFVEWLKELEEGQLKGVSYAVFGCGNRSWASTYQRIPRLIDDMMKAKGASRLTAIGEGDAADDFESHRESWENRFWKETMDAFDINEIAQKEDRPSLSITFLSEATETPVAKAYGAFEGIVLENRELQTAASTRSTRHIELEIPAGKTYKEGDHIGILPKNSRELVQRVLSRFGLQSNHVIKVSGSAHMAHLPMDRPIKVVDLLSSYVELQEPASRLQLRELASYTVCPPHQKELEQLVSDDGIYKEQVLAKRLTMLDFLEDYPACEMPFERFLALLPSLKPRYYSISSSPKVHANIVSMTVGVVKASAWSGRGEYRGVASNYLAELNTGDAAACFIRTPQSGFQMPNDPETPMIMVGPGTGIAPFRGFIQARSVLKKEGSTLGEALLYFGCRRPDHDDLYREELDQAEQDGLVTIRRCYSRVENEPKGYVQHLLKQDTQKLMTLIEKGAHIYVCGDGSQMAPDVERTLRLAYEAEKAASQEESAVWLQKLQDQRRYVKDVWTGM

SEQ ID NO: 36050 - protein, 362 aa, Haemophilus influenzae R2866
MQPTLFIDRDGTLIDEPKTDFQIDSLEKLKLEPKVIPALLRLKAKYRFVIVSNQDGLGTDAFPQTDFDKPHNVMMALFESQGITFDEVLICPHKPEENCLCRKPKIKLLDHYIRKNLFDIDRSFVIGDRETDMQLAENLGIRAIQYDPQKMNWDLIAEKLLGETVTNCGKRPPRFAEVIRQTKETDIKVQVWLDEAGVNEIKTGVGFFDHMLDQIATHGGFRMNVQCKGDLWIDEHHTVEDTALALGQALKQAIGDKRGIARFGFVLPMDECKAECALDLSGRPWIKFNACFKRDKVGDFSTELTEHFFQSLAFSMLATLHLNVTGNNDHHKIESLFKAFGRTLRQAIRIEGNEMPSSKGVL

SEQ ID NO: 36051 - protein, 221 aa, Haemophilus influenzae R2866
MNITKIDWQKVNGLLPVIIQNISTREVLMLGYMNEEALTKTIKERKVTFFSRTKQRLWTKGEISGNFLNVEEMSLDCDNDTLLILVDPIGATCHTGEYSCFHQFTSPQSENKKQQFANWAWFIKLEQHLKEKKNADPSNSYTATLHAKGTKKIAQKVGEEGVETALAAVAQDKAEVISEATDLVYHLTVLLHNQDLQWYEIIAKLQERHQGIELHPEGGNK

SEQ ID NO: 36052 - protein, 1106 aa, Leptospira interrogans serovar Lai str. 56601
MPRREDIRSVLILGSGPIVIGQACEFDYSGTQAAKALKEKGIRVILLNSNPATIMTDPDLADATYVEPMTVPVVQKILEKEKPDAILPTVGGQTALNLALACNSAGILEKYNVELIGAKVDAIKKAEDRELFKKAMEKIGVRVPASGLANNLKDAVEIKNKLGLPLIVRPAFTLGGTGGGIAYTEETFEEVVSKGLKASPISQVLLEESVLGWKEFELEVMRDLADNVVIICSIENIDPMGVHTGDSITVAPQQTLSDKEYQNLRDMSIAIIREIGVETGGSNIQFAVNPTNGDVIVIEMNPRVSRSSALASKATGFPIAKIAALLSIGYTLDEIKNDITRVTPASFEPSIDYVVTKVPRFAFEKFPGTDDTLGVQMKAVGEAMAIGRTFKESFQKALRSLEIDRYGFGSDGYFQELLYSRSLNNDQRKEWIDSHLKRPNDKRIFYVKLAFDEGYTVDQIHDLCKIDRWFLWQMEGLLKLEKEYSEKGNSILYKMKQVGFSNRQLSFLKNKKQILDLLDGNLRVDLKKTEIQNLLKLSEEEIEVELGSKKILPVYKRIDTCAGEFEAYTPYFYSSYDEEDESDVTNAKSVMILGGGPNRIGQGIEFDYCCCQASYALQDLGIESIMINSNPETVSTDYDTSDRLYFEPLTLEDVYRIYQNEKPEGVIIQFGGQTPLKLAKDLEKKGVKILGTSPDSIDRAEDRKRFVEVLEKLKLNSPESGIATSMEEAREIAHKIGYPVLVRPSYVLGGRAMLIINEEKELDRYMEKAEEISKDRPLLIDSFLEDAIEVDVDALCDGKEVFVTGIMEHIEEAGIHSGDSACVLPPQTLSKNMMDEIRKATVNLALELQVKGLINIQYAVKNEILYIIEVNPRASRTVPFVSKALGHPIVKYATRIMMGESLKSLPLPKEMEFSQVSVKEVVLPFNKFPGVDTILGPEMRSTGEVMGIASTAGEAFLKSQYMAGDELPSQGTVFVSINDKTKAELLSYIKDLSELGFNLIATSGTHKFLSDNGILSSKINKVYDGIFPTALDYIRENKIHLIINTPLSRVTRDDSFTIRQAAIRFKVPCLTTSNAAKALIKGMVEMKNKGFTIHSLQEIHAMPKIL

SEQ ID NO: 36053 - protein, 378 aa, Bacillus halodurans C-125
MKAVTYQGIKDVKVKEVPDPKLEKKDDVLVRITSTAICGSDLHLVHGMIPNFPKGYIIGHEPMGIVEEVGPDVTKVKKGDRVIVPFNIACGKCYYCTHDLESQCDNSNPNGQAGAYFGYSGTFGGYPGGQAELLRVPYGNFTPFVVPEDAEMEDEKLLFLSDIIPTAYWGVEQAEVKKGDTVVVLGCGPVGLLAQKFAWLKGAERVIAVDYVQYRLTHAKQTNQVEVLDFSTIDDVGTHIKEITKGGADSVIDCVGMDGKKSAVEMVETALKLQGGTLGPINIASQAVRKGGTVSIVGVYGTRYNAFPLGDFFARNITLKMGQAPIIHYMPTLYQMIKDEVFDPTDLITHRLPLELAEHGYDIFDAKQDDCIKVVLKP

SEQ ID NO: 36054 - protein, 980 aa, Bacillus subtilis subsp. subtilis str. 168
MMDVKSISVRVDGTEIQARAGATILDILNENGIEYPQICHVPEVDPIQTCDTCIVEANGKLVRSCATVAENGMSIDLSGNRVKEAQTEAMDRLLENHLLYCTVCDNNNGNCTLHNTAEMMGIEHQKYPYTPKEDPSCAVDMSHPFYRYDPNQCIACGQCVEVCQNLQVNETLSIDWERERPRVIWDEGVPINESSCVSCGQCVTVCPCNALMEKSMLGQAGFMTGIKEDVMEPMIDLVKNVEPGYGSIFAISEVEAAMRETRTKKTKTVCTFCGVGCSFEVWTKGRDILKIQPVSDAPVNAISTCVKGKFGWDFVNSKERITKPLIRKNGAFVESSWEEALDLVASRLGSIKEQYGKGSVGFISSSKITNEENYVIQKLARQVFETNNVDNCSRYCQSPATDGLFRTVGMGGDAGTIKDIAKAGLVIIVGANPAEGHPVLATRVKRAHKLHGQKLIVADLRKNEMAERSDLFISPKQGTDQVWLMAVTKYMIDQGWHDQAFIDENVNYFEDYKETLKTYTLDYAERITGLSKENIIQIAEMIRDADGTCVLWGMGVTQNTGGSDTSAAISNLLLATGNYRRPGAGAYPLRGHNNVQGACDMGTLPGWLPGYQHITDDKARAKFEEAYGVEIDGKPGLDNIQMLHAIEEGKMKAMYLVGEDMALVDSNANHVHDILSSLDFFVVQDIFLSRTAQYADVVLPATPSLEKDGTFTNTERRVQRLYQALPTLGDAKPDWWIIQEVANRLGANWNYSHPSDIFSEMASLSPLFAKASYEVLEGWNSFLWGSFTGESTPLLYEDGFNFPDKKARFALSDWTEPAAFPEEYDLHINNGRMLEHFHEGNMTNKSKGIQAKVPNVFVEISPELAQERGVCDGSLVRLVSPFGAVKLNALITDRVRKNELYLPMNSTDKESAINFLTGPAADKRTNTPAYKQTKVRMEVLGGCETAPLPKTNPRNKKRHPQNGVEAERKWNRPGYVHLTD

SEQ ID NO: 36055 - protein, 487 aa, Mycobacterium smegmatis str. MC2 155
MTPVTINHLVAGDWVAGAGDVVVSVNPARPGDIVAEGHNATTAQVDTAVAAAAEAFRAWAATPTHQRGAVLLAAAQIVDRNAEAWGLELATEEGKTKAEGIGEVRRAAQILRYYGNEGDRQAGEIFSSPRAGEQILVTRKPLGVVGVITPFNFPIAIPAWKIAPALVYGNTVVWKPASTVPVLAIRFAQALTEAGLPAGALNLVIGDSETGTAIVDHPRIDGLTFTGSTAVGRRLASVAATCGIPMQAEMGGKNAAVVLDDADLDVAVEQVMLGAFRSTGQKCTATSRLIVTDGIADKFTEALVERARALRVGDPTDDATEMGPVITDTSRASILAGIDTAVAQGATVLAGGRPYTEGPLAEGYFIAPTVLELDGSPAKVWSEELFGPVLAVRRAADADEAFELANDSEFGLSAAIFTQDVTRVLQAMEQIDVGVLHVNSESAGADPHVPFGGDKKSGLGPKEQGAAARDFFTHTTTVYLRGGRPGV

SEQ ID NO: 36056 - protein, 182 aa, Glycine max
  misc_feature (37)..(37): Xaa can be any naturally occurring amino acid
  misc_feature (88)..(88): Xaa can be any naturally occurring amino acid
MENQMAPSMIDCPAVTTVNRAGAVMAASFTGLKSMAXGFRTRETNSDITYIASNGGRVQCMQVWPPVGTKKSETLSYLPDLDDAQLAXEVEYLLRKGWIPCLEFELEHGFVYREHNTSPGYYDGRYWTMWKLPMLGCTDASQVLKERAEAKTVYPNGFIRIIGFFFVGRVHCISWLAYKPPG

SEQ ID NO: 36057 - protein, 296 aa, Pediococcus pentosaceus ATCC 25745
MNSNFDDFVKQNVELLDQHIDELFDSDSTLNTDLKMMMKYSIDAGGKRVRPLVLLAILKAFGKTPNYDILTVAAALEAVHTYSLIHDDLPAMDNDDLRRGRPTSHKKFGEAEAILAGDALLTVAFQWISSTNLKDRIKSELVLSLASDAGASGMIAGQLLDIQGNQRHYSLAELKHLHHLKTGKMLLFPAEAALIMKPSKLQVAELVKDFMANFGLAFQIHDDIIDVTESTAILGKTAGKDVDLNKNTYVNLLGLSGAKEELNQVLQKCEQDLTSLGELQPEMDLMILEGFLTYLK

SEQ ID NO: 36058 - protein, 2139 aa, Botryotinia fuckeliana
MTSKDGSCRNSSATSSSTGSWKSTDTIKGPGYFQGSSMKRGAPMQVKTDRSSRVEIDAQVSPTSAGPRNTISPSSSISPNVSPREQRMADFGNYRRDLAVLETSGGRIPQIHHNPPTAIASSNQIAPWMSNGGGATGSPNGFTSFYNDSSDALSQASQLSPVARPGTAVTGNTNASDSPADALFGDGDERRPSVASITTASSTGSKGSVSRAVGGLHKKLTSFFGEDPTSSDTSLPSQQGKEARSHSFARSHRDRNHSSATDHGHYRDASPAGGSRPRTPVPSSEVVPFLYQNSQDISLYGEAPVRENLSGPDRERYINDSSDKPPKTSSSSKSHHLPGHHLRNRSNDDTRSLRPTISREESAFSNRFKDRNNPMGTVSANASNPNLQRPKSPTPSGMSTWSQPTKNGNGDAPSSPRDNNNGAKRSLLNLTGRFKRHKDKDHTPSRLKETPAPSRAPINGSSRQDAGRIYESPDLAKYSQDGSITGSELNLTPQYTNGSARPPAGRQGTFPKLPFRKGRGRAEDTDQTYDTLDRGGDNIHHLDTNLSNMEGILTKPPPLTPLDNNIFNGNGHDDENKTDAESAGGLGWNAPDSWAVKKVDDDNMSRLPEIDEAGIPQKADEKASPYCIRIFKVDGTFATLSTALNTTVTELVAQLNKKTYQADNLENYQIVMRKHDLQRILAPGERPLVIQRRLLEQAGYEPGDRIEDVGREDNSYLCRFSFLPARQGGYASVSNDNGLALKSQKYSHVDLSGRNLITIPIALYSKTSEMISLDLSRNLSLDVPKDFISSCVNLRDIKFRSNEAWKLPVSLTRGSRVTMLDLTNNRIENLDHAELSRLQGLVSLKFANNRLKSLPSYFGIYRSMRTLNLSSNFLEEFPEFLCNMVSLTDMDMSFNGISDLPVEIGKLTALERFVFTNNRLIGSLPNSFGKLVNLKEVDIRYNLLSSIDIVATLPKVEQISADHNSVSVCECEFANIRILRLNSNPVTKFEIKNSVPTLTTLNLSNAKLAQIPDAAFDKMPNLNKLVLDINHFVFLPAQIGKLRKLEYFSIARNSLSSLPADVGCLTELRYLDIRQNNLKKLPMEIWWANKLEFLNVSSNVLENFPKPGSRPPQPPGDVGSANNNLNPNSQNSSFEELGPLDFGHRRPSQASSGLLSVGSSPVPDARKGSVVSVYGKGGRKTSVVSRSTSASTINQPPPVNIRKDSGLSAKLVNTFAGSLRNLHLADNGLDDDVFDELTLLSELRVLNLSYNDLNDMPSRSIKSWPQLVELYLSGNELTSLPSDDFEEFELVLQVLHINGNKFQTLPAELGKAHRLTVLDCGSNSLKYNVSNWPYDWNWNWNTNLKYLNLSGNKRLEIKPSLPGSAGARDGRDLTDFSALQSLRILGLMDVTLTIPSIPDQTEDRRVRTSGSLAGQLAYGMADSLGNDSHLSIIDMVVPRFNSTETETLLGMFDGAISSNRGSRIAKYLHENFGHIFSDELKRLNALNNETPKDALRRAFLSLNKDLATAAAQSNEERAVLSQRGSTTPAVLSQDDLTSGGVLPIMFLQQSELYVANVGDAQAMLIHEKDGHRILTRKHDPAEPNERQRIRDAGGWVSKQGKLNDVLEVSRAFGYVHLLPAVQAAPHVTHVTIKEQDEMVLIASRELWEYLSPELVVDIARYEKHDLMRAAQRLRDLASIFGASGKIMVMMMGVSDLKKRAQIRPHRVQSLSFNPNMMMDEGYVPSKRPKKKINDIEDSSLRRLKQEVQAPVGDIGIVFTDIKSSTALWETYPNAMRSAIRLHNEVMRRQLRIIGGYEVKTEGDAFMVSFPTATSALLWCFAVQAALLEVNWPAEVITSHMGHEVYDSNQNLIFKGLSVRMGAHWGRPVCENDPVTRRMDYFGPMVNRAARISAVADGGQITVSADFISEIQRCLETYSESDRSGSTGSEDAFDSDLISQSIRRELRSLSSQGFEVKDMGERKLKGLENPEYIYLMYPHSLAGRMNSQRSLEGEAAVITEEPATLAPDSELTIDPAHVWDIWRLSLRLEMLCSTLEEPRGEPLQPPETAMLEKMKNRGGEVTDRFLLNFLTHQVSRIETCITAIATRHLALGQIAISDLDQLRAPMADVMEGLAADPLTCRSTQIRLPFTRLRSLSCKIY

SEQ ID NO: 36059 - protein, 356 aa, Arabidopsis thaliana
MEWWKKKSLRAIIKRERLVRGHERGGTLLEEIIKSCNGKANPIKIFSADQILEATDTFSESNRVSELFDEIPYDWYYSGKNNNHHHHHKLLLIKKWRYRFSEHNGGNFCRDIAISSIVSGHKNFMQLVGCCLESEHPVLVYRASKKPTSLDLKMVVSWRQRLKIAEEIATALAYLHTAFPRPFVYRILRLEDILLDDEDGVAKLCNFSYCVSIPQGETFVKLGNGCIGGDYDYMDDNYLINGIVSEKTDAFGFGIFMQKLLMGEERFHELCYDRSDLTTFENRRKFAKCIDEIVDSNMLEKIGDVTEEERCRMEAFIVLSERCIGLRGEVPKMVEVAKELKRFLRDSSSSCGETSL

SEQ ID NO: 36060 - protein, 101 aa, Triticum aestivum
ADAASSAKIFAVLAGVQSLVACSLRKLRGKDDGINAGVAGCCTGLALSFPGAPQTLIQSCLTFGTFSYIIEKLNKQQPALALQPATGVTGLKAGQSVLPPF

SEQ ID NO: 36061 - protein, 474 aa, Burkholderia vietnamiensis G4
MRTSEQSYIAGQWLDPADARAIDVIDPATARPYARLAIGSAADVDRAVGAAKQAFDAYSRWSVDARVALLQRVLDIYQRRYDEVARTISQEMGAPLAFARAAQAAVGTAHLEQTIRALRAFRFSTQVDSLLVSYEPIGVCALITPWNWPINQIVCKVAPALAAGCTMVLKPSEIAPFSAILFAEILDEAGVPPGVFNLVHGYGHEVGDALSRHPDVDMVSFTGSTRAGVEVAKAAADTVKRVHQELGSKSPNLILPDADIDAAVTLGARSCFSNSGQSCNAPTRMFVHVDQLAAAEAAARREAARTVVGDPRSPETEIGPVVSRTQFDRIQQLIQRGIDEGATLVAGGLGRPDGLGDGFYVKPTVFSNVTPDMTIAREEIFGPVLSILTYRTEDEAVALANDSVYGLAAYVQTKDLERARRIAARLRVGNVHINYPAWNPAAPFGGYKRSGNGREYAEFGLVEYLETKGTTGYA

SEQ ID NO: 36062 - protein, 465 aa, Burkholderia vietnamiensis G4
MNGIDVGLEADLQALGKRHLLMHFTHADAYRDQALTVFDRGEGCWLVDRNGKRYFDGLAGLYCVQLGYSHGAEIGDAMREQMGRLPFATNWGYGHEPAIRLAHKLATLAPDGLNRVFFTSSGSESNESAIKLVRQYHQARGEPQRRKFIARRVAYHGTSFGALALNGMTNFRKHFEPLMAGVRHVSNTKRYGRPDGETEAQFTRHLLDEIESLIVQEGPDTVAAIVVEPLQNAGGSLTPPAGYAQGLRALCDRHGVLLVADEVICGFGRLGEWFGSTRYGLQPDLITFAKGIASGYVPLGGVIASDAVVDTVLAGPQQMFLHGATYGGHPVACTAALANLAIMERERVLENVGGNQAVFRRTLDGLLELPCVGDVRGDGYHYSLELVTDKAARRWAAGIGAQAFVSTLLAPAIFEAGLLCRAGVDHEGTPIVQFSPPLVMSRDEIVWFVAKIRDILADTYARAMR

SEQ ID NO: 36063 - protein, 516 aa, Mesorhizobium loti MAFF303099
MSREKYYLTTPIFYPNGKPHIGHAYTVIATDALARFQRLDGKDVFFLTGTDEHGLKMQQTAEKEGITPQALADRNSAIFRSMTEAVGGSNDEYIRTTEPRHYASCQAIWKAMAANGDIYLDRYSGWYSVRQEAYFDESETTLGEDGVRREPLGSPVEWNEEESYFFRLSAYQDKLLALYESQPDFVGPAERRNEVMSFVKSGLKDLSISRTTFKWGVPVPGDDKHVMYVWVDALTNYITAAGYPDTKSDQWRYWPATHIIGKDIVRFHAVYWPAFLMSAGIELPKRVFAHGFLFNRGEKMSKSVGNVVDPFALIEHYGLDQVRYFFLREVPFGQDGSYSHDAIVNRTNADLANGLGNLAQRSLSMIAKNCGGVVPKRGEMTDADSAILDQAVAALTTARKAMAGQGIHLALAAIFDVVAEADRYFAGQAPWALKKTDPERMETVLWTTAELVRRVAVLCQPFIPGSAAKLLDLLAVPADKRDFVHVHADYALVPGTALPAPEGVFPRYVEQPGANA

SEQ ID NO: 36064 - protein, 509 aa, Rhodococcus ruber
MTGTLSRDSGTTNQVDERLGAAAREFLGRPHQLFIDGQWVDAADGRTFGTYDPATGAEITQVAHGGPEDVDRAVAAARRAFDDGDWATMKPNKREQILWRIGDLLDARGEMLGQIEALDNGKSAAIATAVDVTFAADVFRYYAGWCTKIEGTTVDVSMPFAGDKQFHAYTQRVPVGVCGQIIPWNFPLLMAAWKLAPALATGNTLVLKPAEQTPLTALLLGEIMAEAGVPDGVVNIITGFGDAGAAISAHDDVDKVAFTGSTEVGKLIVDAAKGNLKKVSLELGGKSANIVFADCDFDAAVAGSVAAWMFNHGQACTAGTRLYVEDSIYEKFTQAVADAAAQATIGHGLDPATELGPLVDQDQFDKVSYYLRAGIEDGGRALTGGGRHGDTGYFIQPTVFVDVEPDHRVVTDEIFGPVVAALRFSDMDDAVRQANDSIYGLAAGVWTKDISKAHKVASRLHAGSVWVNQYNGFDTAMPFGGFKQSGWGRELGKGALDLYTQTRSVNIQL

SEQ ID NO: 36065 - protein, 421 aa, Glycine max
  misc_feature (233)..(233): Xaa can be any naturally occurring amino acid
  misc_feature (250)..(250): Xaa can be any naturally occurring amino acid
MELFFYTVFGGLAAVVAVMELSKNNKDRINTSSAFNSFKNNYLLVYSLMMAGDWLQGPYVYYLYSTYGYGKGDIGQLFIAGFGSSMLFGTIVGSLADKQGRKRACVTYCITYILSCITKHSPQYKVLMLGRILGGIATSLLFSAFESWLVAEHFKRGFDQQWLSLTFSKAIFLGNGLVAILSGLVGNVLVDTLALGPVAPFDAASCFLAIGMAIILSSWTENFGDSSENQDLXLTQFRGAAVAIASDEKXALLGAIQSLFEGSMYTFVFLWTPALSPNDEEIPHGFIFATFMLASMLGSSLASRLMSRSSLRVESYMQIVFAVSSAALMLPILTTFLVAPSGVKGGSISFSGCIQLLGFCAFESCVGIFWPSIMKMRSQYIPEEARSTIMNFFRIPLNIFVCVVLYNVDAFPITVMFGMCS

SEQ ID NO: 36066 - protein, 197 aa, Streptomyces avermitilis MA-4680
MSRVGRVERTTKETSVLVEIDLDGSGKVDVSTGVGFYDHMLDQLGRHGLFDLTVKTEGDLHIDSHHTIEDTALALGAAFKQALGDKVGIYRFGNCTVPLDESLAQVTVDLSGRPYLVHTEPENMAPMIGEYDTTMTRHILESFVAQAQIALHVHVPYGRNAHHIVECQFKALARALRYASERDPRAAGILPSTKGAL

SEQ ID NO: 36067 - protein, 306 aa, Haemophilus influenzae R2866
MRKTLTVLGSINADHVISVPYFAKPGETLTGQNYQIAYGGKGANQAVAAARLGAKVAFISCIGSDSIGKTMKNAFAQEGIDTTHINTVSQEMTGMAFIQVAQSGENSIVLASGANSHLSEMVVRQSEAQIAQSDCLLMQLETPLSGVELAAQIAKKNGVKVVLNPAPAQILSDELLSLIDIITPNETEAEILTGVAVTDEQSAVKAASVFHDKGIKTVMITLGAKGVFVSRKGKSRIIKGFCVQAIDTTAAGDTFNGGFVTALLEEKSFDEAIHFGQAAAAISVTKKGAQSSIPTRQETLEFLEHA

SEQ ID NO: 36068 - protein, 117 aa, Glycine max
  misc_feature (112)..(112): Xaa can be any naturally occurring amino acid
MAGHFDLQGRHGKSRVRVSRVWRRPADAGGHLFVEWSVAVSVVSDCLPSYTSDDNSAIVATDSIKNTVYVKAKECTEVVSMEEFAVILGRHFTSLYPQVSEAAVTIVERPWXRVAVD

SEQ ID NO: 36069 - protein, 123 aa, Zea mays
MSVAVTVPVAVGVRVLGRGAVRVTPRPWAVVGGRRRFYVRMFVATTEDTTTIVGGASEDQALEARNYKTVVAVMLCGGAGTRLIPFTRRRGKPAGSIGGAYRLMDAPMSNCINSGIIQDYIST

SEQ ID NO: 36070 - protein, 371 aa, Triticum aestivum
  misc_feature (105)..(105): Xaa can be any naturally occurring amino acid
MATRALREVVGRRRVGATGIGGGRRFSDSAAAAAPVGAAERGEGGGGKAVNLFTAVNQALHIALDTDPRSYVFGEDVGFGGVFRCTTGLADRFGKQRVFNTPLCXEQGIAGFAIGLAAMGNRAIAEIQFADYIFPAFDQIVNEAAKFRYRSGNEFNCGGLTIRSPYGAVGHGGHYHSQSPEAFFCHVPGLKVVIPRSPREAKGLLLASIRDPNPVIFFEPKWLYRLSVEEVPEGDYVLPLSQAEVIRKGSDITLIGWGAQLAVLEQACEDASKDGISCELIDLRTLIPWDKETVEASVSKTGKLLISHEAPITGGFGAEIAASIAERCFQRLEAPVARVCGLDTPFPLVYEPFYMPTKNKILDAIKATVNY

SEQ ID NO: 36071 - protein, 409 aa, Nostoc punctiforme PCC 73102
MKAVVFHGIGDIRLDNVPEPKIKESTDAIIRLTSSAICGTDLHMIRGTFTGMKPGTILGHEGVGIVEEIGSNVRNLKVGDRVVVPSTIACGYCSYCRTGYHAQCDNANPNGHNAGTAFFGGPEAAGPFDGLQAEYARIPYANAGLVKLPKEVTDDQAILLSDIFPTAYFGADIAEITPGDTVAIFGCGPVGQFAIVSARLFGAGHIIAVDTIPSRLEMARDLGAEIIDYNAEDPIEAIRELTGGIGVDRAIDAVGVDANAPDSGPAAEKARQEAQQFQQQLQQIAPKTNPQNGNWHPGNAPSLVLEWAVQALAKAGTLSIIGVYPPSHNFFPIGTAMNKNLTINMGNCNHRKYIPTLVDLVRNGTVDPTKVLTQVEPLMSVIDAYKAFDRRQPGWVKVELVPGATLANV

SEQ ID NO: 36072 - protein, 403 aa, Glycine max
  misc_feature (157)..(157): Xaa can be any naturally occurring amino acid
APSRATAAVAEAALAAAHAAAEVVRLTSGTGGVSSRPAPAPQPRRVAEETTAAAVKIQSAFRGYLARRALRALKALVKLQALVRGHIVRKQTSDMLRRMQTLVRLQSRARATRGNLSDNMHSFKSPLSHYPVPEDYKHSLRAYSTKFDGSILKRCSXNANFRDIDVEKARFGSHWLDSWMEENSWRQTRDASLKVGRLDDEKSDKILEVDTWKPHLNSHHSSGSSYQTSSHHYLYSDYNNENFVAYESPSKGSSKGLNPSLSSREVLPFGSLTFHKGKEEVAALPNVEDSPQAFSASSRLGSGGARRGPFTPTKSECAWSFFSGYPGHPNYMANTESSRAKVRSHSAPRQRMEFERYGHSTRRSLQGLWEAEPSSDRDSDFRSQAYATTTSSSLNRIGSANLR

SEQ ID NO: 36073 - protein, 475 aa, Rickettsia rickettsii
MNLLKNITGKNYINGEFIEFGKQISVINPATLKEIATVPNLGLSEINSAINNTVTSFALWSQSSFEARIAILRRWYNLVIENIEELSHILTLEQGKVLAESKKEILYGASFIDWYTYAIHNIHSTIKPGNSNTHKIVTQYEPVGPSAAITPWNFPNAMIARKVVPAIAAGCSVILKPSSLTPLSALVLAKFASDAGLPSGVFNVITGSSDIIGKAFCEDFRLRKLSFTGATNVGKILYQNAANTLKRLSLELGGNAPFIITADNNLEKVVSDLVIAKTRNSGQSCTSPNRIFIEESIYEKFIEILKAKFTKLKAGDGFDKESDVGPLINSAAIEKIQKLLADAQSKGAKLICGGKTVDNFIEPTIIIDCLDNMDIFRIEIFGPVVACYKFKDLDEVIEHANNTEYGLQGYVYSNNISVAQMIASKLDFGMVSINDPLPANAKAPFAGRKASGFGVEGSFEGIFEYLNTKYINLQN

SEQ ID NO: 36074 - protein, 204 aa, Zea mays
GAGAVVVFRRRRRYVTHSDVTASLTLAVSHTINRAQLQGWYNRLQRDEVVAEWKKVRGRMSLHVHCHISGGHLLLDLIAGLRYYIFRKELPVVLEAFVHGDGDLFSRHPELEEATVWVYFHSNLARFNRVECWGPLRDAAAPAPAEDDSTAPAAASIAMEGQMPVGEWPHRCPQQCDCCFPPHSLIPWPNEQDMAAAAGQVRQQ

SEQ ID NO: 36075 - protein, 323 aa, Cryptococcus neoformans var. neoformans JEC21
MPTSLEALKASGTTVVADTGDFSSIDEFKPQDATTNPSLILAAVKMPAYAKLLEPAIKYAKSKGGDIEVQSENAMDRLLVEFGTEILKIIPGRVSTEVDAKFSFDTQATINKAHQIIALYKEQGIDKNRVLIKIASTYEGILAAKQLESEGIHCNLTLLFGFGQAVACAEAGVTLISPFVGRILDWYKKANPDTTYTAETDPGVQSVQKIYNYYKQHGYKTIVMGASFRNTGEIAALAGCDFLTISPKLLDELNKSQDDLPKKLDASSTGEPIPKTSYLDDEAKFRWALFEDVMAFDKLHEGIRGFAKDGASLKQMLIEKLKA

SEQ ID NO: 36076 - protein, 380 aa, Glycine max
MALHCGTFCFWTVASHPPSSVKLSQPTIKASSFSSPLAPPLVKLNVRGKAFPGDGTPETKESPLVVCFGEMLIDFVPTVNGLSLAEAPAFKKAAGGAPANVAVGISRLGGSSAFIGKVGEDEFGYMLANILKENNVNNEGMRFDPGARTALAFVTLRSDGEREFMFYRNPSADMLLQEDELDLDLIRKAKIFHYGSISLITEPCKSAHIAAAKDAGVVLSYDPNLRLPLWPSADSAREGILSIWETADIIKISEEEISFLTKGENPYDDAVVHKLFHPSLKLLLVTEGAEGCRYYTKEFSGRVKGLKVDAVDTTGAGDAFVAGILSQLAVDLSILQNEDELRDSLKFANVCGALTVTERGAIPALPTKEAVLNAMLKPVS

SEQ ID NO: 36077 - protein, 1871 aa, Cryptococcus neoformans var. neoformans JEC21
MPDGSTSPREPANSAYSTHEPQSKRHSSPQSVAMPAAPRFHRQHTSSQDHGSSSTPISPAASSTGPLSPSIPPGSFVFPIRSVFQGMVHSDSSNGITEGHQQRKKDGLQRSSGSSSPLRSPALSDAHRFSTDAAGALHDEPDAGIQTIAQMLQQDGSAPLKEKGKHQPGVATFVGKAERDRNGSGGGETLKPSSPDASGHLGNSPITHSSSDSEHQKQQDVAKSSRSEEGTNDSPESSHGSGGTLKQATRTDLPAALQRSSTVKGKVSASGLTKTSPSNYRHFPSEHHSGQRERRFSTVNKVNPPSRNSSSHPVDASHPPNPELQHPVPRRNTRQQHTQDAEGNNRTSSHGSRTSLEVDESGMRSLISDMSGIVLLGEAGSWGSMGGSGVSGSKGTDGGTGTTGTVDSASIDSGHATGGRGQGDERQVTKASLAAKHGARQTSRQDSVRSFIQSQAGTTNLQDPNAPTLSPMPSGSPPAEGSQDATVSMEDSANNEKQREQQQEEGEAEQQGEEENGQVEQPVAASAEDAENPDEPAVTMRFEHVVTEEGHHIVAGREGRLRRCQDEPITTPGAVQGFGVLMVLEEDYETGNLEIRQVSEVNIFVIVMSKYQETILRDTLEYLPESYGGSNSVEDSGPSVFLLSGFGEPGSGVEEGETEGGPETEVRSTASSAGGKRKEWTCWVAAHRPEHRGWNKVNEIGEPIPPPDWIILEFELERDVYNPLVHPSENAETSTAAANSNARSLRPDSTAASVSASGSNSNSNTLSASTRSGERTLDSLTSTLAGGRAGVSAGLGPGTASSDASPGDLGSSASDFTSVPKQEARMGLDGLEMHIPLEKILESTTNHASPLRALERMRGTTVNASNEARSRGRGRGRGRGGRQRPIRTESGGTGTMDIFAVLGQINDQLVAAPDLDTFLKVAVGLMQDICRFHRVLIYQFDEQMNGLVVSELVEWGKTTDLYMGLRFPATDIPPQARELYKINKVRMLYDRSQTTARMVLRNKEDLDQPLDMTHCYLRAMSPIHLKYLGNMSVRSSMSISIMAFGQLWGLIACHSYGQHGMRVSFPVRQMLRLLSDSISRNIERLSYAQRLHTRKLISTIPDRSHPTGYIISDAGDLLQIFGADAGLLVIGDGCKLLGHSNEQGQAMLAIAEYLRIKRFDNLNASSSIQRDFPDLVLPRASDTIAGLLYVPLTAKAGQDFIVFLRKGQVREVQWAGKPYKDDKASEEASLEPRKSFKAWTETVTGCSRAWTDHQLESAGVLALIYGKFIQVWREKQTAMASNQLTAILLSNTSHAVRTPLSQIINTLELALAGNIDDDVRKMLENSHQASRALLFHVHDLLDLTRIETGNETAFNDPFDIRQSISDAVRLYQTEVARRGLEFRVNMAEDLPQYVVGDSRKIKTVISNLVANSVKFTEKGFIEVYCGIQRPFDGESSQTSLTESKEGNTITIEIVISDSGCGIPTVQLEEMFFTLEGAEPLQKNTGVGLGLAVVARIVEQLEGQLRAESEVGVGTRFYFNVPMVAHPSGRPGSRQSSHNSRNTNSSQLRTRTGSSGSKSDSVVSLRSDGSGVPEIESFVQDFGGSHLPAPVGDDDPRLLEAQERMSRLGTFPVTDSSYPVRATKVNTDDQHVKSPKPKKPRFTAIGSSERSTSRHNTTSSKTSSASQSPAFSRPSSNSVQGPKRNKKGPNGKTVMRIMVVEDDPINSQILQKRLKMDKHVVVAVTNGQEAVDQLEKDRDIDAILMDIQMPIMDGRTSAKEIRELEARTPQPDDIEPFKVDGRTPIFAVSASLYEDDRANLAENFDGWLLKPLDFSRVRAILEGLESSEKRVAEVYQQGNWERGGYLKAAPLPASSSASTPSTTQSSPCTSTS

SEQ ID NO: 36078 - protein, 254 aa, Arabidopsis thaliana
  misc_feature (102)..(102): Xaa can be any naturally occurring amino acid
  misc_feature (117)..(117): Xaa can be any naturally occurring amino acid
MEQTFIMIKPDGVQRGLIGEVICRFEKKGFTLKGLKLISVERSFAEKHYEDLSSKSFFSGLVDYIVSGPVVAMIWEGKNVVLTGRKIIGATNPAASEPGTIXVGTFAIDLERNGIHXMDSGKNAQKGNGFWGSRRDLAKWEKNGSPLGPIKTGENGAFLPKGGFPQVVWFLTKREKIFGGGGGTPPPLCGGGPKKKTPPPPRGGKKKISWGREKKKKKKIGGGGGAPPPPRGGGFILWRGGFYQGEGEKRGGRK

SEQ ID NO: 36079 - protein, 330 aa, Glycine max
MASTNALPPTGNGLIVSFGEMLIDFVPTVSGVSLAEAPGFLKAPGGAPANVAIAVARLGGKAAFVGKLGDDEFGHMLAGILKENDVRSDGINFEKGARTALAFVTLRADGEREFMFYRNPSADMLLTPEDLNLELIRSAKVFHYGSISLIVEPCRSAHLKAMEVAREAGCLLSYDPNLRLPLWPSAEEARQQILSIWDKADVIKVSDVELEFLTGSDKIDDASALSLWHPNLKLLLVTLGEHGSRYYTKNFRGSVEAFHVNTVDTTGAGDSFVGALLSKIVDDQSILEDEARLREVLKFTNACGAITTTKKGAIPALPTEADALKLIKEA

SEQ ID NO: 36080 - protein, 202 aa, Arabidopsis thaliana
MSSQISEIEQEQLIEKLEIFKIHGRDKRGRKILRIIGKFFPARFLSLDVLKKYLEEKIFPRLGRKPFAVLYVHTGVQRSENFPGISALRAIYDAIPVNVRDNLQEVYFLHPGLQSRLFLATCGRFLFSGGLYGKLTYISRVDYLWEHVRRNEIEMPEFVYDHDDDLEYRPMMDYGQESDHARVFAGAAVDSSVSSFSMRCIS

SEQ ID NO: 36081 - protein, 397 aa, Silicibacter sp. TM1040
MTASAPITQDVLTLPRKEPEGGKINLVGLTRDRMRAVLIENGTPEKQAKMRVGQIWQWIYQWGVRDFAEMTNLAKAYRAQLEETFEIRIPEVVSKQVSTDGTRKYLVRINGGHEVEVVYIPEDDRGTLCISSQVGCTLTCSFCHTGTQKLVRNLTPAEIIGQVMMARDDLEEWPTPGAPKDETRLLSNIVLMGMGEPLYNFDNVRDAMKIAMDPEGISLSRRRITLSTSGVVPEIARTAEEIGCLLAISFHATTNEVRDVLVPINRRWNIDELLQALADYPKVSNSERITFEYVMLDGVNDSDEDAHRLLDHIKRHNIPAKINLIPFNEWPGAPYKRSSNNRIRAFANIIYQAGYASPIRKTRGDDIMAACGQLKSATERARKSRKQIEAEAGVNNS

SEQ ID NO: 36082 - protein, 444 aa, Bacillus cereus E33L
MFKWLKPAPAIERLPADMIDRVYRLLRIRVLIGISVGYAAYYLVRSNFTLSSTYLVQEYGFSTAEIGLLGSVMAIVYGFSKFFMGNLSDKAFAQRFIAVGLFLSGLVNICFGFASSFGMIVTLLVVNGIVQGMGAPPCSIVMTKWFSKKERGTKTGIWNISHNVGGMLVPPLVGIGVGIFGENHWQGGVFIFPAIIAMIISVLVWINAKDTPESEGLPPIDEYRNDYENLEKADNANKMSPKEILMKYVVKNKFVWFLCIANAFVYLIRFGVINWVPLYLTTVKGFSKNEAHAAYAIFEGMAIPSSLIVGLLSDKLFKGKRMPLCIISMVGVVIGTFVYWQATSILVVSIAVSIIGCLIYVPQFLIGLSAMELVPKFAVGTTVGMCGLFGYVGGSLVANAAIGVIVDRSGWDGCFILLLTGAILSTIFLFIVQRGHESKASKVA

SEQ ID NO: 36083 - protein, 323 aa, Saccharum officinarum
MAPALSFPIIDMGLLGGEERPAAMELLRDACESWGFFEILNHGISTELMDEVEKLTKDHYKRVREQRFLEFASKTLKDAQDVKAAENLDWESTFFVRHLPESNIAEIPDLDDDYRRAMRQFAGELEALAERLLDLLCENLGLDRGYLARAFRGPRTGAPTFGTKVSSYPPCPRPDLVSGLRAHTDAGGIILLFQDDRVGGLQLLKDGAWVDVPPLRHSIVVNLGDQLEVITNGRYKSVMHRVVAQPDGNRMSIASFYNPGSDAVIFPAPALVKAEEAAAGAYPRFVFEDYMKLYVRHKFEAKEPRFEAFKSVETDSSNCIAIA

SEQ ID NO: 36084 - protein, 148 aa, Colwellia psychrerythraea 34H
MTAVKYPPNVGENDCVILFDGVCKLCDFWTQFIVKVDTQQRFKLCSVQSPEGQSILNYFKMPTDHFDTMLLVEGNQCFDKSDAFLNTMSKLSYPWRLFTAFKILPKGIRNWLYDRIARNRYYLFGRYDSCMLPSKENENRFLKGDVGE

SEQ ID NO: 36085 - protein, 117 aa, Kineococcus radiotolerans SRS30216
MNLLDNVDAASLRTDVPDFRAGDTLNVHVKVVEGNRSRVQVFKGIVIRRTGGGIREAFTVRKVSFGVGVERTFPLHTPIIDKIEVVTRGDVKRAKLYYLRDLRGKAAKIKERREPRG

SEQ ID NO: 36086 - protein, 294 aa, Arabidopsis thaliana
MGEVWRWNKEVEMDSIRDCLKHFSSIAIDTEFPGCLKETPMDASEEIRYRDMKFNVDNTHLIQLGFTLFDRRGITKTWEINLSDFNEHKCFKNDKSIAFLKSNGLNLDKIGEEGIGIEEFFRDFSQILKEKDGKITWVNFQGSYDNAYLVKGLTGGKPLPETKEEFHETVEQLLGKFVFDVKKIAESCSGLSSRFGLQRIADVLQMKRVGKAHHAGSDSELTARVFTKLTFDLLNSRKQCVRRVDHQQYQLEQQQLMMTRCYIPIPIPIPRPRSVMFAAHHPNPYFGGGYFGMP

SEQ ID NO: 36087 - protein, 471 aa, Acidovorax sp. JS42
MAKTVADVMKMVKENEVKFVDFRFTDTRGKEQHVTVPISHFDEDKFASGHAFDGSSVAGWKGIEASDMLLMPDPNTANIDPFFEETTMIMACDVVEPADGKAYDRDPRSIAKRAEAYLKASGMGDTAYFGPEPEFFIFDGVRWSTDPNHTFYEIEEYEAPWNTGAKLEGSNRGHRPTTKGGYFPVPPVDSTQDMRAEMSLILESLGIPVEVFHHEVAGAGQNEIGTRFSTLVERADWTMLQKYVIHNVANAYGKTATFMPKPYHGDNGSGMHVHQSVWKDGKNLFAGDGYAGLSDFALYYIGGIIKHARALNAITNPGTNSYKRLVPHFEAPVKLAYSAKNRSASIRIPFVANPKGRRVEARFPDPLMNPYLGFAALLMAGLDGVENKIHPGEAATKDLYHLPPEEDKLVPTVCHSLDQALEALDKDRAFLTKGGVFTDSMLDAYIELKMQEVTRFRMAVHPVEYDMYYSL

SEQ ID NO: 36088 - protein, 234 aa, Triticum aestivum
MAAANGGGAALFSEEELRDVSGLRLREGFVEMMCGCTSRRYGDAVGRLLIYPSGELEISCDCTPGCREEKLTPSAFEKHSGRETAGKWRNTVWVMIDGEKVPLGKTEFLKYYNLSNKSVNGSNRSRNGRPLHRDEFIRCTRCDKERRFRLRTKEECRIYHDALAKPNRTCANLTADSVTCDDDEERGSRKVLKGCSRAASCAGCEKCVCFGCEMCRFTDCGCQTCVDFYRNSKE

SEQ ID NO: 36089 - protein, 350 aa, Cryptococcus neoformans var. neoformans JEC21
MPSHFFFSTSVKSDEQVLPRPNRRKKGAAKEGEENTRANRDGVGFGQANANLYHKNHIYQRCEDRAHARWWVYKHTSPKLLELITLIGVRGLYTGLTASVFRQMTYSVTRLGVYDLMKNTMSNNGAKKLRTGDMVICASVAGALGGVAGNPADIILVRYIVLGSNQAVLLMNCFCRHRMVADPTKPAENQMHYRNAIHGIYKMVSNEGVASLARGLAPNTIRAILMNASQLVSYDFFKEHILAANLMENGMPLHFVSSALSGTVATTICAPADVVKSRIMNMKAGAGGHGPVGLLLESLKHEGPRFLFKGWLPAWIRLTPNTICMFVFLEQLRNAVDLFRNPTAKSQSAA

SEQ ID NO: 36090 - protein, 344 aa, Burkholderia vietnamiensis G4
MKIVKPLLIAAVVAATWSGASAATAASAQAVRPDTATSAFLAVLNGQKGPGLETLSPEKARQVLVDAQSGVKVDLSGIDVSNRTIEQDGLSVPITIVRPQQVSGTPPVFMFFHGGGWILGDFPTHERLVRDLVVQSGAVAVFVNYTPSPEAHYPVAINQAYAATKWVAAHGAEIGVDGSRLAVVGNSVGGNMAAVVALMAKDKGGPAIRFQGLLWPVTDHDFNTGSYGAYAQGHFLTRPLMKWFWNAYTKNEAQRDEIYASPLRASVAQLKGLPPALIQVAQFDVLRDEGEAYGRKLDAAGVDATTTRYDGTIHDFGLLNALANDAPTKAAMKAMGNEIAARLK

SEQ ID NO: 36091 - protein, 176 aa, Mycoplasma genitalium G37
MDAHFLKSASDLKDCPQDNIPEICFMGRSNVGKSSLINAFFKKKLAKTSATPGRTQLLNYFEYKDKRFVDLPGYGFAKINKNKKDFITNLLTQFLNFRSNLVGVVLIVDSGVVTVQDQEVVKIILQTGLNFLIVANKFDKLNQSERYFSLKNIANFLKVNFDKCVLQVQKHIIILL

SEQ ID NO: 36092 - protein, 907 aa, Flaveria trinervia
MMSSLSVEGMLLKSARESCLPARVNQRRNGDLRRLNHHRQSSFVRCLTPARVSRPELRSSGLTPPRAVLNPVSPPVTTAKKRVFTFGKGRSEGNRDMKSLLGGKGANLAEMSSIGLSVPPGLTISTEACEEYQQNGKSLPPGLWDEISEGLDYVQKEMSASLGDPSKPLLLSVRSGAAVMGIPHSLFDEKLEQMKAEKGIHLDTDLTAADLKDLVEKYKNVYVEAKGEKFPTDPKKQLELAVNAVFDSWDSPRANKYRSINQITGLKGTAVNIQSMVFGNMGNTSGTGVLFTRNPSTGEKKLYGEFLINAQGEDVVAGIRTPEDLGTMETCMPEAYKELVENCEILERHYKDMMDIEFTVQENRLWMLQCRTGKRTGKGAVRIAVDMVNEGLIDTRTAIKRVETQHLDQLLHPQFEDPSAYKSHVVATGLPASPGAAVGQVCFSAEDAETWHAQGKSAILVRTETSPEDVGGMHAAAGILTARGGMTSHAAVVARGWGKCCVSGCADIRVNDDMKIFTIGDRVIKEGDWLSLNGTTGEVILGKQLLAPPAMSNDLEIFMSWADQARRLKVMANADTPNDALTARNNGAQGIGLCRTEHMFFASDERIKAVRKMIMAVTPEQRKVALDLLLPYQRSDFEGIFRAMDGLPVTIRLLDPPLHEFLPEGDLEHIVNELAVDTGMSADEIYSKIENLSEVNPMLGFRGCRLGISYPELTEMQVRAIFQAAVSMTNQGVTVIPEIMVPLVGTPQELRHQISVIRGVAANVFAEMGVTLEYKVGTMIEIPRAALIAEEIGKEADFFSFGTNDLTQMTFGYSRDDVGKFLQIYLAQGILQHDPFEVIDQKGVGQLIKMATEKGRAANPSLKVGICGEHGGEPSSVAFFDGVGLDYVSCSPFRVPIARLAAAQVIV

SEQ ID NO: 36093 - protein, 110 aa, uncultured bacterium
MADIMEQIESAVKKNKVMIFMKGNRSFPQCGFSAATVAIFDQLGVPYETADVLSDPELRDGIKRYSNWPTIPQVYIDGKFVGGCDIIRELHETGELEPLVKAALAESATQ

SEQ ID NO: 36094 - protein, 875 aa, Flaveria trinervia
MMSSLSVEGMLLKSARESCLPARVNQRRNGDLRRLNHHRQSSFVRCLTPARVSRPELRSSGLTPPRAVLNPVSPPVTTAKKRVFTFGKGRSEGNRDMKSLISMPGMMDTVLNLGLNDEVVAGLAGKSGARFAYDSYRRFLDMFGNVVMGIPHSLFDEKLEQMKAEKGIHLDTDLTAADLKDLVEKYKNVYVEAKGEKFPTDPKKQLELAVNAVFDSWDSPRANKYRSINQITGLKGTAVNIQSMVFGNMGNTSGTGVLFTRNPSTGEKKLYGEFLINAQGEDVVAGIRTPEDLGTMETCMPEAYKELVENCEILERHYKDMMDIEFTVQENRLWMLQCRTGKRTGKGAVRIAVDMVNEGLIDTRTAIKRVETQHLDQLLHPQFEDPSAYKSHVVATGLPASPGAAVGQVCFSAEDAETWHAQGKSAILVRTETSPEDVGGMHAAAGILTARGGMTSHAAVVARGWGKCCVSGCADIRVNDDMKIFTIGDRVIKEGDWLSLNGTTGEVILGKQLLAPPAMSNDLEIFMSWADQARRLKVMANADTPNDALTARNNGAQGIGLCRTEHMFFASDERIKAVRKMIMAVTPEQRKVALDLLLPYQRSDFEGIFRAMDGLPVTIRLLDPPLHEFLPEGDLEHIVNELAVDTGMSADEIYSKIENLSEVNPMLGFRGCRLGISYPELTEMQVRAIFQAAVSMTNQGVTVIPEIMVPLVGTPQELRHQISVIRGVAANVFAEMGVTLEYKVGTMIEIPRAALIAEEIGKEADFFSFGTNDLTQMTFGYSRDDVGKFLQIYLAQGILQHDPFEVIDQKGVGQLIKMATEKGRAANPSLKVGICGEHGGEPSSVAFFDGVGLDYVSCSPFRVPIARLAAAQVIV

SEQ ID NO: 36095 - protein, 348 aa, Silicibacter sp. TM1040
MRPNTMKALEKSKPQEGLWMVQAPVPEIGPDEVLIKINKTGICGTDIHIWNWDDWAAHTVPVPMITGHEFAGEIVELGRNVTGLTVGQRCSGEGHLIGTESRQSRSGKFHLDPGTRGIGVNEQGAFAQYLRLPAFNVVPLPDDIPDDIGAILDPLGNAVHTALSFDLLGEDVLITGAGPIGIMAAAVARHAGARHVVITDVNADRLALASEVTRVRTVNVAVEDLNDVMHELGLREGFDVGLEMSGNQQALDQMVEALVMGGKIALLGIPPGKSPVDWSRIVFKAITIKGVYGREMFETWYKMIAMLQNGLDVSGVITHRFAVDEFEQGFAAMKSGQSGKVVLDWTGG

SEQ ID NO: 36096 - protein, 601 aa, Debaryomyces hansenii CBS767
MSHLPVKKEVVVKKEEADGSSSPAMSSSNGKSSSDQGWQDIPLKCCTKEDIKDIRYHIMKFQSKQNVDIIENFTKPVRLHRKDPRNIQFHLTRAEVDKRKREEEEAKIEKEKQKQESIEAAEKEAIANGEDPKNINRDEVDMSQVAPDGGARKLKKSLFKRKTRQINLMDDQKRKLRYEEYYPWVVEDYDGKNVFVGNYEAGSSDTQQVLFVFDKDGFKMVPAEKVYKFTQRNKYATLTLEEAEAKMEKNSSVPRWLMRHMEDNSGLEGATADQRFRHNVGSSRDGSTLASSNNRGRLRTVLGGSTSNERDSDHDDLDFDEEFADDEEAPIMDGDEEENKLSEQKIKKEMLKAAHFDGQSDAEVDDDDLDDLFETEKSRKVDKEGKKLRKVLNKTEGGVYDSDDDDKLNPYLSKSDLESDDESDDDAAIKKEDEDRLLDNIDSDKPAQRSFTAQNIGDGFVLVRAPPSFLSGFPNGDWNPNGRKRPAVANNDPSKKAKFDDGKTKLKVSIKKENGSPSPSLPGSPINATLDVDLTSGGPDNVLVTVKEVLDIVKDNPLTTKELLFGLKNRVNAHKDNKLRIISIVKQNLRLVDGKLVLKDE

SEQ ID NO: 36097 - protein, 558 aa, Oryza sativa (japonica cultivar-group)
MAAAAARGAAAARSPLVLHRHPHPAHHRRLRLLPLVAGGGGGSPPRVGRRIRASREKGRRVGIRVFARYSQAQDFSTRLQDRAGELPKLVEDLLQTSISTGPRGAFRFAQGIQAVLGVGGEWLNDFSKTANTSAGIPAQMQLGLLSPLYLRRLFERMGATYIKLGQFVASAPTLFPAEYVEEFQNCFDRAPPVPYSEIESILREELQQPLDSVYEYIDPVPIASASIAQVHGARLKSSQKDVVIKVLKPGIEDTLVADLNFIYVVARILEFLNPELQRTSLVGIVKDIKESMLEEVDFRKEAMNIEAFQRYIDAMGFDRQAKAPFVYRHCSTKRVLTMERLYGVPLTDLDSIRSLVPDPELTLVTALNVWFGSLISCESFHADVHAGNLWLLRDGRVGFLDFGIVGRISPRTWAAMEVFLASFATDDYNAMASALSEMGATGNDINVNEFAKDLEKIFSSIQDLDTEVIVATARTPDATAVSANVVVDERQMNALFLDLVRVSESYGLKFPREFALLMKQLLYFDRYTRLLAPSMNMLRDERVNISSRQQARRVDRFQ

SEQ ID NO: 36098 - protein, 226 aa, Arthroderma benhamiae
MARIGRILTLVVFAAVGLFLFMGQTVEAKGPKITSKVYFDIEHDGQPLGRIVMGLYGKTVPKTAENFRALATGEKGFGYEGSTFHRVIKDFMIQGGDFTNGDGTGGKSIYGNKFEDENFKLRHTKKGVLSMANAGKDTNGSQFFITTAITAWLDGKHVVFGEVLEGYDIVDKIQVVPKGFQDRPTKDVKIVKCGELDMKEEAEGEGTESPSKPDSEKEQAPVRDEI

SEQ ID NO: 36099 - protein, 469 aa, Nicotiana tabacum
MVFYRGVSLLSKLRSRAVQQTNLSNSVRWLQVQTSSGLDLRSELQELIPEQQDRLKKLKSEHGKVQLGNITVDMVLGGMRGMTGLLWETSLLDPDEGIRFRGLSIYECQKVLPAAKPGGEPLPEGLLWLLLTGKVPSKEQVDSLSQELRSRATVPDHVYKTIDALPVTAHPMTQFATGVMALQVQSEFQKAYEKGIHKSKLWEPTYEDSMSLIAQVPLVAAYVYRRMYKNGNTIPKDDSLDYGANFAHMLGFSSSDMHELMKLYVTIHSDHEGGNVSAHTGHLVASALSDPYLSFAAALNGLAGPLHGLANQEVLLWIKSVVEECGENISKEQLKDYAWKTLKSGKVVPGFGHGVLRKTDPRYTCQREFALKHLPEDPLFQLVAKLYEVFLQFLQNLAKLNPWPNVDAHSGVLLNYYGLTEARYYTVLFGVSRALGICSQLIWDRALGLPLERPKSVTMEWLENHCKKA

SEQ ID NO: 36100 - protein, 193 aa, Bifidobacterium longum NCC2705
MAQSDITIDALSKVGQQDAEYLVSLVRSVPGFPKEGIIFRDFMPVLADPKGLKILLKALEEALPVSPSEFDSIAGLESRGFLFGPVMAAHLGKGFIAVRKAGKLPPETIGESYDLEYGTASVEIETDAVQAGKRVLIVDDLIATGGTAKAATDLIEKAGGTVVGFSFVMRLDGLDGLDKLDGKPSSSLIAMPA

SEQ ID NO: 36101 - protein, 367 aa, Debaryomyces hansenii CBS767
MPSELEELVSFLHSPQPAVIQIALDNLVGYSQGAHQQVFSYDNYEAIKDLKKLAQAEGKTTVSQSVTILANLCDDLTMRNLIVEDEEFLKVLVSAVINTKNSNADLMCILLTNLAKNDSITKVFDFDISHNEEQQKIFKSTKAMDCLMDCFVKGFDRSLNKYADYDYLAYFFADISRFLQGREYFITEQSYDEVVPISKLLVFTEKYDSKIRREGVASTIKNSLFDSKPHMKLLTDEKINILPYILLPLAGPEELDEDDMFNLPDELQLLPSDKKRDPVNALICIHLESLLLLCTTREAREYLREKSVYPLIREMHKVMENEEEVVDLCDRLVQMLMRDESNDAANQDQEESSDDEDDEDDKVVEIL

SEQ ID NO: 36102 - protein, 1073 aa, Escherichia coli O157:H7 EDL933
MPKRTDIKSILILGAGPIVIGQACEFDYSGAQACKALREEGYRVILVNSNPATIMTDPEMADATYIEPIHWEVVRKIIEKERPDAVLPTMGGQTALNCALELERQGVLEEFGVTMIGATADAIDKAEDRRRFDVAMKKIGLETARSGIAHTMEEALAVAADVGFPCIIRPSFTMGGSGGGIAYNREEFEEICARGLDLSPTKELLIDESLIGWKEYEMEVVRDKNDNCIIVCSIENFDAMGIHTGDSITVAPAQTLTDKEYQIMRNASMAVLREIGVETGGSNVQFAVNPKNGRLIVIEMNPRVSRSSALASKATGFPIAKVAAKLAVGYTLDELMNDITGGRTPASFEPSIDYVVTKIPRFNFEKFAGANDRLTTQMKSVGEVMAIGRTQQESLQKALRGLEVGATGFDPKVSLDDPEALTKIRRELKDAGAERIWYIADAFRAGLSVDGVFNLTNIDRWFLVQIEELVRLEEKVAEVGITGLNAEFLRQLKRKGFADARLAKLAGVREAEIRKLRDQYDLHPVYKRVDTCAAEFATDTAYMYSTYEEECEANPSTDREKIMVLGGGPNRIGQGIEFDYCCVHASLALREDGYETIMVNCNPETVSTDYDTSDRLYFEPVTLEDVLEIVRIEKPKGVIVQYGGQTPLKLARALEAAGVPVIGTSPDAIDRAEDRERFQHAVDRLKLKQPANATVTAIEMAVEKAKEIGYPLVVRPSYVLGGRAMEIVYDEADLRRYFQTAVSVSNDAPVLLDHFLDDAVEVDVDAICDGEMVLIGGIMEHIEQAGVHSGDSACSLPAYTLSQEIQDVMRQQVQKLAFELQVRGLMNVQFAVKNNEVYLIEVNPRAARTVPFVSKATGVPLAKVAARVMAGKSLAEQGVTKEVIPPYYSVKEVVLPFNKFPGVDPLLGPEMRSTGEVMGVGRTFAEAFAKAQLGSNSTMKKHGRALLSVREGDKERVVDLAAKLLKQGFELDATHGTAIVLGEAGINPRLVNKVHEGRPHIQDRIKNGEYTYIINTTSGRRAIEDSRVIRRSALQYKVHYDTTLNGGFATAMALNADATEKVISVQEMHAQIK

SEQ ID NO: 36103 - protein, 560 aa, Xanthomonas campestris pv. campestris str. ATCC 33913
MSQARPWLQSYPAGVAAEIDLEQFRTVAEVFATSVARFADRPAYHSFGKTITYREADQLVDQFAAYLLGELQLKKGDRVALMMPNCLQYPIATFGILRAGLTVVNVNPLYTPRELKHQLIDSGSSVLVVIDNFGTTVQQVIADTQVKQVITTGLGDMLGFPKAALVNFVVKYVKKLVPEYRINGAIRFRDALALGRKHRVPTLQIEPDDIAFLQYTGGTTGVAKGAMLTHRNLVANMQQAHQWLAGTGKLEEGHEVVITALPLYHIFALTANGLVFMKIGGCNHLISNPRDMPGFVKELKKTRFTAFTGVNTLFNGLLNTPGFDQIDFSSLKMTLGGGMAVQRSVAERWKQVTGLTLVEAYGLTETSPAACINPMDLVDYNGSIGLPIPSTDACIKDDDGKVLALGEIGELCIKGPQVMKGYWKKADETAKVMDAEGWLHTGDIARMDERGFVYIVDRKKDMILVSGFNVYPNEIEDVIATMPGVLEVAAVGVPDEKSGEIVKVVIVKKDQALTAEDVKAHCRTNLTGYKQPRVIEFRKELPKTNVGKILRRELRDAAKA

SEQ ID NO: 36104 - protein, 205 aa, Triticum aestivum
MSDADDYRCFVGSLSWNTTDVDLKDAFGKFGRVTETKVVLDKFSGRSRGFGFVTFDDKKAMEEAVEAMNGIDLDGRNITVERAQPQGSGRDRDGDRDYRGGGDRYGGGRDFGGGRGGGRGGGGDCYKCGKPGHFARECPSGDGGDRYGSRDDKYGGSNGSSRYGPDRGGDRYSGSRDGGSRSSGGGDRYSRDTPGPYDRRSRDEY

SEQ ID NO: 36105 - protein, 308 aa, Lactobacillus johnsonii NCC 533
MNKVTIVGSINVDNIMHIKKLPQPGETIAMSEFSKAAGGKGANQAVASSRAKNETIFVGRVGDDDNGRFMLEQFKENGINVDHVAVTPNQQTGQAYILLQETGQNSIIIQHGANFDVTAEDVRNAKSQIEDSDFVIAQFETPIEATIEAFKIAREAGKITILNPAPARTDIPEELLELTDLITPNETEAESITGIKVDSEESMKKSSEIFHQMGIKGVIITIGERGSYVSYEDIEEIVPAFKVKAVDTTAAGDTFLGALSSELKPDLSNLRDGVIYASKSSSFTVQKLGAFPSIPTREVVEEALKEKN

SEQ ID NO: 36106 - protein, 232 aa, Lactobacillus johnsonii NCC 533
MNKTEQDQLKKEAATKAAKMVEPNSVLGVGTGSTVAFFIDALGERKEREGFSLKHIVTTSNRSKKQLEGLGFKVDELADIDQADLTVDGADRVDDNLDGIKGGGGALTLEKNVAINSKKIIWIVDESKLVHHLSGFPLPVEVLPVSAEQNFKRFEAEGLKPQWRLNDEGKRYVTHYGNYIIDLAADPTPVPHGLADYLDHTVGVVEHGLFLDMCDEVIIAHSDGTIEDKKRK

SEQ ID NO: 36107 - protein, 323 aa, Triticum aestivum
MFYAGYGYHASNFEQTYRCYPASFFDKPHLEGGDKVIMPPSALDRLASLHIEYPMLFELHNGVTDRISHCGVLEFVAEEGMIIMPYWMMQNMLLQEGDIVRVKNATLPKGTYVKLQPHTTDFLDISNPKAILEKTLRNFSCLTTGDSIMVAYNNKQYYIDIVEAKPASAVSIIETDCEVDFAPPLDYKEPEKPQRPIVPAGKAPAEDQEVIVEDEPKFKPFTGSGKRLDGKGPKQPAPGASSATAAARSAPSDSNKRANQQTASPSGASTSTRQKTGKLVFGSSASSKKEAEAQKEPAKGSEPPKKEEPKFNAFTGKSYSLKR

SEQ ID NO: 36108 - protein, 388 aa, Acidovorax sp. JS42
MAPEAAPLVELIYFNAGGGHRTSALALEAAIARAGLPWQVCRTNLFEVLDPNARFRQWTGMEPEDVYNKRLARGWTLGLTHELRLLQGMIRWSHQRLMQSLRRHWAARRPAMVVSLVPNFNRAMADALEQALPGVPYVTVMTDLADCPPSFWMEPQTQQIVVCGSPYAVDQARAADFPPHRIWETSGMVLSAQFHAPVDQDRAAERARLGLDERPVGLVLFGSEGSREMVTIARRLTDTPLILACGRNAALAQALRALRRNAPTVVLEYTREMARVMQLADFFIGKPGSGSLSEAVHMGLPPIVTRNAWTMPQERYCTEWVGEQGLGLVLPSFRSIASGVQALLADLPRYQAATRRMHNRAAAEVAQALAQILRHAQARAEWAGRWVA

SEQ ID NO: 36109 - protein, 513 aa, Rhodopseudomonas palustris CGA009
MADAATPPSGFQANLDRAAPLLKQLKADGIGHLIGGEIVAASSGEVFETASPIDNSVLAQVARGTAADIDRAAKAAKAAFPAWRDMAPAKRRKLLHTIADAIEARADDIAVLECIDTGQAHRFMAKAAIRAAENFRFFADKCAEARDGLNTPSDEHWNVSTRVPIGPVGVITPWNTPFMLSTWKIAPALAAGCTVVHKPAEWSPVTADMLARICKDAGLPDGVLNTVHGFGEEAGKALTEHPAIKAIAFVGETATGAAIMAQGAPTLKRVHFELGGKNPVIVFGDADLDRALDAVVFMIYSLNGERCTSSSRLLVQSSIADSFIEKLAARVRALKVGHPLDPATEVGPLIHQRHLDKVCSYVDVARKDGATIAVGGAPFDGPGGGHYVQPTLVTNARSDMQVAQDEVFGPFLTVIPFKDEAEAIQIANDVRYGLTGYVWTADMGRALRVADALEAGMIWLNSENVRHLPTPFGGMKQSGIGRDGGDYSFDFYMETKHVSLARGTHKIQKLGAV

SEQ ID NO: 36110 - protein, 244 aa, Chromobacterium violaceum ATCC 12472
MSATERQLQYLRQLVDGARRIAVLTGAGMSTESGIPDFRSADGLWSRDMSLTDAVSVDYFRRDPAAFWRAFRDIFHIKLVGDYQPNDGHRFLAALEASGKEVTILTQNIDGLHGRAGSRRVLELHGTLLTASCPDCRSPHPLDYVQRHELPACRRCGAALKPDVVLYGEAVPLIDVAFQAALNAELLLVMGSSLEVSPVNLIPVEAARAGIPCALINYTPTRFDALFDLCIQAGIGDTCRQLRA

SEQ ID NO: 36111 - protein, 125 aa, Synechococcus sp. PCC 7002
MAGSEVKADYWINEYITPWDIYSHGITKILAYKQTQFQEMAIVESGAYGKALVLDGKWQSCTGDEFLYHEPLVHPAMIAHGAPKKVLILGAGEGATVREVLRWQSVEKVMMVDIDGEVVEACKEF

SEQ ID NO: 36112 - protein, 311 aa, uncultured bacterium
MQLDPQMKAILDQAAAAGAQPFHTMTPAQARAAIDTMFQAFRGQPKEVAQSEDRKVPGPAGDIPIRIYTPAGSGPFGALVYFHGGGWVIGNIETHDVTCRDLAHGTPCVTVSVDYRLAPEHKFPAGPEDCYAATKWVSDNARSLNVDPNRIAVGGDSAGGNLAAAIALMARDRGGPKLAYQLLIYPAIDSADETPSHREFTKDGYILSRADMEWFWGHYLADKDRANPYACPSRAKSLAGLPPAFVLTAEFDPLRDEGEAYGQELRKAGVAVTAKRYDGVCHGFVSMASLLDAGKRAVAECCKELRGAIGR

SEQ ID NO: 36113 - protein, 484 aa, Oryza sativa
MPGSSGRAPLFACRGAAAVSASSMLGGGGAAYQAAVVAHVAPVPAIRPCASWVVEAMRASSPTRPAAAAVDAEYDAWTQRKHPSALGSFEQVAAAASGKRVVVFLDYDGTLSPIVADPDMAFMSDEMRAAVRDVAEHFPAAIVTGRCVDKVQSFVGLPELYYAGSHGMDIKGPSSNEEEDTKILLQPAREFLPVINKAYKALMEKTKSTPGARVENNKFCLSVHFRCVDEKRWNPLAEQVKAVLRDYPELKLTQGRKVLEIRPSIMWDKGKAVEFLLKSLGFDDDRRDVLPVYIGDDRTDEDAFKVLRKRGQGLGILVSKCAKETDASYSLQDPAEKYTNAGAHVFVTMLLTVVFTAAVALALVNAVNSHDFAAHLAGVDCRMGLAGPVRCPASGFVELLVLALHVVRCVLAILDRLHACPMSPSLQLSIASPCHGVPCSIGAVEASAIIVSDAPEGLISTLTTDHIYYMTVFPAKLALTSEEV

SEQ ID NO: 36114 - protein, 397 aa, Rhizobium leguminosarum bv. viciae
  misc_feature (263)..(263): Xaa can be any naturally occurring amino acid
MTMNQSINPHDLGAHAAADDLFTPVDPAAFNAVSPPIFQTSLFTYDSYEAMEDVFAGRTRNYIYSRGDNPTVREFELLVARLEGAEDGRAFSSGTAAITSTILSLVEAGDRVVAVRHLYNDVYRLLVKLLGRLGVAVDFVDPADHDEVRKALSGAKLLYLENPTSFVFELQDIAALSAMAKEAGVTTIIDNSWATPLFQKPIQHGVDIVIHAASKYLGGHSDTVAGVVVGSKEAIARINSISYPYVGAKLSPFEAWLLLRGMXTLRVRLKEHERSGLLLAGRLKEHSAIARVRHPAFQEHPGRATLTGYAGLFAFDLYPDIDVARFVNSLRDIRLGVSWGGTETLVVPAKVALQIPDRMTSFIRFGVSEQTVRFAVGLEEPELLWSDLQQALYAAKR

SEQ ID NO: 36115 - protein, 479 aa, Escherichia coli W3110
MAQHTVYFPDAFLTQMREAMPSTLSFDDFLAACQRPLRRSIRVNTLKISVADFLQLTAPYGWTLTPIPWCEEGFWIERDNEDALPLGSTAEHLSGLFYIQEASSMLPVAALFADGNAPQRVMDVAAAPGSKTTQISARMNNEGAILANEFSASRVKVLHANISRCGISNVALTHFDGRVFGAAVPEMFDAILLDAPCSGEGVVRKDPDALKNWSPESNQEIAATQRELIDSAFHALRPGGTLVYSTCTLNQEENEAVCLWLKETYPDAVEFLPLGDLFPGANKALTEEGFLHVFPQIYDCEGFFVARLRKTQAIPALPAPKYKVGNFPFSPVKDREAGQIRQAATGVGLNWDENLRLWQRDKELWLFPVGIEALIGKVRFSRLGIKLAETHNKGYRWQHEAVIALASPDNMNAFELTPQEAEEWYRGRDVYPQAAPVADDVLVTFQHQPIGLAKRIGSRLKNSYPRELVRDGKLFTGNA

SEQ ID NO: 36116 - protein, 396 aa, Zea mays
MAKVQQDKAASGGNGGGDGAAAPAGEQLVIRAPVHCDGCGRKLRRSLQRLEGVGEVTVDSRADTVVVRGRGAVENAAEVVQVVERKTGEKAVLVSPSPPEKLLLPARSSAPKAKGGETNTNKDIGNELPELDMKMVTVLKINLHCDACSEEIKRRILKITGVEEAMPHLKSSQVAVKGKVEPATLVGFIHKCTGRRAAIIRAEPLDDVLLPQPPNPPAAPPASKAESKKDEPPAENPPARVEEPNEENRGGGEKDNADDDNPKTEKPASDGHGAGAAEEHGAHATTEGPDRDNDDDAGDGLVLENHTKAAVDRLFAVPTPAGVVTVVAPEMALGSRSYCYPAYPCAQYYYPYQPHLYPPQPYPAASAYSPVAMYGYPASYPPEAFSEENPNACTIV

SEQ ID NO: 36117 - protein, 121 aa, Thermosynechococcus elongatus BP-1
MQFCNWSTQEEKRTMTPELHAKIDNLVKSNKIIVFMKGSKLMPQCGFSNNAVQILNALGVPYETVDVLEDFEIRQGIKEYSNWPTIPQVFINGEFIGGSDILIELYQSGELQQLVEVALAS

SEQ ID NO: 36118 - protein, 193 aa, Buchloe dactyloides
GIGKTTLLDVLAGRKTGVYIEGTISLCGYQKKQETFSRVSGYCEQTGIHSPYLTVYESLQFSACLRLPSVLKPHEKDVRYLMFFTFYTKSNTQPVEQGSLSSMFHAFQMYVEEVMRLLELTSLRNAIVGIPGETGLSAEQRKRLTIAVELVASPSIMFMDEPTTGLDAHAAAIVMRTVRNMVNSGRTVVFPMP

SEQ ID NO: 36119 - protein, 673 aa, Oryza sativa (japonica cultivar-group)
MATGMLLRGLRSAASRTSPVFPTSASSPAPYVSPLLRRLYSAAAASAAASPALGPGGALDPSRIRNVAVIAHVDHGKTTLMDRLLRQCGADIPHERAMDSISLERERGITIASKVTSVSWKENELNMVDTPGHADFGGEVERVVGMVEGAVLVVDAGEGPLAQTKFVLSKALKYGLRPILLLNKVDRPSVSEETCNEVESLVFDLFANLGATEEQLDFPVLYASAKEGWASLEFTKSPPDNAKNMSALLDSILQHVPSPKADLEAPFQMLVSMMERDFYLGRILTGRVRSGVVRVGDKVHGLRSTDDGVQKIEDGKVVKLMKKKGTSMVIVEAAGAGDIISMAGLAAPAIGHTVSNSDILTALPTIELDPPTISMTFGVNDSPLSGRDGTHLTGAKIGNRLMAEAETNLAINVLPGPLSESYEVQGRGELQLGILIENMRREGFELSVSPPKVMYRTDRGERLEPIEEVTVEVDEEHVGFVMETLTHRKGEVMDMGPVPGTTGRTRIFLTCPSRGLVGFKGIFSSFTRGTGFMHRAFQAYAKYRGQLGNVRKGVLVSVGKGLITSHALMSLEARGILFVSPGMEAYEGMIVGEHSRDSDLDINPVRTKELTNIRAPGKDENVRLSPPRLMSLEEAIGYVAADELIEVTPKVIRLRKKYLDATKRKMMKNKPMD

SEQ ID NO: 36120 - protein, 1035 aa, Thermosynechococcus elongatus BP-1
MRIFMFRFPLLSFIQLFLPTTAVIAALLTPLYVGQRQALFKDFRVGQEGKLEEIQLTIANDIDDAVTDPKGLGSFHLWHELIDSPSQGELAEEVQELVDQWHRLKEHYDQLYVLDTRGRIRFQWTSTPQSDPPSTVKAINSYWPILRELTPDQVFVSPVEVTATKSSGLPFPVLYIGVPLYHQSAPKGVLVVRYQLNHLFNNLLSRCNIQMGWCLVADDQGYWLLGEDIREQWGFDFPERRQFTVRHQYPLLWQQMQHQLRGGLFGPDGLFVFQSFSLLQENWISAERSAHSSRRQSNVRWWLIGFLPSSALEQYLDHLNRDFLVSFTALCILAAVAVLLITRDRQRKRSLQKLLETSNARFRSVSEMAPVGIFTLDAQGQPTFLNQRLLQLLQVHNLEEAQQQWIERLHPEDRDRVLKAWAACQQKRVPFHERFRIVHNDSSSHWINARIIPLQESSATDSFVGTWEDISQMMQQQELLEVARQAAEEASRAKSEFLATMSHEIRTPMNAIIGLTGLLLDTPLNPQQQEFVNTIRLSGDALLGVINDILDFSKIESGKLELESYPFNLRTCVEEVLDLLASRAAEREVELAAHIDSGVPCAVIGDMGRLRQVLVNLIGNAIKFTQKGNVTLYVKAKPMPMSQYEFMPSYYSYLFAIQDTGIGISAAGMNRLFKPFSQVDASTTRQYGGTGLGLVICQRLVERMGGQIWVESKKTGESLVVGGTPLAVYESIPIAESGSVFYFTARFLLNPNPAPEPTDDTCYLENRRVLIVDDNATNRQILALQIKKWKMQPLVAESGPSALALLQQQGWVDLAILDLQMPEMDGVTLARQIRAAYGELPLILLTSLGNTLTESEKALFSSLISKPVKQSTLYNALNSLFCEKQKTVSPKPAAAPSFEHLKAELPPLRILVAEDNKVNQMVALRILEKLGYRGDIAANGLEVLDAVQRQPYDVILMDMQMPEMDGITATREVTQLFQGLKKPRPRIIAMTANAMESDRQLCLDAGMDDYVSKPIRLEELVRALRQCQPLQTPTT

SEQ ID NO: 36121 - protein, 470 aa, Mycobacterium smegmatis str. MC2 155
MRHYYSADAIREAEAPLLAALPDGALMRRAAYGLATVILRELSARTGGVAGRRVCAVVGSGDNGGDALWAATFLRRRGAAADAVLLNPERTHATALAAFRRAGGQIVQTVNPATDLVIDGVVGISGRGPLRPNAAEVFAGTDAPVVAVDIPSGIDVHTGAAEGPHVRAALTVTFGGLKPVHALGECGRVELIDIGLDLAPADLASFEAADVRALWPAPGPHDDKYTQGVTGVLSGSATYPGAAVLSTGAAVAATSGMVRYAGSAAQQVLAYWPEVIASATPQDAGRVQAWVVGPGLGTDDTAKAALLFALETDLPVIVDADALTMLAADPAPVTGRSAPTVLTPHAGEFARLAGAPPGTDRVAAARELAERLGVTLLLKGNVTVIATPGATTYLNPAGQSWAATAGSGDVLSGIIGALLASGLPPGEAAAAAAFVHARAANLSAADAGPRPVPTSASRILVHVRAAIAAL

SEQ ID NO: 36122 - protein, 121 aa, Glycine max
  misc_feature (53)..(53): Xaa can be any naturally occurring amino acid
  misc_feature (70)..(70): Xaa can be any naturally occurring amino acid
  misc_feature (92)..(92): Xaa can be any naturally occurring amino acid
  misc_feature (109)..(109): Xaa can be any naturally occurring amino acid
MPNDSVLSLFLFATLFTCLHSDTSHDDHILQPSQVHDNYSLSCSETDPSLNYXPVIGILTQPGDGASGRXLNNSTGNSYICASYVNFEETGXIKQFPLSTGEAPPHPNXKIDLINGKAFYL

SEQ ID NO: 36123 - protein, 194 aa, Brassica rapa
KIPLYASNFARSSSGSSKSWITGLLALPAAAYMVQEQEVLAAEMERTFIAIKPDGVQRGLISEIVARFERKGFKLVGIKVVVPSKDFAQKHYHDLKERPFFNGLCDFLSSGPVIAMVWEGEGVIRYGRKLIGATDPQKSEPGTIRGDLAVVVGRNIIHGSDGPETAKDEINLWFKPQELVSYTNNAEKWIYGDN

SEQ ID NO: 36124 - protein, 417 aa, Glycine max
  misc_feature (151)..(151): Xaa can be any naturally occurring amino acid
MLESGAKFPGIIDLNKNNNNYYDFSQGFYHKLGEGTNMSIDSVGSLQTSNGGGSVAMSIDNSSVGSNDSHTRMLDHQGLRRRANDNYSVAHSANRRGRVTHALSDDALAQALMDNSSPTEGLDNFDEWTIDLRKLNMGEPFAQGAFGKLYXRGTYNGEDVAIKILERPENDPAKAQLMEQQFQQEVTMLATLKHSNIVRFIGACRKPMVWCIVTEYAKGGSVRQFLMKRQNRSVPLKLAVKQALDVARGMAYVHGLGFIHRDLKSDNLLIFGDKSIKIADFGVARIEVQTEGMTPETGTYRWMAPEMIQHRPYTQKVDVYSFGIVLWELITGMLPFQNMTAVQAAFAVVNRNVRPIIPNDCLAVLRDIMTRCWDPNPDVRPPFAEIVGMLENAENEIMTTVRKARFRCCMTHPMTAD

SEQ ID NO: 36125 - protein, 495 aa, Oryza sativa
GEILAICGLVASLIYLLSFFGIAFVQSVVSNSDDEEEEEDFLIDSRAAGPVAAQATPPPAPAPCSLLGSACAAPKKMPEEDEEIVAEVVAGKIPSYVLETRLGDCRRAAGIRREAVRRTTGREIRGLPLDGFDYASILGQCCELPVGYVQLPVGVAGPLVLDGERFYVPMATTEGCLVASTNRGCKAIAESGGATSVVLQDGMTRAPVARFPSARRAAELKGFLENPANVDTLAMVFNRSSRFARLQRVKCAVAGRNLYMRFSCSTGDAMGMNMVSKGVQNVLDYLQDDFPDMDVISISGNFCSDKKSAAVNWIEGRGKSVVCEAVIKEEVVKKVLKTNVQSLVELNVIKNLAGSAVAGALGGFNAHASNIVTAIFIATGQDPAQNVESSQCITMLEAVNDGKDLHISVTMPSIEVGTVGGGTQLASQSACLDLLGVKGANRESPGSNARLLAAVVAGAVLAGELSLISAQAAGHLVQSHMKYNRSSKDMSKVAS

SEQ ID NO: 36126 - protein, 585 aa, Zea mays
MCGILAVLGCADDTQGKRVRVLELSRRLKHRGPDWSGMHQVGDCYLSHQRLAIIDPASGDQPLYNEDKSIVVTVNGEIYNHEQLRAQLSSHTFRTGSDCEVIAHLYEEHGENFIDMLDGVFSFVLLDTRDNSFIAARDAIGVTPLYIGWGIDGSVWISSEMKGLNDDCEHFEIFPPGHLYSSKQGGFKRWYNPPWFSEVIPSVPYDPLALRKAFEKAVIKRLMTDVPFGVLLSGGLDSSLVAAVTVRHLAGTKAAKRWGTKLHSFCVGLEGSPDLKAAKEVANYLGTMHHEFTFTVQDGIDAIEDVIYHTETYDVTTIRASTPMFLMSSKIKSLGVKMVISGEGSDEIFGGYLYFHKAPNKEELHRETCQKIKALHQYDCLRANKATSAWGLEARVPFLDKEFINEAMSIDPEWKMIRPDLGRIEKWVLRKAFDDEEQPFLPKHILYRQKEQFSDGVGYSWIDGLKAHAESNVTDKMMSNAKFIYPHNTPTTKEAYCYRMIFERFFPQNSAILTVPGGPSVACSTAKAVEWDAQWSGNLDPSGRAALGVHLSAYEQEHLPATILTGTSKKPRMIEVAAPGVAIES

SEQ ID NO: 36127 - protein, 509 aa, Oryza sativa
MVARRRRPRRRSRPPGSKPRGPLPLSLFGADEDEEEEEGPAELPPTAADQRGASHASSNGSKPADLKDLIAGLYGSHPQPSSTDAAEVGTQEGSAVAAAEEEEEDGDGFEDDGWEFKAAAPSSSSDAVQDGGRQAHGDLTQDVPKSMSSDQEGWSSFTSVSENLNNVQTTDHVGTHENHSIKSASDRILIDFYHKLREESLTVISQYKKDLKESQKNSMLSDEKNEVMTETEREIQEICKELQDSSLAKGFCKDEHPSKDVCISELLNSAKEDHLKDFDKEYHLTEIIAMALEDMSSAVKLYKHSVSILRTLEIASKEEQCDYVSAWYSMLLSCAQELQHGAMIWQESCHANVGETVISQGAHYFIALGEIYRVAQILHISMLSFKPWVLADPGMLSKMLVCWNSCVNSWTSGLGMALTMVVDSKNLHAPVAKVLLESIININDIEVPNLQSFLPSDKMACKLTLLPTSLVPGMEVIIWDADHYFVKVANLWANQISSDPPQFSVSRVA

SEQ ID NO: 36128 - protein, 482 aa, Nocardioides sp. JS614
MPWAAGREVNARDRTGTNLVNGNRTFAVEDPATLELIAEVADHGETEARAAVDRAHEAFAGWSGTSPRQRSDVLRRAYELMLRDEGRLSALIARENGKSLADAASEVVYAAEFFRWYAEEVVRTEGSYGEAPAGGVRTIVHHKPVGVAALVIPWNFPAAMATRKIAPALAAGCTVVLKPAAETPLTAIAIADLLAEAGLPAGVVELVTTTHAGAVVTAWLEDDRVRKVSFTGSTGIGRLLLHQAADRVVNTSMELGGNAAFIVTEDADLVDAVAGAMIAKFRNGGQACTAANRIYVHRDVADAFVALVGAQVEKLSVGAANDGNMIGPLISAAAVSRVGAAVDRAIEEGARVAARAQLPDAPGYFYPPTVLTDVPSTSSILAEEIFGPVAPIATWDDEQELLRQVNGTEYGLAAYVYTGHLERGLRLGERIEAGMVGINRGIVSDPSAPFGGVKQSGLGREGAREGLREFQETQYLSISWDD

SEQ ID NO: 36129 - protein, 408 aa, Leptospira interrogans serovar Lai str. 56601
MANINENYLKLKAGYLFPEISKRVKIYSEKNPSAKIIRLGIGDVTLPIVPSVVDAMVEASKEMGTVGGFHGYGPEQGYSFLLKSIADHDYGSLGIKIDESEIFVSDGSKCDCGNIQEIFSTDSKIAVADPVYPVYVDTNVMAGRTGEIGPDGRYSNLIYMPATKENGFQPEIPKEKADIVYLCYPNNPTGTVTTKESLKAWVEYAKKNNSIILYDSAYEAFISEPGVPRSIYEVEGAKEVAIEFRSFSKTAGFTGLRCAYIVIPKELKGKTRSGEEVSLNSLWNRRHTTKFNGVSYVTQKGAEACYSPQGKKEIQTSIAYYMANASKIRDGLKKAGYEVFGGVNAPYIWLKTSDNLSSWDFFDKLLNKAQVVGTPGSGFGPAGEGYFRLSAFGKKEDVEEAIARITSL

SEQ ID NO: 36130 - protein, 190 aa, Triticum monococcum
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDS

SEQ ID NO: 36131 - protein, 907 aa, Triticum monococcum
MYTKGPPLDVLRASISSAPSTSSHGSAQDDCDSLGDVYVWGEVVCDNSARTSSDTVIRSTGKTDFLLPKPLESNLVLDVYHVDCGVRHASLVTRNGEVFTWGEDSGGRLGHGTREDSVHPRLVESLAACNIDFVACGEFHTCAVTTTGELYTWGDGTHNVGLLGHGTDVGHWIPRRISGPLEGLQIAYVSCGTWHTALITSMGQLFTFGDGSFGVLGHGDLKSISCPREVESLSGLKTIAVACGVWHTAAIVEVIVTQSSATVSAGKLFTWGDGDKHRLGHGDKEARLKPTCVASLIDYDFYRVACGHSLTVGLTTSGKVWTMGNSVYGQLGNLNSDGRPCLVEDKIASEHVLQIACGSYHVAVLTSRSEVFTWGKGANGRLGHGDIEDRKVPTTVEALRDRAVRHIACGANFTAAICLHKWVSGADQSQCSSCRQPFGFTRKRHNCYNCGLVHCNACTSRKALRAALAPSPGKLHRVCDSCYSKLKNASSSANKKDLAPGESNGEARVGKSILSSNMDMIRSLDSKAAKQGKKTDALSFLRNPQVSSLLQLRDIAFSGGADPNRPAVPRAARTPAARSVTSSRAVSPFSRRSSPPRSTTPVPTTHGLSLSKSATDNLVKANELLSQEVERLRAQVDSLRNRCDHHELELHKSAKKVQEAMTLVAEESAKSKAAKEVIKSLTAQLKDMAERLPPEHGAYDFNEAKQVHVPNGVEPHVATYSSMNGKVHQARNELLNAPSPNSGRSPHSNGGISNQHKLLGNISENSEGSTHSLRITSPHGSDRPHRRAHSNSDEMLSASSRGDDNVSIDARSLQNGDDSYKPRGTISISSNQVQAEWIEQYEPGVYITLTTLRDGTRDLKRVRFSRRRFGEHQAENWWNENREKVYEKYNVRSSERVSSAASTRSAY

SEQ ID NO: 36132 - protein, 407 aa, Triticum monococcum
MAAVAMADGGGKKPYVVAVAIQAINTGTFVVSKAAFDSGMYTYIFVFYRLAAATALLVPIALINCACRRSQSTTSTPAQAMSCRLLFKLFLCAFLGSAGLTLQALTKFVKKSCQEVGGFTSLLSSSLLQGKAEHLHPQVYHASLKQTSATVASAATNSMPVVTFLLALVLRMETIKLRRRSGLGKLAGVALCLAGVLVIAFYVGPSIRPLAHHPVFAHKTQSVGNGAWIRGTFLLILSCTTWSLWITLQVPLLIEYPNKLMATAMQCLFSALQSFVVAVVVEKDFTKWKLGLDIGLLAAFLGTGALMYLQAWCAEMSGPVFVVMWSPLAFIFTIFSSSFFLGEVVHLGSILGGILLVGGLYSVLWGKSNERKNMILPVMPEKSQGQGDGDGATTQEKHGETNLTSQV

SEQ ID NO: 36133 - protein, 405 aa, Rhodopseudomonas palustris CGA009
MNDTVLIAGAGHAGFQVAVSLRQAKYPGRIALINDEKHLPYQRPPLSKAYLKSGGDPNSLMFRPEKFFQDQAIELISDRMVSIDREGRKLLLASGTAIEYGHLVLATGARNRMLDVPNASLPDVLYLRTLDESEVLRQRMPDKKHVVVIGAGFIGLEFAATARAKGLEVDVVELAPRVMARVVTPEISSYFHDRHSGAGIRMHYGVRATEIAAEGDRVTGVVLSDGNTLPCDLVVVGVGVIPNVEIAAAAGLPTAAGIIVDQQLLTSDPHISAIGDCALFESVRFGETMRVESVQNATDQARCVAARLTGDAKPYDGYPWFWSDQGDDKLQIVGLTAGFDQVVIRGSVAERSFSAFCYKAGKLIGIESVNRAADHVFGRKILPLDKSVTPEQAADLSFDLKKAAA

SEQ ID NO: 36134 - protein, 399 aa, Bacillus thuringiensis serovar konkukian str. 97-27
MAVEVVMPKLGMAMKEGVITSWNIKAGDYVSKGELIASINSEKIETEIEAPADGTVLDIAVSEDEGVPPGTVICYIGKSNEKVEVYESTNVVEEKTSNPEPKKVPHPDPYVIDVTKQRVKISPVAKKIAKTENLDIKSLLGTGPGGRITKVDVLKALEERVAISEVLEQEESKVVPVTGMRKAIANRMHASLQNSAQLTLTMKVDVTDLVALHKDVAEVVQKRYDNKLTITDFVSRAVVLALKEHKEMNSAYIDDAIHQYKHVHLGMAVALEKGLVVPAIRFANNLSLVELSKEIKNMAQKARAGNLSSDDMQGTTFTISNLGSFGIEYFTPVLNTPETGILGVGAIEHVPVYKGKKLRKGSMLPLSLTFDHRVLDGAPAAAFLRTIKRYLEEPVTILL

SEQ ID NO: 36135 - protein, 332 aa, Bacillus thuringiensis serovar konkukian str. 97-27
MLKTTESKGNGITKEQARWMYEKMLEIRKFEDKVHELFAQGVLPGFVHLYAGEEAVAVGVCAHLTDSDSITSTHRGHGHCIAKGCDLNGMMAELFGKATGLCKGKGGSMHIADLDKGMLGANGIVGGGFPLACGSALTAKYKGTKDVSVCFFGDGANNEGTFHEGVNLAAIWKLPVIFIAENNGYGEATTFEYASSCDSIADRAKAYNIPGVQVDGKDLLAVYKAAEEAVERARNGDGPTIIECMTYRNYGHFEGEAQTYKTSEEKEEHLNEKDAIVNFRKHLIHEALLTESEIVDMEKAVDEAVQRSIEFSENSPYPGDEELLKDVYVSYK

SEQ ID NO: 36136 - protein, 495 aa, Zea mays
MAKIVDGAHLQCQAPPIVSAAAHKAPDDLELGLPDYYGAGCRHPLTSRVVTLLYRVPELLLGSNSPKAKSLLEAALMEANRERKKHITGTMTTKPNDDDDLDKDDGELCLGGIYLELACAMEVQDCRHQMCVAFMLALCFNISMPNTIAPSAILKMAQPDGELLVSVGVPGNALVLKISIQGVVVALHRETLQGTSPNEEQMKQDSVADNFHCQLNKILADLNQDHIIDRKNVWNSIRFSNVYVKNLSDTVTDDELTEMFEKYGTITSAVVMRDNVGNSRCFGFVIFENADAAGQAIQELNRKIFNDKELYVGRVQQPMMPGNLYSSKFAVFGDKVFSPKEISAMIFGKMKDTAEAYLGKKINDAIVFVPEYFNDVQRQATKDAAITKVDIFRDAAVLVVNYVDEIRAQGFKLEYAVLPTPMDLINTVRELVLSQDITLIIEPGRFLVRADGQLFWALSSDASDAMICPDQERCDEIFQLFASFLGFKIKNQRSI

SEQ ID NO: 36137 - protein, 984 aa, Burkholderia mallei ATCC 23344
MTSSAFDSSRQGCGSGQCACRRAAQMRRADPFDDTDYGTPTRHADTDVTLDIDGRAVTVPAGTSVMRAAIEAGINVPKLCATDSLEPFGSCRLCLVEIEGRRGYPASCTTPVEAGMKVRTQSDRLQALRRNVMELYISDHPLDCLTCAANGDCELQDMAGAVGLREVRYGFDGKNHLSDAKDESNPYFSYDPSKCIVCNRCVRACEETQGTFALTIASRGFESRVAASAGEAFMDSECVSCGACVAACPTATLIEKSVARLGQPEHEIVTTCAYCGVGCALKAEMKGEQVVRMTPHKNGLANEGHACVKGRFAWGYATHKDRITKPMIREKITDAWREVSWDEAIGYAAARFRRIQDEHGRDSIGGITSSRCTNEETYLVQKLVRAAFGNNNVDTCARVCHSPTGYGLKTTLGESAGTQTFASVGSADVIVVIGANPTDGHPVFGSRLKRRVREGAQLIVVDPRRIDLVDGPHVKAVHHLQLRPGTNVALVNALAHVIVTEGLVDEAFVDERCEPQAFDVWRAFAARPENSPEATADITGVPADAVRAAARLYATGGRAAIFYGLGVTEHAQGSTMVMGIANLAMATGNLGIEGAGVNPLRGQNNVQGSCDMGSFPHELPGYRHIGDAAVRARFDEAWSTTLQPEPGLRIPNMFDAALDGSFKGLYCQGEDIVQSDPNTQHVAAALASLDCLVVQDIFLNETAKYAHVFLPGATFLEKDGTFTNAERRISRVRRAMRPLSGYADWEVTLMLSRALGYDMHYAHPSEIMDEIARLTPTFAGVSYALLDELGSVQWPCNDAAPQGTPTMHVDQFVRGKGKFVITQYIASPEKVTPRYPLILTTGRILSQYNVGAQTRRTENVRWHGEDRLEIHPHDANDRGIRTGDWVGVASRAGQTVLRALVTERMQPGVVYTTFHFPESGANVITTDSSDWATNCPEYKVTAVQVAPVAQPSEWQRAYTRFRAEQLALLEQRTAERAPAIATGK

SEQ ID NO: 36138 - protein, 250 aa, Methanopyrus kandleri AV19
MPLREAAERVVEAETVVVLTGAGASADSGIPTFRGKDGLWNKYDPRELATPEAFARDPEKVWEWYLWRRRKIAEAEPNPAHTVLARMERDGLLEAVITQNVDGLHQRAGSRRVIELHGNIWRDECVSCEYQRVNDPERGEGLEYDELPPRCPECGDPLRPGVVWFGEPLPSDALVEAENLARSCDVMLVIGTSGEVRPAADLPLVAKSCGATLIEINPSETALSPHMDVIIRERAASAMEALWNEIERLL

SEQ ID NO: 36139 - protein, 466 aa, Bifidobacterium longum NCC2705
MAAAGTPKDDTGLERKMESRHLTMISLGGVIGTGLFVSSGYAIHQAGPLGAILAYAAGSLLVYCVMVSLGELSVAMPYAGSFHMYAKRFIGPGTAFTIAILYWLNWAVALASEFTAAGLLMQRWFPHSPSWVWSAVFIVVVFALNIMSVRLYGEAEFWFASIKVFAIIAFIVIGLLAIFGAIPIAGHDSAPLLGNFVAGGWFPSGIAPIFSTLLTVVFAFSGTEVVGVAAGETKDPSRAIPKAVHTTVLRLAIFFIGSILVMAALIPWHQAGVDTSPFVLVFQSIGMPFAGDIMNFVVLTAVLSAANSGLYVCSRMVWSLAKERLIPERFARTNFRGVPVWAVLFSMAGSLLALLSSVIAASTVYLVLVAVSGLATLVVWFSVCVCHIRFRREWARDGHSADELGYRAPGFPVLPWLAIVMCIGALVLVVLDDTQRSTLYCMIPFVACCYAAYYALERQRKRENNA

SEQ ID NO: 36140 - protein, 495 aa, Pseudomonas aeruginosa UCBPP-PA14
MSIAIDPSVSAFLRSPHGLLIEGESGPARSGADMPLYDPATGAELARVARAGAEDVDRAVAAARRAFEGNWAGQRPADRERLLLRLAERIEAHGEQLAQLETLNNGKSINLSRALEVGASVEFIRYMAGWATKIEGRSLDLSIAAVPGARYRAYTVPEPVGVVGAIVPWNFPLLMAIWKIVPALACGCTVVLKPADETPLTALRLGQLCLEAGIPPGVVNIVTGTGAEAGAALAAHPGIDKLAFTGSTPVGKLIGHAAVENMTRFSLELGGKSPVIILDDTSLDMAAAGSAGAIFFNQGQVCTAGSRLYVQRKRFDQVLERLAAIAGDLSIGPGLDPTTQINPLVSARQQERVLGMIESGVAEGASVVCGGARQGETGFYVQPTILADVTPGMQVVREEIFGPVLVATPFDDLDEAVRLANDSIYGLGASIWSNDLRQVMDLVPRIKAGTVWVNAHNLLDPSMPFGGFKQSGIGREMGHAAIEAYTENKSVCIAY

SEQ ID NO: 36141 - protein, 348 aa, Aquifex aeolicus VF5
MEFVTNYTLEELKKRFTELGLEPYRAKQVFRWVYKKFVTDFEKMTDLGKKHRELLKEHFAFHPLEKLDRVEAPDAVKYLFKTKDGHILETVLIKERDHYTLCVSSQIGCAVGCTFCATALDGLKRNLSTAEIIDQYLQVQQDLGEEKIRNVVFMGMGEPLANYENVRKAVEIMVSPEGLDLSKRRITISTSGIVAQIKRMAQDPVMKEVNLAVSLNAVSQKKREELMPLTKTNTLEELMEVLKNYPLPKYRRITLEYVLIKGVNDSPNDAERLAKLIGRHKKKFKVNLIPFNPDPNLPYERPALTDIMKFQKVLWKYGISNFVRFSKGVEVFGACGQLRTQRLQLQRV

SEQ ID NO: 36142 - protein, 356 aa, Coccidioides immitis RS
MSHLGRPDGRPNDKYSLAPVAPELEKLLGTPVKFVHECVGREVEETVSSANNGQVILLENLRFHPEEEGSYKDQEGKKVKADKNKVEEFRKALTALGDVYINDAFGTAHRAHSSMVGINLPEKASGFLVKKELEYFAKVLENPQRPFLAILGGAKVSDKIQLIDNLLSKVNSLIICGGMAFTFKKVLDNMKIGNSLFDEPGSKTVNQIMEKAKQNNVEVVLPVDFVTGDKFAADAKVGYATDADGIPEGWMGLDCGEKSVELFKAAINEAKTILWNGPPGVFEMDSFANATKKTLDAAVASAQEGKVVIIGGGDTATVAAKYGVENKLSHVSTGGGASLELLEGKELPGVSALSNK

SEQ ID NO: 36143 - protein, 1260 aa, Zea mays
  misc_feature (55)..(55): Xaa can be any naturally occurring amino acid
  misc_feature (694)..(694): Xaa can be any naturally occurring amino acid
PNLPEPATASASSSLAFQSQLRIASRAGKQHPRCAPDARSQCRRSRPPPWPEPPXPILLHLLLLLLLLTDHGPGPAAAVRFDYASLTLGSLRLLGDAHLKNGTIRLSRDLPVPTSGAGRALYATAVPLRGGFSTQFAFTVATLNPSSVGGGLAFVLATDGATLGDAGAYIGVSVATDAAAVEFDTLMDVQFGDPNGNHVGLDLGSMVSAAAADLGGDDAGVDLASGRTINAWIDYRPSSSPSGSAAGILEVFVSYAPKQPPKPVLSAPLDLAEAVKDAAFVGFSASTQGSTEVHAIEWWSFSTASPAPSPRSAAPAPESQALPPPVATPVLPSPLLPGGTTTAPAPPSGSAGAPAASIAPSSGATVGRNAAGSGTPRPPAAVAGAATAGAFVAASFAGVALWALARRARARKRQAALAVGTRRDSSVASAAALARSPREFSYKELSAATRGFDASRVVGNGAFGTVYKGIVPDTGAMVAVKRCTTGARGGGGGSGEQARSEFLSELSIIAGLRHRNLLRLQGWCYEKGEILLVYDYMRNGSLDRALFDASAPVLPWRHRREILAGVASALAYLHHECERRVIHRDVKSSNVMLDEAYRARLGDFGLARQAEHGESPDATAAAGTMGYLAPEYLLTGRASECTDVFSFGALALEVACGRRPIGATPEGVGGCCSNLVEWVWSLHAEARILGAVDXRLGGEFEEGEARRALLVGLACSSPEPALRPGMRAVVQVLGGEADPPFVPAARPSMSLGSANQQLLLSLQDSVSDYHAMLGLPLSDSSSSGSLSSSSLTSTLRRGGHDIRVSSTAGEASWEKMSCFGCFKPDKKVPPRRTESREVTVVNKAPSQNEAPPRESGSIRPPPVASKHKHRPSSETAASIEPPKGSCSVAKTAKAFTFRELATATKNFRSDCLLGEGGFGRVYKGRLENGQLVAVKQLDLNGYQGNREFLVEVLMLSLLHHPNLVNLVGYCADGDQRLLVYEYMALGSLADHLLDSTPDQVPLSWYLRMKIAYGTAKGLEYLHEKANPPVIYRDLKSPNILLDEKYNPKLSDFGLAKLGPVEGKTHISTRVMGTYGYCAPEYIRTGQLTVKTDVYSFGVFLLELITGRRAVDTSRPASEQILVNWVKPMLRDRKRYNELVDPHLRGEYPEKDLSQAVGVAAMCLQEEASVRPYMSDAVVALGFLAEMPAGYKHKSGPILQMKQVGDPSRTGSTKQDKDAYNRQKAVAEAIEWGSLRQKQKAQNPEKKALSQGISPPEASRL

SEQ ID NO: 36144 - protein, 541 aa, Oryza sativa
  misc_feature (38)..(38): Xaa can be any naturally occurring amino acid
  misc_feature (391)..(391): Xaa can be any naturally occurring amino acid
MARRLRWHDLVGLGLGGMVGAGVFVTTGRATRLYAGPXVVVSYAIAGLCALLSAFCYTEFAVDMPVAGGAFSYLRVTFGELAAFLTGANLIMEYVFSNAAVARSFTAYLGTAVGVDAPSKWRIAVPGLPKGFNEVDLIAVGVILLISVCICYSTKESSVVNMVLTAVHVAFILFIIVMGFWRGDTRNLTRPVDLAHNPGGFFPHGAAGVFNGAAMVYLSYIGYDAVSTMAEEVERPSRDIPVGVSGSVVLVTLLYCLMAASMSMLLPYDAIDTEAPFSGAFKGSSGWGWVSNVIGAGASLGILTSLMVAMLGQARYLCVIGRSGVMPAWLAKVHPCTATPVNASAFLGVFTAALALFTELDVLLNLVSIGTLFVFYMVANAVVYRRYVAAXTTTPTTAAPWPTLVFLAAFSLVALCFTLLWQFAPAGRARTGLLAACGAAAVATVGAFRALVAEARRPELWGVPAMPWVPAASVFLNVFLLGSLDRPSYVRFGFFTAAAVLVYVLYSVHASYDAEEGGGAGAGAAALDGAKVQDEAADFKV

SEQ ID NO: 36145 - protein, 283 aa, Chromobacterium violaceum ATCC 12472
MSLPQGMSLATLAPGVDQILLAGDRFSARIALLGGQLIDYRRDGEPPLLYLSPQTTYQPGKAIRGGVPVCWPWFGPHPSDAGLPAHGVARQQVWRLSDAGRDGDVFHVKLDGPRHGGLAAELDFRIGPDGVEIALTTANLGDAAQTVGAALHSYFAVSGIDKVDLLGLESAPAHDKVADQRVNLPALPLRFDGETDLIAYRGGLVTLRDAGWRRDIRIESAGSHSAVVWNPAQDKAQRLADLPDGDWRRFVCVETANAGDDARALAPGARHRLACRLHFSCHD

SEQ ID NO: 36146 - protein, 588 aa, Oryza sativa
MSAAVGGAEFHGFRGGGGGAAQLQRSRMLGRPLRVATPHAAAPAGGGGSSSASIRAVSAPLKKDASEVKRSKVEIIKEKSNFLRYPLNEELVSEAPNINDSAVQLIKFHGSYQQTDRDVRGQKNYSFMLRTKNPCGKVPNQLYLAMDTLADEFGIGTLRLTTRQTFQLHGVLKKNLKTVISTVIKNMGSSLGACGDLNRNVLAPAAPYVRKDILFAQETAENIAALLTPQSGAYYDLWVDGEKIMSAEEPPEVTKARNDNTYGTNFPDSPEPIYGTQYLPRKFKIAVTVAGDNSVDILTNDIGVVVVSDSAGEPVGFNIYVGGGMGRTHRVETTFPRLADPLGYVPKEDILYAIKAIVVTQRENGRRDDRRYSRMKYLIDNWGIEKFRAEVEKYYGKKFEDSRPLPEWQFNSYLGWQEQGDGKLFYGVHVDNGRVAGQAKKTLREIIEKYNLEVSITPNQNLILCGIDQAWKDPITAALAQSGLLEPKDVDPLNITSMACPALPLCPLAQTEAERGILPILKRIRAVFDKVGIKDHESVVVRITGCPNGCARPYMAEVGFVGDGPNSYQIWLGGTPNQSTLAEKKMCL

SEQ ID NO: 36147 - protein, 658 aa, Mycobacterium smegmatis str. MC2 155
MCGLLALVTDPSRADQVEASPGTGSQLVSAVAEAAHLMRHRGPDEPGTWPDPDAENPHPEVVLGFNRLSIIDIAHSHQPLRWGPADAPGRYLLVFNGEIYNYLELREQLRNEFGAQFHTDGDSEAIVAAYHHWGVDALHRLRGMFAFAIWDTEKRELFCARDPFGIKPLFMATGPGGTAVGSEKKCLLSLADRLGLDLGIDQRAVQHYTVLQYVPEPETLHRGVRRLESGSYARIRPGAAPEVTRYFVPKFTAVNFAAGSEQARYDEITAALEDSVAKHMRADVTVGAFLSGGIDSTAIAALAMRHNPRLITFTTGFEREGFSEIDVAVASAEAIGARHVAKVVSQAEFVEALPEIVWYLDEPVADPALVPLFFIAREARKHVKVVLSGEGADELFGGYTIYREPLSLRPFDYLPRPLRKSLGKASKPLPEGMRGKSLLHRGSLTLEERYYGNARSFSDDQLRAVLPQFRQEWTHTDVTAPVYAASQGWDPVARMQHIDLFTWLRGDILVKADKMTMANSLELRVPFLDPEVFAVASRLPVDQKITRATTKYALRRALEPIVPAHVLNRAKLGFPVPIRHWLRSGELMDWAYALIGSSGAGEHVDLAAVRTMLDEHRNGVSDHSRRLWTVLIFMLWHAIFVEHSVTPQIKEPHYPVQL

SEQ ID NO: 36148 - protein, 556 aa, Carboxydothermus hydrogenoformans Z-2901
MIDLNNPPSWPYYPKNVKYHLDYPPISLGEKLDKTANEFPDTDATIFFGARIKYQKLKELTDNLAANLQNLGIKKGDRVALILPNSPQAVIAFYGALKAGAVVVWNNPMYTERELHHQLTDSGSKIVITLDLILPRVLNIKAKTSLEKIVVTRLSEFMPPLLKLLYPVKVKKEKRWIEIPKESFILGFQELLKSPPQPLAKITINPEEDLAVLQYTGGTTGISKGVMLTHRNLIANAMQVNAWDPVRSSQDIILAVMPFFHVYGLSVALNLAVLTGATLLIMPRFNVDEMLKTIVKYRPTLFPGAPTIYVAIINHPRIKDYDITSIRLCISGSAPLPVEVKKKFEEITGGRIVEGYGLTESSPVTHCNPVHSLEKPGSVGLPLSDTLCMVVEPDTLNPVAIGEVGEVAVKGPQVMKGYWNRPEETALVLKEGWLLTGDLGRMDEDGYLYIVDRKKDLIISGGYNIYPREVEEVLYEHPKVKEAVVIGVPDEYRGEVVKAFIVLKENETATSEEIIKHCQEKLAKYKVPKYVEFRTELPKTTVGKVLRRALREEAKK

SEQ ID NO: 36149 - protein, 302 aa, Glycine max
  misc_feature (205)..(205): Xaa can be any naturally occurring amino acid
MALVVMCGQPCSGKSKAAVCLAEALKESESKLQVRIIDEACFHLNRNQSFANMPSEKNLRGVLRSEVDRSLSKDSIIIVDSLNNIKGYRYELWCLARAAGIRYCVVFCDVEETICRKWNEERREKGEANYDDSIFEDLARRFEKPDRRNRWDSPLFELWPHREATEKSSPAVVDAVSYLTKKVDSKTRDVKILQPTIATQTSRFXDANSLYELDKATQEVTNAIVEAQSQALGGPLNGVSIGKDLPVINISRSVGLPELRRMRRTFIKLTGQTSLSGPPPPSDADSAKRMFIDYLNRELGTS

SEQ ID NO: 36150 - protein, 209 aa, Arabidopsis thaliana
MSQLGVETSQAQPETPQSTTFLDLLRLQMDGLDRSRRRKRTLKERLGFKRIGCCGPTWGLRLTSNTGEDDDEPFENRLVSGSDHVTGPLNQGMNLATALAAERNYRTEETEASGSLTPLKVSLMRLLEETAERVVVEENETERVTASASSTVRGVNNDSVCCVCMGRKKGAAFIPCGHTFCRVCSREVWLNRGSCPLCNRPIIEILDIY

SEQ ID NO: 36151 - protein, 373 aa, Aquifex aeolicus VF5
MDRLEKVSPFIVMDILAQAQKYEDVVHMEIGEPDLEPSPKVMEALERAVKEKTFFYTPALGLWELRERISEFYRKKYSVEVSPERVIVTTGTSGAFLVAYAVTLNAGEKIILPDPSYPCYKNFAYLLDAQPVFVNVDKETNYEVRKEMIEDIDAKALHISSPQNPTGTLYSPETLKELAEYCEEKGMYFISDEIYHGLVYEGREHTALEFSDRAIVINGFSKYFCMPGFRIGWMIVPEELVRKAEIVIQNVFISAPTLSQYAALEAFDYEYLEKVRKTFEERRNFLYGELKKLFKIDAKPQGAFYVWANISDYSTDSYEFALKLLREARVAVTPGVDFGKNKTKEYIRFAYTRKIEELKEGVERIKKFLEKLS

SEQ ID NO: 36152 - protein, 364 aa, Escherichia coli O157:H7 EDL933
MMSKNYHIAVLPGDGIGPEVMTQALKVLDAVRNRFAMRITTSHYDVGGAAIDNHGQPLPPATVEGCEQADAVLFGSVGGPKWEHLPPDQQPERGALLPLRKHFKLFSNLRPAKLYQGLEAFCPLRADIAANGFDILCVRELTGGIYFGQPKGREGSGQYEKAFDTEVYHRFEIERIARIAFESARKRRHKVTSIDKANVLQSSILWREIVNEIATEYPDIELAHMYIDNATMQLIKDPSQFDVLLCSNLFGDILSDECAMITGSMGMLPSASLNEQGFGLYEPAGGSAPDIAGKNIANPIAQILSLALLLRYSLDADDAASAIERAINRALEEGIRTGDLARGAAAVSTDEMGDIIARYVAEGV

SEQ ID NO: 36153 - protein, 476 aa, Mycobacterium sp. KMS
MTTPEQNGSQKGDFIPRGRIRRTMPLAGFTARAATARLVAGAREKAGDAGALERFHERTAEHYVDLLGHSKGALMKAGQFFSMIDVDALGNGGFARYQKVLSRLQTDAPPMTPTLLHAVLLTELQRPADELFATFDDAPMAAASIGQVHRALMHDGRDVVVKVQYPGVDEAIRGDLANAELLATFLRFLTAASGMKADVRTMAREATARLTEELDYRHEADMITRFSELYRDHPFIRIPEVVPELSGDRVLTMTHLDGIDWSAAQLADQDLKNTWAEVIHRFSYANYRHSNLMHADPHPGNYRFRADGTVGFVDFGCVRILPEHIRRGWIAMGRAAIEGRKNDLRAVMTELGFLDADPTLTADDLYHWFSQMLYEVLAPEQPVTYNQATTDRALRNLFDTRNHTGVLARLSVPEELTMTSRVIFAVNAISGSLNATLHARAAANDIDSVAEPVTEFGKAHHAWVRARGLPTALEPQ

SEQ ID NO: 36154 - protein, 359 aa, Oryza sativa
  misc_feature (22)..(22): Xaa can be any naturally occurring amino acid
ARAGSDVAGRQDGLLWYKDTGXNNLLEDQCQIESGPLSFLDSGPYGTFVGVYDGHGGPETACYINDHLFHHLKRFASEQNSISADVLKKAYEATEDGFFSVVTKQWPVKPQIAAVGSCCLVGVICGGILYVANVGDSRVVLGRHVKATGEVLAVQLSAEHNVSIESVRKELQSMHPEDRHIVVLKHNVWRVKGLIQVCRSIGDAYLKRSEFNREPLYAKFRLREPFHKPILSSEPSISVQPLQPHDQFLIFASDGLWEHLTNQEAVDIVHSSPRNGSARRLIKAALQEAAKKREMRYSDLKKIDRGVRRHFHDDITVIVVFLDSSLVSRASTYRGPSVSLRGGGVNLRSNTLAPYASQM

SEQ ID NO: 36155 - protein, 262 aa, Nostoc punctiforme PCC 73102
MKWPEKYGEWAIVTGASSGIGRAFAHDLAQRGMNLILVARQLAGLEEVAAECNSWETKTYLCAVDLTEPNGIHKLISLVGDREVGILVNNVGIVARGLFTKIELQRQLDMVTLHCTVPVALTHHYLAQMLKRNQGAIINISSVAAYHFQPLLTTYAATKEFDWKFSKSLAWELKDTDIDILTVVPGFTKTAAYEAADWKIDFDSIPALFKPQNPREVSKKSLDILGKQRSIIVASFMEKLIINANYLLPDRFMEFILSKMFV

SEQ ID NO: 36156 - protein, 242 aa, Pseudoalteromonas tunicata D2
MNKVAVVTGGSKGIGLAIVQTLLAQDYQVYNLDITPSDVGFFVPCDVSQVAEVTHAIEAIAIKTSRIDCLVSNAGVHFSATIENTSEHELDRIFSLNVKGAYAAIKATLPSMKAQKNGSIILISSDQALIAKRNSFAYNLSKAALASIAKTTALDYAQFNIRANAVCPGTIETPLYHAAIDNYCAKSGANKQQIHQEEAALQPLGRLGQPQEVANLVAFLASDAASFITGSLQVIDGGYTAQ

SEQ ID NO: 36157 - protein, 557 aa, Arabidopsis thaliana
MATSSAWKLDDHPKLPKGKTIAVIVLDGWGESAPDQYNCIHNAPTPAMDSLKHGAPDTWTLIKAHGTAVGLPSEDDMGNSEVGHNALGAGRIFAQGAKLCDQALASGKIFEGEGFKYVSESFETNTLHLVGLLSDGGVHSRLDQLQLLIKGSAERGAKRIRVHILTDGRDVLDGSSVGFVETLEADLVALRENGVDAQIASGGGRMYVTLDRYENDWEVVKRGWDAQVLGEAPHKFKNAVEAVKTLRKEPGANDQYLPPFVIVDESGKAVGPIVDGDAVVTFNFRADRMVMHAKALEYEDFDKFDRVRYPKIRYAGMLQYDGELKLPSRYLVSPPEIDRTSGEYLTHNGVSTFACSETVKFGHVTFFWNGNRSGYFNEKLEEYVEIPSDSGISFNVQPKMKALEIGEKARDAILSGKFDQVRVNIPNGDMVGHTGDIEATVVACEAADLAVKMIFDAIEQVKGIYVVTADHGNAEDMVKRDKSGKPALDKEGKLQILTSHTLKPVPIAIGGPGLAQGVRFRKDLETPGLANVAATVMNLHGFVAPSDYEPTLIEVVE

SEQ ID NO: 36158 - protein, 334 aa, Corynebacterium glutamicum ATCC 13032
MTIRVGINGFGRIGRNFFRAVLERSDDLEVVAVNDLTDNKTLSTLLKFDSIMGRLGQEVEYDDDSITVGGKRIAVYAERDPKNLDWAAHNVDIVIESTGFFTDANAAKAHIEAGAKKVIISAPASNEDATFVYGVNHESYDPENHNVISGASCTTNCLAPMAKVLNDKFGIENGLMTTVHAYTGDQRLHDAPHRDLRRARAAAVNIVPTSTGAAKAVALVLPELKGKLDGYALRVPVITGSATDLTFNTKSEVTVESINAAIKEAAVGEFGETLAYSEEPLVSTDIVHDSHGSIFDAGLTKVSGNTVKVVSWYDNEWGYTCQLLRLTELVASKL

SEQ ID NO: 36159 - protein, 494 aa, Bacillus thuringiensis serovar konkukian str. 97-27
MLTKNIELKPKVKAFLNEEIKMFINGEFVPSISGKTFETYNPATEDVLAVVYEAQEEDIDVAVKAARSAFESGPWVEMTTAERAHLIYKLADLIEEHGEELAQLEALDNGKPYQVALDDDIAATVENYRYYAGWATKIIGQTIPISKDYLNYTRHEPVGVVGQIIPWNFPLVMSSWKMGAALATGCTIVLKPAEQTPLSLLYTAKLFKEAGFPNGVVNFVPGFGPEAGSAIVNHHDIDKVAFTGSTVTGKYIMRQSAETIKHVTLELGGKSPNIILEDADLKEAINGAFQGIMYNHGQNCSAGSRVFVHRKHYETVVNELVKMANNVKLGAGMEKETEMGPLVSKKQQERVLHYIEQGKAEGATVAAGGERAFEKGYFVQPTVFTDVTDDMTIVKEEIFGPVVVVLPFDSTEEVIERANRSSYGLAAGVWTQNIKTGHQVANKLKAGTVWINDYNLENAAAPFGGFKQSGIGRELGSYALDNYTEVKSVWVNIK

SEQ ID NO: 36160 - protein, 213 aa, Campylobacter jejuni RM1221
MNKTILFDLDGTLIDSTDAILNSFQGVFKALGLTSKNNEEIKNLIGYPLEQMFRMLYPDKVNLSKEFVLAYREIYAQIYLEQTTLLPKAKEALELGSEIADLGIVTTKGGKFTPILLDYLGVKKFFKTLITLEDVTNPKPSSEPIILALKRLNKTQENAYMIGDTILDIQAAISANITPLALTCGYGNENELKTHSMVFLNAYEAVNYIARLN

SEQ ID NO: 36161 - protein, 204 aa, Yersinia pestis CO92
MLTEQQINQLDWEKVDHLMPAIVQHAVSGEVLMMGYMNQEALAVTEKTGKVTFFSRTKQRLWTKGESSGHFLNVVNIYPDCDNDTLLILVKPIGPTCHLGNSSCFAPAASDWSFLYQLEQLLASRKSADPASSYTAKLYASGTKRIAQKVGEEGVETALAATVNDREELTNEASDLMYHLLVLLQDQDLDFSTVIGRLRERHEK

SEQ ID NO: 36162 - protein, 524 aa, Bifidobacterium longum NCC2705
MSQPDTDTAAQSPSSQQEPQIQTDGRRSHSEQMNQPAQTSQSESSHDGKDEHALHTNLKRGMESRHLQMISLGGVIGTGLFLSSGYTIQQAGPIGTILAYSIGALIVYLVMLTLGELSVAMPVTGSFHVYAEKFIGPGTGFVIAIQYWLTWTVALGSEFTAAGLLMQRWFPDSPTWVWSAACIILIFTLNALSVRLFAEAEFWFASIKVFAICAFIVIGLLAIFGVIPIAGYQHAPMFGNLVKDGIFPNGFMPVFATILTVNFAFSGTELIGVTAGETRDPETTVPKAIHTTLWRLVLFFIGSITVMCALIPWRQAGVGESPFVLVFNSIGIPYAGDIMNFVVLTAVLSASNSGLYASTRMVWSMGNEGMIPRWFAKTNRRGVPMLALCAAMAGGLLALLSSVIAASTVYLVLVALSGLSAVVVWIAIAYCQIVFRRRWLESGHSTSELKYRTPGYPYVSWAAFILCTASFVLVIFDVEQRFALVAELVFIVACYGAYFLQQWVRKRKKATEADDLDTLWVARD

SEQ ID NO: 36163 - protein, 135 aa, Zea mays
MRRHRIVSLLAALLVLLALAAVSSTRSAQEESVADNAGMLAGGIKDVPANENDLQLQELARFAVNEHNKKANALLGFEKLVKAKTQVVAGTMYYLTIEAKDGEVKKLYEAKVWEKPWENFKQLQEFKPVEEGASA

SEQ ID NO: 36164 - protein, 355 aa, Yersinia pestis CO92
MSQKFLFIDRDGTIIAEPPTDYQVDRLDKLALEPDVIPALLALQKADYKLVMITNQDGLGTSSFPQETFDPPHNLMMQILTSQGINFEQILICPHLPEDNCTCRKPKTALVESYLADGVMNSTNSYVIGDRETDLQLAENMGISGLRYQRDGLNWTQIAKQLTQRDRHAYVNRVTKETAIDVNVWLDREGGSKIKTGVGFFDHMLDQIATHGGFRMDIQVSGDLYIDDHHTVEDTALALGEAINIALGDKRGIGRFGFVLPMDECLARCALDISGRPHLEYKAEFNYQRVGDLSTEMVEHFFRSLSYAMACTLHLKTKGRNDHHRVESLFKVFGRTLRQAIRVEGNTLPSSKGVL

SEQ ID NO: 36165 - protein, 289 aa, Nocardioides sp. JS614
MATTDGSRIVLGANQYGKAEVRLLRVDRASERHTIEDLGITTQLRGDFEACHTHGDNSQVVPTDTQKNTIQAFARDGIGAPEHLLLRLARHFTDGFAWVTGGRFDAESYAWERIGLPDGSGHDHSFVRTGRETRTATVEVDGDEVVVTAGLTDCTVLKSTGSEFHGFSRDRYTTLPETTDRILATSIAATWRYATTEVDFDARYAGVRDTLLATFATTHSLALQQTIFEMGKAVLERYDDVAEVSLSCPNKHHFLVDLEPFGLDNPGEVFFPADRPYGLIQATVRREGA

SEQ ID NO: 36166 - protein, 109 aa, Nocardioides sp. JS614
MTTLSTHVLDAGRGVPAEGLDVRLAGHLVAGDGTLATSRTDADGRVRFDVELQSGPHLLTFETGAWFDAQGRDTFFSLVNVAFEVDAEEEHHHVALLLSPYSYTTYKGS

SEQ ID NO: 36167 - protein, 472 aa, Oryza sativa (indica cultivar-group)
MAASPTGSSSSAPAAAAAAAMAAAVAAEATDGPTLSVVSKRLRALRKKHNRILQMEESLAGGRKLNKEQEEVLRSKPAVVALIDELERMRAPLAAALAEELSSRPAPSSSAAPPPPASSSAAGAADSSVVEDLLALIYFGTLFDLKPQTEFVATMVARAQERDCCITYDYVTEDAADLLHQSDLDKVSALAALAASRPAAAVGVSHRDALQSCAQHARLWLRRADEPIHPESSITYAAVRAKLDKIMASDYYTAQPEMPEMGAAVDLSAAVQESMVVSPEAPAVEESQAEGHKDEKEASEATEIYNDNQPNVADAQNVEDEAPVNPSEEFSAAEVEQEKFEADVEELERNADQQFTSRRPYQNQRGGGGRGGGRRGYQNGGRGGRGGRGMGGGGYQNGRGGGGGGGYQNGRGGGEGGGYYYNEPGYYQQRGYSNRGRGGRSGGGNSYYNNQGGGSQGGGHAHPGRVELGANA

SEQ ID NO: 36168 - protein, 459 aa, Listeria monocytogenes EGD-e
MKHIVIIGGGLSGLAAAYELQKTHPNYTWELVEKDEKLGGKFETVKRDGFLIEKGPDSFLARKPAGVGLVKDLGLEDKLIANATGRSYIYHQKALHPIPEGSVMGIPTDKEALLASTLVSEIGKARALQEPTMERNNQERDQALGDFFEARFGKELVKTIIEPLLSGIYAGDIYKMSLRATFPQFEQTVKKYGNLMDGLKESSMQTTGTKATIGAFRTLEGGLDALPKAIAAALPKENLHTAKQATEIVKKNNAYEISFADGDKMEADGVIIAATHDALIHLLAETTTEPFAGQPLTTLATVSLAYNEQDVPILPDGTGYLVARTAPYKTTACTWVQKKWPHMVPKNKMLLRGFVGKAGETWLEQASDEAIVSAVLRDYAEIMDLHAAPLFYEVSRMKSAMPQYLVNHQDRLKQLKKNIKTDYPGVFFAGMSYEGVGIPDCIAGAQTAAKELVDYLEEV

SEQ ID NO: 36169 - protein, 61 aa, Arabidopsis thaliana
MDGASLDKFIEQQVTNSGWIVEKEGGSIVLPQNEFNHPELKKNTGENVPLEHIARIFPILG

SEQ ID NO: 36170 - protein, 150 aa, Pseudomonas syringae pv. tomato str. DC3000
MQSNTPQPNPAPFLKAGETVVLFDGVCKLCNGWAKFIIRHDRRQRIRLATVQSPEGQALLEWAGLPLDRFDTMAAVTGDRLYVRSEAFFVALSDFPAPWRWLRVLRFFPAVIRDWLYDRIALNRYRLFGRYDSCLLPTPDHERRFLKASP

SEQ ID NO: 36171 - protein, 757 aa, Oryza sativa (japonica cultivar-group)
MEIQKSDHHEQNLTSPRGLIHKVLRRTSSRRSPTAADHNPSPVFLETSNSKFLKQKDIDDAIKDPEKAGTHDNRIEDEKSDLLGYEICSGKLTLDNKAKSASGEQSGSGSSSNCFDARITTEALVWGSNILKLEDIVSVSYHSGLRHFTVHACPLEKRSSGLSCFMKPRKIQKDLRFLSTSPHEAFRWVNGFADQQCYVNLLPHPMASSKKHSSELIPFDNMFDPCVKCRSPPKILVILNPRSGHGRSSKVFHGKVEPIFKLAGFKMEVVKTTHAGHAKSLVSTIDFSTCPDGIVCVGGDGIVNEVLNGLLCRDDQNVAVSVPIGIIPAGSDNSLVWTVLGVKDPISAAMSIVRGGFTPIDVFAVEWIQSGTIHFGTTVSYFGFVSDVLELSERYQKRFGPLRYFVAGFLKFLCLPKYNFELEYLPISDGGGGEHKIVEGQDKVDASDLYDDVVRRSRVECLPRASSLSSIDSIMSTGIMSGGDLEVSSPHANNEPSELVRALDPKSKRLSLGRTSTFKEPEEVIHPQAHVSSTPNWRRSKSKSRTEKAWPGSGATNDANSSRGTTTHDKEDASSTISDPGPVWDSGPKWDDEPKWDNQPNWEPETPIDLPGPLDDIELGLTKELVPSLDERWTVRKGRYLGVLVCNHSCKTVQSLSSQVIAPKAEYDDNCLDLLLVGGSGRLRLLKFLVLLQFGKHISLPNVEYLKVKSVRLKAGPNTHDGCGIDGELLHVKGQVRCSLLPQQCRLIGRPAKNPVQ

SEQ ID NO: 36172 - protein, 469 aa, Oryza sativa (japonica cultivar-group)
MAHVMAASELVTATIKRPFQNDDDNSSNGNGNADGKPKARRREADPAAALAAARHEFGEHGGVNMSIEASATFTVMEPDTMRRLFSGELGPERGDLYIYSRHFNPTVLALGRQMAALEGTEAAYCTASGMSAISSVLMQLVGAGGHVVASRCLYGGTHALLSRFLPRASGVRATFVDADDEAAVRAAVRPGETRVVYVETMSNPTLAVADIPMLARVAHDAGAKLVVDNTFTPMVVSPARLGADVVVHSVSKFISGGADIIAGAICGPASLVNAMMDLQEGALMLLGPTMNAKVAFELSERLPHLPLRMQEHSRRAAEYASRMRRLGLRVAYPGLPDHPHHARLLAIANPGYGAGGMLCVDMGTEDRANRLMHHLQNTTRFGLMAVSLGYYETLMSCSGSSTSSEMPPEDRARAGISPGLVRMSVGYNGTLEQRWAQFERALSLMQQQQQQHPDRDAAAKYCKIVEWHS

SEQ ID NO: 36173 - protein, 345 aa, Arabidopsis thaliana
MTATNKQVILKDYVSGFPTESDFDFTTTTVELRVPEGTNSVLVKNLYLSCDPYMRIRMGKPDPSTAALAQAYTPGQPIQGYGVSRIIESGHPDYKKGDLLWGIVAWEEYSVITPMTHAHFKIQHTDVPLSYYTGLLGMPGMTAYAGFYEVCSPKEGETVYVSAASGAVGQLVGQLAKMMGCYVVGSAGSKEKVDLLKTKFGFDDAFNYKEESDLTAALKRCFTNGIDIYFENVGGKMLDAVLVNMNMHGRIAVCGMISQYNLENQEGVHNLSNIIYKRIRIQGFVVSDFYDKYSKFLEFVLPHIREGKITYVEDVADGLEKAPEALVGLFHGKNVGKQVVVVARE

SEQ ID NO: 36174 - protein, 354 aa, Forsythia x intermedia
MAKVVNPRVEILASNGIQSIPKEYVRPQEELESIRDVFEEEMSDEGPQLPTIDLEGLDSDDKQVREKCHQELIKASKEWGVMHLVKHGISDELIDRVKMAGKAFFNQSVEKEKYANDQASGNVQGYGSKLANNASGQLEWQDYFFHCIFPEEKRDLSICPKTPTDYIPAISEYAKQLRDLTSKMLSVLSLGLGLEQGRLEKEVGGMEELLLQLKINYYPKCPQPELALGVEAHTDISALTFILHNMVPGLQLFYKGKWVTAKCVPNSIIMHIGDTIEILSNGKYKSILHRGLVNKEKVRISWAVFCEPPREKILLKPLPETVSEAEPSRFPPRTFAQHVMNKLFRKSEDSGETK

SEQ ID NO: 36175 - protein, 508 aa, Aspergillus oryzae
MGIFKNHRVYILTAVAYSGSLLFGFDTGVMGSVLALDSFKNDFGLSGSDGFADAANAQVSSNVVSLLTAGCFFGAIGASFLNDFLGRRYSLMILTVVFLIGAAIQVGASHQIGMIYGGRVVAGLGIGGMSSITPVFVGESAPPEIRGRIAGMFQEFLVIGSTFAYWLDYGVSLHIAPSTKQWRTPVAIQIIPGGLMLIGLFFLKESPRWLTSKGRHEEALQSLAYIRNEPASSEVVQTEMAEIRASIEEEQAATEGLTYKEFLQPSNRNRFMFAAVLMLCQQFSGTNSIGYYAPQIFQTIGLSATSSSLFATGVYGTVKVVATAIFLFIGIDRWGRKKSLIGGSIWMASMMFIIGAVLATHPPDTSASGVSQASIAMVAMIYLYVIGYSASWGPTPWVYLSEIFPTRLRAYGVGLGASSQWLFNFCVTEFTPHAVHNLGWRTFLMFGIFCVAMGVFIVFFAKETKGRSLEEMDILFGAVDENERRAAVEHTLNKGVVSHIEQAEDNKV

SEQ ID NO: 36176 - protein, 424 aa, Burkholderia mallei ATCC 23344
MAIVEVKVPQLSESVSEATMLQWKKKPGEAVAQDEILIELETDKVVLEVPAPAAGVLAQVLQNDGDTVVADQVIATIDTEAKAGAAAAAAGAADVQSAAAPVAAPAPAAQPAAAASSTAATSPAASKLMAEKGIGAGDVAGSGRDGRITKGDVLSAGSAPKAAPAAAPAKAAAKPALPEVKVPASATTWLNDRPEQRVPMSRLRARIAERLLESQQTNAILTTFNEVNMQPVMDLRAKYKDKFEKEHGVKLGFMSFFVKAAVHALKKFPLVNASIDGNDIVYHGYFDIGIAVGSPRGLVVPILRNADQLSLAEIEKKIAEFGQKAKDGKLSIEEMTGGTFSISNGGVFGSMLSTPIINPPQSAILGVHATKERPVVENGQIVIRPINYLALSYDHRIIDGREAVLSLVAMKDALEDPARLLLDL

SEQ ID NO: 36177 - protein, 476 aa, Burkholderia mallei ATCC 23344
MSKEFDVVVIGAGPGGYIAAIRAAQLGKTVACIEKWKNPAGALKLGGTCLNVGCIPSKALLASSEEFENAQHHLADHGISVDGVKMDVAKMLARKDGIVEKMTGGIEFLFKKNKITWLKGHGKFTGKSDAGVQIEVSGEGETQVVTAKNVIIATGSKARHLSNVPVDNKIVADNEGALAFDSVPKKLAVIGAGVIGLELGSVWRRLGAEVTVLEALPAFLGAADEALAKEAAKLFKKQGLDIHLGVKIDGVKTGANGVSIAYTDKDGNAKTLDADRLIVSVGRVPNTDNLGLEAIGLKANERGFIDVDDHCRTAVPNVYAIGDVVRGPMLAHKAEDEGVLVAEVIDGQKPHIDYNCIPWVIYTYPEIAWVGKTEQQLKAEGREIKSGKFPFSINGRALGMNAPDGFVKMIADAKTDELLGVHVIGANASDLIAEAVVAMEFKAASEDIARICHPHPSMSEVMREAALAVDKRSLNS

SEQ ID NO: 36178 - protein, 416 aa, Leifsonia xyli subsp. xyli str. CTCB07
MNPVPGRKAGHRSVKPHRRTPSNRAYTCRISGDPPTSSAGKSSRHSGGTHDRIHARAHFADPSSHGDPHADHQHLQRTARTRPRRGPSRTAPRLLHRHFRRPLGRLARCHRRVRAAGRLLVPAPHRRGPQPDLHPVRLPFLQGHEASHRQVFASGPTNARAGRLIATWLVGMSYQWWMIKHARHHANQNAKGKDPDIAFDTISFTEEDAARQRGLLAAITRRQGYLFFPLLLLEGVNLHVTSIRSLLSRGPVERRTAELVAIGLRLSTYITIVFLMLPLGMAFAFLGVQFAVFGVYMGASFAPNHKGMPLLPTGSRVDFLNKKVLTSRNIRGGWTMRMLMGGLNHQIEHHLFPSMPRPHLRRARELVRDHCATHGIPYTETSLVNSYRIIIRYLNRVGLAARDPFDCPAAHRFRRA

SEQ ID NO: 36179 - protein, 124 aa, Codonopsis lanceolata
MEHHQISISKVVKVDSKQTWDSLVIQAINQSSPIVAHFTASWCIPSVVMNPFFEELASTYKDTMFLLVDVDDVQEVASKYEVKAMPTFVLMKEGAQVDKLIGANPDEIRKRIESLIQSNPICVA

SEQ ID NO: 36180 - protein, 471 aa, Methanopyrus kandleri AV19
MEYGCLIGGEWLEGDREIVVENPYDGSEVGRVLAPEVDVEALLKDAREGQRRWRERPTYEVREALAEAAHLLKKHEDELAELIALEGGKPIRDARYEVYRTREVLRLSAAEAERLYGETLPGDAQRGRTAELILTVREPVGVVLSITPYNFPLLLPTHKLGPALAARCSVVHKPATVTPLSSLRLAEILLDAGVEPLALQVVVGPGAELGEELARADFDALSFTGSRSVGEHLREISPIPRITLELGGNDPVIVDETADVEAAAEAAVRGACYHAGQVCIAVERAIVVEDVYEEFLEAAVEVAESLKVGDPLDEDTDVGPLIDDGAVEKVRRHVEDAVERGAEILTGGEPEGRLFPPTVLADVPEDALVAREETFGPVLPVIRAKDFEEAIRIANSTDYGLHAAVFTERLDRAVKATRKLEAGGVIVNESTIYRADYMPFGGVKASGVGREGVPQAVREFTEEKTVVIGRR

SEQ ID NO: 36181 - protein, 590 aa, Psychrobacter arcticus 273-4
MDVQTNLFSKNTMPIALYSSEQLYAMEQAWFAQGNGSFGLMQQAAWQMAQHIESLYEKKCLNKQLTKQGITSRFNTSQRRASIWVGIGSNGGDGWLIAYYLQQRGWQVQVIAVGFEKQDFVVKGNLEISADENKKSITAAARALQLALSVDCEYQCFKSSDNNTNDTSVRALQANVYIDALFGIGFNRAPNNMYQQAICAFNAAAENAQALVIAVDIPSGLVASTGQVFERIAIVADTTLCLIARKFGLHTKDGLDYSGAVIDIPLIPYQVNNEKLIPVATLITSAHSLKPRRQNSYKGSYGHVLVIGGNRIEGSQGMGGAAILSASSAMATGAGKITVACHEVFHGALLTSLPDAMTIDLHDKDGINRLIGQASVIAIGMGLGRDEKAKIVFISCIEAAIAVGKPIIIDADGLYHLASLHSKNHKLIAELKTHSATHQVCLTPHSGEAARLLNKKINEIENDRLAAIKQCAAIYGGDWVLKGAGSLVLEQQSGQAHIYVCGVGNAGMATAGMGDVLAGVIAGLLAQEDLKHELRSLHQAVLIHGLTGDILVNQTSSNDDNSLLVGQRGLQAQDMPAAIRHVMQLITDSL

SEQ ID NO: 36182 - protein, 413 aa, Wolbachia pipientis
MDKKALLELSNGSKIDLPVLSGTVGPDVLNIKDLYKKTGLFTYDPGFVSTASCSSTITFIDGDEGVLKYRGHNIADLAENNNFTAVIYLLLYGKLPSSEQHKKFLLKIQESSKVSEQVTNVIKAFPKTAHPMSILVACFANLSASYHEMHGKNVNGEDLDFGISAIAKVPAIVAMIYRHINNQEFINANNKLSYSENFLNMIFGSAVNNTLFVKALDKIFTLHADHEQNASTAAVRLVGSAGSNLFASLSAGVATLWGPAHGGANEAVINMLKEIEQSGDVDRFIEKAKDDKDPFKLMGFGHRVYKNYDPRALILKDACHEILSKLEQNNELLEIAKKLEEIALKDEYFITRKLYPNVDFYSGIIMNAIGIPSSMFTPIFALARTTGWVAQWYEMINDKETKICRPRQLYLGK

SEQ ID NO: 36183 - protein, 231 aa, Zea mays
MTTSPPPAEQEQQEEEEVLVPHGPHQELPNGAQPMEVVPAEPAATVENQQIEDPPISRFTWTIENLSRVSTKKLYSEIFVVGGYKWRILIFPRGNNVEFLSMYLDVADSGVLPYGWTRYAQFSLSVVNQIHNKFTIRKETQHQFSARESDWGFTSFMPLGELYNPSRGYLVNDTCIVEAEVAVCKVVEYWSYDSKKETGYVGLKNQGATCYMNSLLQTLYHIPYFRKAVYH

SEQ ID NO: 36184 - protein, 481 aa, Brassica napus
EKKLIRKNPPEKNSQRTKREFPRMPSPPTTTSLSVTQTINGSHSFTIKGYSLAKGIGIGKHIASDAFTVGGYEWAIYFYPDGKNPEDNSAYVSVFIALASDGTDVRALFELSLLDQSGKGKHKVHSHFDRALESGPYTLKYRGSMWGYKRFFRRTLLEASDYLKDDCLKINCTVGVVVSEIDCPRLHSIHVPASDIGSHFGMLLENEDGSDITFNVSGEKFRAHRLVLAARSPVFESEFLDVIGEEEGREIEVTDMEPKVFKALLHYIYKDALIEDAESASSSGSSVGPSASDTLAAKLLGAADKYKLPRLSLMCESVLCKDISVDSVANILALADRYNASALKSVCLKFAAENLIAVMRSDGFDYLREHCPSLQSELLKTVAGCEEELSGGGGGGGKTRSVWGQFSDGGADTNERSVRQQQQQHAGGEVNGAERSQSVGVQVVNANASGRNNDDDNNNENGDDDDDPREEDGANKRVIRR

SEQ ID NO: 36185 - protein, 232 aa, Prunus avium
MDMIYSQLSDLASMENPDTSSFSDASVTARRASLSDEEVILASSCPKRRAGRRVFKETRHPVYRGVRRRNNNKWVCELRAPNNKKARIWLGTYPTAEMAARAHDVAVLAFRGKLACLNFADSAWRLPVPASTDAAEIRRAATEAAEAFRQAEDGGVDEKESKAVVSEEKGCVGMEGSSNLFYLDEDEIFEMPRLLDDMADGIMLCPPQCLDGYMDWNDVETVDDLKLWSFSI

SEQ ID NO: 36186 - protein, 690 aa, Oryza sativa (japonica cultivar-group)
MEEVGYGAHAVVYRALFVPRNDVVAVKCLDLDQLNNNIDEIQREAQIMSLIEHPNVIRAYCSFVVEHSLWVVMPFMTEGSCLHLMKIAYPDGFEEPVIGSILKETLKALEYLHRQGQIHRDVKAGNILVDNAGIVKLGDFGVSACMFDRGDRQRSRNTFVGTPCWMAPEVLQPGTGYNFKADIWSFGITALELAHGHAPFSKYPPMKVLLMTLQNAPPGLDYDRDRRFSKSFKEMVAMCLVKDQTKRPTAEKLLKHSFFKNAKPPELTMKGILTDLPPLWDRVKALQLKDAAQLALKKMPSSEQEALSMIRDDEPPEIKEDDDTARTIEVEKDSFSRNHLGKSSSTIENFFSGRTSTTAANSDGKGDFSFEAFDFGENNVDTKIMPNGYENARSENSSSPSTSKQDPESKYWRSTSGQKQQTSGTPAVHSGGVNSSTTEKGHGVERDATVQLASDKLRTETRRATNLSGPLSLPTRASANSLSAPIRSSGGYVDSLGDKSKRNVVEIKGRFSVTSENVDLAKVQEVPLSSLSRKSPQASPLKKSASVGDWLVNTKPMSNSHHVKELCNSSVSSSILIPHLENLVKQTMFQQDLIMNVLSSLQQNEKVDGVLSGISPQLRNTDSDTMVGSVNSEKERSLLVKISELQSRMITLTDELIAAKLKHVQLQQELNALYCREEIEDIRDDDNEET

SEQ ID NO: 36187 - protein, 256 aa, Cryptococcus neoformans var. neoformans JEC21
MSNREDSVYLAKLAEQAERYEEMVENMKSVASSDQELTVEERNLLSVAYKNVIGARRASWRIVSSIEQKEESKGNEAQVAMIKAYREKIEAELAKICEDILEVLDKHLIPSAASGESKVFYHKMMGDYHRYLAEFATGDKRKDSADKSLEAYKAASDVAVTELPPTHPIRLGLALNFSVFYYEILNSPDRACHLAKQAFDDAIAELDTLSEESYKDSTLIMQLLRDNLTLWTSDMNEPEKEEKPEETKQEEVAPAA

SEQ ID NO: 36188 - protein, 360 aa, Arabidopsis thaliana
MAKFGEGDKRWIVEDRPDGTNVHNWHWSETNCLEWSRNFFTKQFSGVDILSGEGNLFIKVSKIEKVEGEAYVNVRKGKIIPGYELNVSLSWEGEAKDSDGKTLLKADGLVDMPYISDENADEDPEIRFSVKDEGPIGRTLKEAMVKKGKEIILEKVRVYVEAMARGGPCRDELESKKVAPKSVAAGSATVAVEKSGAAPVVSAAAVESKVVKEKKKAKTKEGFKTITMTEKFNCRARDLYEILMDENRWKGFTQSNAKISKDVNGPISVFDGSVTGINLELEEGKLIVQKWRFGSWPDGLDSTVKIVFEEPQPGVTIVNLTHTDVPEEDRYGNATVVENTERGWRDLIFHRIRAVFGFGI

SEQ ID NO: 36189 - protein, 324 aa, Pseudomonas syringae pv. tomato str. DC3000
MNQSSDLIQSAQRTIRLEIEAIQGLLERLDGDFVRACEMILASKGRVVVVGMGKSGHVGKKIAATLASTGTTSFFVHPAEASHGDMGMITRDDIILALSNSGSTHEIVTLLPLIKRLGIKMISLTGDPESILARAADINLNAHVVHEACPLNLAPTSSTTAALVMGDALAVALLDARGFTAEDFAFSHPGGALGRRLLLKVENVMHSGDALPSVQRGTLLRDALLEMTRKGLGMTAILEADGTLAGIFTDGDLRRTLDRPVDIRQTTIDEVMTLHGKTAHADMLAAQALKIMEDNKISALVVVDQNDKPVGAFNLQDLLRAGVM

SEQ ID NO: 36190 - protein, 384 aa, Oryza sativa
  misc_feature (303)..(303): Xaa can be any naturally occurring amino acid
MAIVDLVNAGEQQQMGSKRAAAEDGDGGVDDSREYYCRRGVRHLCDSGITRLPGNYVLPASDRPGQAAGAAAAAGGSVKLPVVDLSRLRVPSERGAVLRTLDAACREYGFFQVVNHGVGGEVVGGMLDVARRFFELPQPERERYMSADVRAPVRYGTSFNQVRDAVLCWRDFLKLACMPLAAVVESWPTSPADLREVASRYAEANQRVFMEVMEAALEALGVGGGGVMEDLAAGTQMMTVNCYPECPQPELTLGMPPHSDYGFLTLVLQDEVAGLQVMHAGEWLTVDPLPGSFVVNVGDHLEXILSNGRYRSVLHRVKVNSRRLRVSVASFHSVAPERVVSPAPELIDDRHPRRYMDTDLATFLAYLASAAGNHKSFLHSRRLY

SEQ ID NO: 36191 - protein, 309 aa, Bacillus cereus ATCC 10987
LFFVYNIEMLYMNRGRDVMSKFTVASNGSLETTLRGVEVLSTPLLNKGVAFTQEEREELGLKGLLPPAVLTLEEQARRAYEQFCSQPDDLLKNVYLTALHDRNEVLFYRILTDHLREMLPIVYTPTVGVAIQRYSHEYRKPRGVYLSINDPSGIEEAFANIGATAENIDLVVVTDGEGILGIGDWGVGGINIAIGKLAVYTAAVGIDPSRVLPVILDVGTNREELLNNPFYIGNRHPRITGEAYDEFIDTFVRAVNKQFPKALLHWEDFSSRNARKILDKYRHDICTFNDDIQGTGAVSLAAVLSAVKA

SEQ ID NO: 36192 - protein, 1113 aa, Corynebacterium glutamicum ATCC 13032
MPKRSDINHVLVIGSGPIVIGQACEFDYSGTQACRVLKEEGLRVTLINSNPATIMTDPEMADHTYVEPIEPEYIDKIFAKEIEQGHPIDAVLATLGGQTALNAAIQLDRLGILEKYGVELIGADIDAIERGEDRQKFKDIVTTIGGESARSRVCHNMEEVHETVAELGLPVVVRPSFTMGGLGSGLAYNTEDLERIAGGGLAASPEANVLIEESILGWKEFELELMRDTADNVVVICSIENVDALGVHTGDSVTVAPALTLTDREFQKMRDQGIAIIREVGVDTGGCNIQFAINPVDGRIITIEMNPRVSRSSALASKATGFPIAKMAAKLAIGYTLDEITNDITGETPAAFEPTIDYVVVKAPRFAFEKFVGADDTLTTTMKSVGEVMSLGRNYIAALNKALRSLETKQQGFWTKPDEFFAGERATDKAAVLEDLKRPTEGRLYDVELAMRLGASVEELYEASSIDPWFLAELEALVQFRQKLVDAPFLNEDLLREAKFMGLSDLQIAALRPEFAGEDGVRTLRLSLGIRPVFKTVDTCAAEFEAKTPYHYSAYELDPAAESEVAPQTEREKVLILGSGPNRIGQGIEFDYSCVHAALELSRVGYETVMVNCNPETVSTDYDTADRLYFEPLTFEDVMEVYHAEAQSGTVAGVIVQLGGQTPLGLADRLKKAGVPVIGTSPEAIDMAEDRGEFGALLNREQLPAPAFGTATSFEEARTVADEISYPVLVRPSYVLGGRGMEIVYDEASLEDYINRATELSSDHPVLVDRFLDNAIEIDVDALCDGDEVYLAGVMEHIEEAGIHSGDSACALPPMTLGAQDIEKVREATKKLALGIGVQGLMNVQYALKDDILYVIEANPRASRTVPFVSKATGVNLAKAASRIAVGATIKDLQDEGMIPTEYDGGSLPLDAPIAVKEAVLPFNRFRRPDGKTLDTLLSPEMKSTGEVMGLANNFGAAYAKAEAGAFGALPTEGTVFVTVANRDKRTLILPIQRLALMGYKILATEGTAGMLRRNGIECEVVLKASDIREGVEGKSIVDRIREGEVDLILNTPAGSAGARHDGYDIRAAAVTVGVPLITTVQGVTAAVQGIEALREGVVSVRALQELDHAVKA

SEQ ID NO: 36193 - protein, 141 aa, Yersinia pestis CO92
MVSAPLPYIKPGERVIIYDGVCALCTGWVNFLIRHDRRHTVRLSAVQSKKGHALLEWAGLPTDKINTLVLIENQQVYLRSEAIFRVIANLPWPWRILGVLRIFPRPLRDRCYDGIALNRYRLFGRYDAVRKLKADHERRFL

SEQ ID NO: 36194 - protein, 352 aa, Zea mays
  misc_feature (63)..(63): Xaa can be any naturally occurring amino acid
  misc_feature (83)..(83): Xaa can be any naturally occurring amino acid
  misc_feature (106)..(106): Xaa can be any naturally occurring amino acid
MAPELMTAKMTAKKAAAAAAAAAAAKPATRAYVTFLAGDGDYWKGVVGLAKGLRKVRSAYPLXVVAVLPDVPESHRRILVSQXGCVVREIEPVYPPENQTQFAMAXYYVINYSKLRIWEFVEYERMVYLDADIQVFENIDGLFELEKGYFYAVMDCFCEKTWSHTPQYRIGYCQQCPDKVAWPAATAELGPPPSLYFNAGMFVHEPSVATAKALLDTLRVTPPTPFAEQDFLNMFFRDQYRPIPNVYNLVLAMLWRHPENVQLEKVKVVHYCAAGSKPWRFTGKEANMDREDINALVKKWWDIYNDETLDLKGLPSLSPDDDDEVEAVAKKPLRAALAEAGTVKYVTAPSAA

SEQ ID NO: 36195 - protein, 506 aa, Methanopyrus kandleri AV19
MFRLGTTPRATTYDPDARIGEVASRFGLPTRVLIEIVRTESFQRSLRRVTSGKPVVLDLRELDSDLASWIATHARLVEPALRELVRTVAPDVEPRVRFRGLPHRFRRVERIRPMDGALISIEGVVREVRGAERLEHAIVDTGSELVAVRLHGHRLGPGLRVEILGIVRSATLDALEVHKKDPIPEVHPDPAELEEFRELADKDPLTTFARAIAPLPGAEEVGKMLALQLFSCVGKNSERLHVLLAGYPVVCSEILHHVLDHLAPRGVYVDLRRTELTDLTAVLKEDRGWALRAGAAVLADGGILAVDHLEGAPEPHRWALMEAMDKGTVTVDGIALNARCAVLAAINPGEQWPSDPPIARIDLDQDFLSHFDLIAFLGVDPRPGEPEEQDTEVPSYTLLRRYLLYAIREHPKPELTEEARKRLEHWYETRREEVEERLGMGLPTLPVTRRQLESVERLAKAHARMRLSDDVEPEDVDIAAELVDWYLETAMQIPGGDEIRISSLKP

SEQ ID NO: 36196 - protein, 262 aa, Glycine max
  misc_feature (141)..(141): Xaa can be any naturally occurring amino acid
MATLTTAFVPSKLNPLHSGYQVSPFAHITPLRKKINQPVARLFGPAIFEVSKLEVLFLGMDQKKHPADLPRTYTLTHSDITSKITLSISQTINNSQGMPQLMDGGCDSYKNRAWTNTGLDTRQLQGWYNKLQRDEVVAHWXKLKGKMSLHVHLHVSGGHFLLDMCASIRYFIFRKELPVVLNAFSHGDKNLFKDYPELHDALVWVYFHSNISEFNKVECWGPLKDACAFPSGSHEVVIDGAPQSCQENCECCFIPMSSITWS

SEQ ID NO: 36197 - protein, 350 aa, Leifsonia xyli subsp. xyli str. CTCB07
MLIERKTPMRAAVVTSFTEPIVVEDVPLPTPGPGQVLVRIETCGLCHTDIHAAHGDWPVRPSLPFIPGHEGVGRVTALGEGVTAPAVGTRVALAWLGSACGSCRYCETGRENLCVSQQNTGYSIDGAYAEYAVADARFAVPVPDSVSSMDAAPLTCAGVTAYVAVKTARVRPAERVVVFGVGGLGHLAVQYARLVGAEVIAVDVTDEKLALATELGADHVVNARTSDPVQEIHALGGADAVIVLAVAPAVFDQAFRSLSRGGRLILVSLPANGVMGIPVFETVLNGITVAGSIVGTREDLAEVFRLQALGRTRVIAQPRELEQAPEAMQEVLDGTVPARLVFDLAHVGSH

SEQ ID NO: 36198 - protein, 449 aa, Listeria monocytogenes EGD-e
MEKHYDYIAIGGGSGGIASINRAAMHGAKCALIEPKFLGGTCVNVGCVPKKVMWYGAQIKEAMDLYADAYGYQVDASFNFQKLVENREAYIERIRGSYKNGLDNNNVDWIKGYAEFVDEKTLRVNGELVTADHILIATGGEPALPSIPGAEFGITSDGFFALKELPKKVAVVGAGYIAVELAGVLQQLGSETHLFVRKHAPLRNFDPLLTDTLTEIIEQSDMTLHKHAIPQKVEKNPDGSLTLSLEDGRTETVDTLIWAIGRKPVIKGLQIEKSGVELLESGHIAVDKFQNTNVAGIYAVGDVTGHYELTPVAIAAGRRLSERLFNNKKDAHLNYENIPTVVFSHPAIGTVGLTEPEAIEKYGKENIKVYTSSFTSMYTAITDHREPCRMKLICEGKTERVIGLHGIGYGVDEMIQGFAVAINMGATKADFDNTVAIHPTGSEEFVTMK

SEQ ID NO: 36199 - protein, 299 aa, Thermosynechococcus elongatus BP-1
MLMLIGSQEGTAHLPLAVMNPQEYALVLDPGYPSHVGGVYLAGGQVYPLPLRSEDHFLPDLAAIPLAVREQAKLLILSYPHNPTTAVAPLDFFKTAVEFCDRHGILLVHDFPYLDLVFDGERAPSIFEVDRDRQVGIEFYSLSKSYNMGGFRIGFAIGRADIIAALRQIKSVIDFNQYAGILRGAIAALTGDQTCVQQTREIFRQRRDVFVQALGDHGWPVPLPPATMYVWAQLPAPWQRDSLGFCQALVQATGIAAAPGSGFGQGGEGYVRFALVRDRPCLEVAAAQIAAFSQTVPKV

SEQ ID NO: 36200 - protein, 240 aa, Prunus avium
MDMFFSQLSDSVDQPQSSLLSDASVTTRGASCSDGDVILASSRPKKRAGRRVFKETRHPVYRGVRRRNNDKWVCEMREPNKKKSRIWLGTYPTAEMAARAHDVAALAFRGKLACINFADSAWRLPVPASMDTMDIRRAAAEAAEGFRPVEFGGVCSGSSDEKERMVVQVEEKNKKGSVNLERSRSLSLSYWDEEEVFHMPRLLHDMAEGLLLSPSQCLGGYMNLDDMGTDADVKLWSFSI

SEQ ID NO: 36201 - protein, 375 aa, Rhodococcus sp. RHA1
MSEHQVAIVGAGTSGVAAAVALADRGINPLLIDRADQVGSSWHSRYDRLRLNTGRQFSHLPNRPYPKGTPTFPTREQVIEHLERHARADGIELRLGCPVERLDLTDGHWRLTTAAGSVDAAEVVVATGFDHEPFVPDWPGRGDWRGALVHSSQYRNPSQYNGKRVLVVGAGCSGMEIAYDLATGGAAKVWLSARTPPNIMLRQGPGGIPGDFIATPLYHAPVPIADAIARFGRERSIGDLREFGLPIPDEGIFARSARLGVAPAIVDKELIAAIRDRSIEVVRGVESLDADSVWLVDGVRIDPEAMVCATGFRQELEKLVGHLGVLDERGWPHATGEKPAAERLRFIGFVPRPSQIGFAAKQARRAARAIARELR

SEQ ID NO: 36202 - protein, 1764 aa, Cryptococcus neoformans var. neoformans JEC21
MSHHPQLSVSTGSAGAGPSTPTLPRRPQGARRRGVMPGLFIANPDNSDEENSPPKAGSQRSSSGVSPISVSSSSGRGGPSSVSIPQPASPSHSIKERGSLPYPSIPAPQSSPLPSISAFPSPQPLIPTPSPAPIAYGHTPEISSGPPQPPPQPQRHLQRAFTTATPENAPRLLPEPRSSSTGTTSFHQQVNNSPSRALPSLPSPITRQSTMPSPVSQSPSTSHGQPYSAPPAYHPHDPTRVASPDDVMSPATGSEHGSIMSAGIGHRNRSASVQGQQVRLQVTTDNEAFHLVDITGINTAEGIREKVFSKLRIRDEDYPTLSMYRTEIGEPADETPILPAALLNICRTLGDSRASLKFLVKQTDVPPSSAASVIPPVSQTDYHPFRAASDPRRAGVPPITTDLPNPVLYRVSSRHSKEGKDWSGPGLSRSTRKSVLQNAGVRLSTSTGGSRSPVTEHSASLGTSSPALPTPPIPPHSTSLQAGEPSIHSSPSSRPSSRHYEFNELSLPPQFDHFKPSNAISVFPRPGTPISDSYQNENAFAGPSRPVMNQEQGSQGLGLTLDDDIDPETRALIEQFQREEQEAQKKEEERRRQLEADEELAKREQQSERELWEMMQQMQKEQRQREQAQIAEDEARARQVEEEQRQEEEQRQALEAARTAWEAEQREQRDQREQREQQESRFHTFEKDRRQRQQFFQNRARMGAPLDDSATWESTWMVGPSAEGSLSSRRPSEGRMPMVQTSAPRTSQTQSPALPPRQSSQPIYQPSQSQYLPDFAYSHRRPSGFPNTSYAETSHAQERLHDPRLQQATGRAPAPGQRGGTSNTPRPESQRLRHPFSYAAHEPSNERLQAPALSTARSVDNLRMTNGPLGMTSRQSQVYGPPRTSITPAPGFAEHRNIQPASATATSYRSPSSDRARDGRYPEPLHSSSRVATPMAPAIIDTGLVPFPSPHPNSAASSNSWRGHTPQFNSLPRSARGPTFDITRPNTVHYDRSPPPPTSPETAIPPRRPSTYYDEFHPPDTARTIVEDGATIRRPSSPFPWGDRARSGNASTPYRTASPVPVDQPRTSETNTFDDTDSQLPYAHNASPQSSWLSVSRAGAHRSDSDTLSVAGTVSSEATVRPGKGMGEDNDTNSGDTAKAGQWDRHLKEMIAKMGPGGGEGTVRPRKEEEEDEATLFITPPVRAPETSSSRTNAIRPSPSKPNLIVNTASLSQQAYDQVNPVLSASTPSDSATESEGTGEGDGEIEGSNIKRGKSFARPRDPNQWNFRPEPEQLYENLDRVFPQIDLDRPIVQGAESTPSTPGIESPSRVEIIGGLPLPAGAAPGRQGGPQAGSGPLGRAPQATGPSSAPTGAFNRSKFNKAENRRSIRVVADHKRRTLQRQVSRHEDLPPEYDVGAEEVNSAMDDQVVDPRSEEQRKKDNRRSSSMWDHKLVEVTRFARAQANREADIPESPASDGKPGTVNWVKGELIGKGSYGRVYIALNVTTGDMMAVKQVELPATEIERHDSRQQGMVKALRDEIELLKGLEHKNIVAYLGYETSPEYLSIFLEYVPGGTIASIYRTPNQARFEPQLVRFFTEQILEGLAYLHSKNIWHRDLKGDNILVDAQGICKISDFGISKQTADAYDSFGQATNMKGSVFWMAPEVIHSYSERSYSGKVDIWSLGCVVLEMWSGKRPWGDMEQFAAMFELFNKRSRPPLPPDINLSSVALDFLNEKCLATDPRNRPMARDLLQHEFIKNRDLTWTFKDSKIGKAVAKRGAKRPQA

SEQ ID NO: 36203 - protein, 403 aa, Lactobacillus johnsonii NCC 533
MAKLIVSDLDLKGKKVLVRVDFNVPIKNGVIGDDNRIVAALPTIKYIIDHGGKAILLSHLGRVKSDADKKELSLRPVAERLSELLEKPVTFVPENEGKEVEEAIDNMKDGDVVVLENTRFQDIDNDFGKRESKNDPKLGEYWASLGDVFVNDAFGTAHRSHASNVGIATAMKKAGKPAAAGYLLEKEIKFLGDAVENPVHPFVTILGGAKVSDKIGVIENLIPKSDHILIGGGMAYTFLAAQGHKIGKSLFEADKVELAKSLLEKAGDKIVLPVDNVAATEFSNDAPHEIVGDDIPDNEMGLDIGPKTVEKFRDILKDAKTVVWNGPMGAFEMPNYAEGTLEVGRALADLKDAVTIIGGGDSTAAAKQLGIAPKISHISTGGGASLNYLEGKELPGIACVSDK

SEQ ID NO: 36204 - protein, 251 aa, Lactobacillus johnsonii NCC 533
MRTPIIAGNWKLHMNPEQTIEFVNAVKGKLPDPSKVESVIAAPAVDLYVLKKTAEGSNLHTGAENAYFEVEGAFTGETSPKVLNEMGIDYCIIGHSERRGYFHETDEDINKKAKALFANGVTPIICCGESLETREANKQDEWVVAQIKAALDGLTAEQVSKLVIAYEPIWAIGTGKTASADQAEEMCKTIRETVKDLYNEETAENVRIQYGGSVKPANVKELMSKPDIDGGLVGGASLDPESFLALVNYQD

SEQ ID NO: 36205 - protein, 130 aa, Oryza sativa
MDHEADAYRTDLMTITRYVLNEQSRNPEARGDLTILLSHIVLGCKFVASAVNKAGLAKLIGLAGETNVQGEEQKKLDVLSNEVFVKALVSSGRTCVLVSEEDEEATFVDPALRGKYCVCFDPLDGSSNID

SEQ ID NO: 36206 - protein, 271 aa, Solanum bulbocastanum
MLTCITCKQKIEDDGGEEGPRGRAPTPHTKDSIKSLTAQIKDIALKVSGAYKCKSSTPAGTYRKGHRPYPDFDTISEGVPYPFQPASSSSTPAWDFTSAGNLRTPRPDSRFARGFSGGGGGAESISQSGDVVVEDDGQKDWTAHVEPGVQITFVSLPNGGNDLKRIRFSRDMFNKWQAQRWWGENYDRIMELYNVQRFNKQALNTPGRSEDGLSAKFTEKLKYKANQFPLHWLVTLIKVISQLYSSSHLLFSTGKKLYFCALKINNSTKFT

SEQ ID NO: 36207 - protein, 453 aa, Pseudoalteromonas tunicata D2
MAQHFDYIAIGGGSGGIASANRAAMRGAKVALIEAKHMGGTCVNVGCVPKKVMWHGAQVAEAIKLYAPDYGFDVEIKNFNWSKLLESREAYIGRIHQGYDKYLASNGVTVIKGFAKFVDEKTIEVNGEHYTADHFLIAVGGRPSIPNIPGAEHGIDSNGFFELKTQPKRVAVVGAGYIAVELAGVLNGLGTQTQLFVRQHAPLRSFDPLIVDTLKEVMAAEGPQLHTHATPSKVVKEADGSVTLHLENGESHNVDQLIWAIGRHPATDAINIQAAGVALNDRGYVIVDEYQQTSTANIYAVGDIVEGGVELTPVAVKAGRMLAERLFNQAMPNAKMDYNLVPTVVFSHPPIGTIGLTEPEAIEQFGKDDIKVYTSSFTAMYTAVTQHRQPCKMKLVCQGPNEKIVGLHGIGFAVDEMIQGFAVAMKMGATKADFDSVVAIHPTGSEEFVTMRG

SEQ ID NO: 36208 - protein, 365 aa, Bacillus subtilis
MKKRIALLPGDGIGPEVLESATDVLKSVAERFNHEFEFEYGLIGGAAIDEHHNPLPEETVAACKNADAILLGAVGGPKWDQNLSELRPEKGLLSIRKQLDLFANLRPVKVFESLSDRSPLKKEYIDNVDFVIVRELTGGLYFGQPSKRYVNTEGEQEAVDTLFYKRTEIERVIREGFKMAATRKGKVTSVDKANVLESSRLWREVAEDVAQEFPDVKLEHMLVDNAAMQLIYAPNQFDVVVTENMFGDILSDEASMLTGSLGMLPSASLSSSGLHLFEPVHGSAPDIAGKGMANPFAAILSAAMLLRTSFGLEEEAKAVEDAVNKVLASGKRTRDLARSEEFSSTQAITEEVKAAIMSENTISNV

SEQ ID NO: 36209 - protein, 221 aa, Brassica napus
  misc_feature (200)..(200): Xaa can be any naturally occurring amino acid
  misc_feature (209)..(209): Xaa can be any naturally occurring amino acid
PKQKHFTISIEKGEEIVDSFEGSEVKWSYVQSEKEKGEQVKRHYELTFEKKLREKITSSYLTHVVAESEEIKRSLRVVKLYSKDLYETDDDDGCAGGNWGCISLEHPSTFETLAMDPNAKKKIIGDLDRFLKRREFYKRVGKAWKRGYLLYGPPGTGKSSLIAAMANYLKFDVFDLELSSIYDNGQLKRILLSTTNRSIXLVFEDIDCXSEVRDRETDDDD

SEQ ID NO: 36210 - protein, 413 aa, Oryza sativa (japonica cultivar-group)
MAFAARRSLASRLSHHLTRRLHPATAPHLLTSQSDDDPLPPPELPPFPQSPSPRHPRAGQALDRHLLPFSLHHLAGLRRRGFSSAAGEVDAAAGVLADAAAAAEAVPAPFPGEVAAAAADSFFPVAALQHVIDYIHTFTGLNWWACIALATVLIRSATVPLLVNQLKATQKLNAIRPEMEAIKEEMNAMDPKSAKEGKAKMTALFQKHGVSPFTPLKGLLIQGPIFMSFFFAIRNMIDKVPSMKGGGSLWFTDLTTPDPLYILPVLTALIFLVTVELNLQEGMEGNPMARKMKNFSRGMAVLTVPFTMSFAKGIFCYWITSNLFTLTYGFVIRRPAVRKFCNLPALEAQSASAKKQMFNLFGGSKALTTAESPVAITGGPQSSLEQPDAAALGYRVKNPEKKAKSRGKSRRRR

SEQ ID NO: 36211 - protein, 728 aa, Pseudomonas aeruginosa UCBPP-PA14
MTSITPVTLANCEDEPIHVPGAIQPHGALIALRADGMVLAASENIQALLGFVASPGSYLTPEQVGPEVLRMLEEGLTGNGPWSNSVETRIGEHLFDVIGHSYKEVFYLEFEIRTADTLSITSFTLNAQRIIAQVQLHNDTASLLSNVTDELRRMTGYDRVMAYRFRHDDSGEVVAESRREDLESYLGQRYPASDIPAQARRLYIQNPIRLIADVAYTPMRVFPALNPETNESFDLSYSVLRSVSPIHCEYLTNMGVRASMSISIVVGGKLWGLFSCHHMSPKLIPYPVRMSFQIFSQVCSAIVERLEQGRIAELLRVSTERRLALARRARDADDLFGALAHPDDGIAALIPCDGALVMLGGRTLSIRGDFERQAGNVLQRLQRDPERDIYHTDNWPQPSEDSPDGGDCCGVLAIRFHRQESGWIFWFRHEEVHRIRWGGKPEKLLTIGPSGPRLTPRGSFEAWEEVVRGHSTPWSETDLAIAEKLRLDLMELCLNHAAEVDRMRQRLIAVLGHDLRNPLQSISMAAALLSSSDTRTTELRQHISASSSRMERLVSQILDMSRLQSGIGLTVNPVDTDVSQLVQQIVCETDVAYPGLVIEIAIDPQVRAVVDPDRYAQVAANLLSNARHHGLPGRPVLVTLTRQGDEVCLSVLNETSGLSEAQLANLFEPFKRESADNQRNRNGLGIGLYISQAIAQAHQGRIDVDCRDDVITFCLRLPVRQAETGSSS

SEQ ID NO: 36212 - protein, 67 aa, Zea mays
PSPYNPLKSSFFKTFGAPFPQRGLFSKFLLLGGGFFLAYVRGWGSPALFPIKKGLQDPPQPGPRGKI

SEQ ID NO: 36213 - protein, 317 aa, Clostridium acetobutylicum ATCC 824
MKIFRKKSLDKMMVSAEKTHLKKTLKTKDIAALGIGAVVGVGIFVATGTGAHKAGPGIIISFLLAGIVACLCGLCYSELATMFPVSGSTYSYAYITFGEIVAMIVGWCLTSEYLVACSAVASGWSGTFIGILKNAGIVLPKVITASPSKGGIVDLPAVLITLILTYILYYGMKESSRVNNIIVIVKIAIIVMFLVLGATHIKMTNYKPFAPFGFKGIFAGASVIFFSYIGFDAISTTAEEAENPGRDVSRGLIICLAVVSILYISVAFVLTGMVHYDKIVTEDAVPAALASVGIRWGSALVGIGAILGMISTMIAVL

SEQ ID NO: 36214 - protein, 94 aa, Triticum aestivum
  misc_feature (16)..(16): Xaa can be any naturally occurring amino acid
  misc_feature (35)..(35): Xaa can be any naturally occurring amino acid
  misc_feature (83)..(83): Xaa can be any naturally occurring amino acid
MGFIMDFAENLILRLXEDPDKRDQVRREHVYKMKXERCERTKAAWSLPLRPYGFWTFDRFNSQLSWDSQISQAAGRRDPYDDXIARHSGSPPSS

SEQ ID NO: 36215 - protein, 426 aa, Aquifex aeolicus VF5 [sequence omitted]

SEQ ID NO: 36216 - protein, 969 aa, Oryza sativa
MTTLQLDPPVVPARRSAATSCDLHPDETFTGFCTACLRERLAGLEASAAAASAPGRKSTSAIRSLFARPFGGGAGGSSVAGAGASLPDLRRCKSFSCGRGGDALAAAAAAAAAGTARADEPQRRSCDVRGHSTLWSLFHQDDRGRVPSSSSAADIAPPHQQPPPPPPRPFIPDDFLDEDIPVVMEHDEIMPVVEPVIVVDTSGEIETEPNVVAREGKAMKDHMDFESSQPKKPPTKDLKESFWVAASVFSKKWQKWRRKQKLKKEAAVSKAAAAAMPPPEKPSKPSFLRRRRLRGEAGSELAGGRRSCDTDPRFSLDAGRMSVDDAGFSWDEPRASWDGYLFGAGAGIGLGRAPPPLSRLPPMMSVLEDTPATIVERSDGQIPVEDDADIDPPGGSLQTRDYYLDSSTRRRRSLERSSSVRRPSFEVTEPKPAPTTIANGKESPLGGSEFYHFHHAEDLLDRGFSSNSLIEDISASLEAALSGPGSAKKPRRWRKAWSLWGFIHRRASGRRSGGPSDIADRSFSEAWPDLRVRGYNPKMQRCNSNLSARSSFSSNSGGLGSSRRSHVDVNGSSARRREEHVLERNRSARYSPPGRVDNGMLRFYLTPMRSGGGGGGGRARVAAASETVKGGTRLALIVSMRRCLALPLELRVDLGWSSADADTASHTAWRPHRRCVLSDELLASIAPVVLAAAHGHGNRPTQERTDHSGIDRNDGKDKHETAGQSSAPASAAPTKNHDEPAGVASPVSRQKRHGFRRAELGSTSTRRVQWHPARCPPEGPNARLATGRRNVSHVFGRRTSSRVPCGLHGAMLRHQSETGHIRRHGLLNAGCCFVSLPGVAWKFRFCNQSDTIKRTKQTSRTTPNFSFSMRGALILDQMARANCTHRTIPCTAEDMQWHVWHCSCMHCTVPLSHGSTVRNKADMAIVLPAEKVDRCVETFDDTSVVRPCHFSVLTKLISKHILICRSKWI

SEQ ID NO: 36217 - protein, 486 aa, Pseudomonas aeruginosa UCBPP-PA14
MIKHWINGREVESKDVFENYNPATGELIGEVASGGAAEIDAAVAAAREAFPKWANTPAKERARLMRRLGELIDRNVPHLAELETLDTGLPIHQTKNVLIPRASHNFEFFAEVCTRMNGHSYPVDDQMLNYTLYQPVGVCGLVSPWNVPFMTATWKTAPCLALGNTAVLKMSELSPLTANELGRLVHEAGIPPGVFNVVQGYGASAGDALVRHRDVRAVSFTGGTATGRRIMEAAGIKKYSMELGGKSPVLVFEDADLERALDAALFTIFSLNGERCTAGSRIFVQESVYPQFVAEFAARARRLIVGDPQDPKTQVGSMITQAHYDKVTGYIRIGLEEGATLVAGGLERPTGLPAHLSKGQFIQPTVFADVDNRMRIAQEEIFGPVVCLIPFKDEAEALRLANDVEYGLASYIWTQDIGKAHRLARGIEAGMVFINSQNVRDLRQPFGGVKASGTGREGGEYSFEVFAEIKNVCISMGSHHIPRWGV

SEQ ID NO: 36218 - protein, 934 aa, Campylobacter jejuni RM1221
  misc_feature (181)..(181): Xaa can be any naturally occurring amino acid
MSSVGENIKLTRRSFLKMAALSSLATPLLARSETLREASADELKEAYEGSKKVKTVCTACSVGCGIIAEVQKGVWVRQEIAQDHPVSSGGHCCKGSDMIDMVRSHVRLKYPMKKENGEWKRISYEQALSEIGEKLAAYRKENPESVMFLGSAKLNNEQAYYIRKFAAFFGTNNVDHQARIXHSATVAGVANTFGYGAMTNHLGDIQRSKCIIIIGANPAVNHPVGFRHFLKAKEKGAKLIVVDPRFTKSAAKADIYARIRPGTDIAFMYGMLKIIFDEGLEDTKYLDERVFGIDKIREEAAKWTAEEVENVTGISKELLVQITHEVAKNKPTTLIWAMGLTQHTVGTSNTRLAPIVQMVLGNIGKFGGGVNILRGHDNVQGASDMACLSENLPGYYPLNEATWRYYAKIWGVDYEWLLGNFVSKDWMHKTGLSLARWWAAALNGKDGNDAIDNAGTPLKALVVMGNGITSTAQQVKVKEGLEALELLVLADPFVNEAGIIAERKDGIYLLPAATQFETSGSVTATNRSGQWRFKVVDPLYESMEDQEILFELAKKLGFYEDFTKTLRDEKGEIVWPENATREIAKAVRSIGLNGWSPERLKKHTLYWDKFDEVTLEGKDEVAGEYYGLPWPCWSDKHPGSPVLYNTDIEVAKGGMGFRNNFGLEYEGESLLAKNAPLNSPIDTGYPQITKDNIEKVLGITLSAQEKEKMGSTWSYDDSNIIATKCIEKGIVPYGNAKARAVVWTFKDKIPLHREPLHSPRNDLVQKYPSFEDQKALYRVDTKFVSVQQAKDYSKEFPLNLVTARLVNLNGAGMENRASMYLTRLTPEMFCEINPELAKEQDIKAGDMIWVHSPEGTKIHVRVKVNPGVAKDMIFLPFHFTGVMQGVDLTHNFPEGTKPYASGESANTVTNYGYDIMCQIPETKGGLCRISKDGK

SEQ ID NO: 36219 - protein, 442 aa, Chlamydophila caviae GPIC
MIENDFQGYSPSYQASHFYRDKVGVIVLCGGEGKRLSPLTYWRCKPTVSFGGRYKLIDVPISHAIASGFSKIFVIGQYLTYTLQQHLVKTYFYHGVLQDRIHLLAPEGREGSQVWYQGTADAIRQNLLYLEDTEIEYFLVLSGDQLYNMDFRKVVDYAIAMQSDMVIVAQPIQEKDASRMGVLQIDKDANLVDFYEKPQEEEILNRFRLSSEDCRKHKLDPQYGNFLGNMGIYLFRRESLFQLLLEEQGDDFGKHLIQAQKQRGSIKTFLYDGYWTDIGTIESYYEANIALTQRPKPQVRGLNCYDDAGMIYSKNHHLPGTIVTDSMISSSLLCEGAVIDSSNVSHSVVGIRGVIGKNSIIDHSIVMGNDRYGNPQQNALGIGDNCEIYKTIIDENCRIGNGVKLTNIQGHKDYNSPDGKLVVRDGIIIIPRGTRIPDNYTF

SEQ ID NO: 36220 - protein, 213 aa, Vitis riparia
PTLASATGLAKAASISSRAYVTFLAGNGDYVKGVVGLAKGLRKVKTAYPLVVAVLPDVPAEHRRILEDQGCVVREIEPVNPPDNQTQFAMAYYVINYSKLRIWEFVEYSKMIYLDGDIQVFGNIDHLFDLDDGYFYAVMDCFCEKTWSNSPQYKIGYCQQCPEKVQCPAEMGPAPPLYFNAACLCLSLASPSMMISLPLSRSQLLPPLPSRTI

SEQ ID NO: 36221 - protein, 500 aa, Aspergillus oryzae
MRSTVTRSLSNATRARKGCISLRRFSLTTGKHKLVEAEKQRDGEQNHTSTNLESGDKSAILHSKLDTKPPTIVSSNGNYLIAEGGREILDASGGAAVACIGHNNSRVNNAIMRQLQSFSYIYAPFFTSKASEKLATLLSESTQNQLSKAFIVSSGTEAIEAALKMARQYFLELPNPEPSRTRFIARRQSYHGNTLGSLSLGGHVGRRAPYAPILTTNVSHVSPCYSYRGKRAEESDEDYVARLAQELEDEFQAVGASNVCAFVAETVSGTTLGCVPPVAGYLQAMKEVCDRHGALFILDEVMSGMGRCGTLHAWEQEGVVPDLQTVAKGLGGGYAPIGALLVNKRVVQALDKGTGAFVHSQTYQGHPVACAAAYEVQKIIKEENLLQNVRSLGEYLGNRLKEQLGDHKHVGDIRGRGFFWGIEFVKNKETKEPFLAEQKIAPVIHKTGLSEYSISFIPGTGVADGKNGDIIQIAPPYNATKADIDLIVERTALVVKRVLG

SEQ ID NO: 36222 - protein, 366 aa, Oryza sativa (japonica cultivar-group)
MADCMQEWPEPVVRVQALADSGLEAIPRCYVKPPCDRPAPEADDASSGASIPVVDLGNGGDDEGGQLAEAVAAACRGWGFFQVVNHGVRPELMRAAREAWHGFFRLPLQEKQKYANSPRTYEGYGSRLGVEKGAILDWGDYYFLVLSPDAAKSPAKYWPANPGICKEVSEEYGREVIKLCERLMRLLSASLGLDETRFQEAFGGADCGAGLRANYYPRCPQPDLTLGLSAHSDPGILTVLLADDHVRGLQVRRRDGHWVTVQPLPDAFIVNVGDQIEILSNSMYKSVEHRVIVNAEEERISLALFYNPRGDVPVAPAPELVTPERPSLYYRPMTFDEYRVYVRKNGPKGKAQLEALKGQSITQNNE

SEQ ID NO: 36223 - protein, 255 aa, Glycine max
IIVIQNLLQVPGKSQQDCFDRIHCDYMTPPQTQPHSRAKTLKSSPIHQFSISASKLLKPIDKTVRKSNVLKPKNIITQKSIEKLLQHHLKVDLDREVDIFSVLEPNTDFSTNALQPSEALSTPKQQKENKGFLQNCTETSSSSHKKPLSRLSGSCVTELVSPPVLKKVKNRVMHEKYINQLRCRESRRRAAATKIIGEGTSIQKRDVVKGAKVALVSEARDAINKFQQSQVNLMDNTCSSDEDNGDGVEFEDESQ

SEQ ID NO: 36224 - protein, 204 aa, Brassica napus
MSCTHDHNCEDHECSSDWSLYKHIDLPKVSALNESVSGSVKSVFKAWEQRLHSSGEHLESNEGDPELLVFVPFTSDVKIKSISIVGGPDGTSPSKLRVFINREGIDFSDAESMQAVQEWELAENLQGVLEYQTRYSKFQSVGNITLHFPESFGGDTTQIRYIGFKGEATQLKRDVVATIVYEIRPNPSDHKTKAETGGGFSQVE

SEQ ID NO: 36225 - protein, 681 aa, Kluyveromyces lactis NRRL Y-1140
MVCESGDCSVNKQVAEKFLDGISHEQQQDVEQTSKLLASAPLPKLIAAGLAINHLQLDNIRTGIGSKLYLELSADPAITKELNTGSFKVGDIVLVQPSAKAKSKKDETVNLDAVVSKVSNNQIVLAVDESKDQDAVQLYSFNRLCLLKTTNTITYKRMQSTMRKLAEFNSIPDNILIQYMLHERKFIKKDPEHNVKFYNEQLNESQRDAIQHSLSNEISIIHGPPGTGKTYTLVELIKQLYDRGERILVCGPSNISVDTILERLSKVVPGDELLRIGHPSRLLPQVLSHSLDVLSKKGDSGMILKDIMKEIDDTIASVKKLKSSRDRKKGWQEVKALRKELRQREKSGLINIILKSKIVVCTLHGSSSRELLSAYDLQSKLFNTLIIDEVSQSLEPQCWIPLISHLKSDMQRLIIAGDDKQLPPTIKTEDNDKVKRLLSTTVFDRLLQHYGNEFKYLLNVQYRMNEEIMQFSSNELYDGKLKADDSVAKQLLADLPGVESNDNTTFPCIWLDTEGDDFPERSDENDNDADDKFHLVSSKYNENEAYLALYHVEQLIKAGVTEESIGVISPYNSQVSLLKKLIHEKHQAIEISTVDGFQGREKECIILSLVRSNENFEVGFLKDERRLNVAMTRPKRQLCVIGNMEMLSRCRVPFLNRWVLWVESGFEVIYPDPSIIHSLYT

SEQ ID NO: 36226 - protein, 488 aa, Listeria monocytogenes EGD-e
MSIKETALPKVQTKLFINGKWTDGDNKETKDIVNPANGDVIAKIAQAGPSETKKAIKAAKDAFPDWAKMELADRVKLLHKIADLMEEKADTLAKIMTLEQGKPLKESKGEVLTGVENFRFAAEEARRLYGETIPAPNNHAFIVKKQPIGVVAAITPWNFPGGMVTRKLAPALATGNTIVLKPSGDTPLSALAIFEIFEEAGLPKGVANIVMGSSKEIGETLTDSDDVRKLTFTGSTKVGQTLFKQSADTLKKISLELGGHAPFIVFDDANLDAAVNDLVAAKFRNNGQVCVSPNRIFVAKEIKEKFTKALVAKVEQLKVGNGLDDVNVGPLIREDAIDKIDKQLKNATEKGAKVLTGGGRLTGSDYDKGNFYKPTVLDNVTRKMDIFYEETFGPVIPLITFETEDEAIEMANDSEFGLASYFYTKDLARVEKVGAALEYGMVGANEIAISNPETPFGGVKHSGFGRENGHYGMEEYIQVKFINLKYRD

SEQ ID NO: 36227 - protein, 302 aa, Triticum aestivum
  misc_feature (272)..(272): Xaa can be any naturally occurring amino acid
MCIAAWTWQDHQAYGLLLLFNRDEYHSRPTRPAQWWAAAGEEGEEILGGRDELGGGTWLGCTKGGKLAFLTNVREPSPRVGARSRGELPVRYLQGRQGPLEYATEIAKEADQYNGFNLVLADVRSGTMVYISNKPGDAPVVQTVSPGCHVLSNAAIDSPWPKVLRLGQSFNGFLAAHDDAEVSLKQMVEELMTDTVKADRSVVPDTGVDPDWEYELSSIFIDTKKGQARYGTRSMAAIGVKLDGEVTFYEKSLASSLWNENVVQFEMEMAQXQDLRGTYIGCECLHRETEGVRHDCTPSVPK

SEQ ID NO: 36228 - protein, 457 aa, Escherichia coli O157:H7 EDL933
MMEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVTVFGEMEFWFAIIKVIAVVAMIIFGGWLLFSGNGGPQASVSNLWDQGGFLPHGFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAVVLVIMLMTPGMAISVYLIPVWLVVLGIGYLFKEKTAKAVKAH

SEQ ID NO: 36229 - protein, 498 aa, Mesembryanthemum crystallinum
MTLDSIPGSSGYLDSYPERRITYFGNKFVLALTVTAGIGGLLFGYDTGVISGALLYIKDEFPAVKNSSFLQETIVSMALVGAMIGSATAGWINDVYGRKKATLLADFIFAIGAVVMAAAPDPYILIVGRFLVGLGVGLASVCAPVYIAEASPTEVRGGLVSTNVLMITFGQFVSYCVNLAFTEVPGTWRWMLGVSGVPAVLQFGFMLLLPESPRWLYLKHEKSKAAAVLAKIYDPFRLEDELDLLAAAEEEEKNKPAVHISDVFTKRELRYAFIAGGGLLAFQQLAGINTVMYYSPTIVQMAGFSSNQLALLISLIVAAMNAVGTVLGIYLIDHMGRRKLALTSLSGVFVALVMLTISFMLRSSGPTSALYSWLAVLGLALYIAFFAPGMGPVPWAINSEIYPQAYRGLCGGMGATICWIVNLFVSETFLSIADAIGTGPTFLIIAGIVIVAFVFVVCFVPETKALTFEEVDQMFMDRAYGTEENTQSLLESSNRSGN

SEQ ID NO: 36230 - protein, 887 aa, Escherichia coli O157:H7 EDL933
MSERFPNDVDPIETRDWLQAIESVIREEGVERAQYLIDQLLAEARKGGVNVAAGTGISNYINTIPVEEQPEYPGNLELERRIRSAIRWNAIMTVLRASKKDLELGGHMASFQSSATIYDVCFNHFFRARNEQDGGDLVYFQGHISPGVYARAFLEGRLTQEQLDNFRQEVHGNGLSSYPHPKLMPEFWQFPTVSMGLGPIGAIYQAKFLKYLEHRGLKDTSKQTVYAFLGDGEMDEPESKGAITIATREKLDNLVFVINCNLQRLDGPVTGNGKIINELEGIFEGAGWNVIKVMWGSRWDELLRKDTSGKLIQLMNETVDGDYQTFKSKDGAYVREHFFGKYPETAALVADWTDEQIWALNRGGHDPKKIYAAFKKAQETKGKATVILAHTIKGYGMGDAAEGKNIAHQVKKMNMDGVRHIRDRFNVPVSDADIEKLPYITFPEGSEEHTYLHAQRQKLHGYLPSRQPNFTEKLELPSLQDFGALLEEQSKEISTTIAFVRALNVMLKNKSIKDRLVPIIADEARTFGMEGLFRQIGIYSPNGQQYTPQDREQVAYYKEDEKGQILQEGINELGAGCSWLAAATSYSTNNLPMIPFYIYYSMFGFQRIGDLCWAAGDQQARGFLIGGTSGRTTLNGEGLQHEDGHSHIQSLTIPNCISYDPAYAYEVAVIMHDGLERMYGEKQENVYYYITTLNENYHMPAMPEGAEEGIRKGIYKLETIEGSKGKVQLLGSGSILRHVREAAEILAKDYGVGSDVYSVTSFTELARDGQDCERWNMLHPLETPRVPYIAQVMNDAPAVASTDYMKLFAEQVRTYVPADDYRVLGTDGFGRSDSRENLRHHFEVDASYVVVAALGELAKRGEIDKKVVADAIAKFNIDADKVNPRLA

SEQ ID NO: 36231 - protein, 322 aa, Exiguobacterium sibiricum 255-15
MSLKRIAILTSGGDAPGMNAAVRAVTRKAIFHGLEVFGVYNGYQGLINGDLVQLNLGSVGDIIQRGGTFLRSARCPEFRTEEGRAKAVVNLKKFEIDALVVVGGDGSYRGAQKLTGLGFPTIGLPGTIDNDIPGTDYTIGFDTALNTALEAIDKIRDTASSHERTYVIEVMGRDAGDIALYAGLAGGAESILVPERPEDLKEVLNRIQSGVNRGKKHSIVIVAEGAGRAQDVGDEIAKETGLDTRVTVLGHVQRGGAPTAADRVLASRMGAYAIDILLEGKQGRVVGVRGGKMVDLDIDEALDENKHELDLEILELSKQLSI

SEQ ID NO: 36232 - protein, 135 aa, Oryza sativa (japonica cultivar-group)
MRTAAVLLMALALTLAAAGTGTGAELETAAIRRRQSRFLASAKNSPPLSYYDCKRKPPSVCLEPGSPGATCCKGACVDTGSSFAHCGSCNHVCKYGETCCGGHCVDLLSDRKNCGDCFVRCPSKKCSFGLCDYAG

SEQ ID NO: 36233 - protein, 388 aa, Avena sativa
MASATLLKSSFLPKKSEWGVTRQAAAPKPMTVSMVVRASAYADELVKTAKTVASPGRGILAMDESNATCGKRLASIGLENTEANRQAYRTLLVTPPGLGNYISGAILFEETSTSRLLMGRRLLTSLSSRVIVPGIKVDKGLVPLVGSNDESWCQGLDGLASREAAYYQQGARFAKWRTVVSIPNGPSELAVKEAAWGLARYAAISQDNGLVPIVEPESHVDGEHGIERTFEVAQKVWAETFFYMAQNNVMFEGILLKPSMVTPGAECKDRATPEEVASYTLKLLHRRIPPSVPGIMFLSGGQSVVEATLNLNAMNQAPNPWHVSFSYARALQNTCFKTWGGRPENVAAAQEALLLRAKANSLAQLGKYTSDGEAAAAKEGMFVKNYSY

SEQ ID NO: 36234 - protein, 1433 aa, Solanum bulbocastanum
MKSLANSIFILILTLFFSHTCIINLLSVAAITSLKPGDELNHSQVLDSEGDPQDKKLWIANPNTPLLNNSGLLTIDTTGTLKITSGGKTVVNITPPLLTRSSIARLQGSGNLVLQDETQNRTLWQSFDHPTNTLFPGMKLGYNLTTKQNWTLTSWLSSYIPASGAFTLSLESIQDAFQLVIRRRGEVYWISGAWRNQSFPLLTALHDSSNRYQYNLNLVSEKDGVFFQFDAPDGSFPSLELNFNGAIVGGGEDSRVYALYNEFCYGYESQDGCVSNQLPECRKDGDKFEQKSGDFIDRSKNSNSYDNASTSLGDCMKRCWEHCSCVGFTTTSNGTGCIIWNGNGEFQVDESGNTVKKYVLVSSKSSNGKQKNWIWIVIVVAIVVPMLISGFICYSIVRRRKLQAEKRREEEYIRELTASDSFNDTNMKEKDGREVQDLKIFSFGFVLAATNNFSSENKLGEGGFGPVYKGKFPDGREVAVKRLSRTSGQGLVEFKNELILIAKVQHTNLVRVLGCCIHEDEKMLIYEYMPNKSLDFFLFDPERKKLLDWQKRYEIIEGIAQGLLYLHKYSRMRVIHRDLKASNVLLDENMNPKIADFGMARIFKQNETEAVTARVVGTYGYMAPEFAMEGAFSIKSDVFSFGILMLEIAWELWKEGCALELKDPALGDLCDTKLLLRVIHVGLLCVQEGATDRPTMSDVISMLGNESMPLPTPKQPAFFTGRNETESHSAGDPVEKKLWIANPNTPILNNSGLLTLDSTGALRITSGGKTVVNIATPLLTGSLIARLQDSGNFVVQDETRNRTLWQSFDHPTSCLLPGMKLGYNLTTRQNWTLTSWLVSSAVPAPGAFTLSLEAIQDAFQLVVSRRGEVYWTSGAWNNQGFPFLPSFRDSATTYQYNLNLVSGTDGMFFQFEATKGSFPSLELFSDGAIAAGDGSIYTRYNKFCYGYGGDDGCVSSQLPECRKDGDKFEQKRGDFIDLSGTTTSYYDNASISLGDCMQKCWEHCSCVGFTTLNSNGTGCLISNGKRDFRVDESGKAWIWIVLSIVITMLICGLICLIKTKIQKLQGEKRKKEEHIREMNAADSFNNTNLKEEDVREVQDLKIFGFGLIMAATNNFSSDNKLGEGGFGPVYKGQFPDGREVAIKRLSRTSGQGLAEFKNELILIAKVQHRNLVRVLGCCIHGDEKMLIYEYMPNKSLDFFLFDPERKKLLDWQKRFEIIEGIAQGLLYLHKYSRMRVIHRDLKASNVLLDENMNPKIADFGLARIFKQNETEAVTRRVVGTYGYMAPEFAMEGAFSIKSDVFSFGVLMLEILSGRRNASLQQFNRPLNLIGYAWELWKEGCGLELKDPDLEDLYDTEQFLRVIHVGLLCVQEGATDRPTMSDVISMLCNGSMSLPIAKQPAFFTGRDEIESYSSSNKTEQCSINDCSITVIEAR

SEQ ID NO: 36235 - protein, 524 aa, Apium graveolens var. dulce
MAGAFNVSGDDSGGSKDVGSPVIFDAVKKPKRNKYAFGCAILASMTSVLLGYDIGVMSGAAIYIKDQLHVSDVKLEIVVGIINFFSLVGSALAGRTSDWIGRRYTMVLAGAIFFVGAILMGFATNYSFLMFGRFVAGIGVGYALMIAPVYTAEVSSASSRGFLTSFPEVFINIGVLLGYVSNYAFSKLPANLGWRFMLGIGAIPSIGLAIGVLGMPESPRWLVMKGRLGEARQVLDKTSDSKEESRLRLSDIKQAAGIPEECNDDIVVMPKRRNDEAVWKELLLHPTPSVRHAFIAGVGLHFFQQSSGIDAGGLYSPRIFEKAGITSTDLKLLATIAVGISKTLFILVATFLLDRIGRRPLLLTSMGGMIISLTLLGTSLAVIDHSDHTVHWAVALAIFGVLAYVGTFSIGLGPIAWGYSSEVFPLRLRAQGCSIGVAVNRGTSGIISMTFLSLYKAISIAGAFYLFAAIAGVAWIFIFTLLPETQGRSLEEMGLLFGTYFGWRKTLKGLKNREAEEAKNANVI

SEQ ID NO: 36236 - protein, 289 aa, Ralstonia solanacearum GMI1000
MSTTEPYATMSDALHDWLQRHVDEGFEADPLVASMVQSGYDRAFARRVVDEALAQRPKPEPAATVPSPAPAGPEPESSNAVRTSDREIPILFAIETPRIVLFQHFLSDEECDQLIALGRHRLKRSPVVNPETGEENLISARTSQGAMFQVGEHPLVARIEARIAQATGVPVEHGEGFQVLHYQPGGEYQPHFDYFNPGRSGEARQLEVGGQRVATLVIYLNSVPAGGATGFPKLGLEVAPVKGNAVFFVYKRPDGTLDDNTLHAGLPVERGEKWIATKWLRERPYRRGA

SEQ ID NO: 36237 - protein, 456 aa, Oryza sativa (japonica cultivar-group)
MHMMRRLKSIASGRSSVSDPGGDSGTKRPKFDQDGAGDIVIEPHLTDDKPMRVDQESSSSHRDAEASTSTSKNPGRTEEAGADILPKEMNEMTISDDKVDGHNDKESEGVIVNANGTETGQIIVTSIGGQNGKPKQKVSYMAERVVGTGSFGVVFQAKCLETGETVAIKKVLQDKRYKNRELQTMQLLDHPNVVQLKHHFFSTTERGEVYLNLVLEYVSETVYRVAKYYNRMNQRVPILHVKLYAYQMCRALAYIHRVVGVCHRDIKPQNLLVNPHTHQLKLCDFGSAKKLVPGEPNISYICSRYYRAPELIFGATEYTTAIDIWSVGCVLAELLIGQPLFPGESGVDQLVEIIKILGTPTREEIRCMNPNYSEFKFPQIKAHPWHKLFGKRMPPEAVDLVSRLLQYSPNLRCTAVDACAHPFFDELRDPKTCLSNGRSLPPLFDFSAAGAVWMLY

SEQ ID NO: 36238 - protein, 374 aa, Prunus armeniaca
MTFTLRKKEILIDILVRLPAKSLIRFLSTCKSWSDLIGSSIFVSTHLCRNVTKHTHVYLLCLHHPNFERLVDPNDPYLKKEFQWSLFPKETFEECYKLSHPLGMTEHYGIYGSSNGLVCISDEILNFDSPIHIWNPSVRKFRALPMSTNINIKFSCVALQFGFHPGVNDYKAVRMMRTNKSALAVEVYSLKRDSWKMIEAIPPWLKCTLEHHRGTFFSGVAYHIIQKGPMLSIMSFDSGSEKFEEIIAPDAICSLWGLYIDVYKEQICLLFICYGCEEEGMEKADLWVLQEKRWKQLSPFIYPPDYYYCTTGISMDNKILMLRVDDIRGIRNLDLCDYESNQVLETGIELATMKYGEIEFLFSITYVETLPLLN

SEQ ID NO: 36239 - protein, 276 aa, Corynebacterium glutamicum ATCC 13032
MGSHITHRAAVLGSPIEHSKSPVLHNTGYKALGLDQWEYDRFECTGDMLPGIVSGADETYCGFSVTMPSKFAALEFADEVTERACAIGSANTLLRTATGWRADNTDVDGIRGALGELLGGASLAGKHAIVIGSGGTARPAIWALIEAGVARITVLNRSDRTAELQTLFDETPTTLAYAPLEHLHIEADVVVSTVPSAAIAGLEDTLAIAPVLDVIYDPWPTPLVEVTRAKGLKAVGGHVMLAHQSYGQFEQFTGMDAPRDAMREALEESLGISEEH

SEQ ID NO: 36240 - protein, 171 aa, Triticum aestivum
MVVTGDGELGFDSRRGSLRNGYHIQGRQQARKLPNPINPPPPQIPPQASAALPLLPNLAHLSELGGAAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 36241 - protein, 687 aa, Oryza sativa (japonica cultivar-group)
MALTTLCQLKLGIVKSSFCFNAATDNDGRAEASRYDDGRRLMVISVSLIAAAAAAAGGGAAILLGALAIGVASRRGRAAAAGGGGEGEERIGDLSASFLAELRVSTNLLHTPNTADHEVRCCSFDRGMSLHCCPAAGDPPAPAGTAEELLERARSLVPAALDAARAATGFGGRWKVIAARLERVPPCLSDLSSHPCFSKNSLCRELLQSVAATLAEAAELGARCREPPRAGKLQMQSDLDALAGKLDLNLRDCALLIKTGVLSDATVPPVAPAAEAAAQTDVRELLARLQIGHAEAKHRAVDGLLDALREDEKSVLSALGRGNVAALVQLLTATAPKIREKAATVLCLLAESGSCECLLVSEGALPPLIRLVESGSLVGREKAVITLQRLSMSPDIARAIVGHSGVRPLIDICQTGDSISQSAAAGALKNLSAVPEVRQALAEEGIVRVMVNLLDCGVVLGCKEYAAECLQSLTSSNDGLRRAVVSEGGLRSLLAYLDGPLPQESAVGALRNLVSSAISPDSLVSLGVLPRLVHVLREGSVGAQQAAAAAICRVSSSSEMKRLVGEHGCMPLLVRLLEAKSNGAREVAAQAVASLMSCLANARDIKKDEKSVPNLVQLLEPSPQNTAKKYAISCLLTLSASKRCKKLMISHGAIGYLKKLSEMDVAGAKKLLEKLERGKLRNLFSRK

SEQ ID NO: 36242 - protein, 375 aa, Aspergillus nidulans FGSC A4
MRIRPSPPKKPTPGLLHEYADRLVAFEYSASKGLKPHTLLFISGLGDGLGTVAYLEDIVAALEGSQWSVFSPVISSSYGGWGTSGLGRDTDEMARCIEYIQKYKEGSGVHETERKIVIMGHSTGSQDVLTYISSPNPRHPQPGLDPGHGHRHKRMPPLRPQVDGAIMQAPVSDRQAIQTVLEEGNERHSAKYMRKVVNDAIAYAKKHTYEDYDSLDTIIPLPITAAIGYPASTAVSSRRFLSLTSPDSPDSPGEDDLFSSDLTDERLRKTFGMVRHRGVLKDQKGLLVLYSGNDPSVPAFVDKEGLLRRWRWATDADEKRAYWHGESGIIPGATHTLEGPGQVEQRKELVRRVWMFLADVEGDPRTSCHSARPLS

SEQ ID NO: 36243 - protein, 557 aa, Pseudomonas aeruginosa UCBPP-PA14
MYQYDEYDQALVSERVAQFRDQIARRLDGELSEEEFLPLRLQNGLYLQKHAYMLRVAIPYGTLSSPQLRALAHVARHYDRGYGHFTTRQNIQFNWIELEQVGDILEHLAGAQMHAIQTSGNCVRNITTEAFAGVAADEWTDPRPLAEILRQWSTVNPEFLFLPRKFKIALSSAVEDRAAVQMHDIGLYLYRHPDAGELRLRVLVGGGLGRTPMLGQVIRDDLPWQHLLSYVEAILRVYNRYGRRDNKYKARIKILVKALGIEAFAREVEEEWQHLRDGPAQLTAEECQRVAERFVLPRYLPPAGGELAYGSARAVDPAFARWASRNVQAHKVPGYASVVLSTKPGASAPPGDVTAEQMERVADWAERYGFGEIRVAHEQNLVLPDVRLENLHALWREACAAGLGTPNQGLLSDIIACPGGDYCALANAKSIPIAQGIQQRFEDLDHLHDIGELSLNISGCMNACGHHHIGNIGILGVDKNGSEWYQVTLGGAQGKDSALGKVIGPSFSAAEVPAVIERIVETFTDLRVGPERFIDTFNRVGLEPFKARVYARMEEPA

SEQ ID NO: 36244 - protein, 218 aa, Zea mays
MAMSRFGRSGQPENRESFSLLVLNVSFRTTADDLFPLFDRYGKVLDIYIPRDHRTGDPRGFAFVRYNYEDEARDAIDGLDGMRFDGRALMVQFAKYGPNAEKIHRGRITEENPKPRGRCRSRSPRQRYREDYRDRDYRRRSQSRSRERYEQAGYRDGDHRRHRTHSISPDYDRKRNRHSGSPVLKRPSHSRSRSPRRAPHEGIPSKPRDGRAACSGSP

SEQ ID NO: 36245 - protein, 499 aa, Aquifex aeolicus VF5
MEQGYRTISRKTLRPLQKDIRKITFLCKAECSRKRIIQYSIMIKFGTDGWRARIAEEFNFDNVRRVAKAHAEVLKEKGVKRVIVGYDWRFRSEDFAKAVYDVFRSEGLEAKLVGSACTTPMVSFAVKYLGYENGVMITASHNPPAYNGYKIKESFGGSATPEFVKNVEEKVKDIESVEIKEFEPEYQEVRKKYVEKIREFFDMDLFKEKKTLVVHDSMHGTSSGLLDFVLRDTKVSVINIRKDRDPLFGGHPPEPIEKYMEITKEKVRALGAELGIANDGDGDRIALVDDKGNYVNTQLIYAMLLLHLLENKGKRGKVVKTVSTTYLADRICKEFGVPLIEVGVGFKNINEIILKEGGVIFGGEESGGYGIPEYLPERDGIFSALNILELLYLKDKKVSEVVAEIFERFGEAYYKRVDLRVKEKIKGRIKELKENPPERIGEFKVREVKTIDGVKFVFEDDSWLLMRPSGTEPLIRVYAETPTKEEVEKIIQKGLELLK

SEQ ID NO: 36246 - protein, 473 aa, Burkholderia thailandensis E264
MDLEEGIRRLYPYAEEFGVTRGFPEHGMPRDALLAQLRSMAEREDRNWESGRCSGAMYSGDRDHHAWLNEAYSIFSHVNALRRDMCPSMNRMESEIVGMTVAMLHGEAVAAHHPGQRACGMITLGGTESILGATLAYREKARAERGIDRPRMIWPASAHPVFRKAAHLFGFDVTVAPVDPDTMQVDADFVRDAIDADTVMLVGSACNYPYGTVDPIEALSEIAVEKEVWLHVDGCLGGWMLPWGEELGYPNIPAFDFRLPGVTSISADTHKFGYGPKGGSVLAWRDASFRRYQYFLMTDWVGGVYGSPGLAGSRSGGLIAATWAALRGLGREGYRARARAIFDTAFDMQAAVRAIPELRVLGKPTFCFAFASDAFDIYHVNDFMRQRGWRLNGLRHPDALQMCVTEPQTRPGVADQFRRDLGAAVEHARRHARERPKTSGIYASDATGVDLSDDARARAFFTQVIDLFTDCPL

SEQ ID NO: 36247 - protein, 486 aa, Bradyrhizobium sp. BTAi1
MPNDVSRRDLAKLAGLAAMGAAAGPAHAEEAAVTDDAGRRFPSDFVWGTATSSYQIEGGATADGRGPSIWDVFTHTPGKIEDGSTGDVACDHYDRYKHDVRLIKELGCRAYRFSIAWPRLFPDGGLTPNPKGLDFYSRLVDELLANGIEPYATLYHWDLPQALQDRVGGWRSAETAAAFAHYAGYVAQTLSDRVKTIFTINECGRFIPFGYGLGIDAPGLKLPQQEVNQARHHVALAHGLAVQAIRAKGRAGTRVGMAENITACLPAIDTPENIRAAEIATREMNAGFLNVILEGRYTDAFLAWSGKDAPTFTADELKTISTPVDFVGLNIYAPQAYVVASERAPGFDVLPMPSSFPHMSSPWLLVGPETAYWVPKLAAKIWNLKTIYITENGTSSDDKVTADGKVHDLDRVMYLRNYLAQLQRATSEGVPVKGYFLWSLMDNFEWVFGYKQRFGVYHVDFDTQLRTPKLSASYYRHVITRNAVSA

SEQ ID NO: 36248 - protein, 862 aa, Oryza sativa (indica cultivar-group)
MSLHEPIRRCCCSCFFFFFTSLFLPSTSSIYVAMAAASDMPNCRNECGGVLIPYPFGVGENCSRPGFDVFPITCNNSFVPPRPYWSNLEIIDINIATAEMRVYLPVSHKCFSSTNQTADPNWGWSLNSSSSQFLVSPTKNIFTALGCYTIAMLSGRDNGTYSTGCISYCASESEVKVGDGKGCTGLGCCQTSIAGGLSYIAFYFNVPNNPSWNYSPCSYAMVADKSWDIKISKEDVIGNMTFARRIERGAPLVLDWAIRNNGTCPPALISGENGKQRQQAAAACVSPHSYCLNATNGPGYFCNCSDGYAGNPYVSNGCKNVNECDPSFYKENYPCIGGKCLDTEGGFKCKCNFGRKRDSKNSHICQPVLSKPAIVVTATTCAISILSIIFLFLHMEREKRKLREFFKKNDGQLLQSMGIKIFKKKTIEKITNNYSTIIGKGGFGLVYKGAVDNDQKVAVKCPNPISVDTARQNDFANEVSIQSQISHKNVVRLLGCCLETNIPILVYEFIPRGSLYDVLHGNGDDSNMTEHKLSLDVRLGIAIESAEALAYMHSSASQKILHGDVKSSNILLDENFTPKVSDFGISRLLSIEKDHTKFVIGDANYMDPVYMKTGLLTEKSDVYSFGVVLLELITGKKARYEGNESLPLNFVKSYMTESRAREMFDKELMCTEEVNCLEMIGDIAVQCLEEDVDKRPAMKEVSEHLHLARKEFMQNQGAATISDEAKKRKRGADGKLLCDFALHQRSPISPLSTLEAGLDAARHQPTIRRSPEDRGVQPFSQDEEETITIDCFYKPVVARAVSVEIENPSPTNVEVADQENLQAEQEVIVTTAFERDPGKRVQISAAMLHCLFDVGDLELVAT

SEQ ID NO: 36249 - protein, 532 aa, Zea mays
  misc_feature (486)..(486): Xaa can be any naturally occurring amino acid
MQQRKAKVVWGGAESAAAQEIPASSQLAMAHNSSWPEGEGAPEHSPVPRKKRLSLDEKRWNTVVNVMLVAFVMAVPPVVVVFAGGGIAPAVWIAAAKAQLRRGSGDGPPDRLLGGLLADGLDERTCRSRYESSLYSRRPARRPSPHLIAKLRRHEELQRRCGPNTDAYSRAVQQLRAGKSVGSPECKYVVSISYRGLGNRILAAASAFLYAVLTDRVLLVDPSNDMGELFCEPFPGTTWLLPREFPLASYTNFSIDTAESYGNMLKNRVLRADVPPPPTETQLPAFVYLHLDHDYGDEDKMFFCDDDQRLLSSVQWLVMRTDMYTVPGLFLVAAFQEELDVLFPERDAVFHHLARYLFHPTNRVWGLFTRFYRAYLARAELRLGVQVRNFYPWAQQSPVVLRQITSCLWREKLLPEVLDTEENAVPAPRPGGARTTAVLVTSLRSWYYERIKGMYWDQATATGEDLSVHQPSHEGQQQYGKRSHSXRAWAEMYLLSLCDVLVTSGWSHVRQHSNAQLLSLAYNHLNAILVFI

SEQ ID NO: 36250 - protein, 322 aa, Ralstonia solanacearum GMI1000
MPASVLLAPVAEDMHAVDAVIRRRLGSEVALINQIGEYIISAGGKRLRPVILLLMANALGYRGQHHYELAAVVEFIHTATLLHDDVVDESELRRGRQTANAVFGNAASVLVGDFLYSRAFQMMVQADSMRVMQILADATNVISEGEVLQLLNMHDPDVTEERYLQVIRYKTAKLFEAAAQIGAVLSGADAATEAAAAEYGRRIGTAFQIVDDLLDYTATADQMGKNAGDDLREGKPTLPLIYLLSHGTETQRALARQAIEQGGTEHFDAIFAAIQASGALEYTRKAAEHEASAAAEAIIALPPSQFRQTLIELCAFSLQRQS

SEQ ID NO: 36251 - protein, 481 aa, Oryza sativa (japonica cultivar-group)
MAGAGAGESLDLPVVDLASSDLAAAAKSVRKACVEYGFFYVVNHGAEGLAEKVFGESSKFFEQPLGEKMALLRNRNYLGYTPLGADKLDASSKFKGDLNENYCIGPIRKEENFPCWKETMKLYHETALATGKRILSLIALSLNLDVEFFDCPVAFLRLLHYPGEANESDDGNYGASAHSDYGVLTLVATDGTPGLQICREKDRCPQLWEDVHHIEGALIVNIGDLLQRWTNCVFRSTLHRVVAVGKERYSACVECGFFYVVNHGIEEGLLEKVFAENRRFFEQPLEEKMALLRNSSHLGYTPPYTEKLDASSKFRGDLSETFKIGPIGDEGFQNDANQWPSEERLPCWKETMKLYRGTALGTGKRILSLVALSLNLDAEFFDCPLAFLRLLHYPGEINESDDGNYGASAHSDYGILTLLATDGIPGLQICREKDRHPQLWEDVHHIDGSTLHRVVAVGKERYSVPTYKKWRLFGRALELYI

SEQ ID NO: 36252 - protein, 232 aa, Glycine max
MAGAHSHRQSQLHHQQPSSRLLLLLTVLPLTLATLAFVLQWRGGVTDPVTRWSPDHDQFPGMATAVPSLRHHSDCGKNPLSQSYNPSFPYFRDWTFDFSSNLSPKICITTSTSAGLEQTLPWIFYHKVIGVSSFLLFVEGKAASPNVTRVLETIPGVKIVYRTRELEEQQAKRYVYIYTHTHIFFFFWKGKASFFCFVECCDLLIEGNLWSIWDLKSSCNLNEKKTKLFRQC

SEQ ID NO: 36253 - protein, 596 aa, Oryza sativa (japonica cultivar-group)
MPTVSVGRDRFFVALGRTYTQEEFEVLCFEFGIELDDVTTEKAIIRKEKHLEDDDGEVDGDDDEVIYKIEVAANRYDLLCLEGLARALRIFTGTEATPMYKISCIPRDSMLLMHVKPQTSQIRPYVVCAVLRGVTFDEARYNSFIDLQDKLHQNICRKRTLVAIGTHDLDTLKGPFSYEALPPQEINFVPLKQEESFRADKLMEFYKSDMKLKKFLHIIENSPVYPVIYDSNRTVLSLPPIINGAHSAITLKTRNVFIECTATDLTKAKIVLNTMVTMFSEYCENKFEVEPVEVVSHDGSKTIYPDLSCYKMEVSLSEVVGPIGISLDETKVISLLNKMQLQAESCPSKGEPRISVSVPPTRSDILHARDLVEDVAIAYGYNNVPKSKPKCMTIGGRQPLNRFSDKLRAEVARAGYMEVLTFTLCSREENFDMLNRTQDVNKAVIIANPRTSEFEVVRTSLMSCLLKTLKHNIDHPRPIKIFEVGDVVTLDGSRDVGASNNRRLAALYCNKQSGFEEIMGLVDRIVNVVRAPHIKFGQNYYVPTNEPEFFPKRQCKIVMSDGKQIGYLGIVHAEVLRKFGIPDPCTFVEIDVEALL

SEQ ID NO: 36254 - protein, 467 aa, Burkholderia mallei ATCC 23344
MSLFRKKNVDRMIAGAQAAGLKKALGAVDLTFLGIGAIIGTGIFVLSGTGAVQAGPALMLSFVIAAIACGLAALSYAEFASTIPVAGSIYTYSYATLGELVAWIIGWDLMLEYGLAASAVSVGWSGYLQSLLQGFGVSLPTALTAAPGALPGVVTYFNLPAFVVMLVITTLLSIGIRESTRVNNIMVFIKVAVVLLVIAVGVFHVTPVNWKPFMPHGWNGVFGAAAVMFFAFIGFDAVSSAAEEVKNPKRDLPVGIIASLGVCAFLYVAVAAIATGIVPWAQYANVSHPISYALQVAGEKWVAGFIDLGAVIGMLTVILVMSYGQTRIIFAMSRDGLLPAALSRVHPRFATPFLTTWLVGLFFGLIAALIPLNVLAELINIGTLAAFSMVSIAVLVLRRTHPDLPRAFRCPGVPLVPILAVAACLFLMLNLQPVTWIAFLTWLVIGLFVYFAYSRSRSKLAHGAQQH

SEQ ID NO: 36255 - protein, 393 aa, Arabidopsis thaliana
MSSRFSLTVVCLIALLPFVVGIRLIPARITSVGDGGGGGGNNGFSKLGPFMEAPEYRNGKECVSSSVNRENFVSSSSSSNDPSLVHIAMTLDSEYLRGSIAAVHSVLRHASCPENVFFHFIAAEFDSASPRVLSQLVRSTFPSLNFKVYIFREDTVINLISSSIRLALENPLNYARNYLGDILDRSVERVIYLDSDVITVDDITKLWNTVLTGSRVIGAPEYCHANFTQYFTSGFWSDPALPGLISGQKPCYFNTGVMVMDLVRWREGNYREKLEQWMQLQKKMRIYDLGSLPPFLLVFAGNVEAIDHRWNQHGLGGDNIRGSCRSLHPGPVSLLHWSGKGKPWVRLDEKRPCPLDHLWEPYDLYKHKIERAKDQSLLGFASLSELTDDSSFL

SEQ ID NO: 36256 - protein, 705 aa, Pseudomonas syringae pv. phaseolicola 1448A
MTQSAATILIIDDDVHVRDLLEVLLQNQGYRTLTAESGELGLAMVELQAPDLILLDIMMPGMDGYEVASQLKASKSTANIPIIMLSALDEQSARLSGLEAGAEEYLNKPVDSAELWLRVRNLLRLKAFGDYLKNHSLILEDQLQQRTIDLERFRTVMDASEDAIFLINRNTMSLIEFNRRACQLLGYTAEELAHKTPAELGETSMENLEVVYDQIIAGKGPSEPLETQIRDKSGRDVEVEIHRQAYRTGEDWVIVGIVRDITRRKESDQRLLTMTHYDALTGLPNRDLFFTSLQMGVTQAAISRWKLAALTVNLDGFKNINETWGHVLGDEVLLEVSRRLSECLNASDTLGRVDGDQFALILMLRDGQADTRQTLDRIRNALRVPFQLEGQSIVMTASIGIALYPEDGEDSRELIKHAYTAMNSAKKIGPDTYRFYTAQMNADVSARLDLEAALRDAVQKQAFEIVYQPKLNLTDNRVCGLEALLRWPRPGQSGISPAVFVPVLESLGLIGEVGNWVVDSVCAQIARWQRSGLGSFQVAVNISGQQIYSSSLVADIRQALEKHKVAPQWLEVELTESSLMENTSHTIATLGALRANGVSISIDDFGTGYSSLAYLRRFPIDKLKIDIAFIREVTSNPQDAAIARAIIELAHSLDLKVIAEGVETPEQLAFLRENHCDQIQGYLISKPLPLGELEVFLRSPASRVG

SEQ ID NO: 36257 - protein, 162 aa, Brassica napus
LLGLDSKLEKSLLIPFREIKVECTIPKDDGTLASFVGFRVQHDNARGPMKGGIRYHPEVEPDEVNALAQLMTWKTAVANIPYGGAKGGIGCDPSKLSISELERLTRVFTQKIHDLIGIHTDVPAPDMGTGPQTMAWILDEYSKFHGYSPAVVTGKPIDLGGS

SEQ ID NO: 36258 - protein, 328 aa, Aspergillus oryzae
MSTTSSTFKSSSGANCHPTALEIIQNNGLEGKLQDKVILITGCSSGIGIDTARALSVTGATLYLTARDLKKAEQALGDLIEKPNVHLLTLNLNSLASVRACAEEFLPKSSQLNVLINNAGVMATPEGRTQDGFETQFGTNHLGHFTLFYLLKPILLASSTPEFNSRVVNVSSLAHRYGEPVFDNINLEGIYEPWRAYGQSKTANIWTANEIERRYGSQGLHAFSVHPGGIRTGLQQYVPKEQKDAWDQDDAISSVWKTSEHGAATTVWAAVAKELEGKGGKYLEDCQIAEKYDPSTGTAGKGYAPWVYDEAKQAKLWEMSLNLAGLHV

SEQ ID NO: 36259 - protein, 331 aa, Zea mays
MGECEDGKEYRCWEELLPDALGLIFRNLPLQEVLTVLPRVCKSWGRVVAGPYCWQEIDIEEWSQQQSKPEQIARMVELLVGRSAGSCRRISVSGLPCDPRFSFIGDNARALRTLEIPRSEISDSMVESVAPRLPNVTFLDISSCTKIGARGLEAFGKHCKSLAGLRRVMHPIDLADRACQHDEAHAIACSMPRLRHLEMGYMLVATEAVAEILGRCRELRFLDLRGCWAVDDKLLLRDRHPGLRVLGPRVDDCYENSYWEECSDDYSDDSSIYSWELMDDVDDDYDYAAAGSDDDEAVWDDDGQGLENLEVRFYGGGFGETFAGFDWPPSP

SEQ ID NO: 36260 - protein, 547 aa, Bradyrhizobium sp. BTAi1
MSTNQYQLGLDKNAANYVPLTPLSFLARSAAVYPDHVSTVYEGRSFTWRQTYERCRRFASYLAGRGISEGDTVAAMLPNIPAMNEAHFAVPMTGAVLNTLNIRLDAPSIAFQLDHGQAKIILVDPEFSGVISEALKLMSGPKPFVIDVDDASYAGGSRIGEIEYEVAVAAGDPGFEPRRPADEWDAIAMSYTSGTTGNPKGVVTHHRGAYLNAVSNILAGGLGQHPVYLWTLPMFHCNGWCFPWTMAAAAGINVCLRKVDPTKIFELIKTHGVTHMCGAPIVYNVLINAPDAPKGKRETPVIGLIAGAAPPVAVLEGAENIGIKLTHVYGLTEVYGPASVCAEQPGWDDLPPAERAQLKRRQGVPYPLQEAVTVLNPETMQEVPRDGETIGEVMFRGNIVMKGYLKNEKATQDAFAGGWFHTGDLGVLDAHGYVIIKDRSKDIIISGGENISSVEVEDILYKHPAVLFAAVVAKPDPKWGEVPCAFIELKDGAQATEAEIIAYCRSHMSGFKTPKVVVFGPIPKTSTGKIQKFLLRNEVNSAKAISA

SEQ ID NO: 36261 - protein, 134 aa, Solanum commersonii
DEYGNPVRQTDEYGNPIQQTGGTMGEYGTTGTGYGTQAGHTTGVLGGDQRQHGTLGGMLHRSGSSSSSSSVSEDDRHGGRRKKKGIKDKVKEKLPGGHRDHLAHSTATTTTTGYGMDGTHEKKGIMEKIKEKLP

SEQ ID NO: 36262 - protein, 835 aa, Rhodospirillum rubrum ATCC 11170
MGSVDTVGALPRDLVRLAVSPRDKADAIAQAAQMLVAAGCVEAGYAQSMIRREGVANTFLGHGVAIPHGMAEDRALVRANGIAVLQVPDGVEWNPGQSARLVVAIAAQSDTHIAILRRLTRLLQDEDRLGGLFVTSDPGDVITALTTDPEVNAPAVPVSDLAKRFEWVLDYPNGLHARPAARWVDTAKGYAARCQIRHGDEVADVKNLVALLRLGLTQGERISVSAEGPDADQALSRLKATMLDLSVQERADAALAARRAKQPVIGWHPPGAPMALAGIAAAPGLAIGRLHVLAAADRSVPDHPVPLSEGGNILHEALSATRLQLKALADDTARRLGPSEAGIFKAQGELLNDTDLITLTCQLMVEGHGVAWSWDQAIERMAGKLAALGNALLVARAADLRDVGRRVLGQLDPGLGGASLHDLPDEPCILIAGDLAPSETAGLDPSRVVGLATAQGGPTAHTAILARTMGLPAMVAAGPGLLALESGTLAILDGYGGRLYPDPSPEALSSARAFIAEQGLRRAREEERRSLPASTRDGHRVEIAANVNFADQAAFALSQGAEGVGLMRTEFLFLERGDTPDEEAQLAAYTAMQDALNGRPLIVRALDIGGDKQVAHLDLPREDNPFLGVRGARLLLRRPDLLDPQLRALYRAAKSGKPLSIMFPMITSVPEIIALRGICERIRAEVEGPEVALGIMVEVPAAALAADVLARHADFFSIGTNDLTQYTLAIDRQNPELAAEADSLHPAVLRLIRMTVDGAAAHGRWVGICGGIAGDPFGAALLTGLGVQELSMTPRDIPAVKERLRDCDATALRALAERALTCETATDVRALEADL

SEQ ID NO: 36263 - protein, 828 aa, Bradyrhizobium sp. BTAi1
MRSAMRSAPATVWRLQASSTASSAGSRSGSGLQIPMRNCRALHGWRRYGKRSSAPRATPNPIIWNENRWFSRCSGCSPKPRGNRADHHPGIARINPSTDVVKEEFAVAKASKTTVKKGKPASAAKNKAAAKSPAKAKSPVKAGAKTKAKDKDAKDKATKAKAAKGKAAKTAPAKAKTKAKSKAPKAKATKVVAKKAVKAPAKKVVAKPAATAAKKPAATSKAAPAKKPAASRQPAAPKAAAPAVADVPKPQRAAKPKAPRKPKVEAAETVEIETVEIEVFEIEAPESEAAEGEIAETSAPEEVSAAAPAAVAPADNNTFYVTTAIAYPNGNPHIGHAYEAIATDAIARFARLDGKDVFFLTGTDEHGLKMVQTAQNEGLTPGELATRNAGRFRDMDERLNVSFDRFIRTTEPAHHKSVQAIWNRMLENGDIYADTYAGWYSVRDEAYYAEDETVVGEDNVRRGPQGTPVEWVEEKSYFFRLSAYQDRLLALYESQPDFIGPDARRNEIISFVKGGLKDLSISRTTFDWGVRVPHDDEHVMYVWVDALTNYITGVGFPDENDANWKYWPADVHVIGKDIIRFHAVYWPAFLMSAGVPVPKRVYAHGFLFNRGEKMSKSVGNVVDPFNLADQYGVDQLRYFFLREVPFGQDGNYNHEAIVARINADLANDLGNLAQRSLSMIAKQLGGQLPEPGEFSANDRAILAEADAMIGAARKAMATQQIHQWLNAVWSVVAEANRYFAGEAPWALAKTDPKRQHTVLYVTAEVIRQVAILTQPVMPTASAKLLDSLGIPEDERNFARLGGEIRIAAGTQLPAPQAVFPRYIEPTAA

SEQ ID NO: 36264 - protein, 380 aa, Lotus corniculatus
MSSTAGQVIKCRAAVSWEAGKPLVIEEVEVAPPQAGEVRLKILYTSLCHTDVYFWEAKGQTPLFPRIFGHEAGGIVESVGEGVTHLKPGDHALPVFTGECGECPHCKSEESNMCDLLRINTDRGVMISDNQSRFSIKGKPIYHFVGTSTFSEYTVLHAGCVAKINPAAPLDKVCILSCGICTGFGATVNVAKPKPGSSVAIFGLGAVGLAAAEGARVSGASRIIGVDLVSSRFEGAKKFGVNEFVNPKDHDKPVQEVIAEMTNGGVDRAVECTGSIQAMISAFECVHDGWGVAVLVGVPNKDDAFKTHPVNFLNERTLKGTFYGNYKPRTDLPNVVEMYMRGELELEKFITHTVSFSEINKAFDYMLKGESIRCIIRMEE

SEQ ID NO: 36265 - protein, 183 aa, Fagus sylvatica
MKAVREKPNLFELFLQNQYAGAAPQNDEFGNPIRSDEYGNRVRTHEFGNPTHHTQQRCCRIRNWWFDTNTLQGMRHDATTGAGHGGVDYRHDQQQQQHGLSGMLHRSGSGSSSSSEDDGFGGRRKKKGVMEKVKEKIPGVGHKDDQYHQGQTTSTITPDYYDQGQTHEKKGIMEKIKEKLPGH

SEQ ID NO: 36266 - protein, 760 aa, Corynebacterium glutamicum ATCC 13032
MSLERNTQKSSMGVRSMSARLARSLTGNRVRTNPVLDPLLSIHRQFHPRADVQVLERAYDTAERLHDGVIRKSGDPYITHPLAVATIAAEIGMDTTTLVAALLHDTVEDTDYSLDDLTRDFGEEVARLVDGVTKLDKVALGAAAEAETIRKMIVAMSQDPRVLVIKVADRLHNMRTMRFLPPEKQAKKARQTLEVIAPLAHRLGMASVKWELEDLSFAILYPKKYEEIVRLVADRAPSRDRYLKEIIDQVTGGLRENNIAAEVLGRPKHYWSIYQKMIVRGRDFDDIFDLVGIRILVDNVNNCYAAIGVVHSLFNALPGRFKDYISAPRFGVYQSLHTTVMGPGGKPLEVQARTHDMHYNAEFGIAAHWRYKETKGSHSGEQAEVDQMAWMRQLLDWQKEAADPNEFLDSLRYDLTSKQIFVFTPKGDVVNLPVNSTPVDFAYAVHTEVGHRCIGAKINGKLVALETKLKSGDRVEVFTSKDQNAGPSRGWQEFVVSPRAKAKIRQWFAKERREEYLEAGRDALAAVIQRGGLPMHRLFTASSMKTVATELHYPDVDALYTAIGSGSVSAQHVVNRLMAIFGDEEDAEDALVARTPFSELVNSRATTESSTGILVEGSPDVMAKLAKCCMPVPGDEIFGFVTRGGGVSVHRTDCTNVEKLKEEPERIVSVSWASEGQGSVFSATLQLEALDRAGLLFELTRVINEQKVSVTAMNSHCSEDRVATVRFTFAVSDTKQLGSLMTQLRNAEGVFDVYRVTSGG

SEQ ID NO: 36267 - protein, 185 aa, Corynebacterium glutamicum ATCC 13032
MSEQALSTFDRAREALDKKTRYVQDFPEKGVLFEDLTPVLGDAESFVAVVDAMAEAAEKLNAEIIGGLDARGFLLGSAVAYKLGLGVLAIRKKGKLPPPVVTQEYELEYGTAALELPSEGIDIAGKNIVLIDDVLATGGTLGAARKLIESCDGHVSGYVLAIEVPGLGGRDNLGDRPVIVVRDPQ

SEQ ID NO: 36268 - protein, 619 aa, Aspergillus nidulans FGSC A4
MDKKVASDASATHEEVPYVVPATKALQADSARRGSTAVNIIQNPLQNVSREQAVYDARVFAQTHGMDEHADVFGRAALVARDPDNFLTIPELSEEERTALQYEKDHKWHGPRMLWYSIGLCAIGAATQGWDQTGSNGANLQFHDEFNIAGEGRDEWIVGLVNSIIFLTAGLIGAFIVDPLNHYLGRRGEIFVTALCLTATPIGSAFTHSWQALFAARFIMGIGIGAKNATVPIFSAEMAPHRIRGALVMFWQLWVVAGIFLGLIANVAVKDTGRIAWRLQLGSAFIPSFILGAGIYFCPESPRWLMKHGRYAEGFRSMCRLRAHPIIGARDYYYSYVIYQEEIKEARGAGYFRRMWDCFSIPRIRRANYGASTVMIAQQMCGINIISFYSSSIFKDAGYTDSEALYASLGYGAVQVLATIPTLFLIDTKGRRTLCLITFPGMCIFLLAAGLSLLVPDSASTSAQLGPVVLFVYLFTIMYSLGEGPVAFQYSAEVFPTVQREQGMAWAVCINNTFAGILSLTFPRMRTVMTPTGAFGFYAGLNLIAWVMIFCFVRETKQLTLEELDQVFSVPTKEFLKHETTVWLPYFIRRHIFRQDIPKPPAIIATADEKRGSSNSVDA

SEQ ID NO: 36269 - protein, 324 aa, Pseudomonas aeruginosa UCBPP-PA14
MSTLSTDQLLHAYRVMRTIRAFEERLHVEFATGEIPGFVHLYAGEEASAAGVMAHLRNDDCIASTHRGHGHCIAKGVDVHGMMAEIYGKKTGVCQGKGGSMHIADLEKGMLGANGIVGAGAPLAAGAALAAKLKGSDAVAVAFFGDGGSNEGAVFEAMNLAAVWNLPCLFVAENNGYAEATAANWSVACDHIADRAAGFGMPGVTVDGFDFFAVHEAAGAAIERARAGEGPSLIEVKLTRYYGHFEGDAQTYRDPDEVKHYRETRDCLKQFRERTCHAGLLSASDLDAIDAEVEARIEDAVQRAKNDPKPEPDDLLRDVYVSYP

SEQ ID NO: 36270 - protein, 532 aa, Aspergillus oryzae
MLTLSFSALLGIALAWAIHRLAWKYSRLKAICVKRDNKLATQYGCEQPPRLRNWWPLGIDRLIQIWTADSEQRLMDLFTFPFKDVGYTLEQKFLGTIAFGTIDPENLEAIMTNINVFSFGLRRHILFPLLGDGIFTQEGKSWRHSRELLRPQFTRQHYRDLNIFRPHVDRLLHYLTGNGAATDLQPLFFRLTLDTTTEYLFGKSVNSLMPGEATKGQSFANHFDMAQNYVVQRFRLLDLYWLIGGPKFWRSCSAVHRFIDEIIDTRMDSKEKDKDCNSKSIFFDAVARDSRTRRDLRDQLTNVLLAGRDTTACLLSWTFHCLARHPDVLGRLNVEIASVVGTNTDLTRDDFKRMPYLDQVLREVLRLYPPVPVNTRTAHKTTILPTGGGKDGTKPFMVREGENVAFCVYAMHRREDLYGPDAGQFRPERWDEDLPLFQNERTATWGYLPFNGGPRACLGQDFGFVEAAYTVVRILQKYPIVKPDMYKGDIQGRKWLGWSSHQPEGIEMVTEERQKMTIVLSLGDGCRVTLGR

SEQ ID NO: 36271 - protein, 344 aa, Pseudomonas syringae pv. phaseolicola 1448A
MIEGVMSQESINWDTLGFDYIKTDKRYLSHWRDGAWDQGSLTEDNTLHISEGSTALHYGQQCFEGLKAYRCKDGSINLFRPDQNAQRMQRSCSRLLMPHVPTDVFIEACKQVVKANERFIPPYGSGGALYLRPFVIGVGDNIGVRTAPEFIFSIFCIPVGAYFKGGLKPNNFVISGYDRAAPNGTGAAKVGGNYAASLMPGSEAKKHSFADCIYLDPQTHSKIEEVGSANFFAITNDDVFLTPKSPSVLPGITRLSLIELAKSRLGLTVEEGDVFIDQLDTFKEAGACGTAAVITPIGGISYKDKLHVFYSQTEVGPVTQRLYKELTGVQSGDIEAPAGWIVKA

SEQ ID NO: 36272 - protein, 339 aa, Pseudomonas aeruginosa UCBPP-PA14
MARKISYQQAINEALAQEMRRDPSVFIMGEDNAGGAGAPGEDDAWGGVLGVTKGLYHQFPGRVLDTPLSEIGYVGAAVGAATRGMRPVCELMFVDFAGCCLDQILNQAAKFRYMFGGKAVTPLVIRTMVGAGLRAAAQHSQMLTSLWTHIPGLKVVCPSSPYDAKGLLVQAIRDNDPVIFCEHKLLYSMQGEVPEELYSVPFGEANFLRDGDDVTLVTYGRMVHLALDAAASLARQGISCEVLDLRSTSPLDEDSILESVEKTGRLVVVDEANPRCSMATDIAALVAERAFSALHAPIRRVTAPHTPVPFSDALEDLYIPDAAKIEAAVRQALEGRDAA

SEQ ID NO: 36273 - protein, 292 aa, Yersinia pestis CO92
MLSRYNGSQWADAIDIKVKKMTRYLNKDTTVCISLAARPSNFGTRFHNFLYDALDLDYLYKAFTTNDLAAAIGGVRALGFRGCAISMPFKEAVIPMVDEMDPSAKAINSVNTLVNTGGYLKAYNTDYIAIAKLLQEYQVPVDNVFALRGSGGMAKAVAFALKNAGFKQGYIIATNEKTGKQLAEQSGYIYRPDMQNIQADMLINATPVGMAGGADADKLAFTETEVDRAKIVFDVVALPAVTPLIRYAQTQGKTVITGAEVFAIQAVEQFVLYTGIRPSQALFEQAAAYARG

SEQ ID NO: 36274 - protein, 134 aa, Solanum tuberosum
DEYGNPVRQTDEYGNPIQQTGGTMGEYGTTGTGYGTQAGHTTGVLGGEQRQHGTLGGMLHRSGSSSSSSSVSEDDGHGGRRKKKGIKDKIKEKLPGGHRDDLAHSTATTTTTGYGMEGTHEKKGIMEKIKEKLP

SEQ ID NO: 36275 - protein, 117 aa, Yersinia pestis CO92
MAEETIFSKIIRREIPADVVYQDELVTAFRDIAPQAPTHILIIPNVLIPTVNDVTAEHEAALGRMVTVAAKLAEQEGIAEDGYRLIINCNHHAGQVVYHIHMHLVGGRELGPLLPHK

SEQ ID NO: 36276 - protein, 558 aa, Triticum aestivum
  misc_feature (435)..(435): Xaa can be any naturally occurring amino acid
  misc_feature (443)..(443): Xaa can be any naturally occurring amino acid
MGCLLGKLADAPGSSLFFPAAVTATGTAGGGDAEAQLSAPAPVHIAAVKKDASGWPLWLSSAAGDALQGWVPRSANAFQKLEKIGSGTYSNVYKAIEVETGAVVALKKVRVDGVGEAESARFMAREIALLCRLGEHDNVVRLHGLVTSRLATAPSLYLVFEYMDHDLTGLVSAATASGARFTLPQVKCYMKQLLSGIEHCHNKAVLHRDIKSSNLLVSEDGILKIADFGLATHFDPDNPRPMTSQVITLWYRPPELMLGATHYSVGVDLWSVGCVLAELLLGEPIFPGRTEVEQLHKVFKLCGTPADDYWDKLKLPHHTFKPYERCMAQKFKDLEPSTLSLLETLLSIDPDMRGTATDALNSEFFRTEPYACEPSSLPRYPPCKEMDIKLKYEKHKRKLRANGSVERQTNTRKPISQNHGRRRVFTPDVNNKPHXKPKVAWSXRGTSTTKLERFPPPHLDASIGHSIDSSADVTTNEFFSSSVVELKKMPSLLFGHVKSYLNSPKKGMHKAKPSLTMAPSTVLIGAFRPYSLGHPMEVRRKNRDQLRAKGKFPVGLVK

SEQ ID NO: 36277 - protein, 251 aa, Ashbya gossypii ATCC 10895
MSLSREDSVYLAKLAEQAERYEEMVENMKAVASSGQELSVEERNLLSVAYKNVIGARRASWRIVSSIEQKEEAKEKSEYQVKLIRTYRSKIESELTKICDDILSVLDTHLIPSATTGESKVFYYKMKGDYHRYLAEFSSGDVREKATTSSLEAYKSASDIATTELPPTHPIRLGLALNFSVFYYEIQNSPDKACHLAKQAFDDAIAELDTLSEESYKDSTLIMQLLRDNLTLWTSDMSEAGQEEQPADAHE

SEQ ID NO: 36278 - protein, 237 aa, Ashbya gossypii ATCC 10895
MTVIDITSKDQFTQQTTVAAGSKLVALYFHTAWAEPCKAMSAVFSAVSEEPAHKDVLFLAIDADEHAEISELFEVAAVPYFVLIKEGAIVKEISGSDPKDFVSALNEYTAGSNSTGAAATASAPAEEYGEEETEEQLQERLKKLTSAAPVMLFMKGTPSEPKCGFSRQMVGILREHQVRFGFFDILKDESVRQGLKTFSDWPTFPQLYINGEFQGGLDIIKESLEEDPEFFQNTLSS

SEQ ID NO: 36279 - protein, 542 aa, Lotus corniculatus
MAARTLSYLLSRSRSLSSSSGAASLLPSLGGKSGGWRNSNNRYSTAAVVEELITPQVSINYTQHLINGKFVDAASGKTFPAYDPRTGDVIAHVAEGDAEDVNRAVAAARKAFDEGPWPRMTAYERSRILLRFADLVEKHNDEIAALETWNNGKPYEQAAKAEVPTFVRLFRYYAGWADKIHGLTVPADGNYHVQTLHEPIGVAGQIIPWNFPLLMFAWKVGPALACGNTIVLKTAEQTPLTALVVAKLLHEAGLPPGVLNIVSGYGPTAGAPLASHMDVDKLAFTGSTDTGKVVLGLAAKSNLKPVTLELGGKSPFIVCEDADVDKAVELAHFALFFNQGQCCCAGSRTFVHERVYDEFLEKSKKRALRRVVGDPFKKGVEQGPQIDTEQFEKILRYIKSGIESNATLECGGDRLGSKGFYVQPTVFSNVQDDMLIAQDEIFGPVQTIFKFKEIDEVIRRANSTRYGLAAGVFTQNLATANTLMRALRAGTVWINCFDVFDAAIPFGGYKMSGIGREKGIYSLHNYLQVKAVVTPLKNPAWL

SEQ ID NO: 36280 - protein, 362 aa, Oryza sativa (japonica cultivar-group)
MSAYCGKYKDELIRNAAYIGTPGKGILAADESTGTIGKRLASIGVENVEENRRALRELLFTAPGALDCLSGVILFEETLYQSTRDGTPFVDVLAAAGVLAGIKVDKGTVELAGTDRETTTQGHDGLGERCRRYYAAGARFAKWRAVLSIGRASSRPSQLAVDANAQGLARYAIICQENGLVPIVEPEILVDGEHGIEACAEVTERVLAACYKALSDHHVLLEGTLLKPNMVTPGSDAARAPPEVVAEHTVRALLRTVPPAVPAIVFLSGGQSEEEATRNLNAMNQVASRGKKPWSLTFSFGRALQQSTLKAWAGKAENVGKAQAALLARCRANSQATLGAYAGDAAAGEGVSENLHVKDYKY

SEQ ID NO: 36281 - protein, 439 aa, Polyangium cellulosum
MSAQPEYCIVGGGPIGIGIGKCFAQEGLKFTIVEADEDFGGTWALSQRSGLVYKSTHLISSKKNTQFLDFPMPEDYPHYPSHAQMLSYLRSLATHYGLYDRALFGTRVEHVEPNGAGCRVRLSNGETRTFSAVVVANGRMRTPLIPRYPGVFSGETMHSAAYKSHEVFRGKRVLVIGGGNSGCDIAVDAALAAEQTFHSTRRGYHYMPKFIHGKPTQEWLMDMGSKFRSQDDYWSFVQREFKAAGYDPVDYGLPRPDHAIHEAHPILNSLVLYYIGHGDIHPKPDVRRFEGRTVEFVDGTRAEVDLILYATGYEMDFPFLAEDLRPSDGALELFLSMFHRKADSLVFVGYFNAASGLGNLLNCGGALVTDYLVAREKNTDAFRVLRRLIQGPEPDIGRGRFLNSPRHRVETDLWKAMKVMNFFRSVLNPARAAGDVVRA

SEQ ID NO: 36282 - protein, 597 aa, Zea mays
MASSASLQRFLLPSSHAAATAASPSSRLRRTGRARAAVSVPPPAAAGEQVPTERLEPRVEERAGGYWVLKEKYRAGLNPQEKVKLEKEPMALFMEGGIQDLARVPMEQIDAAKLTKDDVDVRLKWLGLFHRRKHQYGRFMMRLKLPNGVTTSEQTRYLASVIEAYGADGCADVTTRQNWQIRGVTLPDVPAILDGLRAVGLTSLQSGMDNVRNPVGNPLAGVDPHEIVDTRPYTNLLSSYVTNNSQGNPTITNLPRKWNVCVIGSHDLYEHPHINDLAYMPAVKDGEFGFNLLVGGFISPKRWAEALPLDAWVAGDDVVPVCKAILEAYRDLGSRGNRQKTRMMWLIDELGMEVFRSEVEKRMPNGVLERAAPEDLVDKRWERRDYLGVHPQKQEGLSYVGLHVPVGRLQAADMFELARLADEYGTGELRLTVEQNIVLPNVSNERLDALLAEPLLQEQRLSPRPSMLLRGLVACTGNQFCGQAIIETKARALQVAREVEKRVAVPRPVRMHWTGCPNSCGQVQVADIGFMGCLTKDSDGKIVEAADIFVGGRVGSDSHLADVYRKSVPCKDLVPIVADLLVERFGAVPREREEDEE

SEQ ID NO: 36283 - protein, 145 aa, Vaucheria litorea
VVPKTAENFRALCTGEKGVGRSGKPLWYKGSAFHRVIKDFMCQGGDFTRGNGTGGESIYGDKFADENFSLRHTGPGILSMANAGPGTNGSQFFLCTVPTPWLDGKHVVFGEVSKGMEVVRAIESVGSSSGKTSRPVVIANCGQLS

SEQ ID NO: 36284 - protein, 434 aa, Yersinia pestis CO92
MTTLKKKIVIIGGGAGGLELATSLGHKLGRSKKADIVLVDRNHSHLWKPLLHEVATGSLDDGVDALSYLAHARNHYFNFQLGSLTGINRENKTISLAEICDEHGDVLVTQRELSYDILVMALGSVSNDFGTPGVKDNCIFLDNPHQAHRFHNEMLNLFLKYSAQPGEKGKVDIAIVGGGATGVELSAELHNAVKQLHSYGFEGLDNHALNVTLVEAGERILPALPPRISSAAHQELTKLGVRVLTKTMVTSADENGLNTKEGEFIHADLMVWAAGIKAPDFMKDIAGLETNRINQLVVEPTLQTTRDPNIFAIGDCASCPQPSGGFVPPRAQSAHQMASRCYSNILALLNGQSLKPYIYKDHGSLVSLSKFSTVGSLMGNLMRGSMMVEGRVARVVYISLYRMHQVALHGYTKTGLMMLVGGINRVIRPRLKLH

SEQ ID NO: 36285 - protein, 182 aa, Arabidopsis thaliana
  misc_feature (121)..(121): Xaa can be any naturally occurring amino acid
  misc_feature (135)..(136): Xaa can be any naturally occurring amino acid
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGFVYREHGNSPGYYDGTXWTMWKLPLFGAPDXXQVVEREWEKCQERSTPMPLFRIIGFDNTRQVQCISFIAYKPPSFTG

SEQ ID NO: 36286 - protein, 513 aa, Chlamydomonas reinhardtii
MVLGRLFARSESAAPALADYNNEGNGSTIDTSVVAVEVEASGSPSSATVRGDSTLNEPLLEGFKDRGELPSLPESNASLSFPEESAPWWRKFFAFMGLGFLISVGYMDPGNWATDLAAGSSFGYTLLFVVLCSSLCAMFLQYLSLKLGIASDRDLAQACRDAYHPHVNKLLWVVAEAAIAATDLAEVVGCAIAFNLLLGIPLWAGVLITAADVIILLVAEARSFRFLEILVGALTALISACFIYELVKAQPDMGKVMRGYLPSKEIITNKDMLYLATGILGATVMPHNLYLHSSVIQTRAYPRTTAGRTIAIKLGLVDSTLSLLVAFVINSSILIVAAAAFHYATPPLEDIADITDAYELLASSLGSKAASILFGVALLAAGQNSTITGTLSGQIVMEGFLSFKMRPWLRRIITRGAAIVPAATVAAVMGREGVSQLLVLSQVILSLTLPFAVFPLVHFTSSRKYLGNFANRWYASVIAWLLFLFISALNVNLVVQSAISGSFGGLGHRRAAV

SEQ ID NO: 36287 - protein, 550 aa, Aspergillus oryzae
MASFDQEAKEGNDAKNPTNTPDALAGDVEEANGNTLKRALEGRHIQMIAMGGAIGAGLFVGSGEALANGGPASVLIGYLIVGVLLLCTIMSLGELAIMYPINGAFYQYSTRFIDPCWGFAIGWAYSLGWLVTLPFEITAASLTIEYWNSDLNPAIFVSIFLIVLVIIQVFGVRGYGEVEFVLSIIKVIACIGLIILGIIINTGGVPGSPQGYIGGKYWRDPGAFANGFKGFCAVFVNAAVAFSGTELVGLAAAETKNPQKTLPTATKQVLWRVTIFYIVNLLIVGLNVPHNSPQLLGSGDAASSAGVSANASPFVLAIQDAGIHVLPSIINAVVLISSLSVANSSTFASTRTLQALAADGGAPSFFAYIDKAGRPLAPIALQVLFGFLAYLQFASSGLTIFNWLLSIAGVSTVMMNLSINMAHIRFRLALKAQNRSTDEIPWKSTLGTVGSSIGAFLSAIALVAMFYSALYAPGGDPPSAFNFFQQYLAGFMGLVLMIFWKVWNRQWWLGVPLRQIDLDTGRRFMEMEQVTPDETGESLPWWKRAKQTIC

SEQ ID NO: 36288 - protein, 863 aa, Oryza sativa (indica cultivar-group)
MLGGLKDKLTGKNGNKIKGLAVLMSRKLLDPRDFTASLLDNVHEVFGNSITCQLVSATVADQNNEGRGIVGSEANLEQGLTDLPSVSQGESKLTVRFNWEMDKHGVPGAIIIKNHHSTKFFLKTITLHDVPGCDTIVFVANSWIYPVGKYHYNRIFFANNSYLPSQMPEALRPYREDELRYLRGEDRQGPYQEHDRIYRYDVYNDLGEPDRDNPRPVLGGSQKHPYPRRGRTGRIPTKKDPNSESRLSLLEQIYVPSDERFAHLKMSDFAGYSIKAIVQGILPAIRTYVDLTPGEFDSFEDILKLYRGGLKLPSIPALEELRKSFPVQLIKDLLPVGGSYLLKFPKPDIIKENEVAWRTDEEFAREILAGLNPMVIRRLTEFPPKSTLDPSKYGDQTSTITPAHIEKNLEGLSVQQALDSNRLYILDHHDHFMPFLIDINSLDGIFTYATRTLLFLRDDDTLKPLAIELSLPHIEGNLTTAKSKVHTPASSGIESWVWQLAKAYVAVNDSGWHQLISHWLNTHAVMEPFVIATNRQLSVTHPVYKLLQPHYRDTMTINALARQTLINGGGIFEQTVFPGKHALAMSSAVYKNWNFTEQGLPDDLIKRGIAIKDPSSPSKVKLLIKDYPYATDGLAIWQAIEQWVTEYCAIYYPNDGVLQGDVELQAWWKEVREVGHGDLKDADWWPKMQSLPELTKACTTIIWIASALHAAVNFGQYPYAGYLPNRPTISRRPMPEPGSKEYTELDENPEKFFIRTITSQFQTILGVSLIEILSKHSADEIYLGQRDTPEWTSDPKALEAFKRFSRQLVEIESKVLNMNKDPLLKNRVGPANFPYTLMFPNTSDNKGAAEGITARGIPNSISI

SEQ ID NO: 36289 - protein, 591 aa, Rhodospirillum rubrum ATCC 11170
MCGVCGEIRFDGQFAGTTAVDRMTAKLAPRGPDDGGILVHGPVALGHRRLSIIDLSPKAAQPMVDSDLGLSIVFNGCIYNYPALRSELEALGYRFFSGGDTEVILKAYHAWGTACVKRFNGMFAFAIHERDSGKVVLARDRFGIKPLYLAEVDGGLLFASSLPALLATGRVDKAIDPLALRFYISFHAVVPAPRTILKGVRKLPPATLRVVSADGSSFDEVYWRLDFRALPGEDGRSAKDWEDGLFEAVRAAVARRIIADVPVGVLLSGGLDSSLIVGLLAEAGQRDVETFSIGFEEANGEKGDEFFYSDLIAERYATRHHKIFIPEADMIAALPGAIAAMSEPMVSYDNVAFYLLAREVSKRVKVVLSGQGADEIFGGYHWYRPLVGSTDPVADYAAHFFDRTPERLARHLSPAWLGTTDEARAFVAAHFAEDGAPDPVDKALRLDSTVMLVEDPVKRVDNMTMAFGLEARVPFLDHQLAEFAGRIPSSLKLAQNGKGILKEVARRVVPAAVIDREKGYFPVPGLKYIEGSRLDYVRDGLSSRAARQRGLFREDYLASLYENPRDAITPLRGSELWQVGLLELWLQEHGI

SEQ ID NO: 36290 - protein, 329 aa, Streptomyces fimbriatus
MPILMPSADVPTIDISPLFGDDPDAKTHVAQQINKACRGSGFFYASHHGIDVQQLQDVVNEFHGTMTDEEKYDLAINAYNSANPRVRNGYYMAVEGKKAVESWCYLNPSFGEDHPMIRSGTPMHEVNIWPDEKRHERFRPFCEQYYRDMFQLSKTLMRGFALALGKPEDFFDANLPEDDTLSAVSLIRYPHLKAYPPVKTGPDGTKLSFEDHLDVSVITVLFQTEVQNLQVETVNGWQDLPTSGDDFLVNCGTYMGYLTNDYFPAPNHRVKFINAERLSLPFFLHAGHTTLMEPFSPEDTGGKELNPPIEYGDYLQHGFHALIAKNGQT

SEQ ID NO: 36291 - protein, 470 aa, Zea mays
MGAFLLFVCLLAPVVVLACAVRGRKRRASSAAAGGKALPLPPGSMGWPYVGETFQLYSSKNPNVFFARKQNRYGPIFKTHILGCPCVMVSSPEAARFVLVTQAHLFKPTFPASKERMLGPQAIFFQQGDYHAHLRRLVSRAFSPEAIRGSVPAIEAIALRSLESWDGRLVNTFQEMKLYALNVALLSIFGEEEMRYIEELKQCYLTLEKGYNSMPVNLPGTLFHKAMKARKRLGAVVAHIIEARREGERQRGSDLLASFLDDREALTDAQIADNVIGVIFAARDTTASVLTWMVKFLGDHPAVLKAVIEEQQEIARSKGSSGEPLTWADTRRMRTTSRVIQETMRVASILSFTFREAVEDVEYQGYLIPKGWKVMPLFRNIHHSPDHFPCPEKFDPSRFEVAPKPNTFLPFGNGTHSCPGNELAKLEMLVLFHHLATKYRWSTSKSESGVQFGPFALPLNGLPMTFVRKD

SEQ ID NO: 36292 - protein, 548 aa, Coprinopsis cinerea okayama7#130
MNLTPQLASFSIPAIDNEPMKSYAPGSPERQALQAAIRQMEQELPFEVPCIVNGQEVRTGKLAKQPLPHDHAKHLCQYHEADEVTAAKAIEGALAAKAEWEAMPWNDRAAIFLKAADLVSQKYRYKLMAATILGQGKNAWQAEIDAAAELADFLRFGVKYVEELYAQQPPKNAQGSWNRVEYRALEGFVLAVSPFNFTAIGGNLPGAPALVGNVVVWKPAPAATYSNYLVYQILAEAGVPPGVIQFVPGPPAEVVAQAIGHREFSALHFTGSTFVFKKLWKDIAMNLDKYRGYPRIVGETGGKNFHLVHKSAEVRNAVLQSVRAGFEYQGQKCSALSRLYVSRSVWENGFKDQFLGEVAKIKVGPPQDFGNFMGPVIGRSAYDKILGYIQKAKDAGGEVLIGGTGDDSKGYFIQPTVILTKDPKSVTMVEEIFGPVITVFVYEDDDFEKTLELIDTTTDYALTGAIFSQDRKVLISATNKLRNSAGNVYYNEKCTGAVVGQQPFGGGRASGTNDKAGSINLFYRFVSPRSIKENFVGLEDFQYPSNLV

SEQ ID NO: 36293 - protein, 569 aa, Ralstonia solanacearum GMI1000
MEKPWLKHYPPGVPAEIDASQYRSLAHLLEDSFQKNRDHRALECMGKVLTYGEVDALSRQLAAWLQSRGLVPGARVALMMPNVLQYPVALAAVLRAGYVVVNVNPLYTPRELEHQLKDSGAEAIVILENFATTLQQVLPNTPVKHIVVASMGDLLGGLKGMLVNFVVRSVKKMVPAWELPNCIRFNTALEAGARLALKPTAVGPDDIAFLQYTGGTTGVSKGATLLHRNIVANVLQSEAWMQPGLDKPAHDGSRLAPGDEVVTITALPLYHIFALTVCCLLSMRKGGLAVLIPNPRDIPGFIKVLKRYRFHMFPAVNTLYNALLNHPEFASVDCSRLRVANGGGMAVQEAVAKKWLEVTGCPIIEGYGLSETSPSATCNPTDTDVFSGTIGVPLPSTEIAIRDDEGRDQPIGTPGEICLRGPQVMAGYWKRPDETAKVMYADGFFKTGDVGVMDARGYTKIVDRKKDMILVSGFNVYPNEIEGVVAMCPGVLEVAAVGVPDVHSGEVVKLFVVRRDPSLTEERLLAFCKEQLTGYKRPKFIEFRNELPKTNVGKILRRELRDEAMKKRA

SEQ ID NO: 36294 - protein, 131 aa, Brassica napus
  misc_feature (77)..(77): Xaa can be any naturally occurring amino acid
MVRVSVLNDALKSMYNAEKRGKRQVMIRPSSKVIIKFLIVMQKHGYIGEFEYVDDHRSGKIVVELNGRLNKCGVISXPRFDVGVKEIEGWTARLLPSRQFGYIVLTTSAGIMDHEEARRKNVGGKVLGFFY

SEQ ID NO: 36295 - protein, 316 aa, Aspergillus oryzae
MKSPIPDYLRQVLEKARPDDSGQLANYIDVLAKADPSKMAIALSTVDGNLYSAGDDEVEFSIQSISKAFVYAIAIEDAGLPRVLEKIGVEPSGDAFNKLSLQPGTNRPMNPMINAGAIAAHTLVAGESASAEERVDHILKVLSKLAGRQLKVDEEVYEAELKDANRNMAIGYMLKAAGIISCDPQDAVRGYIRQGSITTNVRDLAMMAATLANAGVNPITGEEIMPHQSARQVLSVMTTCGMYDAAGDWVSRVGMPAKSGVAGGIIGALPGQVGIAVFSPKLDERGNSFRGVKMFEQLSSEMGLHMMDISQGSMWE

SEQ ID NO: 36296 - protein, 213 aa, Campylobacter jejuni RM1221
MKNYYLVDEKRKTPVSTWEKISQALRRSVKLELFVGLFVMMRELLKRNNSATIKYPFEKVKLDNRYRAVHRLMRFIESENERCIGCGLCEKICISNCIRMETSLDENGRKKVGNYSINLGRCIYCGFCAEVCPELAIVHGTEYENAAEQRSYFGYKQDFLTPIDKLKNQVEFEGAGSLRKDANLWVKKTPNYYDAMLESALENQNTQEQGENK

SEQ ID NO: 36297 - protein, 411 aa, Triticum aestivum
  misc_feature (296)..(297): Xaa can be any naturally occurring amino acid
  misc_feature (306)..(306): Xaa can be any naturally occurring amino acid
TRPVDAPARADKRAAPATTTTTTPPPSSSGGNTTTTTSSRAAVAAPEPAACNLYQGWWTYDAEASQVPLYREAECEFLTEQVTCMRNGRRDDSYQRWRWQPSSCDLPRFDARALLERLRNKRLMFVGDSLNRNQWESMVCLVQSVIPKGHKTLTKFVNNGSSNVFYAHDYNATVEFYWAPFLVESNSDNPKVHSVPDRVIQWHSIAKHAKNWVGVDYLVFNTYIWWLSALDMKVLKKGSFDEGATEYEEVDRPVAYSEVLKTWAKWVDRNIDPNSTTVFFMGMSPNHITPEAWGNXXGIKCAMETXPIANRSATLDVGTDWRLYAGAQDVLKTFRRVPVHFVDITALSELRKDAHTSVHTLRQGKLLTPEQQANPKTYADCIHWCLPGLPDTWNQFLYARIVSSASTQRQE

SEQ ID NO: 36298 - protein, 324 aa, Triticum aestivum
MATLVLYQFFLKLLLLISVFQLSFAARRLNQLVQDQSQLLHYHNGPLLYGKIAVNLIWYGHFKPSQKAIITDFVTSLSSPSSQSSQPSVATWWKTTEKYYHLSPKNKKAASSLSLSLGDQFLDEGFSLGKSLTSKNLVELASKGGQRNAINVVLTSADVAVEGFCMSRCGTHGSSSSASHVKKNNNGKNYKFAYIWVGNSETQCPGQCAWPFHQPIYGPQSPPLVAPNNDVGLDGIVINLASLLAGTATNPFGNGYFQGPAEAPLEAASACPGVYGKGAYPGYAGNLLVDSATGASYNVEGDNGRKYLVPALYDPSTSSCSTPV

SEQ ID NO: 36299 - protein, 856 aa, Oryza sativa (indica cultivar-group)
MLGGIIDTITGSSKQSRLKGMVVLMRKNVLDLNDFGATVIDGLGEFLGKGVTCQLISSTAVDPNNGNRGKVGAEASLEQWLTSSLPSLTTGESRFGVTFDWDVDKLGVPGAIIVKNHHSNEFFLKTITLDDVPGRAGAVVFLANSWVYPADKYRYDRVFFANDAYLPSQMPAALKPYRDDELRNLRGDDQQGPYEEHDRVYRYDVYNDLGSPDSGNPRPILGGSPDTPYPRRGRTGRKPTTTDPDSESRLSLVEQIYVPRDERFGHLKMADFLGYSIKAIAEGIVPAIRTYVDTTPGEFDSFQDILDLYEGGLKLPDVPALEELRKRFPLQLVKDLLPAAGDYILKLPMPQIIKQDKEAWRTDEEFAREVLAGVNPMMITRLTEFPPKSSLDPSKFGDHTSTITAAHIGSNLEGLTVQQALDSNRLYILDHHDRFMPFLIDVNGLEGNFIYATRTLFFLRGDGTLAPLAIELSEPMIQGDVTAAKSTVYTPASTGVEAWVWQLAKAYVAVNDSGWHQLISHWLNTHAVMEPFVIATNRQLSVTHPVHKLLSPHYRDTMTINALARQTLINAGGIFEMTVFPGKYALWMSSMGVAVEDATSPFKVRLLIKDYPYAADGLEIWHAIEQWVGEYLAIYYTDDGVLRGDAELQAWWAEVREVGHGDLKGAAWWPRMDAVSELRDACTTIIWIASALHAAVNFGQYPYAGYLPNRPTVSRRRMPEPGTEAYGELGRDPERAFIRTITSQLQTIIGISLIEVLSKHSSDEVYLGQRDTPAWTSDARGAGGVPAVQRPAGGDRREGGGHERRRGAQEPQWPSRVPIHAALPQHLRRHRRRRRHHRQGHPQQHLDLKSELPILI

SEQ ID NO: 36300 - protein, 273 aa, Arabidopsis thaliana
MWMATQSNSGFDSLSSMMSRHAINFQSNTSSEMTPMSPYLGMNMNMINVGSPGFLQTGNSSNGSDSGSGLKLDTSMVSEWSNEEQYILDAGLEKYKDMPSIDMYIQIGNTLPDKSIRDIALRCRWLRRKRRKSEELNCGRRASSSKGKQVESSSKSSIPSVLPHNMASYPFSGPSTSTSKQITSEDLSSYATNLIEQNVRAFSQIRANLSSYKAGDNLDLFRQARNNLITIQNEINNMPGLMNKMPPLPVTINDDLSVMMPFNTMQSGGFHRK

SEQ ID NO: 36301 - protein, 640 aa, Kluyveromyces lactis NRRL Y-1140
MIKLPAKLLGSRFYSSVTNQNRYSVTRHNAPKKCPESGHYNKIPIGKEAARLQSQPKVTRLSVDGPIECPLEGFQLLNSPLFNKGSAFTLEERKAFGLDGLLPPQVNTLDEQVERAYKQLCYLKTPLAKNDFMTSMRVQNKVLFFELVRRHIRQLVPIIYTPTEGDAIAAYSHRFRKPEGVFLDITEPDSIDSRLAAYGEDKDVDYVVVSDGEGILGIGDQGIGAIRIAISKLALMTLCGGVHPGRVMPVALDVGTNNKQLARDELYMGNRFSRIRGKQYDQFLDKFIKALKHRFPNAVLHFEDFGVTTARTLLERYRNELPCFNDDIQGTGAVVMASFIAALKHTNRELVDSRILVYGAGSAGLGIADQIVNHMVTHGCTPEEARAKIYLMDRKGLILDTMENDSNPAQFLYAKPSENWEGANTQSLVDVVSKVKPTCLIGCSTQAGAFNKVVVEEMYKHNPRPIIFPLSNPTRLHEAVPEDLLKWTNYDALVATGSPFPPVDGYRISENNNCFSFPGIGLGAVLSRAKVISDKMISAAVDQLADLSPLKPGDSKPGLLPPLEEINDTSARVATAVILQALEEGSARIEEENVPGTDKKVQVPRDFNKCLEWVIKQMWKPEYRPLIKVEHDPAVHTHQF

SEQ ID NO: 36302 - protein, 877 aa, Oryza sativa (indica cultivar-group)
MQVQGFFDRLTGRNKEAWKEGRIRGTAVLVKKDVLGLGDFHASLLDGVHNILGHKEGVAFRLVSATARDPSNGGRGKLGKPAHLEELVVTMKSTAAGESVFRVAFEWDESQGIPGAVVVTNSNRSEFFLKTLTLDGVPGKGTVVFVANSWIYPADNYQYERVFFANDTYLPSKMPAPLIPYRQEELNILRGDGKIGPYKEHDRIYRYDYYNDLGQPDKGSKLVRPVLGGSQELPYPRRGRTGRAPTKTDPNTESRLPLLDLNIYVPRDERFGHLKMSDFLGYSLKAIVEGVLPIIRTYVDTTPKEFDSFQDIMELYEGGLKVANASALAEIKKRVPFELIKSLLPVAGDQVLKLPLPHVIKEDKFAWRTDEEFAREMLAGVNPVMIKRLTNFPAKSTLDPNVYGDHTSKITEAHIKHNMEGLTVQNALKGNRLFILDHHDHFMPFLDKINKLDGNFIYASRTILLLKDDGTLKPLAIELSLPHPDGQQHGAVSKVYTPANTGVESQIWQLAKAYASVNDSAWHQLISHWLNTHAVIEPFVIATNRQLSVVHPVHKLLSPHYRDTMNINALARQTLINADGIFEKTVFPGKYALEMSSVVYKNWKFTEQALPVDLVKRGVAVPDPTSPYNVRLLIKDYPYAVDGLVIWWAIERWVGEYLAIYYPNDGVLRGDEELQAWWKEVREVGHGDLKDQDWCPKMDTVQELTRACTIIIWIASALHAAVNFGQYPYAGFLPNRPTVSRRPMPEPGTEEYAKLERGGDEADLVFIHTITSQFQTILGISLIEILSKHSSDEVYLGQRDTPEWTSDAKALDAFKRFGSRLVDIENRIKDMNGNSALKNRNGPVKMPYMLLYPNTSDVTKEKGQGLTAMGIPNSISI

SEQ ID NO: 36303 - protein, 457 aa, Glycine max
TKETLKMQMQAMSKPMNLFSNDIGPRVSPYDHYIVNKHGKNSFIWNGQTPRVTLTDPELIKDVFNKIYDFGKPNMGPNIRSLIPGLAMHEGEKWSKHRKIINPAFNLEKLKNMLPLFIQCCDDLISKWEEMLSSDGSSEIDVWPFVKNLTADVISRTAFGSSYLEGRRIFQLLKEKIELTLKMRGQRLVPKRMKEIDRDIKASLMDIINKRDKALKAGEATKNNLLDILLESNHKEIEEHGNNKNVGMNIEEVIEECKLFYFAGQDTTSVLLVWTMILLSRYPDWQARAREEVSQVFGNQKPTFDGLNQLKIVTMILYEVLRLYPPGVGVPRKVIKDVKLGNLSFPAGVEIFISTILVHHDSELWGDDAKEFKPERFSEGVLKATNGRFSFFPFGGGPRICIAQNFALLEAKIALSMILQCFSFELSPTYTHAPTMVMTIQPQYGAPVILHKVEKYE

SEQ ID NO: 36304 - protein, 245 aa, Triticum monococcum
MDMSLEHSSSASSSSTTERGGTAWPWPPKRPAGRTKFRETRHPVFRGVRRRGNAGRWVCEVRVPGDRGTRLWLGTYFTAEAAARAHDAAMLMLRGRSAACLNFRDSAWLLSVPPAFSNLSDVRRAAVQAVADFLRRPEATGAFAGAAQEVTSSVTVPSAAACSVPSSETAQTSGDANFEEPGALSMDMFDLDCLFGETDSDTYYYANLAQGLLMEPPPSMATGAYWDNGDCADGGAGADVALWSY

SEQ ID NO: 36305 - protein, 279 aa, Exiguobacterium sibiricum 255-15
MEQKLKLWFTEHQTEDYGITFRVNHVYESEQTEFQRLEMVETDEFGTMLLLDGMVMTTDRDEFVYHEMVAHVPLFTHPNPKSVLVVGGGDGGVIREVLKHPSVEKAVLVEIDGKVIEYSKKYLPNIAGGLDDARVEVIVGDGFMHIAEAVNEYDVIMVDSTEPVGPAVNLFTKGFYSGISKALKEDGIFVAQSDNPWFTPELIRDVQRDVKEIFPITKLYIANVPTYPSGLWTFTIGSKKHDPLAVAPERFHEIETKYYTPELHTAAFALPKFVKDLTI

SEQ ID NO: 36306 - protein, 158 aa, Glycine max
  misc_feature (33)..(33): Xaa can be any naturally occurring amino acid
  misc_feature (37)..(37): Xaa can be any naturally occurring amino acid
MHSKPSSITSNYPLISAIVAFALAQSIKFFTTXICKXKDRRWDLKQLVGSGGMPSSHSATVTALAAAIGLQEGFGGPLFATALVFACIVMYDATGVRLQAGRQAEVLNQIVYELPAEHPLAESRPLRELLGHTPPQVIVGGILGLLTAIGLLRPVTKN

SEQ ID NO: 36307 - protein, 210 aa, Triticum monococcum
MDNSGVVFYGGAYATVMSAPPKRPAGRTKFRETRHPVYRGVRRRGAAGRWVCEVRQPNNKSRIWLGTFASPEAAARAHDVAALALRGRAACLNFADSAALLAVDPATLRTPQDIRAAAITLAQTACPHDAPRSSVSAASAPAPAMVITQEAAAAPYDSYAMYGGLADLEQHSHCYYDGMSGSGDWQSISHMNVADEDGGYGAGDVALWSY

SEQ ID NO: 36308 - protein, 665 aa, Listeria innocua Clip11262
MSRIDEQMVNSIRVLSMDMIEKANSGHPGLPMGAAPMAFSLWKNHLKFNPEHPTWFNRDRFVLSAGHGSAMLYSLLHLFGYDLPMSELKNFRQTGSKTPGHPEFGHTVGVDATTGPLGQGFAMGVGMAMAEAHLGAKFNQPEFPVVDHNTYVLCGDGCLMEGISYEAASLAGHLKLGKLVVLYDSNDISLDGDLNESFSEDIELRFRAAGWQTLRVDDGNDLDALDAAIHLAKTEKSRPTLIEVKTVIGYGSPGKAGKSAAHGSPLGEKELKLAKEAYDWQMPPFELPKTVENQKEFYHSKGRASESSWLRTFNAYKQKYPALAESLQQLMDDNLNPDWDAELPVFDENADKPVATREVSGIVLQELEKKLPNLFGGAADLASSNKTNLKASERFAPGNYAAKNISFGVREFAMGAAVNGMTLHGGVQAFGATFFVFSDYLRSAIRSAALMGIPSTFIMTHDSIAVGEDGPTHEPIEHLASFRAMPGLHVIRPADGNETVEAYRYAFTQKEQPTMLVLSRQNLPILPNSAAKAKTGLAKGAYILADSPLDKLDIILLASGSEVHLMTAVRDNLAKKGFGARVVSMPSFDLFDKQSPEYKESILPKAVKKRFAAEMGASYGWHKYLGDAGEILAIDSFGMSGPGDELAERFGFTVENLTELALKQL

SEQ ID NO: 36309 - protein, 844 aa, Ralstonia solanacearum GMI1000
MPSPLICAERIRLQQRATDKTSAIRAAGRLLADTGCIDPAYIDSLLRRETVANTFLGHGVAIPHGMGEDRHLIRQTGIAVLQFPDGLEWHPGQTTHLVFAIAAQSDEHITLLRRLTRLLNDDARLRQLFSTQRAEDIVAALSQDAPAPAASAPGGDLAERLALTLNYPSGLHARPAAQWVETARRFAARVQVRHGAETADAKNLVALLQLGLAAGAALTLSAEGPDARAALTALQHTIRSLTAQERAQAARDTQAARTRQIARGWQPAADLPAIGGIGASPGLAIGTVHVMQPGVSAIPDHPVPLATGGDLLDRALADTRAELAALARDTAARLGEAEAGIFKAQAELLGDTDLMTLTCQAMVEGHGVAWSWHHAVERLAERLAALGNPLLAARAADLRDVGRRVLGHLDPALRGTAQALPDGPCILVAQDLSPSDTAALDTRRIAGIVTAQGGPTSHTAILTRTLGIPAVVAAGPAVLDVASGTQAIVDGSGGQLYLDPDAAAVAGAEAWLREDAARAQREQAERGLPARTRDGHAVEIAANVNLPAQAIEAVTLGAEGVGLMRTEFLFLERDHAPDEDAQHEVYAAMLGALGGRPLIVRTLDIGGDKQVPHLNLPKEENPFLGVRGARLLLRRPDLMEPQLRALYRAASGGGPLSIMFPMITSLGEVIALRAACERIRAELDAPAVPLGIMVEVPAAALLADQLAEHVDFFSIGTNDLTQYTLAIDRQHPDLAAEADSLHPAVLRLIQLTVQGAARHGRWVGVCGGLAGDPFGALLLTGLGVHELSMSPRDIPAVKARLRDAHVRQLTELAGQALACASAEDVRALEATLPAHRAGTEMAAA

SEQ ID NO: 36310 - protein, 257 aa, Brassica napus
MSSREVNVYMAKLAEQAERYEEMVEFMEKVAKTVDSEELTVEERNLLSVAYKNVIGARRASWRIISSIEQKEESKGNEEHVAIIKEYRGKIETELSKICDGILNVLEAHLIPSASPAESKVFYLKMKGDYHRYLAEFKAGDERKDAAESTLVAYKSAQDIATAELAPTHPIRLGLALNFSVFYYEILNSPDRACTLAKQAFDEAIAELDTLGEESYKDSTLIMQLLRDNLTLWTSDMTDEAGDEIKEASKPEGGAAE

SEQ ID NO: 36311 - protein, 212 aa, Triticum monococcum
MDAADAASPCDGHRTVWSEPPKRPAGRTKFKETRHPLYRGVRRRGPAGRWVCEVRVLGMRGSRLWLGTFTTAEMAARAHDAAVLALSGRAACLNFADSAWRMLPVLAGPFSTAKEIKDAVAVAVLAFQRQHPVASMAPLSPARTTDDEKEIDGSPAPSALSMSSELLNEHWFGGMDAGSCYSEFMESPDTRPWREDFELGGVETPPWSYLFD

SEQ ID NO: 36312 - protein, 246 aa, Triticum monococcum
MDMGLEVSSSSPSSSSASSSPEHAAGRASLAKRPAGRTKFRETRHPVYRGVRRRGNAERWVCEVRVPGKRGARLWLGTYATAEIAARANDAAMLALGGRSAACLNFADSAWLLAVPPALADLGDVRRAAVEAVADFQRREAANGSLTVTATVTEEASCGAPEESSSESDSVGSSETSEPSADGEFEVPVAVDTDMFRLDLFPELDLCSYYASLAEALLVDPPAPVTTTYAYWDNGDGGADVALWSY

SEQ ID NO: 36313 - protein, 181 aa, Solanum lycopersicum
MASSIVSSAAAATRSNVAQASMVAPFTGLKSAASFPVTKKNNNVDITSLASNGGRVRCMQVWPPINMKKYETLSYLPDFSDEQLLSEIEYLLKNGWVPCLEFETERGFVYRENNSSPGYYDGRYWTMWKLPMFGCTDATQVLAEVQEAKKAYPQAWVRIIGFDNVRQVQCISFIAYKPEGF

SEQ ID NO: 36314 - protein, 180 aa, Solanum lycopersicum
MASSVISSAAVATRSNVTQASMVAPFTGLKSSATFPVTKKQNLDITSIASNGGRVSCMQVWPPINMKKYETLSYLPDLSDEQLLSEVEYLLKNGWVPCLEFETEHGFVYRENNKSPGYYDGRYWTMWKLPMFGCTDATQVLAEVQEAKKAYPQAWVRIIGFDNVRQVQCISFIAYKPEGY

SEQ ID NO: 36315 - protein, 359 aa, Pseudomonas fluorescens Pf-5
MSQQDNPDTQMKWMIYGANGYTGELIARDAVKRGLRPVLAGRNRDKVEALARELGLEARVFGLDDDARLLAQVKGLGLVLHCAGPFSATAAPMIEACLRASAHYLDITGEIAVFEHAQSLNERARAAGVVICPGVGFDVVPTDCVAAALKDALPDATHLALGFDSRSSFSPGTAKTSIEGMAQGGKVRRDGRIVSVPLAYRVRRIDFGAGEKLSMTIPWGDISTAYHTTGIPNIEVFIPGSAGMIRGARFANLIRPLLGWPWVQRLLKERIGKTVVGPDEQKRADQGTYVWGEARNARGDRKVARVHTTNVYSLTVYAALSVVGHLLQVRPTGGAYTPAKLLGADLVTKLPGSGALDIE

SEQ ID NO: 36316 - protein, 353 aa, Aspergillus nidulans FGSC A4
MSNKQIILHERPTDAIDPSLTSGTFRLRTVPRPDNVPADKVLVRVHYLSLDPAMRQWLSASRSYIAPVKIGAVMRGVSMSRVVAVGKDLASKFQVGDWVSAYTGWQEYAVLGKDDVEKIAIPVGGRPTDVLSVLGLTGLTAYFGMIEIGQPRPGDTVVVSGAAGATGMVAGQIAKIKGAKRVIGLAGTQDKCDFLVKELGFDVAINYKSPNWRKQLKAATPDYINVYFDNVGGEILDACLARAAPFSRFVMCGAISQYNTSKPKGPASYMNVISQRVTMKGFIVFDFAEKYAAAREELSSWLAQGKLARKDHILTGGLESAPKALVDLYAGANTGKMMVEVAPVNETEPRAKL

SEQ ID NO: 36317 - protein, 294 aa, Prochlorococcus marinus str. MIT 9313
MVLRSSIEAPSINKMQESSIGFSNRDLDMETPFRNVTPNTPGGTASLLIALLFSSFILITQALFVVPAGQVAVVTTLGKVSGGSRLPGLNLKIPFIQAVAPFDVRTQVRPEKFASLTKDLQVIEATATVKYAVRPNEAGRVYSTIASNDREIYPRIIQPSLLKALKSVFSQYELVTIASKWSDISELVERAVADELDKFDYVEVRGLDLTGLVIAEEYRAAIEQKQIAEQQLLRAQTEVKIAEQEAQRYETLNRTLDDQVLFKLFLDKWDGSTKVVPALPGSKGGGTPVIVGGR

SEQ ID NO: 36318 - protein, 655 aa, Bradyrhizobium sp. BTAi1
MLHCSQPPQTPLTAIRVGFPQQRSWSDRSPCRAMSAERMTRSSSHPHRPIAVAAGASSAIMKIEPLSVGFNDEQKRYLEGLAAGLKVNLAGRAQTATAPLAEPSGPDAIHIKAQDKVLAAGRKLADQEKVKREQHPFDAYPRLKQQAHSNAAPSAADNFRWRYFGLFHVAPAQDSYMCRLRIPNGILKHWQLTGLADLADQLCGSYSHVTTRANLQLREIPPKHAVMLLEGLSDLGLTARGSGADNIRNVTGTPTAGIDPQELLDTRAYAREWHFHILNDRSLYGLPRKFNVAFDGAGRIAALEDTNDIAFSAVEVKDGFGVAPGVWFRLGLGGITGHKDFAKSTGIIVEPERATEVADAIVRLFIETGDRTNRLKARLKYVLDSMGHDKFMEAVESRLGRKLARVADEAIKPRPEADRMAHIGVHPQKQQGLNWIGVVLPLGKLTTDQMRALARIAADLGDGEIRLTVWQNLLLPGVRDENVAMACAAIEQIGLSTKASHIRAGLIACTGNSGCKFAASNTKRHAAEIGDWCESRVEVDTPLNIHLTGCHHSCAQHYISDIGMIGAKVPVGDGDETVEGYHLFAGGGFGPQADIGREVYRDLKAEDAPRTVEKLLKAYLAHRLSPDETFLSFARRHDGETLRKLADAQTSEVAA

SEQ ID NO: 36319 - protein, 621 aa, Rhodospirillum rubrum ATCC 11170
MTAPFLSSLSPTSPLASATAPFPGSRKVYARPADAPHLRVPFREIILSDPGEAPVRVADPSGPYSDPEATIDLRQGLARHRASWASARGNSTVTAGRPAPSEGDFEAFPLTYAPLRRRDETPFTQLEYARAGVITDEMIYVATRENLGRDSAVAGACARLAGGEAFGAALPAHVTPEFVRAEIAAGRAIIPANINHPELEPTIIGRNFLVKVNANIGNSALGSSIEDEVAKLVWAIRWGADTVMDLSTGKAIHATREWILRNSPVPIGTVPLYQALEKVGGDATRLDWAVFEDTLIEQCEQGVDYFTIHAGVRLAHIPLTASRTTGIVSRGGSILAKWCLSHHRENFLYERFADICAILRRYDVAFSLGDGLRPGSVADANDAAQFAELDTLGALTAVAWEHGCQVMVEGPGHVPMHKIKANMDRQLATCGEAPFYTLGPLTTDIAPGHDHITSAIGAAMIGWFGTAMLCYVTPKEHLGLPDRADVKAGVIAYKLAAHAADIAKGHPAAQLRDDAISRARFDFRWSDQFNLGLDPEGARAFHDETLPHAAHKTAHFCSMCGPKFCSMKISHDIRDGALEGADALTQAGLDQMSATFRASGGEVHLDAQALDALAWEGKPAR

SEQ ID NO: 36320 - protein, 150 aa, Brassica napus
  misc_feature (52)..(52): Xaa can be any naturally occurring amino acid
  misc_feature (135)..(135): Xaa can be any naturally occurring amino acid
MADERDGGRLSDASDYSSEDEGTEDYRRGGYHAVRVGDTFKNGSYVIQSKLXGWGHFSTVWLAWDTLKSRYVALKIQKSAQHYTGGQPWTRSKIFENRLRKGDAEDKKCVVKLLDHFKHAGPNGQHVCMVFEYLXGDNLLSGIKYSDYRG

SEQ ID NO: 36321 - protein, 239 aa, Triticum monococcum
MDLSSSSPSSSASSSPEHASGRASPAKRPAGRTKFRETRHPVYRGVRRRGNAGRWVCEVRVPGKRGSRLWLGTYLTAEAAARANDAAMLALGGRSARCLNFADSAWLLAVPSALSDLADVRRAALQAVADFQRWEAANGLVTRTAAEQAPSSAPAQSSSESDSADSSETSEASADGEFEVLATMDIDMFRLDLFPEMDLGSYYVSLAEALLMDPPSTATIIDAYRDNRDGGADVALWSY

SEQ ID NO: 36322 - protein, 255 aa, Triticum aestivum
RKRPSTDFLETIQKDVNPSMRAILIDWLVEVAEEYRLVPDTLYLTVNYIDRYLSGNEINRQRLQLLGVACMLIAAKYEEICAPQVEEFCYITDNTYFKDEVLDMEASVLNYLKFEMTAPTAKCFLRRFVRAAQVCDEDPPLHLEFLANYVAELSLLEYSLLAYPPSLVAASAIFLSKFILQPAKHPWNSTLAHYTQYKPSELCDCVKALHRLFSVGPGSNLPAIREKYSQHKYKFVGKKQCPTSVPAEFFRDAAC

SEQ ID NO: 36323 - protein, 378 aa, Ashbya gossypii ATCC 10895
MLRASALRTVRSLRTPTFGTAFPVGLQRTAIRLNSSASGGGIPKATEELSELQNQLPTFETAEPIVQAAGEASNHIGYLASINMADSWLWPTGLLQNILEHVHVYAGLPWWGTICVTTVLVRALLFPLYVKYSDTIAKTSRVKPELEQLTREVMASTDLVEQQQATLKRRKLLQENGIKNRYLVVPILQLPLAISFFAAIRQMANYPVDGFSVQGIWWFADLAQADPYLGLQCLTAAMFMGLSRAGGESGAQQFSPQMRKVFTFLPLLTIPATMNLASGVVLYLAVNGVCSVAQTLLLRTPAIRRKLNIADVVPAPPADPNAPPKGLLESFRENIKKAKEQAEKKAEMNKKRYELEEAAKKEKERTSNIKIVHRSKLK

SEQ ID NO: 36324 - protein, 951 aa, Vibrio fischeri ES114
MKLTKRSDSVQKQENQLGITRRMFMRTSTIAAGAVASASMFVPSMMKKAQAKEVPVDAPTEVKRTICSHCSVGCGIYAEVQNGVWTGQEPAFDHPFNAGGHCAKGAALREHGHGERRLKYPMKLENGKWKKLSWEQAIEEVGNKALEIRKESGPDSVYWLGSAKHNNEQAYLYRKNAAMWGTNNIDHQARICHSTTVAGVANTWGYGAMTNSFNDMHNCKSILFIGSNPAEAHPVAMQHILIAKEKNSCKIVVADPRRTRTAAKADHYVALRPGSDVAFIWGVLWHVFANKWEDQEFINQRVFGMDEIRTEVAKWNPAEVERVTGITEAEVYETAKLLSENRPGCVVWCMGGTQHTTGNNNTRAYCILELALGNMGKSGGGANIFRGHDNVQGATDLGVLSDTLPGYYGVGEGAWKHWSKVWELDFEWIKGRFDQGKYNGKAPMNNFGIPVSRWVDGVLEDKANIEQNDNIRAMFYWGHAVNSQTRGTEIRKAMSKLDMMVIVDPYPTVAAVMNDRTDGVYLLPATTQFETHGSVTASNRSFQWREKIVEPLFESKPDHEIMYLLSKKLGYADQLFKNIQIDENNQPVIEDITREFNKGMWTIGYTGQSPERIKAHTQNWHTFHKTTLEAEGGPVNGETYGLPWPCWGTPEMKHPGTHILYDTSKPVAQGGGNFRTRFGVEYEGQSLLAEDSYPVGCEIEDGHPEFTDKLLKQLGWWDDLTPEEKVAAEGKNWKTDLSGGIQRVAIKHGCMPFGNAKARAIVWTFPDRVPQHREPLYTPRRDLVADYPTWDDRAANFRIPTLYKTIQDQDKSKEYPIILTSGRLVEYEGGGEETRSNPWLAELQQEMFVEVNPKDANDIGFKDGDMVWVEGAEKGRIHVKAMVTRRVKPGLAFVPFHFGGKFQGEDLRNKYPEGTDPYVIGEAANTATTYGYDPVTQMQETKVTLCKITKA

SEQ ID NO: 36325 - protein, 287 aa, Triticum monococcum
MPLVQTASGKTIKQCTPQDTKILTLPSQAQPALTLHRPPSTVRSSSSQHRPPSAMDMTGSDQQWSSSSSPSSTSSHPKRPAGRTKFKETRHPVYRGVRRRGNAGRWVCEVRVPGQRGERLWLGTYLTADAAARAHDAAMLGLLGRSAACLNFADSAWLLAVPPALADLAAVRRAALAAVADFQRRHASNSAATVPADEETSGASALSSADNASGSSATSQPWAEGTFEVPSALGSDMFELDLSGEMDLGTYYADLADGLLLEPPPSLDSGACWDTGDGGADSGLWSY

SEQ ID NO: 36326 - protein, 240 aa, Triticum monococcum
MDTAGAWPHFEGQEYRTVWPEEEYRTVWSEPPKRRAGRNKLQETRHPVYRGVRRRGREGQWVWVCELRVPAAGSRVYSRIWLGTFADPEMAARAHDSAALALSGRDACLNFADSAWRMMPVHAAGSFKLAAAQEIKDAVAVALKAFQEQQRPADASKAPSSTDSTSEESAPSITSNDLSGLDDEHWIGGMDAGSYYANLAQGMLMEPPAAGAWREDREQDDGVDTSLWSYWLDGFGCVKL

SEQ ID NO: 36327 - protein, 212 aa, Triticum monococcum
MPSGQEEQRHRTVRSEPPKRPAGRTKFQETRHPLYRGVRQRGPAGRWVCEVRVLGMRGSRLWLGTFVTAEMAARAHDAAVLALSGRKACLNFADSAWRMLPVLAAGSFGFGSAREIKTAVAVAVLAFQRQQIVLPVACPAAEPAVAPSGALFSMSSGDLLELDDEQWFGGMVAGSYYESLAQGMLVEPPDAGAWREDSEHSGVAETQTPLWS

SEQ ID NO: 36328 - protein, 471 aa, Mycobacterium tuberculosis CDC1551
MSLRELMLRRRPVSGAPVASGASGNLKRSFGTFQLTMFGVGATIGTGIFFVLAQAVPEAGPGVIVSFIIAGIAAGLAAICYAELASAVPISGSAYSYAYTTLGEAVAMVVAACLLLEYGVATAAVAVGWSGYVNKLLSNLFGFQMPHVLSAAPWDTHPGWVNLPAVILIGLCALLLIRGASESARVNAIMVLIKLGVLGMFMIIAFSAYSADHLKDFVPFGVAGIGSAAGTIFFSYIGLDAVSTAGDEVKDPQKTMPRALIAALVVVTGVYVLVALAALGTQPWQDFAEQETAGLAIILDNVTHGEWASTILAAGAVVSIFTVTLVTMYGQTRILFAMGRDGLLPARFAKVNPRTMTPVHNTVIVAIFASTLAAFIPLDSLADMVSIGTLTAFSVVAVGVIVLRVREPDLPRGFKVPGYPVTPVLSVLACGYILASLHWYTWLAFSGWVAVAVIFYLMWGRHHSALNEEVP

SEQ ID NO: 36329 - protein, 472 aa, Pseudomonas fluorescens Pf-5
MAIQPDAFFQQFDDSKLVAADKAHYMHGFHMFDEHREQGSLNIAAGDGAYIYDTAGTRYLDAVGGMWCTNIGLGREEMAEAIADQVRQLAYSNPFCDMANVSAIELCQKLASLAPGDLNHVFLTTGGSTAVDTAYRLVQFYQNSRGKHEKKHVISRHNAYHGSTFLTMSIGNKAADRAPEFDFMSDLFHHISCPNYYRAPAGMSEADFLEFLVAEFEDKILTLGPDKVAAFFAEPIMGSGGVIIPPEGYHRRMWEICQRYDLLYVADEVVTSFGRLGAFFASEEVFGMQPDIITTAKGLTSGYLPLGACIFSERIWQVIGEPGKGRCFTHGFTYSGHPVSCVAALKNIEIIERENLLAHVEEVGVYMEQRLQTLAELPLVGSVRCKRLMACVEFVADKRTKALLPDGLNIAERIHLRAQAKGLLVRPIGHLNVMSPPLIITRQQIDEIVATLRDCILEAAAELRQNGQYLGQ

SEQ ID NO: 36330 - protein, 123 aa, Triticum aestivum
  misc_feature (51)..(51): Xaa can be any naturally occurring amino acid
  misc_feature (73)..(73): Xaa can be any naturally occurring amino acid
  misc_feature (80)..(80): Xaa can be any naturally occurring amino acid
  misc_feature (88)..(88): Xaa can be any naturally occurring amino acid
VISVTSNLVPGLMHSLMYKGENATLNEKLSPLMKWLFCQPNPIALNTALAXLGVARPVFRLPYVPLPLEKRAXFVRIVEXSIGRENFXGQKEAQVLDDDDFRVDQVGTRKMSLPILLANKLWL

SEQ ID NO: 36331 - protein, 378 aa, Corynebacterium diphtheriae NCTC 13129
MFPSDRSHVDPFRVMQILGEAQSRDDALLLCVGQPSTGAPRAVIERVHSRIDASALGYTATLGIPELREAIAQWHAQKYGIDTAARNVVVTTGSSGGFVALFLAALDHGDPIAMTRPGYPAYRNALTALGAKIIDLPCGAETRFQPTVEMLEACVEKPKALIVTSPDNPSGTIIDGAELARITDWCERNSCLLISDEIYHGITYGRECHSAREYSDKAVVVGSLSKYFSMTGWRLGWLIVPDELVEALDNLQANLALCPPAVSQEAALAAFGPEARAELESHVQRYARNRALLLKRLPELGLGKCAPPDGGFYLYIDVSEHTDDSEVWVRELLNATGVALAPGVDFDPVDGHRFVRLSFCGEYEEILQACERLRTFMP

SEQ ID NO: 36332 - protein, 330 aa, Campylobacter jejuni subsp. jejuni NCTC 11168
MNLPILDLQAYEKDKSTFLKNLREIASKIGFFYLINTSIDKNLNEKLFKLGKEFFNLSRSSKELISMVHSPQFRGYTSEGFEYTAGSKDYREQLDIGTERDALNWNLNSPLWQRLEGPNLWPSEIPELKKTFLTWHKQTKKACLKLLKAFAQALDLPNNAFDKLYGENSYEHCKIIHYPKSSKNITQGVGSHKDGGLITFVFQEKQSGFEAFIDGKWLSIPPLENSVVVNIGEFLELATNGYLKATIHRVNLSPKERFSIAYFLGVQLDKDIPIFKLNPELAKESKGVDTDPKNPLLRNVASNYFKRMIRSHPDVASIYHSDLIEKFSFA

SEQ ID NO: 36333 - protein, 311 aa, Arabidopsis thaliana
MNRGANSDSIPTDLIYEILSRLSVKPITRFRCVSKLWESIICRQDFTELFHNRSSSNPRLLIGVIQGGEWNFFSSPQPQNHYGKSSLVVAADSHMKFSEDKRPRYYSYASGLLYFPNIRISNHNDDVVRVICNPSTRQYAILPPDLRTRYRDSGRLFRNKLGVINLEDDYDGGYLLKLRMFVLEDFEKQKWTTYVHTLRDENKIKDNDNVYVVGATASGQIVLARNKAYKPFYVFYFNPEKSTLQSVEIQGVREEEDWFHRVYYFVDHVEDLRFDVMKTTYAATSIRPAEQNTSTSSREDHLVRTVKRKRA

SEQ ID NO: 36334 - protein, 288 aa, Triticum monococcum
MDMGSEQWSSPSTSASSRDQHAAAPPKRPAGRTKFKETRHPVYRGVRRRGGAGRWVCEVRVPGRRGCRLWLGTYVTAESAARAHDAAMLALGGRSAACLNFPDSAWLLAVPCALADLADVRRAALAAVAGFQRREAASGAATVPVDEVFDTSSADDAGSWSWATPQPSCAAADGMFEVPAAALASDMFDFEFDVSWVMDLGSPATSQPGCADKVLEVPAAALGGGDMFEFDLELDMSGEMNLVGSYYADFAEGLLLEPPQPADATEARWRNGDYCGGDGGGDAALWSQ

SEQ ID NO: 36335 - protein, 203 aa, Agrobacterium tumefaciens str. C58
MKSGNGPLRVGIGGPVGSGKTALTEKLCKAMSGDYSVAVVTNDIYTKEDAEALVRMQALPSERIVGVETGGCPHTAIREDATINLQAIAGLNAQFPDLDVVFIESGGDNLAATFSPDLADITIYVISVCQGEEIPRKGGPGITRSDLLVINKKDLAPYVGADLTVMDSDATRMRNAMPFVFTDMKRGDGVDRIVGFLKEQGGL

SEQ ID NO: 36336 - protein, 126 aa, Oryza sativa
  misc_feature (44)..(44): Xaa can be any naturally occurring amino acid
  misc_feature (70)..(70): Xaa can be any naturally occurring amino acid
  misc_feature (90)..(90): Xaa can be any naturally occurring amino acid
  misc_feature (117)..(117): Xaa can be any naturally occurring amino acid
IGSKQTWVSCGGNNGVLGGAVRFSEENEALVIKSWYIMIKDSGXLDSELFLKIFDVVPSSTNMFSFLRKXSTLLLDKNPMLITQGMYVFXMKCEVADRVPESGVEFTARDTRMNRFXSTHFKYGVR

SEQ ID NO: 36337 - protein, 548 aa, Mycobacterium tuberculosis CDC1551
MSDARVPRIPAALSAPSLNRGVGFTHAQRRRLGLTGRLPSAVLTLDQQAERVWHQLQSLATELGRNLLLEQLHYRHEVLYFKVLADHLPELMPVVYTPTVGEAIQRFSDEYRGQRGLFLSIDEPDEIEEAFNTLGLGPEDVDLIVCTDAEAILGIGDWGVGGIQIAVGKLALYTAGGGVDPRRCLAVSLDVGTDNEQLLADPFYLGNRHARRRGREYDEFVSRYIETAQRLFPRAILHFEDFGPANARKILDTYGTDYCVFNDDMQGTGAVVLAAVYSGLKVTGIPLRDQTIVVFGAGTAGMGIADQIRDAMVADGATLEQAVSQIWPIDRPGLLFDDMDDLRDFQVPYAKNRHQLGVAVGDRVGLSDAIKIASPTILLGCSTVYGAFTKEVVEAMTASCKHPMIFPLSNPTSRMEAIPADVLAWSNGRALLATGSPVAPVEFDETTYVIGQANNVLAFPGIGLGVIVAGARLITRRMLHAAAKAIAHQANPTNPGDSLLPDVQNLRAISTTVAEAVYRAAVQDGVASRTHDDVRQAIVDTMWLPAYD

SEQ ID NO: 36338 - protein, 520 aa, Arabidopsis thaliana
MASIGLYEAFIGFLCFLISFYFLVKKPFSYLLIKKTLQSYPWNWPVLGMLPGVLLRLQRIYDCSVEVLENSNMTFQFKGPWFVGMDVLATVDPANIHHIMSSNFSNYIKGPIFHEIFEAFGDGIINTDAELWRDWRNASQLIFNHQRYQNFSASTTKTKVNDGLVPLFNHFANEEIVVDLEDVFQRFMYDITFIFITGTDPRSLSIEMPEVEFSKALDDVGDAIVHRHITPRFVWKLQKWIGIGTEKKMLKAHATFDRVCEKIIAAKREELGSQGITYNSNGEREDLLTSFIKLDATKYEVLKPSHDKFLRDFTIGFMAAGRDSTASTLTWFFWNLSKNPNVLTKILQEINTNLPRTGSDQDMSSYLNKLVYLHGALSESMRLYPPIPFQRKSPIKEDVLPSGHKVKSNINIMIFIYAMGRMKTIWGEDAMEFKPERWISETGGVRHEPSYKFLSFNAGPRTCLGKNLAMNLMKTVIVEILQNYEIKIVSGQKIEPKPGLILHMKHGLKVTMTKKCSSLE

SEQ ID NO: 36339 - protein, 297 aa, Gibberella zeae PH-1
MAPQELTGILVALITPFKADGSVDYEALDAHIQRQIKAGVHGFVPGGSTGEFTALTVQERKDVLAQVVKSAAGRVPVVAGIGDLTTSGVVDLAKHAAEVGAAATMIVPPFYDAPNLKQLRGMFEEIYKESGLPIMYYNIPSASGVSLSPAEIAGLSEVGVKYLKDTSGNAPALTDLLFHHHNTITALNGWDTLTFYGLCAGAKGSVWGTTNVLPELSVQLWNAIAVDGDIKKGRELWSKIFPVCKFLEAHHYGAGIKTGMELQGFKTGGLRKPFELLEGEERAELAQLLKDAGVTLA

SEQ ID NO: 36340 - protein, 215 aa, Oryza sativa (japonica cultivar-group)
MAPVVSALAKYKLVFLGDQAVGKTAIITRFMYDKFDATYQATIGIDFLSKTMYLEDRTVRLQLWDTAGQERFRSLIPSYIRDSSVAVIVYDVTGKQSFLSISKWIEEVNTQRGGDVIIVLVGNKTDLVDKRQISTDEGEAKAQEHGAMFMETSAKAGFNIKPLFRKIAASLPGMEALSSAKQEDMVDINLRPAASGQIPSGAEAQEEQKAGGCSC

SEQ ID NO: 36341 - protein, 238 aa, Glycine max
SPNALYQATRIFASNFGAKKAERFYKLVLLPRVREDIRKNKRLHFALYQTLKKALYKPAAFFKGILFPLCESRTCTLREAVIIGSIIEKVSIPPLHSSVALLKLSGMEYCGTTSYFIKLLLEKKYALPYRVVDAVVAHFMRFFNETRIMPVIWHQSLLAFVQRYKNELQKEDKDRLRNLLEKQKHKLVTPEISRELDHSCNRGEKEEDLMSISSPVYVINKTIEEDRFDIPDVPMEED

SEQ ID NO: 36342 - protein, 378 aa, Leuconostoc mesenteroides
MVNMDEVLSIHQAHTGVLDIESCFDITTPTDLSEAYTPGVAGLAKLIAKDTSKKRDYTMSGKLIPVITDGSAVLGLGNIGPAAGLPIVEGKALIYKNFANVDALPMALNQMSVDQFVDTVKAIAPSFAGIHLEDISAPKVFEIERRLSNELDIPVYHDDQTGTAIVVLAGIMNAAKVVGKNVHDLKIVVNGIGRCTAGVATTKILIAAGICNITLVDINGVINLGDANSNSYQQELVREVTQVDGKTLDDVIANQDVFIGLSDANVLSGKQVARMNENPIIFALANPVPEISPDDAKKAGAAVIATGSSQWPNQVNNVLVFPGLFKGLLESGIKHVDMALQLNVAHALANMISEPDATHIVPAVFDDDVGELGRNSSS

SEQ ID NO: 36343 - protein, 430 aa, Desulfitobacterium hafniense DCB-2
MMSERQLKFDTLQVHGGQTADPTTGSRAVPIYQTSSYVFANAEHAANLFGLKETGNIYTRIMNPTTDVFEQRIAALEGGVGALAVASGSAAVTYAILNIAGVGDEIVSASTLYGGTYNLFSTTLPKLGIKTVFVHPDDPENFRKAVTEKTKALYIETIGNPGINLIDIEAVAQIAHEYGVPLIVDNTFGTPYLIRPFEFGADIVVHSATKFIGGHGTSIGGIIVDSGKFDWAGSGRFPGLTEPDASYHGLNYAEALGPAAYITKARVQLLRDTGAALSPFNSFLFLQGLETLSLRVERHVANTKKIVDFLSNHPQVAWVNYPSLKESKYYELAQKYLPKGAGSIFTFGIKGGIEAGKKFIDSLEIFSLLANVADAKSLVIHPASTTHAQLSEEDLVAAGVTPDMVRLSIGIEDAEDLIYDLEQALRKAAG

SEQ ID NO: 36344 - protein, 401 aa, Triticum aestivum
MYGEDARTIAELSIDDYLYPDADIYNVSGLPPIKLPPPTCDLAHGRWVFDNESLPLYREKECNFLTKQLTCLANGRNDDLWQYWQWQPNNCSLPTFDARRFMERMRGKRLMFVGDSLNRNQFYSLVCMVQSILSKGRKKVVKRGSNTIFHAKEYRATLEFYWAPFLVESNSDDPNIHSIEHRIIRPERIEGHAQYWRGVDYLIFDTYIWWMNTADIKVRRPDSRSWSEHDEVPRIEAYGRVLKTWSDWLNENVDPARTSVFFMTISPIHISPDKWGNPHGIKCAKETLPVLNYTEPLDLNHDMRLYDMVASTARSMKKVPVTLIDITRMSDYRKDAHTSVYSVRRGYLLTPKQKNDPQNFADCIHWCLPGVPDVWNTVLYTRIFSKSPPSSPPALALPPPQ

SEQ ID NO: 36345 - protein, 245 aa, Frankia sp. EAN1pec
MPTLVLLRHGESTWNRENLFTGWVDVDLSEKGLKEATRGGELLQEAGVLPDVVHTSLLTRAIRTAWLALDAAGRTWVPVRRSWRLNERHYGGLQGLNKAETLAKFGDEQFLLWRRSYDTPPPPIEPGQPSGVDERYADLAPDVIPLTECLRDVVVRMLPYWYDSIVPDLRSGATVLVTAHGNSLRALVKHLDGISDTDIANLNIPTGIPLRYELDDDLKVLDSGYLDPAAAETAAAAVAAQGKKK

SEQ ID NO: 36346 - protein, 329 aa, Chlamydophila caviae GPIC
MGSPATAIDLCQDIITKQKESLERFFATFQCEGTWLLAEKILNHQGSIFFSGVGKSGCIARKIAATLQSFGERAFFLCSGDLLHGDFGVVRPGDIVCLFSKSGETRELLEWIPYFKERGVFIAGITSSAYSSLAILCDHVVILPMIEELDPFNLVPTTSTTCQLLFGDLLSITLLRSRGISLADYGKNHPGGQIGLKVVGKIRDYMFPKTEVPFCSPDNTVADSLDIFSSYGCGCVCVVNELFEILGIFTDGDLRRALSRHGGDILLQKLKDIMTPSPRVISEDADVLLGLQMMETGNPVSILPVVDAKDQKYVVGLLQMHTLAKAGLI

SEQ ID NO: 36347 - protein, 483 aa, Oryza sativa (japonica cultivar-group)
MAEVKPEDMVHHPPMDQLQGFEYCIDSNPSWGEAIALGFQHYILSLGTAVMIPTMLVPLMGGNDHDKARVVQTLLFVTGIKTLLQTLFGTRLPTIIGGSYAFVVPILSIIRDPSLAQIADGHTRFVQTMRAIQGSLIVSSSIQIILGYSQLWAICSRFFSPLGMVPVVALVGLGLFERGFPVVKALIATLTSTLLGDVWRSAFQCSSLMNPLMIFIKIIKLRISIPFPLQWGAPTFSANHAFGMMAAVVVSLIETTGAFMAAARLASATPPPAYVLSRGIGWQGIGTLLDGLFGTGTGSTVSVENVGLLGSTRVGSRRVIQISAGFMIFFSMLGKFGALFASIPFPIFAAIYCVMFGIVAAVGLSFLQFTNMNSMRNLFIVGVSLFLGLSIPEYFSRYTTSAQQGPAHTKAGWFNDYINSVFSSPPTVALIMAVLLDNTLDVREAARDRGMPWWARFRTFRGDSRNEEFYTLPFNLNRFFPPS

SEQ ID NO: 36348 - protein, 334 aa, delta proteobacterium MLMS-1
MGIKVAINGFGRIGRSIFRAIELDPAFKEIEIVAINDLTPPATLAHLLKYDSVMGIYPHEVKAGDGEIRVDDHPVRVYNQRDPKELPWGELGVEYVIEATGLFTDSDKAQAHLDAGAKKVVISAPAKGQVKTIVMGVNEEDYDPATDHIVSNASCTTNCLAPVAKVIVERFGIKSGLMTTVHAYTGDQRLLDFPHNDLRRARAAAMSMIPTKTGAAAAVALVLPELKGKFDGLAVRVPTPNVSLVDVVMELEQETTVTEVNEALKQATNRYLGYSEEPLVSIDYQGDPRSSVVDAISTKVLGSTVKILSWYDNEWGYSNRVLDLILHMEENRTL

SEQ ID NO: 36349 - protein, 702 aa, delta proteobacterium MLMS-1
MKTRKKTFRSGAGSPLPLGVSRTPAGYNFAIAARHAEAVSLVLYPPSRAEPVAELAFDPHLNRSGDVWHLLLADFEPTLRYGFRLRGPCRSAAAGYCYRDELVMLDPYAKALTGGSDWGKPYRRPGRSDPLASFQRRCLYLEDDFDWEGDRPLNIPLSETIIYELHVRGFTRHPSSAVEHPGTYRGIIEKIPYFKELGVTAIELLPVAEFNELENTRVNPFTGEQLKNFWGYSPLAFFAPKAAYAVNGRDGNQVREFKEMVKALHAAGLEVILDVVFNHTAEGGADGPVISFKGIDNPIYYLLDPATREYLNFSGCGNTVNCNHPWVRELIVDCLRYWVTEMHVDGFRFDLASIFGRGAGGEILAEPPMVEKIAEDPVLAKTKIIAEAWDAAGLYQVGSFSPHQRWAEWNGRYRDDVRRFLCGHDDTVASLATRLAGSSDLYGQNGRRPFNSINFITSHDGFTLHDLVSYNHKHNEANGEDNRDGDNHNISWNSGVEGESDEPAVLALRARRLRTAAVILLLSQGVPMLCAGDEFGRSQRGNNNAYCQDNEISWLDWRLVEQNAGLFRFFRLLISLRRRHPLFRRDHFFSTAPSARQPEISWQALEPGRQDWSAGCRVLAFRLHGRAGGSGQRRDRDFFVMLNSDAQPQRFTLPKPPARRPWRLLIDTAAASPRDIYQDEKAPKVRGGRQEVAPHGAVVLIA

SEQ ID NO: 36350 - protein, 198 aa, Zea mays
MSASRFIKCVTVGDGAVGKTCLLISYTSNTFPTDYVPTVFDNFSANVIVDGNTINLGLWDTAGQEDYNRLRPLSYRGADVFLLAFSLVSKASYENVSKKWVPELRHYAPGVPIILVGTKLDLRDDKQFFVEHPGAVPISTAQGEELKKVIGAPAYIECSAKTQQNVKAVFDAAIKVVLQPPKNKKRKKRKSQKACSIL

SEQ ID NO: 36351 - protein, 502 aa, Gibberella zeae PH-1
MSPPSIPLIAPNGVKWSQPTGLFINNEFVSSSSSRTLTSIDPATENEIATVQAADAQDIDKAVKAAKAALRHPSWKDLPASDRGQLMARLADLIEAKRELFATIDAWDNGKTYIETLENDLVEAVGVIRYYSGWADKTFGQTINTTPQKFAYTIRQPIGVIAQIIPWNYPLSMATWKLGPALACGNAVVIKAAEQTPLSLLVLGELIKEAGFPPGVVNIVNGLGKDTGAALVQHPLVDKIAFTGSTATAANIMGVAAKTLKNITLETGGKSPLIVFDDAEMDQAVKWSHFGIMSNQGQICTATSRILVQETIYEEFIKKFIDTLNTVSKVGDQWDKTTYQGPQVSKVQYERILEYIEIGKKEGATLAAGGGPLKINGSDKGFYISPTVFTDVKPSMRVFREEIFGPVVVVSTFKTEEEAIELANDTTYGLGAAAFTTNLEKAHRVAAAIEAGMVWINSSQDCDPRVPFGGVKQSGIGRELGEAGLEAYTQIKSVHINMGNRL

SEQ ID NO: 36352 - protein, 250 aa, Zea mays
MVKLAFGSVGDSFSVTSIKAYVAEFIATLLFVFAGVGSAIAFGQLTNGGALDPAGLVAIAVAHALALFVGVSVAANTSGGHLNPAVTFGLAVGGHITVLTGLFYWVAQLLGASVACLLLRFVTHGKAIPTHGVSGGTTELEGVVFEIVITFALVYTVYATAADPKKGSLGTIAPIAIGFIVGANILAAGPFSGGSMNPARSFGPAVAAADFAGNWVYWVGPLIGGGLAGLVYGDVFIGGSYQQVADQDYA

SEQ ID NO: 36353 - protein, 590 aa, Pseudomonas syringae pv. phaseolicola 1448A
MCGLAGELRFDHQPADLAAVERITHQLAPRGPDAWGFHSQGPVALGHRRLKIMDLSDGSAQPMIDSHLGLSMAFNGAIYNFPELRAELESLGYQFHSGGDTEVLLKGYHAWGADMLPKLNGMFAFAIWERDSKQLFIARDRLGVKPLYLSKTDKRLRFASSLPALLKGGDISGMLDPVALNHYLNFHAVVPAPRTLLAGVEKLPPASWMRIDASGKVEQKVWWTLPYGPHEDEKNLTLEDWRDRVLDSTREAVAIRQRAAVDVGVLLSGGVDSSMLVGLLREVGVEDLSTFSIGFQDAGGERGDEFQYSDLIAKHYGTRHHQLRIQESEIIEQLPAAFRAMSEPMVSHDCIAFYLLSREVSKHCKVVQSGQGADELFAGYHWYPQVDGASDPVAAYRDAFVDRSYAEYAETVQPKWRTANDAAGDFVRDHFAQPGASAAVDKALRLDSTVMLVDDPVKRVDNMTMAWGLEARTPFLDYRLVELSARIPGKFKLPDDGKQVLKEAARLVIPSEVIDRKKGYFPVPGLKHLQGDTLNWVRELLTDSSQDRGLFNPAMVDKLLTNPEGQLTPLRGSKLWQLAALNLWLSEQGL

SEQ ID NO: 36354 - protein, 433 aa, Oryza sativa (japonica cultivar-group)
MDEEARAAGCSPAPPRAPAASCGAAAELCLCSPTGVEGIEQVPGCPCFEDAGAVVVSGEAPEGPGVLCSEDGAELKLAEQGALDVRLGSPAVGIHEQQLLHRGTSGSDEAGAINEISPVEASDGSTTQDFDTDVETESSGSSIEEQDMGYGVHIPHTEQAICEVARGNKSSEVKSSDRMSSVTLPTLILASGAAMLPHPSKVLTGGEDAYFIACDGWFGVADGVGQWSFEGINAGLYARELMDGCKKAVMESQGAPEMRTEEVLAKAADEARSPGSSTVLVAHFDGQVLHACNIGDSGFLVIRNGEIYQKSKPMTYGFNFPLQIEKGDDPFKLVQKYTIDLQEGDAIVTATDGLFDNVYEEEIAAVISKSLEAGLKPSEIAEFLVARAKEVGRSATCRSPFSDAALAVGYLGYSGGKLDDVTVVVSVVRKSEV

SEQ ID NO: 36355 - protein, 428 aa, Oryza sativa (japonica cultivar-group)
MLESLPETSDTRGCEQEVMPGVVVGSSNRDASSEVGVESERGSDADGRNGLGEGELVSSVDGGGAEKSSKVTGVLSEEGVDGMETALEPCVASVGSITQVEEGVDRMETSLDDSEASDGSTTQDFDTDVETESSGSSIEEQDMGYGVHIPHTEQAICEVARGNKSSEVKSSDRMSSVTLPTLILASGAAMLPHPSKVLTGGEDAYFIACDGWFGVADGVGQWSFEGINAGLYARELMDGCKKAVMESQGAPEMRTEEVLAKAADEARSPGSSTVLVAHFDGQVLHACNIGDSGFLVIRNGEIYQKSKPMTYGFNFPLQIEKGDDPFKLVQKYTIDLQEGDAIVTATDGLFDNVYEEEIAAVISKSLEAGLKPSEIAEFLVARAKEVGRSATCRSPFSDAALAVGYLGYSGGKLDDVTVVVSVVRKSEV

SEQ ID NO: 36356 - protein, 509 aa, Bordetella bronchiseptica RB50
MTTVHSATPEETRRLLQQLGVDPARYDGGTLEVRSPIDGQAIARLPELTAEQARARVADARQAFLAWRKVPAPRRGELVRLLGEELRAAKAELGRLVSIETGKILSEGEGEVQEMIDICDFATGLSRQLYGLTIATERAEHRMMETWHPAGPVAIISAFNFPVAVWAWNAAIALVCGDSLLWKPSEKAPLTALATQALLERALARFGDAPAHLSQVLIGGREVGEALVDDPRIPIVSATGSTAMGRKVGPKVAERFGRSILELGGNNAAIICPSANLDLALRGIAFSAMGTAGQRCTSLRRIFVHEQIADDLVARLKQVYESVAIGDPRDSGTLIGPLRDQAAFDAMQRSLADARAAGGRVTGGAREPVGGHDQAYYARPALVEMPAQSEVVERETFAPILYVMRYRDLDEAIALQNDVPQGLSSSIFTNDLREAERFVSAEGSDCGIANVNIGPSGAEIGGAFGGEKETGGGREAGSDSWKAYMRRTTNTVNYGNALPLAQGVKFDVA

SEQ ID NO: 36357 - protein, 326 aa, Glycine max
TPIEHQSAALNTNSTPMGQEEEKSQENKVEEKKVEEEEKKEEEKKSDEKKFKEKSAPPEIVLKVFMHCEGCARKVRRSLKGFPGVEDILTDCKSHKVVVKGEKADPLKVLERVQRKSHRKVELLSPIPKPPAEEAKKPQEEEKPKPEENKQEPQVITVVLKVHMHCEACAQEIKRRIEKMKGVESAEPDLKKSEVSVKGVFETAKLVEHVYKRTGKHAVIVKEEPEKREEEEEEEAKEEKKAEEEGEKKNEKGSGEGEENKEKKGEGEAKAEEESKEETAVLELKKSEYYYNPPPRYGMEFYASYPGPSYPPQIFSDENPNACSVM

SEQ ID NO: 36358 - protein, 455 aa, Rhodospirillum rubrum ATCC 11170
MVSNALRDADLSYTIHPYTNLVAHETKGPLIAVRGEGVRVFDDKGKDYIEGMAGLWCASLGFSEPRLAAAAARQMAELPFFHMFSHKSHEPGIRLSEELVKRAPVPMARAFFCNSGSEANDTAIKMIWYINNALGRPQKKKIIARKRAYHGVTVASASLTGLPANHRDFDLPIANILHTSSPDYYREGKPGESEEAFAKRCADELEAMILAEDPNTVAAFFAEPIMGAGGVVLPPKGYFEHIQAVLKKYDILLVADEVICGFGRTGQYWGSQTFGLKPDILTCAKALSSAYMPISAVLVTEEVYKPLRDNSGKIGTFGHGYTYSAHPVAAAVALETLAIYDERDILGNVAVSGARLQERLRSFADHPLVGNVRGIGLIGAIELVADKATHGAFPASDAVGPRVVTKAEEAGVILRAMAGDVVAFSPPLIITPEEVDQMMDRFTVALEAVTAEVLG

SEQ ID NO: 36359 - protein, 415 aa, Glycine max
MGETQEPQLSPETCFTIHMGEPQEVQLSKIEPSGAKETNSLEDNSFGGPMNESIMSNKKRYYRWLRVAIHSSLVLVCASAAVLLGRLYYEKGGKSKWMGTLVQLAGFPIQLPVYFFLAPKNLTTNNSIHPKQPSVSMLSFIYVSIGLLVALDCYLYSVGLWYLPVSTYSLICSSQLAFNAFFSYFLNSLKFTPYIINSLVLLTISSTLLVFQNESSSDDDDDSDSTKISKKKYVIGFICTVGASAGYGLWLSITQLVFKKVIKRETFKVILDMILYPSLVATLVTLVGLFASGEWSGLKDEMKGYELGKASYLLNLTFTAILWQVFTIGCLGLISEVSSLFSNAISALGVPIVPMLAVLFFHDKMDGIKGISMVLAIWGIVSYVYQQYLDDTKSENRNTTSHVPKASSPIEEVHR

SEQ ID NO: 36360 - protein, 361 aa, Yersinia pseudotuberculosis IP 32953
MKKTYRIAAIPGDGIGHEVMPEGINVLQAAALRWDLDISFENIEWASCEYYQHHGQMMPNDWQRQLQCFDAIYFGAVGWPATVPDHISLWGSLLKFRRDFQQYVNLRPVRLFPGIPCPLVGKQPGDIDFYVVRENTEGEYSSVGGRLFEGTEQEMVLQASIFTRRGVDRILKYAFELAQMRPRKRLTSATKSNGLAFSMPYWDERFEVMAAQYPQISADKQHIDILCARFVLNPERFDVVVASNLFGDILSDLGPACAGTIGIAPSANLNPERDFPSLFEPVHGSAPDIYKRNIANPIAMIWAGAMMLDFLGQGDERYHAAHNGILNAIEQVIAQGPKTPDMCGDASTQQVGSAIVQVLSH

SEQ ID NO: 36361 - protein, 567 aa, Oryza sativa (japonica cultivar-group)
MDEEARAAGCSPAPPRAPAASCGAAAELCLCSPTEGIEQVPGCPCFEDAGAVVVSGEAPEGPGVLCSEDGAELKLAEQGALDVRLGSPAVGIHEQQLLHRGTSGSDEAGAINEISPVEVSPSEASSNLDTAGAIGGSPLMLESLPETSDTRGCEQEVMPGVVVGSSNRDASSEVGVESERGSDADGRNGLGEGELVSSVDGGGAEKSSKVTGVLSEEGVDGMETALEPCVASVGSITQVEEGVDRMETSLDDSEASDGSTTQDFDTDVETESSGSSIEEQDMGYGVHIPHTEQAICEVARGNKSSEVKSSDRMSSVTLPTLILASGAAMLPHPSKVLTGGEDAYFIACDGWFGVADGVGQWSFEGINAGLYARELMDGCKKAVMESQGAPEMRTEEVLAKAADEARSPGSSTVLVAHFDGQVLHACNIGDSGFLVIRNGEIYQKSKPMTYGFNFPLQIEKGDDPFKLVQKYTIDLQEGDAIVTATDGLFDNVYEEEIAAVISKSLEAGLKPSEIAEFLVARAKEVGRSATCRSPFSDAALAVGYLGYSGGKLDDVTVVVSVVRKSEV

SEQ ID NO: 36362 - protein, 687 aa, Oryza sativa
MDFFLTVTDSSIGPPGAAQYANGLLGLDARGAAHCWKTRIGRGEGGKWVAARRRGGAAGRGGRWPISPALVERSGVGEASPAAGRRRGGWEAVMETAHEVAIYIDRFHNLDLFQQGWYRLKISAAWEEDEYRAPVSPARVVQYEVPDIGSKGAFGLWKIDDVDNSFYTQPFQIKYSRQDIYLSVMVSFYIPNTEDEGPATSSVILKFELIYVPTLEDRTEIEDPSDIYVPVHEFRIPYKALLGLHAYFPVHFDAFHPVLVDLTMHIVYLKAGVTKSSQKASEQGLCSKSCYIIKALLSSREILLEEVMKMSAGIGKTLEDLDDADLTLGKHEPIDSSKAGLPKYSKGLYIPTKCIGHLTGVLHDLIERSDNVVRSTNDILLYTLSKEDLLELFQAPVQNSSSRAELHRRSIAQMKVGSQSMLKTETICITPKKRILTQIILQINARFIQDMQIYANPSEIPVVHIEQHVMVVPQHGSSKRLGHHLDLRLIRNQWILCDPGAECLLSQTNEDRTCGDFKEMGRRLSNEVVAFLKRKIDRYSRNGGCKDLKLSFVGHSIGNIIIRSALADPKMQPFLKNLYTYMSISGPHLGYWYSSNSLFNSGLWLMKRLKGVQCMHQLTFSDEQDPQNTFFYKLCKLNTLDNFKNIILVSSPQDGYVPYHSARIDSCPASSSDNSKKGQVFTEMLNN

SEQ ID NO: 36363 - protein, 598 aa, Oryza sativa (japonica cultivar-group)
MKRRAPPDAPQRRPARRLLPVALPPSSASAPLQVWVRGIHACLISFGFGSRFDLVLVWFGVGLDAEGIEQVPGCPCFEDAGAVVVSGEAPEGPGVLCSEDGAELKLAEQGALDVRLGSPAVGIHEQQLLHRGTSGSDEAGAINEISPVEVSPSEASSNLDTAGAIGGSPLMLESLPETSDTRGCEQEVMPGVVVGSSNRDASSEVGVESERGSDADGRNGLGEGELVSSVDGGGAEKSSKVTGVLSEEGVDGMETALEPCVASVGSITQVEEGVDRMETSLDDSEASDGSTTQDFDTDVETESSGSSIEEQDMGYGVHIPHTEQAICEVARGNKSSEVKSSDRMSSVTLPTLILASGAAMLPHPSKVLTGGEDAYFIACDGWFGVADGVGQWSFEGINAGLYARELMDGCKKAVMESQGAPEMRTEEVLAKAADEARSPGSSTVLVAHFDGQVLHACNIGDSGFLVIRNGEIYQKSKPMTYGFNFPLQIEKGDDPFKLVQKYTIDLQEGDAIVTATDGLFDNVYEEEIAAVISKSLEAGLKPSEIAEFLVARAKEVGRSATCRSPFSDAALAVGYLGYSGGKLDDVTVVVSVVRKSEV

SEQ ID NO: 36364 - protein, 408 aa, Yersinia pseudotuberculosis IP 32953
MILNVYVVISIFIMNAMSLLSVEVSNFTFVDLFKNDNVNIVSIHRVLLLLEELMSQLPEKMSAVVCHGPQDYRLEHVPTPVPKAKELVIKVKGCGICAGDCKCKNGAKMFWGETPWVKPPVVPGHEFYGHIVALGEGTESKYKIGERVIAEQIVPCWDCRYCNSGSYWMCETHNIYGFQKDVAEGGMAEYMRFSENAIVHKIPESLSHEDAVLIEPMACAIHTVARGDIQLDDVVVLAGAGPLGLCMVQVARLKTPKKLIVIDTIEERLALAKAFGADVVINPLKEDADKIVKSLTGGYGCDVYIEATGAPIGVTQGLQMIRKLGRFVEFSVFGQETTVDWSIIGDRKELDIRGAHLAPYSYEIATDLFERGLVTSKGIVTHSYSLDDWEKAFELADSTNSIKVILVP

SEQ ID NO: 36365 - protein, 247 aa, Treponema denticola ATCC 35405
MRLVLVRHGESEWNKLNLFTGWTDVDLSEKGVEEAKEGGTYLKKEGFDFDICYTSYLKRAIHTLNYILSQMDREWLPVIKTWKLNERHYGGLQGLNKAETAEKYGEDQVKIWRRSFDIAPPVLEEGDKRCPYLQEQYRGIEKSELPLTESLKDTIARAVPFFEKTIKPQMLEGKRILITAHGNSLRALVKYFENLSDEEIISVNIPTGVPLVYEFDKNFKVLSKRYLGDQEKINAKINAVANQGKKK

SEQ ID NO: 36366 - protein, 520 aa, Mycobacterium tuberculosis CDC1551
MSASPLLGMSRREFLTKLTGAGAAAFLMDWAAPVIEKAYGAGPCPGHLTDIEHIVLLMQENRSFDHYFGTLSSTNGFNAASPAFQQMGWNPMTQALDPAGVTIPFRLDTTRGPFLDGECVNDPEHQWVGMHLAWNGGANDNWLPAQATTRAGPYVPLTMGYYTRQDIPIHYLLADTFTICDGYHCSLLTGTLPNRLYWLSANIDPAGTDGGPQLVEPGFLPLQQFSWRIMPENLEDAGVSWKVYQNKGLGRFINTPISNNGLVQAFRQAADPRSNLARYGIAPTYPGDFAADVRANRLPKVSWLVPNILQSEHPALPVALGAVSMVTALRILLSNPAVWEKTALIVSYDENGGFFDHVTPPTAPPGTPGEFVTVPNIDAVPGSGGIRGPLGLGFRVPCIVISPYSRGPLMVSDTFDHTSQLKLIRARFGVPVPNMTAWRDGVVGDMTSAFNFATPPNSTRPNLSHPLLGALPKLPQCIPNVVLGTTDGALPSIPYRVPYPQVMPTQETTPVRGTPSGLCS

SEQ ID NO: 36367 - protein, 1074 aa, Idiomarina baltica OS145
MPKRTDIKSILILGAGPIVIGQACEFDYSGAQACKALREEGYRVILVNSNPATIMTDPEMADATYIEPIHWEVVEKIIERERPDAILPTMGGQTALNCALDLDRHGVLDRFKVEMIGANADAIDKAENRDRFDKAMKKIGLETPNAEMAHSMEEAFDVLDRLGFPCIIRPSFTMGGSGGGIAYNREEFEEICRRGLDLSPTNELLIDESLLGWKEYEMEVVRDKSDNCIIVCTIENFDPMGIHTGDSITVAPAQTLTDKEFQLMRDAAMAVLREIGVETGGSNVQFGLNPDTGRMVIIEMNPRVSRSSALASKATGFPIAKVAAKLAVGYTLDELENEITGGVTPASFEPALDYVVTKIPRFNFEKFANCNDRLTTQMKSVGEVMAIGRNFQESMQKALRGLELGANGFDSMVDLSSDEARGKVIRELKEPGAERIWYIGDAFRLGMTVREVFELTRIDEWYLIQIEELIKLEEELDALGLAGMNEHVMRALKRRGFSDERIADVLHVSESEVRKRRHKLGIHPVYKRVDTCAAEFASSTAYMYSSYDEECEADVSDRDKIMVIGGGPNRIGQGIEFDYCCVHAALALREDGYETIMVNCNPETVSTDYDTSDRLYFEPITLEDVLEIVRIEQPKGVIVQYGGQTPLKLARALEANGVPIIGTSPDAIDRSEDRERFQAAVNRLKLKQPENSTVTGISEALTEAKRIGYPLVVRPSYVLGGRAMEIVYDEQDLTRYLTDAVKVSNDAPVLLDRFLDNAIEVDVDAICDGEDVLIGGIMQHIEEAGVHSGDSACSLPPYSLSDIIQAQLREQIRKLAFELNVKGLMNAQFAVKDDEIYLIEVNPRAARTVPFVSKATGVPLAKVAARVMVGQSLKEQGYTSEVIPPYYSVKEVVIPFAKFQGVDPIRGPEMRSTGEVMGVGESFEEAYAKANLGAGAALAKKGKALISVRDSDKRRLMDLARGLLALGFKLEATRGTAKMLAEEGIDCTVVNKLQEGRPNIVDAIKNGEYSYIINTVEGRQAIEDSVYIRREALLNKVIYTTTLNAAFATVKANTADDRARVSSVQELHKRVALV

SEQ ID NO: 36368 - protein, 251 aa, Streptomyces coelicolor A3(2)
MSDANNTAGDANEVNPEKDLSAENLPGQRGQGGEEIRVQRGMFGANNGGDTSGYGGLVRSVRLPGPASRPYGGWFDEVADELEGALEEQGLLPDNAIEKTVVDRGELTFHIEREHLVRVARTLRDDPALRFELCTGVSGVHYPHDKGRELHAVYHLRSITHNRLIRLEVSAPDGDPHIPSLVSVYPTNDWHERETYDFFGIVFDDHPALTRIMMPDDWQGFPQRKDYPLGGIPVEYKGAQIPAPDQRRSYS

SEQ ID NO: 36369 - protein, 440 aa, Streptomyces coelicolor A3(2)
MSTSHASPRETTEGTVYTVTGGDWDEVVQSAARADDERIVVNMGPQHPSTHGVLRLILEIDGETVTEARCGIGYLHTGIEKNLEYRTWTQGTTFVTRMDYLTPFFNEAAYCLGVEKLLGIDDQIPDRATIIRVLLMELNRLSSHLVAIATGGMELGATTIMIYGFRDRELILDIYELITGLRMNHAYIRPGGLAQDLPPGAVDQIREFVKKMNKNLPEYDKLATGNPIFKARMQDVGYLDLAGCMALGATGPVLRSTGLPHDLRKTQPYCGYETYDFDVPTADTCDSYGRFLIRLEEMRQSLRIVEQCLDRLQPGPVMVADKKIAWPAQLALGPDGLGNSLDHIKKIMGTSMEALIHHFKLVTEGFRVPPAQVYTAVESPKGELGVHVVSDGGTRPFRVHFRDPSFTNLQAMAAMCEGGQVADVIVAVASIDPVMGGVDR

SEQ ID NO: 36370 - protein, 264 aa, Bacillus licheniformis ATCC 14580
MKRRILLLFSMIGVIVLLAGCTEINQPITAESEGFWNTYIVYPLSQLITYVANLTNENFGLAIIIVTILIRLLILPLMIKQTKSSKAMQALQPEMQKLREKYSSKDQKTQQKLQQETMALMQKHGVNPLAGCFPILIQMPILIGFYHAIMRTREIAEHSFLWFDLGERDPYFILPILAGVFTFIQQKLMMAGTAQQNPQMAMMLWLMPIMIVVFAISFPAALSLYWVVGNLFMIAQTFFIKGPDLKAERQEAAAGGKKSGGKKK

SEQ ID NO: 36371 - protein, 357 aa, Triticum aestivum
  misc_feature (270)..(270): Xaa can be any naturally occurring amino acid
  misc_feature (319)..(319): Xaa can be any naturally occurring amino acid
  misc_feature (346)..(346): Xaa can be any naturally occurring amino acid
MAGDDGNGNSSAVRGGGGGSGQEEVQIEIAGSSKPAVSLAHEAPPQSAPVKHWQWWLMVVLNMFFLVAGQTSATLLGRFYYNEGGNSKWLSTFVQTAGFPVLFVAQFLFRPKSPSTQATTSGPEASITKITLIYIALGLIIAADDLMYSYGLLYLPVSTYSLVCASQLAFNAVFSYFLNAQKFTPLIFNSVLLLTFSASLLGVDEDSPSSSDISQGNHVLGFVLTLGASATYSLIPSLMQVTFEKVIKRETFSVVLNMQIYTAFVATLAXLLLGLFASGEWKTLEGRDAHVQPKGRCPKVMTVLWTAISWQIASGGVVXGLILGVSPLLSNVISTPALAINPVSAXISSRQNGGIKI

SEQ ID NO: 36372 - protein, 446 aa, Idiomarina baltica OS145
MTERKYFGTDGVRGLVGEHPITPEFAVKLGWAAGKVLAAKGTRKVLVGKDTRISGYMLESALEAGLSAAGVNVDFLGPMPTPGIAYLTRTFRAAAGIVISASHNPYYDNGIKFFADNGHKLPDQVELDIEHLIDQPMDCVASEHLGRANRINDAAGRYIEFCKSAFPSHLSLTGMHIVVDCAHGATYHIAPNVFRELGAKVTEVGTRPDGLNINKECGATHLDALQQEVLKQKAHVGIALDGDGDRIMMVSDKGRILDGDEILYVLMVNALRSGTLKGGVVGTLMSNFALEQACQSLDVPFIRAKVGDRYVIEQLKANDWALGGESSGHIINRDFHTTGDGILAGLQVLAAMVAEDSDIETLLDGFKKLPQTLVNVRYPSGADPLNSPQVKAVVAEVETALAGKGRVLLRKSGTEPVIRVMVEGADTRAVKTFAQQIAQEVEAATK

SEQ ID NO: 36373 - protein, 252 aa, Idiomarina baltica OS145
MSNASLVIANWKMNGNRALTRNMSEVLRDNQADFKGVNVVICPPYTLLSEMAGHIYYDDVALGAQNVSEYESGAHTGEVSVAMLQELGVEYVLLGHSERRAEQHESDQLVAAKAATVTQAGLTAVICVGEDKAQREADNTWSVIQAQLEKSLAGLSAKQMARVVVAYEPIWAIGTGETASPAQAQEVHAKIRGWLVENYQQVGAKTPLLYGGSVKANNAESLFSEADINGGLIGGASLNGEDFCAICRAAKG

SEQ ID NO: 36374 - protein, 347 aa, Arabidopsis thaliana
MSETEFKVLLETFTFPADSAPFKSCHASTIVEVVKDHFLAAYFGGTREGAPDVKIWLQHFKDGQWDSPVIVDEEPGVPMYNPVLFKLPSHELLLFYKIGQEVQKWSGCMKRSYDKGITWTEREQLPPGILGPIKNKPILLEDGTLLCGSSVESWNSWGAWMEVTSDAGRTWRKKGPIYIQGKSLSVIQPVPYQTAAGNLRILLRSFTGIDRICISESLDGGENWSFAVPTVLPNPNSGIDGVKLKDGRLVLAYNTDSRGVLKLGVSLDDGDSWTDILTLEESPGMEYSYPAVIQAGDGNVHVTYTYNRTQIKHVVLKTATDIDSKPYRHGEAGGGHVNLDLYEPNIN

SEQ ID NO: 36375 - protein, 325 aa, Listeria innocua Clip11262
MNLNKHSERKFDLITVGRACIDLNAVEYNRPMEETMTFSKYVGGSPANIAIGTAKLGLKVGFIGKISDDQHGRFIEKYMRDLNINTDGMVKDTAGRKVGLAFTEIKSPEECSILMYRENVADLYLTPEEISEDYIKETRVLLVSGTALAQSPSREAVLKAVHLAQKNDVIVAFELDYRPYTWKNTEETAVYYSLVAEQADVIIGTRDEFDMMENQIGGNNEMTIDNLFKHKAEIIVIKHGVEGSFAYTKAGETFRAQAYKTKVLKTFGAGDSYASAFLYGLFSGENIETALKFGSAAASIVVSKHSSSDAMPTADEIKALIANAD

SEQ ID NO: 36376 - protein, 806 aa, Ashbya gossypii ATCC 10895
MDLKTTFLNRTLAPFYANSGAVASVTGDGSLLATCVLDDINIVRLEEPHAIIHKIENEDEQDVTALRLTPDGRYLCYASQNQLLRFYDLETKRTTRSMKISSPAYVLDCDESSTLLAVGGTDGSVNVFDIANGYVTHSLKGHGATISSVKFYGEVDSGMWLLASGDTNGMVKIWDLVKRRCIHTVQEHTAAVRGLDIRVQEGAESLLLSGGRDDVVHVHHFDMKKKCKLLQTIPVKRQIESCGFIGDNTSLIYTAGGDAVYQIISLESGKSIKQTAQPVEELFIVGVLPVQNSTKCYLVLSDQTLFLIDVEKALSQTEKMIEIEKKIAGNHGTIADMRLVGPSLNRLALATNSPTLRIIPTPQASEDKEVMEIETEMYEGHTDLLNSLDATSDGLWLATASKDHSVILWRYNEASSSFEPFTKFLGHAGPVTAIALPNVMNRNWPEFLLTASNDLTIKRWKVPNPNDRKAIELPHIVKASEYTRRAHEKDINAISMSPNDSIFATASYDKTCKIWNVDTGEVEATLANHKRGLWGVAFCEYDWLLATCSGDRSINLWSLESFTVLKTLEGHTNAVQRVSFINGNKQLVSTGADGLVKIWDCSTGECVRTLDAHNNRIWALAVANDGQLIITADADGVFQFWEDNSEEEHERNIEQEKLRVEQEQSLQNYISEGDWNNAFLLAMTLDHPMRLYHVLERAIAKAQGGEAIFNQELDHIIGTLDNEQLLKVMRRCRDWNTNARTHSVAQKMIRCILLQHDLSTLSEVPGLVQLIDSIVPYIERHYGRLDTLVEQTYLLDYALIEMDKLL

SEQ ID NO: 36377 - protein, 591 aa, Schizosaccharomyces pombe 972h-
MKRSSSVSVEDEKSARRKLDVVPKLHFVGCSHLTDYHLMEKLGEGTFGEVYKSQRRKDGKVYALKRILMHTEKEGFPITAIREIKILKSIKHENIIPLSDMTVVRADKKHRRRGSIYMVTPYMDHDLSGLLENPSVKFTEPQIKCYMKQLFAGTKYLHDQLILHRDLKAANLLIDNHGILKIADFGLARVITEESYANKNPGLPPPNRREYTGCVVTRWYRSPELLLGERRYTTAIDMWSVGCIMAEMYKGRPILQGSSDLDQLDKIFRLCGSPTQATMPNWEKLPGCEGVRSFPSHPRTLETAFFTFGKEMTSLCGAILTLNPDERLSASMALEHEYFTTPPYPANPSELQSYSASHEYDKRRKREQRDANSHAFEQTANGKRQFRFMTRGPSDPWYGIRRPNYNSQPQYQRGSYNREGGNMDRSRNVNYQPKRQQNFKPLTSDLPQKNSEFSETNAMNQTSNHSHADGQRYYRPEQDRSQRLRNPSDYGRQGRQSSQSQQPAWNVSSRYQNNSKVQTTSRASENADTNKTQHNIKYIDSYVPEYSIARQSANQKTNEQHPSSTSLHQQSTSDLKSPSFHENSNVDDTPK

SEQ ID NO: 36378 - protein, 354 aa, Schizosaccharomyces pombe
MNHGTKIPVDPFRIIKETARDGSTGEVKQLSYTSSKVVGSGSFGVVMQVHLIESDSKAAIKRVLQDKRFKNRELQIMRIMNDPNIVDLIAYYYTTGDNSDEVYLNLVLEFMPETIYRASRLYTRQKLSMPMLEVKLYIYQLLRSLAYIHASGICHRDIKPQNLLLDPENGILKLCDFGSAKILVAGEPNVSYICSRYYRAPELIFGATDYTHAIDIWSTGCVMAELMLGHPLFPGESGIDQLVEIIKILGTPSREQIKTMNPNYMEHRFPQIRPQPLSRVFSRSVPLDALDLLSKMLQYTPTDRLTAAEAMCHPFFDELRDPNTKLHNSRNPDASPRHLPELFNFSPFGTIHSS

SEQ ID NO: 36379 - protein, 358 aa, Solanum tuberosum
MSCYKGKYADELIKNAAYIATPGKGILAADESTGTIGKRLSSINVENVESNRRALRELLFCAPGALQYLSGIILFEETLYQKTAAGKPFVDVMKEGGVLPGIKVDKGTVELPGTNGETTTQGLDGLAERCQKYYEAGARFAKWRAVLKIGANEPSQLAINDNANGLARYAIICQQNGLVPIVEPEILVDGSHDIKKCADVTERVLAACYKALNDHHVLLEGTLLKPNMVTPGSDAPKVVPEVIAEYTVRALQRTMPAAVPAVVFLSGGQSEEEATRNLNAMNKLQTKKPWTLSFSFGRALQQSTLKAWSGKEENIGKAQAALLTRCKANSEATLGKYAGSSNLGDGASESLHVKDYKY

SEQ ID NO: 36380 - protein, 100 aa, Glycine max
MFFWSILQVVVHFSAFWCVPSIVMNPFFQELASTYEDVLFLTLDVDEVKEIASKMEIKAMPTFLLLSGGTPMDKIVGANPDEIRKRIDHFVNSTHSYKSV

SEQ ID NO: 36381 - protein, 1090 aa, Emericella nidulans
MASVLIRRKFGTEGGSDAEPSWLKRQVTGCLQSISRRACIHPIHTIVVIALLASTTYVGLLEGSLFDSFRNSNNVAGHVDVDSLLLGNRSLRLGEGTSWKWQVEDSLNQDDQKVDQHLALTTLIFPDSISKSASTAPAADAIPVPANASAQLLPHTPNLFSPFSHDSSLVFTLPFDQVPQFLRAVQELPDPTLEDDEGEQKRWIMRATRGPVSGPNGTISSWLSDAWSSFVDLIKVSLAWGRSFGLLPLSFSRACSLSCLGLLVTTKFGVPINILLLSEGLPFLVTTIGFEKPIILTRAVLSASIDKKRQGSATSTPSSIQDSIQTAIREQGFEIIRDYCIEISILIAGAASGVQGGLRQFCFLAAWILFFDCLLLFTFYTTILCIKLEITRIRRHVTLRKALEEDGITQSVAEKVASSNDWFGAGSDNSDADDASVFGRKIKSNNVRRFKFLMVGGFVLVNVVNMTAIPFRNSSLSPLCNVFSPTPIDPFKVAENGLDAIYVSAKSQKLETLVTVVPPIKYKLEYPSVHYAKLGESQSIEIEYTDQLLDAVGGHVLNGVLKSIEDPVISKWIIAVLTLSIVLNGYLFNAARWSIKEPQAAPAPKEPAKPKVYPKIDLNAGPKRSMEECEAMLKAKKAAYLSDEELIELSLSGKLPGYALEKSLENEELMSRVDAFTRAVKIRRAVVSRTPATSAVTSSLETSKLPYKDYNYALVHGACCENVIGTLPLPLGVAGPLVIDGQSYFIPMATTEGVLVASASRGAKAINAGGGAVTVLTGDGMTRGPCVGFPTLARAAAAKVWLDSEEGKSVMTAAFNSTSRFARLQHLKTALAGTYLYIRFKTTTGDAMGMNMISKGVEKALHVMATECGFDDMATISVSGNFCTDKKAAALNWIDGRGKSVVAEAIIPGDVVRNVLKSDVDALVELNTSKNLIGSAMAGSLGGFNAHASNIVTAIFLATGQDPAQNVESSSCITTMKNTNGNLQIAVSMPSIEVGTIGGGTILEAQGAMLDLLGVRGSHPTNPGDNARQLARIVAAAVLAGELSLCSALAAGHLVRAHMAHNRSAAPTRSATPVSAAVGATRGLSMTSSR

SEQ ID NO: 36382 - protein, 478 aa, Mycobacterium avium subsp. paratuberculosis K-10
MREYLKFYIDGQWVDPVRPNTFDVENPATEQVCGKISLGSAADVDVAVGAARRAFGRWSQSSREDRLDLLQAILAEYQKRADDLAAAVTEEIGAPPSLAAGPQVFLGIGHLTTAIEVLKNFPFTEQRGATLIAREPIGVCGLITPWNWPINQVAVKVYPALATGCTVVLKPSEVAPFSSYIFAEILAAAGVPAGVFNLVNGDGPGVGAALASHPDIDLVSFTGSTRAGVEVARNAAPTVKRVTQELGGKSPNIVLDDGGFADAVRAGVANMMPNSGQSCNAPSRMLVPASRMAEAISIAREVAEQVQVGDPDDATAIGPVASRAQFEKVQRLIQQGIDEGATVVAGGPGRPAGLDQGYYVKPTVFADVTNDMTIAREEIFGPVLCILGYDDLDHAVRLANDTDYGLAGYVSGADLDTAREVAGKIRAGWVTINHAFDLNAPFGGYKRSGNGREWSDFGFHEYLEVKSILGYAPAQGDQ

SEQ ID NO: 36383 - protein, 494 aa, Glycine max
  misc_feature (60)..(60): Xaa can be any naturally occurring amino acid
  misc_feature (253)..(253): Xaa can be any naturally occurring amino acid
RYRNFKTFTTPSPRQFVSLTADISGEVICAGTSDSFEVFVWSMKTGRLMDLLRRPPPPPXSGHEAPVHGLVFSPTNAVLASSSYDKTVRLWNVFDGKGAVETFPHTHDVLTVVYRPDGRQLACSTLDGQIHFWDPIDGLLMYTIEGSRDIAGGRLMTDRRSAANSTSGKFFTTLCFSADGSYILAGGSSRYICMYDVADQVLLRRFQITHNLSLDGVLDILNSKNMTEAGPLDLIDDDSSDIEEGVDKQTRGXLGLDLPGSMPNRGRPIIQTKSLRIASTGRSFVAATTEGVLVYSVDESFIFDPTDLDINVTPEAVEEALRENQPSKALILSLRLNEDSFVKKCIFAVSPADIPAVATSIPYKYIQRLVEALADLLENCPHLEFTLRWSQELCKAHGSSIQQNSRNLLPSLKSLQKAITRIHQDLADTCSSNEYMLRYLCSSGAKKCPLRIHKLDFLQLCSRILVRPKYYFNAVLLSIGRMYNLQPIKNQAKF

SEQ ID NO: 36384 - protein, 211 aa, Streptomyces coelicolor A3(2)
MDHKGTDPGFMNPVAGFGVTFKAMFKKRLTEQYPEQQKTTAPRFHGRHQLNRHPDGLEKCVGCELCAWACPADAIYVEGADNTDEERYSPGERYGRVYQINYARCILCGLCIEACPTRALTMTNEFELADSSRANLIFTKEQLLAGLEEGMVDSPHAIYPGTDEQDYYRGLVTEAAPGTVQQVAHSKGEVVQEGDSTFGATEPASEEVIRR

SEQ ID NO: 36385 - protein, 209 aa, Zea mays
MVGTVAKNVTTEPEQLLERSRAITVQGGDKRGRAVVRIVGKYFPARALGGRAEEALKAHLRRRVLPEVGEREFVVVYMHSLVDRGDNFPGLGAIRAAYECMPAAAKEKLRAVYFVHPGIQARLFFATFGRFLFSSGLYEKLRYMSRLEYLWAHIDKGELEVPEFARRHDDELERRPLMDYGIEAADRCCMFDAASMDTPASLRSLRCIS

SEQ ID NO: 36386 - protein, 113 aa, Synechococcus sp. RS9916
MAGDTIFGRILRGEIPCDEVYSDDHCLAFRDVAPQAPVHVLVIPRKPIESLREAEPADEALLGHLLVVAAKVAKQEGLEAWRTVINSGAEAGQTVFHLHVHVIGGRALDWPPG

SEQ ID NO: 36387 - protein, 203 aa, Oryza sativa
MAAKRGSESDGDELGGGAAAEGTSPNDGGASPPPLAAAPAVCFIRSAGDFAGGAFIGSIVGYGQGLFTKKGFKGSFSTAGSSAKTFAVLSGVQSLVVCLLRRLRGKDDIVNAGIAGCCTGLALSFPGTPQALLQSCATFAAFSCIMEGLNKQQAAMAQTLGGSALTVSHQNGGVLPPFTLPPLLDASDALSSCCQPLVLKPKH

SEQ ID NO: 36388 - protein, 213 aa, Rhodospirillum rubrum ATCC 11170
MDIQDLITNNRKWAEERESALPGYFHILSEVQSPKFLWIGCSDSRVPANEIVGMQPGELFVHRNIANVVPHADANCHAVLEYAIDVLKVEHIMVVGHYGCGGVRAALNRLAMGPIDNWLSHIKDIARIFAAELEDLPDEESRVDRLCELNAMAQVMNVARTSMVQAAWRRGQPLAIHAWCYGLKTGLVNDLGRTLTRIADLPEPYRLIFPDQV

SEQ ID NO: 36389 - protein, 289 aa, Arabidopsis thaliana
MASGFPPQKQETQPGIQHVMEPTPEFSSSNYKPSNKLHGKVALVTGGDSGIGKAVCHCYALEGASVAFTYVKGREDKDAEETLRLLHEVKTREAKEPIMIATDLGFEENCKRVVEEVVNSFGRIDVLVNCAAEQHEVSIEDIDEARLERVFRTNIFSQFFLVKYALKHMKEGSSIINTTSVVAYAGNSSLLEYTATKGAIVSFTRGLALQLAPKGIRVNGVAPGPVWTPLIPASFSEEAIKQFGSETPMKRAAQPVEVAPSYVFLACNHCSSYYTGQILHPNGGLIVNA

SEQ ID NO: 36390 - protein, 453 aa, Arabidopsis thaliana
MDGVSSLPNELLCHILSFLTTKEAALTSILSKRWRNLIAFVPNLYIDDTVFLHPEEGKRDRPEIIQSFMDFVDRILALQGNYPIKKCSLKCLTEVDSVRVDAWISNVLARGVTDLDLLIILDCESDDNYRLSPKCLQSSTLVSLKIDGGIDIARVDNFDILLLALPALEELALVDVIWKDEDVIVSSPSLKTLTIYDIYCFSNLSFDTPSLVYFKYYGCVPQDYPLVNMKNLFDARIIFMLQLPGAREPDDDHWFDQNVALRYSNVWKLFLGLQNVPNLYLSPDTLKVLSLYCESMPVFKNLKSLAIKSGKERGWQAIPVLLRNCPHLETLVIEGVLHNVTDKCGDACDCISREDKGRSLTSCPVKMLEIRGFRGTMKEMTMMKHFLDYFLCLKAMNIYVEENDPTELRFPEVSKCIMQMMEEYNKLSSCNVELLVTDYFYFSEKWTAKGRIL

SEQ ID NO: 36391 - protein, 591 aa, Zea mays
MCSILAVLGVAEVSLAKRSRIIELSRRLRHRGPDWSGLHCHEDCYLAHQRLAIIDPTSGDQPLYNEDKTVVVTVNGEIYNHEELKAKLKTHEFQTGSDCEVIAHLYEEYGEEFVDMLDGMFSFVLLDTRDKSFIAARDAIGICPLYMGWGLDGSVWFSSEMKALSDDCERFITFPPGHLYSSKTGGLRRWYNPPWFSETVPSTPYNALFLREMFEKAVIKRLMTDVPFGVLLSGGLDSSLVASVASRHLNETKVDRQWGNKLHTFCIGLKGSPDLKAAREVADYLSTVHHEFHFTVQEGIDALEEVIYHIETYDVTTIRASTPMFLMSRKIKSLGVKMVISGEGSDEIFGGYLYFHKAPNKKEFHEETCRKIKALHLYDCLRANKATSAWGVEARVPFLDKSFISVAMDIDPEWKMIKRDLGRIEKWVIRNAFDDEERPYLPKHILYRQKEQFSDGVGYSWIDGLKDHASQHVSDSMMMNAGFVYPENTPTTKEGYYYRMIFEKFFPKPAARSTVPGGPSVACSTAKAVEWDASWSKNLDPSGRAALGVHDAAYEDTAGKTPASADPVSDKGLRPAIGESLGTPVASATAV

SEQ ID NO: 36392 - protein, 323 aa, Francisella tularensis subsp. holarctica
MTSHINNAVETFRLEIETLEKLKNSIDENFEKACEIILENNRDKSRVIITGMGKSGHIGKKMAATFASTGTPAFFVHPGEAGHGDFGMITKNDVLIAISNSGTSSEIMGLLPMIKHLDIPIIAITSNPKSILARNSNVTLNLHVDKEACPLNLAPTSSTTATLVLGDALAIALLKAKNFSEKDFAFSHPNGALGRKLILKVENIMRKGNEIPIVKPTDNIRKAILEISDKGVGNTLVAENNTLLGIFTDGDLRRMFEAESFNSQRAISEVMTKNPKSISKEEMAITALEKMEKYEITSLAVVDNGHNILGIVTMHDLIKLELR

SEQ ID NO: 36393 - protein, 419 aa, Treponema denticola ATCC 35405
MIKTVKDVNLKDKRIIMRVDFNVPMKDGVVQDDTRIRAALPTIKYILEQGARSLVLMSHLGDPSKDAKKAKEKAEKDGKPFDEEAYINGKHRMKPVAEYLSGLLKLPVDFAPSCMGQLERVKALPQGGILMLENTRFHKEETSKEKAEQQILAKELSLYGDIYVNDAFGTAHRSHASTAEIANFVNTRVAGFLMEKEIKYLEPMLNNPAKPMTAIIGGAKVSSKIAVLESLLKNASSLIIGGGMAYTFLKVQGKKIGKSLFEEDFMDTAKNLLDKAEKQGVKIILPVDHICSETFSPNAEAVLVESTDIPDNLMGMDVGPKTLALYKEIILSSKSIVWNGPVGVFEFEAFSKGTEETARLVAAATEKGALTIVGGGDSVAAVNKFNLADKMSHVSTGGGASLEFLEGKVLPGIACLDTI

SEQ ID NO: 36394 - protein, 203 aa, Oryza sativa (japonica cultivar-group)
MAAKRGSESDGDELGGGGAAEGTSPNDGGASPPPLAAAPAVCFIRSAGDFAGGAFIGSIVGYGQGLFTKKGFKGSFSTAGSSAKTFAVLSGVQSLVVCLLRRLRGKDDIVNAGIAGCCTGLALSFPGTPQALLQSCATFAAFSCIMEGLNKQQAAMAQTLGGSALTVSHQNGGVLPPFTLPPLLDASDALSSCCQPLVLKPKH

SEQ ID NO: 36395 - protein, 523 aa, Treponema denticola ATCC 35405
MKKKPLSAKIVFMKITEKILIVDFGGQYNQLIARRVRDLNVYSDIVPASKALDYIRENKPIGIIFTGGPNSVYEEKAPLPPKEIFNLNIPILGICYGMQAMAHCLGGKVEKSLKREFGKTLTKFDTGIPLFKNIKDKSSVWMSHVDCVSRLPEGFVSAAQTANTKNAAMANKEKKLYGIQFHAEVEHSEEGQNIIKNFLYNVCGAKGDWNMKSFLAEAIKDVQNTVKDGKVLLALSGGVDSSVLAALLNRAVGKNLTCIFVDHGLMRKNEGDEVEAAFRDTPMNFIRVNAESRFLGKLKGVSDPEKKRKIIGEEFIRVFEEEAEKIGTVDFLAQGTIYADVVESGTKGSAVIKSHHNVGGLPDHISFKSLIEPLKTLFKDEIRNLGTELGLPDYLVHRQPFPGPGLAIRIMGEITEEKLDILREADAIWRSELEHADIKKDLSQYFAVLTSTKTVGVMGDFRTYDYTLALRAVKTSDFMSADWVRIPYEVLDKVSSRIINEVKGINRIVYDITSKPPATIEWE

SEQ ID NO: 36396 - protein, 336 aa, Streptomyces coelicolor A3(2)
MTVVGPFGLSVRDQALEADVQAGLVAVEEGLLEATKSEVPFITEAAQHLVRAGGKRFRPLLVMLSAQFGDPYAPGIVPSAVVVELTHLATLYHDDVMDEAAVRRGVPSANTRWDNSVAVLTGDFLFARASQILADLGPEAVRVQALAFERLVTGQILETAGPQDGRDPVDHYLDVLGGKTGSLVAVSCRFGAMMSGADETVVDVLTQYGERLGVAFQLADDVLDIASDSDESGKTPGTDLREGIPTLPVLRLRERAARLGLAEDLALCELLDSDLSDDARHAEALRLLRAHPALEQARRDTVRYAEEARAALAPLRECDAKAALVELCDAVVHRAG

SEQ ID NO: 36397 - protein, 338 aa, Oryza sativa (indica cultivar-group)
MAIIVAATAASELEEFRSCAHERWQRLHPKGKGEKNLSCSYGDGSILVKTSSGEEFHGAKCIITVGAWASKLVKSVAGVDLPVQPLHTLICYWKARPGREHELTPESGFPTFASYGDTCIYSTPSMEFPGLIKVCAHCGAPCDPDRRDWCAGGDALADPVARWIDELMPGHVDTAGGPVIRQSCMYSMTPDEDFIIDFVGGEFGKDVVVGAGFSGHGFKMGPAVGRILAEMAMDGEAKTAAEAGVELGYFRIGRFEGNPEGNRAENKVMVGTLYSGKMVGGRPLNDRFPELYNVAVTKKVTIATLKQKGIDSVKFRRCLYCEKLRDWNKIKNRWVICS

SEQ ID NO: 36398 - protein, 414 aa, Oryza sativa (indica cultivar-group)
MAAAAAATNGGFDAIVVGGGIMGSCAAYAAASSSASRGGGARVLLLERFDLLHHRGSSHGESRGIRATYPQARYPPMVRLAARLWGDAEAEAGYRVLTPTPHLDMGPRADPALRAAIENGGAAEVVGASDDSAASWPWSAVFRLPEGWTAASSELGGVIKATKAVAMFQSLAAKNGAVLRDRTEVIDIAKQGDGSILVKTSSGEEFHGANCIITVGAWASKLVKSVAGVDLPVQPLHTLICYWKARPGREHELTPESGFPTFASYGDTCIYSTPSMEFPGLIKVCAHGGAPCDPDRRDWCAGGDALADPVARWIDELMPGHVDTAGGPVIRQSCMYSMTPDEDFIIDFVGGEFGKDVVVGAGFSGHGFKMGPAVGRILTEMAMDGEAKTAAEAGVELGYFRIGRFEGNPGGKSC

SEQ ID NO: 36399 - protein, 262 aa, Silicibacter pomeroyi DSS-3
MTGELSPIDKAKFVAAKRAADLVEDGMRVGLGTGSTAAWLVRCLGDMVRKEGLKMRGVPTSTRTAQLAREVGIEVITLDEARWLDITIDGADEFDGDLNLIKGGGGALLQEKIVATASDQMVVIADLGKEVSRLGAFPLPVEVIPFGWQTTQALLEETLISMDVLGRTATLRMNGDTPFVTDEGNHILDLHLQRIGNARQLALVLNQIPGVVENGLFIDICDTVVVGHGDGRVEIRDINQGTVEHDRLDFVESDNLFTDLAD

SEQ ID NO: 36400 - protein, 452 aa, Silicibacter pomeroyi DSS-3
MSFDYDLFVIGGGSGGVRAARVAAGETGAKVALAEEDRYGGTCVIRGCVPKKLMVFASEYSGMVEDAQAYGWNIQPGAFDWDVFRSKLYTELDRLEGVYRNILKNNGVETFDMRARLVDAHTVELSDGTRKSAKHILIATGGRPVKPEIKGAELAITSNEIFHLDKLPERMLIVGGGYIACEFVGIMNGMGVEVTQYYRGAQILRGFDDEARGLVSEEMCQNGIKLHLGTNVLEMEREGDRIRVKATNGDEELFDQVMFATGRVPNADHLGLEGLGVELGRKGQIVVDDYSQTAVPSIYAIGDVTDRVNLTPVAIREGMAFVDTVFRGKPTPVDHALIPTAIFTQPEMGTVGLSEEEAAAQEPVEIYATSFKPMQTAFAGRSQRVLMKLIVSKATRKVLGCHIVAPGAGEMIQLVGIAVKMGATKEDFDRTVAVHPVMAEELVTLRQPVRSA

SEQ ID NO: 36401 - protein, 511 aa, Campylobacter jejuni subsp. jejuni NCTC 11168
MKKADILVLDFGSQYTQLIARRLREQGVYAEILPFNVSLADIKAKEPKGIILSGGPASVYATDAYFCDKGIFDLNLPVLGICYGMQLMAHHYKATVAPAGHKEYGKANIEIKKDNALFKNLPKKQTVWMSHSDKVENLPQGFEVLATSENSPFCVFGNEDKKFFALQFHPEVQHSEFGKNILKNFAKYACNCESIWNMGSFAKTQAEKIREEVGNDKVLCAVSGGVDSSVVAALLASAIKEQIIVVFVDNGLLRSGEKEQVEFMFKNTLGIDLISIDASEIFLSRLVNVTDPEQKRKIIGNTFIEVFEEEAKKHKDVKYLAQGTLYTDIIESSVVGASKTIKSHHNVGGLPEKMNLKLIEPLKEIFKDEVRALGLELGLSKEVVYRHPFPGPGLAIRIMGEVNRASLELLRKADVILLEELKSTGWYDKTWQAFCVLLNVKSVGVMGDNRTYDNAVCIRVVDASDGMTATFSHLPYEILENISRRIINEVEGINRVVYDISSKPPATIEWE

SEQ ID NO: 36402 - protein, 297 aa, Schizosaccharomyces pombe 972h-
MENYQKVEKIGEGTYGVVYKARHKLSGRIVAMKKIRLEDESEGVPSTAIREISLLKEVNDENNRSNCVRLLDILHAESKLYLVFEFLDMDLKKYMDRISETGATSLDPRLVQKFTYQLVNGVNFCHSRRIIHRDLKPQNLLIDKEGNLKLADFGLARSFGVPLRNYTHEIVTLWYRAPEVLLGSRHYSTGVDIWSVGCIFAEMIRRSPLFPGDSEIDEIFKIFQVLGTPNEEVWPGVTLLQDYKSTFPRWKRMDLHKVVPNGEEDAIELLSAMLVYDPAHRISAKRALQQNYLRDFH

SEQ ID NO: 36403 - protein, 175 aa, Brassica napus
MSLSNRDPLVVGRVVGDVLECFTRSIDLRVTYGQREVTNGLDLRPSQVLNKPRVEIGGEDLRNFYTLVMVDPDVPSPSNPHLREYLHWLVTDIPATTGTNFGNEIVSYESPRPNSGIHRIVLVLFRQLGRQTVYEPGWRQQFNTREFASLYNLGLPVAAVFYNCQRESGCGGRRS

SEQ ID NO: 36404 - protein, 480 aa, Ashbya gossypii ATCC 10895
MLRCREVYNICKGAMSNEVKHYDYLVIGGGSGGVASSRRAASYGAKTVLIEGKALGGTCVNVGCVPKKVMWYASDLAHRLLHARDYGLLQEVDISKEKLHFNWKEFAGKRNAYVERLNGIYERNLAKEGVEYVHGWARFNSEGQVEVTRPDQTTEKYTADHILIATGGEPVLPEGIPGAEYGVDSDGFFRLEEQPKKVVISGSGYIATEFAGVFNGLGTETHIVIRKDHVLTKFDPSIQEIVTEHYEKEGVNIHKKESIQRVEKDPNTGKLTVHLSGKIIEDVDQLVWAIGRKSLLGIAPENVGVKLGETGHVVVDEYQNTSTKGIYALGDVVGNMELTPVAIAAGRKLANRLFGPEQMRAQKQDYDNVPSVVFSHPEAGSIGLTEPQAIERYGKENIKIYQTKFTAMYYAMLEDKSPTKYKLICAGPEEKVVGLHIVGDGSAEILQGFGVAIKMGATKADFDSCVAIHPTSAEEIVTLK

SEQ ID NO: 36405 - protein, 365 aa, Thermomyces lanuginosus
DLKPENVLIEVGDVEQIVKTYVKEEPKKEEKDNRNGRRRRRTLITGSQPLPSPLNASFGHTDKYGSHNSLNHMVNDGGGKDSLNVPEDERQQREKTADLLEREVSGISLDKKTEPQKQQTDIISVKIADLGNACWVGHHFTNDIQTRQYRSPEVILGAKWGASTDVWSMACMVFELITGDYLFDPQSGTKYGKDDDHIAQIIELLGHFPRSLCLSGKWSQGNLQPQRRTPKHPSAAPLGAPGRAAGRNTISLSRRASRSATFCCQCCIWFRRNGPMPAVWPVMSGSRIHQAWTALIWEFRRGLGARASKAGHARSNGGDFMILCFVALYSGWMDGIYCVLDKLDVDLISFMMTYRELCRRGLPMI

SEQ ID NO: 36406 - protein, 247 aa, Glycine max
MYVASMRKSFKDSLKVLEADIQHANTLASDFPREYDGACLQMRMSYSPAAHLFLFLVQWTDCHLAGALGLLRILIYKVYVDGTTTMSTHERKASIREFYAVIYPSLLQLEKGVTDTEDKKQKVVCMERYRRRDDEEYRQSSDIDIEREDECGICMDMNSKIVLPNCNHAMCLKCYREWRTISQSCPFCRDSLKRVNSGDLWVFTDRRDVVDMATVTRENLRRLFMYIDKLPLIVPDSLFDTYDSHIR

SEQ ID NO: 36407 - protein, 355 aa, marine gamma proteobacterium HTCC2143
MLARTPLEGYPTDGDFRLDSSSIPEPADGQCVSRTLYLSLDPYQWGRRRSGVEQVGDVCHGRTVSAVIKSRHPHFNEGDIIFSTHGWQDYGLTGSGISTFGYMLPRRVEPALAPISSALGVLGMLGLTAYAGTALQCQPKAGETFVVSAASGGVGQIAGQIAKIYGCRVVGIAGAQAKCDFLQQSLGFDAAVSHLSEDFADQLASACPDGIDMYFENVGGKVFNAVLPLFNRAARISRCGLISQYGNTDGLDPLQTWQHIGQAVFDQQAMTIHSLFVGDYVADHQKPFLEIMSQWVANGKVKYREDLWTGLEQAPAAFTAMLAGKNFGKTMIAVGDDPTLTDAISHRRSDGNILA

SEQ ID NO: 36408 - protein, 487 aa, Vitis vinifera
RFFIRSLLLKPSRKLPPGPKGWPLLGALPLLGNMPHVALAKMAKRYGPVMFLKMGTNSMVVASTPEAARAFLKTLDINFSNRPPNAGATLLAYHAQDMVFADYGARWKLLRKLSNLHMLGGKALEDWSQVRAVELGHMLRAMLELCQRAEPVVVPEMLTFSMANMIGQVILSRRVFETKGSESNEFKDMVVELMTSAGYFNIGDFIPSIAWLDIQGIQRGMKHLHRKFDWLLTKMMEEHTASAHERKGNPDFLDVIMANQENSTGEKLTITNIKALLLNLFTAGTDTSSSVIEWSLAEMLKNPSILKRAHEEMDQVIGRSRRLVESDLPKLPYLQAICKESFRKHPSTPLNLPRVSTQACEVNGYYIPKNTGLSVNIWAIGRDPDVWESPEEFRPERFLSGRNTKIDPRGNDFELIPFGAGRRICAGTRMGIVLVEYILGTLVHSFDWKMPDGVEINMDEAFGLALQKAVSLSAMVTPRLHQSAYAV

SEQ ID NO: 36409 - protein, 478 aa, Mycobacterium leprae TN
MTEKTSDDVLKLAKDENIEFVDVQFCDLPGIMQHFTIPASAFDKSVFEDGLAFDGSSIRGFQSIHESDMLLFPDPDTARIDPFRAAKTLNVNFFVHDPFTLEPYSRDPRNIARKAENYLISTGIADTVYFGAEAEFYIFDSVSFDSRSNGSFYQVDAISGWWNTGAATESDGSPNRGYKVRHKGGYFPVAPNDQYVDLRDKMLTNLTNAGFVLEKGHHEVGTGGQGEINYQFNTLLHAADDMQLYKYIVKNTAWQNGKTVTFMPKPLFGDNGSGMHTHQSLWKGGTPLMYDEIGYAGLSDTARHYIGGLLHHAPSLLAFTNPTVNSYKRLVPGYEAPIKLVYSQRNRSACVRIPITGKNPKAKRLEFRCPDASGNPYLAFSAMLMAGLDGIKNKIEPQAPVDKDLYELPPEEAADIPQAPTQLAAVIDRLEEDHDYLTEGSVFTPDLIETWINFKRENEIEPVNIRPHPYEFALYYDV

SEQ ID NO: 36410 - protein, 596 aa, Oryza sativa
MASSASLQRFLPPYPHAAASRCRPPGVRARPVQSSTVSAPSSSTPAADEAVSAERLEPRVEQREGRYWVLKEKYRTGLNPQEKVKLGKEPMSLFMEGGIKELAKMPMEEIEADKLSKEDIDVRLKWLGLFHRRKHQYGRFMMRLKLPNGVTTSEQTRYLASVIEAYGKEGCADVTTRQNWQIRGVTLPDVPAILDGLNAVGLTSLQSGMDNVRNPVGNPLAGIDPDEIVDTRSYTNLLSSYITSNFQGNPTITNLPRKWNVCVIGSHDLYEHPHINDLAYMPAVKGGKFGFNLLVGGFISPKRWEEALPLDAWVPGDDIIPVCKAVLEAYRDLGTRGNRQKTRMMWLIDELGMEAFRSEVEKRMPNGVLERAAPEDLIDKKWQRRDYLGVHPQKQEGMSYVGLHVPVGRVQAADMFELARLADEYGSGELRLTVEQNIVIPNVKNEKVEALLSEPLLQKFSPQPSLLLKGLVACTGNQFCGQAIIETKQRALLVTSQVEKLVSVPRAVRMHWTGCPNSCGQVQVADIGFMGCLTKDSAGKIVEAADIFVGGRVGSDSHLAGAYKKSVPCDELAPIVADILVERFGAVRREREEDEE

SEQ ID NO: 36411 - protein, 470 aa, Pseudomonas fluorescens Pf-5
MSTSNQQPQPAAPRSTQDYQAADAAHHIHAFLDQKALNAEGPRVIVRGEGLHLWDNDGKRYLDGMSGLWCTNLGYGRKDLAAAASAQLEQLPYYNMFFHTTHPAVVELSELLFSLLPGHYSHAIYTNSGSEANEVLIRSVRRYWQILGQPQKKVMIGRWNGYHGSTLAATALGGMKFMHDMGGLIPDVAHIDEPYWFAHEGNLTPAEFGLRCARQLEEKILELGAENVAGFIAEPFQGAGGMIFPPESYWPQIQRICRQYDVLLCADEVIGGFGRTGEWFAHQHFGFEPDTLSIAKGLTSGYIPMGGLVLSKRIAQVLVEQGGVFAHGLTYSGHPVAAAVAIANLKALRDEGVVSQVKNDTGPYLQQCLREVFGNHPLIGEIQGTGLVAALQFAEDKASRKRFANENDIAWRCRTLGFEEGVIIRSTFGRMIMAPALVASRGDIDELVDKTRRAVERTAGEIEAGTLPSS

SEQ ID NO: 36412 - protein, 329 aa, Solanum tuberosum
MAVNGSAPSSGLIVSFGEMLIDFVPTVSGVSLAEAPGFLKAPGGAPANVAIAVTRLGGKSAFVGKLGDDEFGHMLAGILKTNGVQADGINFDKGARTALAFVTLRADGEREFMFYRNPSADMLLTPDELNLDLIRSAKVFHYGSISLIVEPCRSAHLKAMEVAKEAGALLSYDPNLRLPLWSSEEEARKQIKSIWNYADVIKVSDVELEFLTGSNKIDDECAMSLWHPNLKLLLVTLGEKGCNYYTKKFHGSVGGFHVKTVDTTGAGDSFVGALLTKIVDDQAILEDEARLKEVLRFSCACGAITTTKKGAIPALPTVSEVLTLLKGGA

SEQ ID NO: 36413 - protein, 501 aa, Pseudomonas fluorescens Pf-5
MRECSVFDLGYWQQRAARQTFIDQALIGGQRLSAESGATFDAINPATRQVLARVSACGAAEVDLAVAAARRAFEHGPWARMAPVERKKVLLRLAELMLAHREELALLDSLNMGKPVMDAWNIDVPGAANVFAWYAESIDKLYDQVAPGARNSHASISRVPLGVIGAVVPWNFPLDMAAWKLAPALAVGNSVVLKPAEQSPFSALRLAELALEAGLPEGVLNVVPGLGSEAGRALGLHPDVDCLVFTGSTEVGKFFMQYSAQSNLKQVWLECGGKSPNLVFDDCQDLDLAAEKAAFGIFFNQGEVCSANSRLLVQRSIHEEFVERLKAKARDWRPGNPLDPASRAGAMVDARQTASVMGHIAAALEQGAQLACGGRQLSIDGSDNYIEPTILTGVGPAMAIAREEVFGPVLAVTPFDDEEQAIALANDSVYGLAASLWSDDLNRAHRVAGCLRAGTVSVNTVDALDVTVPFGGGRQSGFGRDLSLHAFDKYTQLKTTWFQLR

SEQ ID NO: 36414 - protein, 500 aa, Oryza sativa
  misc_feature (439)..(439): Xaa can be any naturally occurring amino acid
CRFSASASARAPSSSPNGVAAAPTRCSLSLAARRAAAVGPAAASPLRRGGLAAGCQPARSLAFAAAADPRLATHVASRCRQAASSSARGTRAVATMAKKSVGDLTAADLEGKRVFVRADLNVPLDDNQNITDDTRVRAAIPTIQYLIKNGAKVILSSHLGRPKGVTPKFSLAPLVPRLSELLGIQVTKAEDVIGPDVEKLVSELPNGSVLLLENVRFYKEEEKNDPEFAKKLASLADLYVNDAFGTAHRAHASTEGVTKFLKPSVAGFLLEKELDYLVGAVSSPKRPFAAIVGGSKVSSKIGVIESLLEKCDILLLGGGMIFTFYKAQGLSVGSSLVEEDKLELATSLLAKAKEKGVSLLLPSDVIIADKFAPDANSQVVPASAIPDGWMGLDIGPDSVASFSSTLETTQTVIWNGPMGVFEFDKFAVGTEAIAKKLAXLSGKGVTTIIGGGDSVAAVEKVGVADVMSHISTGGGASLELLEGKELPGVIALDEAVTVAV

SEQ ID NO: 36415 - protein, 250 aa, Robiginitalea biformata HTCC2501
MHRFGLIGKDISYSFSPGYFGEKFRKLGLEDYTYQIFDLADISEFPALFGEYPDLKGLNVTIPYKQVVMPFLDHIAPEAARIGAVNTICLQGSITTGHNTDVTGFRESLRPLLLPADREALILGTGGASRAVAHALEQLGIHFRYVSRNPGPGQLSYTGLDAPTLREVQIVVNTTPLGTHPNTDARPEIPYEALGPEHLLFDLIYNPGQTAFLSEGRSRGSRIKNGLEMLEIQAEHAWKLWNAPAATPGN

SEQ ID NO: 36416 - protein, 373 aa, Campylobacter jejuni subsp. jejuni NCTC 11168
MEISYYEILEITQNADKETIKKAYRKMALKYHPDRNQGDKEAEDKFKLVNEAYEVLSNDEKRAIYDRYGKDALKGGGFGSSSSGFGGFEDLGDIFSSFFGEGFGSSRRRKSSNDEKIPSDFIVNLKLSFKEAVFGCKKNIDFTYKCSCKTCNGTGAKDGKLQTCPKCQGRGQVGVSQGFITFAQTCPDCQGIGEKASEKCSDCKGLGYNESKDSVELNIPEGVDTGMKLRVNAKGNILKNGTRGDMYVKIIAAEDDTFIRDDDDIYIEFPVFFTQAILGESIKVPTIRGEATLNLPKGAKDGQRFVLEKEGVKDVHSSRMGNQIVQISIKFPTSLNDEQKELLEKLSESFGIKDGMHQEQKGLFEKITNWFKS

SEQ ID NO: 36417 - protein, 434 aa, Schizosaccharomyces pombe 972h-
MVYIKCRYVCFCCAFISNTTSKSIFNELRCPVTLTFLQFGFVAFFSAVCLLFRKQFLGGTGIQKPSKYVLYTTLPLSIFQIGGHVFGSLATTKIPVSTVHTVKALSPLFTVLAYRFMFRHVYSAMTYFSLVPLTFGVTLACSFELSADIVGLLYALISTCIFVSQNIFGSKIFMEAKSHSTHTKKHYNKLNLLLYSSGVAFIVMIPVWLYQEGFAYLPEVGSPVFLNLIYNGLSHFFQNILAFTLLSIISPVAYSIASLIKRIFVIVVSIIWFQQATNFTQGSGIFLTAIGLWLYDRSKKGNLYESCKVKEFEKDALELEEQTMEDEKSYPSSGTQSPFYGKNFLPQITPRLDSVVPLISDSPMTPNSVYSNEGVTSSVSGNATPASVRQSTQNDFSNSNIHDRRSSYTFQLNNFKAPQPSRLWATETVPTLKI

SEQ ID NO: 36418 - protein, 553 aa, Oryza sativa
RIAWTWEFGIMAGDTTPVNPNYISICNPASSLSLIFTSLFLSWKRVRGSRRGDFCKEMGENGVVASKLCYPAAAMEVVAAELGHTAGSKLYDDDGRLKRTGTMWTASAHIITAVIGSGVLSLGWAIAQLGWVAGPAVMLLFSFVTYYTSALLADCYRSGDESTGKRNYTYMDAVNANLSGIKVQVCGFLQYANIVGVAIGYTIAASISMLAIKRANCFHVEGHGDPCNISSTPYMIIFGVAEIFFSQIPDFDQISWLSILAAVMSFTYSTIGLGLGVVQVVANGGVKGSLTGISIGVVTPMDKVWRSLQAFGDIAFAYSYSLILIEIQDTIRAPPPSESGVMRRATVVSVAVTTLFYMLCGCTGYAAFGDAAPGNLLTGFGFYEPFWLLDVANAAIVVHLVGAYQVYCQPLFAFVEKWAQQRWPKSWYITKDIDVPLSLSGGGGGGGRCYKLNLFRLTWRSAFVVATTVVSMLLPFFNDVVGFLGAVGFWPLTVYFPVEMYIVQKRIPRWSTRWVCLQLLSLACLAITVASAAGSIAGILSDLKVYKPFATTY

SEQ ID NO: 36419 - protein, 297 aa, Desulfotalea psychrophila LSv54
MGGVMEKFHGAYVAIITPFINGEVDEQSFVDLIEFQIANGTHGIVPCGTTGESATLSFDEHKQVMDLAIKTVAGRVPVIAGAGANNTLEAIDLSESAKESGADAILSVAPYYNKPSQEGIYQHFKAIAEAVDIPMFLYNVPGRTVVNIAPETTARLAGIDNIIGIKEACGCLEQISDVIRKCPEDFIVLSGDDFTSMPTNVIGGKGVISVISNVFPKGMAEMQEATFAGDWDRARQLHYQMYDMMKQMFAAPSPAPAKKALELMGVIREGLPRIPMTPIDDDNLANLKLAMKGLNLI

SEQ ID NO: 36420 - protein, 178 aa, Triticum aestivum
YSPCPPPVMASSATSVAPFPGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 36421 - protein, 512 aa, Arabidopsis thaliana
MSATLKNPVIKLKLLIDEEKNKVVFVEAGKDFVDLLFSFFTLPMGTIVRLLEMYKKSQKIAIGCFSNIYASVVSMGIEHFLTEACKQMLLYPGSLNHEKCRNLKLRVDDSEATKYFVCPKFVEREQCTESYSNFNTSRCSCGVLMNEVTQLDGRGGLASAGNGVEGGVFVRSDHTSFMITDDLKVEITSVRLTLNVLKDLGYVDCEKLDEKIHDVNLEEVPTLLECLSTSDNPLTDTFLKKKSSYSTKRIQKLPSPGLCEDREESTPDQTITLNVVKKEGNILFVECGDDFVDLLFTFLAIPLESARGIAGDGIIIGCIGNLSKSFKDLSVDPGREAKCVLPHYYKCQKQLLDAVTTHKPPTFYLYVSSMASNHIREYRLSEDSSKPLVYFWDGLMPMISIDPKSKGSTNTTDESTIPSGGFMKRGTKFMITDDLIITPLNSTSTIGLVKEKQIRLDDVEVQEIIIRKEEAIRLLQASLATCSALSTGLLAIESASTSVPQSANLKKPKIET

SEQ ID NO: 36422 - protein, 185 aa, Oryza sativa (japonica cultivar-group)
MAAGTACRRYIGPLLCVNLVMHAAVLGLAGWSLNKFIDGETHHHLGGNTSSGYLLVFSLMAGVVGVCSVLPRLLHVRAWRGETLAAAASTGLVSWALTALSFGLACKHITLGNRGRRLRTLEAFIAILTLTQLLYLILLHTGSLGSSMTLGLSRRNCDDDEELRCDEIPREELYTNKKPAIVAGA

SEQ ID NO: 36423 - protein, 601 aa, Mycobacterium leprae TN
MPGQSHKEPHRRATSTPRSLKQATSELRWALSLAAPESPAFMRHLLGNAHDKVDITTSSEHVAAFTEHAIVLLNGNAHQTRELLGGKGYNINAMRRHQLAVPPAFCITTEVGVRYLAAPTPTMEAIWNDVLDQMRWLEAETSRTFGWGPRPLLVSIRSGAVQSMPGMMDTILNLGINDPVEQALAAASPSPIPQTFARDTRLRFIRTYRRIVDPLNPPPANTYDQLRAAIESIFSSWNSPRAVAYRTHYGLDDQSGTAVIVQAMVFGNQGAYSGAGTLFSRNPITRESKLFGEWLPGGQGDDVVSGLVEVQPITSLRDEQPTVYDELVDTAGRLERLGSDVQEIEFTTEDSKLWLLQTRVAERSAQVAVRLALQLWQEGLIDDAEALRRVTPVHVETVLLPVLQPENHLSATLLAKGTPTCPGVISGKAYTEVDEALDAAESAEQVILVRDHTRPDDVLGMLASQGVVTEVGGAASHAAVVSRELSRVAVVGCGQGTAVSLAGKQITVDGDKGEVRQGNLTLSAWSENETPELRELADIARRISPLRVHMTEDHTRLDDSSDTAVRLAINTGHADVVSATPLIVMMTTLRLQDSKDSSAKS

SEQ ID NO: 36424 - protein, 217 aa, Oryza sativa (indica cultivar-group)
MAMLARTSRPAPTLLAATSPAVSRRPAAVSFAAAASPGSRGRVALSVAWGGRAARGRVSAAGRIVASSVEQSYIMIKPDGVQRGLVGEIISRFEKKGFVLKGLKLFQCPKDLAQEHYKDLKEKPFFPGLIEYITSGPVVCMAWEGNGVVASARKLIGATNPLQAEPGTIRGDLAVQTGRNVVHGSDSPDNGKREIALWFKEGELCEWESVLTPWLVE

SEQ ID NO: 36425 - protein, 222 aa, Oryza sativa
  misc_feature (167)..(167): Xaa can be any naturally occurring amino acid
  misc_feature (198)..(198): Xaa can be any naturally occurring amino acid
MAPLGDGAAAAAAEPNLVVSFGEMLIDFVPDVAGVSLAESGGFVKAPGGAPANVACAISKLGGSSAFVGKFGDDEFGHMLVDILKKNGVNAEGCLFDEHARTALAFVTLKSNGEREFMFYRNPSADMLLTEAELNLDLIRRAKIFHYGSISLITEPCRSAHVAAMRXAAKSAGILCSYDPNVRLPLWASEDAAGAGIXSIWRGATLRRARRAHPDGPQKVLR

SEQ ID NO: 36426 - protein, 144 aa, Glycine max
MGSLMAGWDSLILDPESATIERNRSLTKEEINAYWRVKKETELEHLRAMSKLSETIQARKFEDSENSHKSSTVTLASIKESLGMDVDQKSLEQLIKKNGWWTKSSWAFPNEPPVIEAASNKYASQFHVANLGSTKLSPGDGINA

SEQ ID NO: 36427 - protein, 197 aa, Streptomyces coelicolor A3(2)
MAPVPGSGLAKGLAVTLRTMTRKTVTEQYPDAQPELPPRTRGVIGLFEENCTVCMLCARECPDWCIYIDSHKETVPAATPGGRDRSRNVLDRFAIDFALCMYCGICIEVCPFDALFWSPEFEYAETDIRDLTHERDKLREWMWTVPAPPALDPGAEEPKELAAARKAADKLAAQQQPDQPGPDHPGQPDESGQEGRT

SEQ ID NO: 36428 - protein, 579 aa, Glycine max
MCGILAVLGCSDSSQAKRVRVLELSRRLKHRGPDWSGLHQYGDNYLAHQRLAIVDPASGDQPLFNEDKTVVVTVNGEIYNHEELRKQLPNHTFRTGSDCDVIAHLYEEHGENFVDMLDGIFSFVLLDTRDNSFIVARDAIGVTSLYIGWGLDGSVWISSELKGLNDDCEHFESFPPGHLYSSKERAFRRWYNPPWFSEAIPSAPYDPLALRHAFEKAVVKRLMTDVPFGVLLSGGLDSSLVAAVTARYLAGTNAAKQWGTKLHSFCVGLEGAPDLKAAKEVADYIGTVHHEFHYTVQDGIDAIEDVIYHIETYDVTTIRASIPMFLMSRKIKSLGVKWVISGEGSDEIFGGYLYFHKAPNKEEFHQETCRKIKALHKYDCLRANKSTFAWGLEARVPFLDKDFIRVAMNIDPEYKMIKKEEGRIEKWALRRAFDDEEHPYLPKHILYRQKEQFSDGVGYGWIDGLKAHAEKHVTDRMMLNAANIFPFNTPTTKEAYHYRMIFERFFPQNSARLSVPGGPSVACSTAKAVEWDAAWSNNLDPSGRAALGVHASAYGNQVKAVEPEKIIPKMEVSPLGVAI

SEQ ID NO: 36429 - protein, 593 aa, Candida albicans
MPTIPVDKGDLFKLLGRSYTTEEFDELCFQFGIELDEDTTEDVKGTDERPQLKIEVPANRYDMLCIEGIAQALNEFLGNTSAPNYKLSPSKPEISLTIKESTYPIRQYAASAILRNVNLDERAYDSFIALQDKLHANLCRNRTLVAIGTHDLDSLTPPFTYEALAPKDIVFKPLNQTKEINGEELMEFYEKDKNIGKFLHIIKDSPVYPVMLDANRTVASLPPIINSDHSKITLNTKNVWIDVTGTDRTKTEIVINQLVAMFSRYCKEPFEIEPVQIISEHNNETRVCPNITPRTAKAEISYINSCVGLDYSGEEISKLLKKMSLDATPSTEERDILDVKIPITRSDILHQCDIMEDVAIGYGYDNLKKDQTLRSKVFSCCPLPVNKVADILRLASSQAGYLEVMPLTLSSHDENFAWLKQKDDGTKAVKLENPKTIEYQVVRTTLLPGILKTVKENRKHSLPIKVFECGDIVLKNPELERGAFNQRNWAALYVGKTSGFEMVQGLLGKIMQTMRTPWLENPSKDQRRGYWIEEDKENTTFFPGRGAKIYFRNADNAEAKAIGSIGVLHPEVMNNFDIPYAASSVEINAEVFL

SEQ ID NO: 36430 - protein, 107 aa, Oryza sativa (japonica cultivar-group)
TRPMKSIILGKYHYMLYILALAMQPRMLLTVDEDLKPLSVPVCVGQAVDVVGQAGRPKTITGFQTHSTPVLLAAGERAELATEKYLPLTPVLEGFVILRNNPEYHED

SEQ ID NO: 36431 - protein, 552 aa, Synechococcus sp. RS9916
MSSTATAEPIQRQVRLETPFSDQKPGTSGLRKSSEQFEQPNYLESFVEAIFRTLPGVQGGTLVLGGDGRYGNRRAIDVILRMAAAHGVSKVITTTGGILSTPAASNLIRSRKAIGGIILSASHNPGGPNGDFGVKVNGANGGPTPASFTDAVYECTKTLEQYSIVEAPTIDLDAPSNHGIGAMVVEVIDGVDDFVELMQELFDFESIRDLIRSDFPLAFDAMHAVTGPYATRLFEELLGAPAGSVRNGIPLEDFGKGHPDPNLTYAHDLAELLLEGDDYRFGAACDGDGDRNMILGQRCFVNPSDSLAVLTANATLAPAYADGLSGVARSMPTSAAVDVVAKELGIECFETPTGWKFFGNLLDAGRITLCGEESFGTGSNHVREKDGLWAVLFWLQILAKRRCSVAEIMDEHWKRFGRHYYSRHDYEAVASEAAHGLYDRLEGMLPDLIGQAFAGRQIANADNFSYVDPIDSSVTKGQGLRILLDDGSRVVVRLSGTGTKGATIRIYLESYVPSSGDLAMDPQVALADMISAINQLAEIEQRTGMDRPTVIT

SEQ ID NO: 36432 - protein, 476 aa, Robiginitalea biformata HTCC2501
MSKFELKLPQMGESVAEATLTSWLKEVGDAIEADEAVFEIATDKVDSEVPSEVDGVLVEKRFEVDDVVKVGQVVAVIELNGESDQPDAGREAAGSPDAEASPGSSDTPGKQAAAKESSGQAEAAAAFVEQGEKTARPAPAPVSHGDRFYSPLVRNMAREEGIGQEELDRIPGTGKEGRVTKSDMLAYLESRGQEGAVRSESEPREAAATEAAGPAMAAAPEKGQAPKPAAAATGSPVSISEGDEVIPMSRMGKLIAKHMAESVSTSAHVQSFVEVDVTRIVEWRDRVKADFEKREGEKLTFTPIFMEAVAKALKKFPMMNISVDGDRVIKKKQINLGMAAALPDGNLIVPVIRNADQLNLVGMARAVNDLATRARNNALKPDEVRDGTYTVTNVGSFGSVFGTPIINQPQVGILALGAIRKVPAVIETPSGDFIGIRSKMFLSHSYDHRVVNGALGGLFVKAVADYLEAWDTERDV

SEQ ID NO: 36433 - protein, 434 aa, Pseudomonas syringae pv. syringae B728a
MNSKVDETPHLLRQRDQFVPRGIVTAHPLVIDRAQGSELWDVDGKRYLDFVGGIGVLNIGHNHPNVVKAIQAQLTKVTHACFQVASYQPYLDLAKRLSHLIAGQSGIDHKAVLFTSGAEAVENAVKIARAHTNRPAIISFRGGFHGRTLLGTTLTGMSQPYKQNFGPMAPEVFHTPYPNEYRGVTTDVALAALHELLATQVAPERVAAILIEPMQGDGGFLTAPVEFMKALRALTEQHGIVLIADEIQSGFGRTGKWFGFEHSGIQPDLVTVAKSLAGGMPLSGVVGRAEIMDAPLPGGLGGTYGGNALSCAAALAVIDTYEQENLLARGEQLGNQLRAGLLKLKERYSCIGDVRGTGFMLAMEMVKNDAARSPDADLNQKVIDQARLGGLLVIKCGVYRNVLRFLAPLVTTEQQIDEALGILDAALARVLKSS

SEQ ID NO: 36434 - protein, 485 aa, Pseudomonas syringae pv. syringae B728a
MLKNQLKDPSLLVDRAYVDGQWISADDGATLTISNPATGEALAQVPALQGVETRRAIEAADRAWPAWRARPAAERAALLERWHQAMLDNVEDLALIMTFEQGKPLNESRGEIRYGASFVKWFAEEARRSYGETIPAPSADRRLMTLKQPVGVCAAITPWNFPNAMITRKCAPALAAGCPIIVKPSDLTPLSALALALLAERVGIPAGVFNVITGMPTGIGEELTGNPVVRKISFTGSTPVGRLLMRQSAEHIKRLSLELGGNAPFIVFDDADLEQAVTGIMLSKFRNAGQTCVCANRILVQNGIYDRFAARLVEEVSKLKVGNGLEEGVTIGPLINPAAVSKVARHIDDALSQGAKLLHGGSPDGTSQFVQPTVLGDTHAGMLLANEETFGPVAPLMRFTDEAEALALANATPYGLGAYYFTQDLRRSWRFGEALEFGMVGLNTGIISMEVAPFGGVKQSGLGREGSSYGLDEYLEVKAFHVGGL

SEQ ID NO: 36435 - protein, 785 aa, Schizosaccharomyces pombe 972h-
MIGSINESPIEEHMNDSPSTKEKADSVDISDYIVSHSDDSLSKDIKKDTKSFLDVEHGEISTVDEFEEDSPYPEVRAAVPPTDDPSMPCNTIRMWTIGLIYSTVGAAVNMFFSLRNPTVTLSVLISELLAYPALQIWDLIFPDREFRIGRLKFNFKPGPFNVKEHALIVVMSSVSFGNAYSTDIILAQRVHYKQRFGFGYEICLTLATQLIGYGLAGLSRRLLVRPASMLWPVNLVQCTLIKTLHRKDLRNAVANGWRISPFRFFLYVFIASFIWNWFPSYIFQALSLFAWVTWIRPNSPTVNQIFGESTGISILPMTFDWNQISAYILSPLMAPADALMNILLGVILFFWIVTPALNFTNTWYGDYLPISSSGIIDHFGNSYNVTRILTKDATFDLDAYQNYSPIFMSTTYALAFGLSFASITSVIFHVILYHGKEIYDRLRDPPAPDIHEKLMKAYDEVPFYWYLSVFLAFFGMMMGTIYGWKTETPWWVIIVGVIFSAVWFIPIGIVQAITNIQLGLNVFTEFIVGYMYPGRPLAMMIFKTVGYITMTQGLAFAADLKFGHYMKLPPRIMFYTQMIATIWSCFVQIGVLDWALGNIDNVCQADQPDNYTCPNATVFFNSSVIWGVIGPKRMFSGKNTYTGLQYFWLAGVLGTILFWALWKKWPQKWWGQLNGPLIFGGTGYIPPATPVNYLAWSGIGLFFNYYLKKIFADWWQKYNFTLSAALDTGTQLSVIILFFCLQLPMVNFPDWWGNDGAFNTLDATGAAVRKLVNESAGEFFGPAEW

SEQ ID NO: 36436 - protein, 211 aa, Staphylococcus epidermidis ATCC 12228
MYKAVVFDFDGTVIDTEKHLFDLINTHLKIHQVAPISLEFYKQFIGGEATELHTYLEDAIGFKNKEKIYDQYYQTSVELPVNSTIIQLMQYLKKRHIPMAITTSSYKKNIYPIFKQLGLDTYIDVVVGRENVDSVQPNPEIYLKAVQELNYNPTTCLAIEDSVNGATAAMLAGLDVVVNTNIITKDQDFSTVQCVGQDMEFEDIKNSLFKE

SEQ ID NO: 36437 - protein, 483 aa, Pseudomonas aeruginosa
MNTKLFINNVWINSSDQQTFERKHPVSGEVMTECANSTVMDALKAAQAAQEAFQTWKTVGPSERRRLLLRVAEVMESKTPEFIEVMAKEVGASALWAGFNVQMSANVFREAASLATQIQGETIPTDKSDTLSMTLRQPVGPILSIVPWNGTAVLAARAIAYPLVCGNAVVFKGSEFSPATHALITQCVQEAGLPAGVLNYLNSSPDRSPEIADALISAKEIRRINFTGSTRVGSIIAQKAAQHLKRCLLELGGKSPLIVLDDADIDAAVKAAVFGSFLFQGQICMSTERLIVDEKIADEFVAKFVEKTKRLSAGDPCVTGDCIIGPMVSPNSGERINGLFKDAIDKGAKVVCGGLAQGALMPATILDHVKSDMRIYDEETFGPITVVIRCKGEAEAVRIANDSVYGLSSGVFGRDINRALRVGMSIEYGSVHINGSTVQNEAQAPYGGTKNTGYGRFDGRAVIDEFTEIKWLTIEPFEQQYPF

SEQ ID NO: 36438 - protein, 525 aa, Agrobacterium tumefaciens str. C58
MTQIAHPDSILIIDFGSQVTQLIARRIREAGVYCEIHPFQNAAEAFEKLQPKGVIFSGGPASVTAEGSPRAPQAVFDSKVPILGICYGQQTLCTQLGGVVEGGHAAEFGRADIDIKKASPLFEGFWEQGKSYPVWMSHGDRVTKLPEGFEVIATSENAPFAIAADEKRHYYTTMFHPEVVHTPDGGKLLSNFVHKIVGLKSDWTMAAYRAEMIRKIREQVGTGRVLCALSGGVDSSVAAILIHEAIGDQLTCVYVDHGLMRLGESEQVVGMFRDHYNIPLVHVDAADLFLGELSGVSDPEVKRKTIGRLFIEVFEAEAAKIAADGKGAPKFLAQGTLYPDVIESVSFSGGPSVTIKSHHNVGGLPERMNMQLVEPLRELFKDEVRALGRELGLPESFIGRHPFPGPGLAIRCPGAITREKLDILRKADAIYLDEIRKAGLYDTIWQAFAVLLPVQTVGVMGDYRTYDFVCALRAVTSVDGMTADFYPYDMNFLGRAATRIINEVRGINRVVYDVTSKPPGTIEWE

SEQ ID NO: 36439 - protein, 286 aa, Zea mays
  misc_feature (33)..(33): Xaa can be any naturally occurring amino acid
  misc_feature (52)..(52): Xaa can be any naturally occurring amino acid
  misc_feature (183)..(183): Xaa can be any naturally occurring amino acid
MAALPPAAEDPDAVEIREVWASNLEEEFAVIRXSVDVYPYVAMDTEFPGFVXRPSAEYRFTCDRNYAALEGNVNVLKLIQLGLTLSNGAGALPPCGTGGRRCIWQFNFRGFDPHTDPSSSDSIDLLRRSGIDFDLFAAEGVDSTRFAELMMSSGVVLNDDVQWVTFHSGHDFGYLLKLLTGRXMPNTLDEFLKLTKTFFPVMYDIKHLMKFCGGGLYGGLSKLGELLKIERVGISHQAGSDSLLTLQCFMKLKQLYLKESVKLYDGVLFGLIPGEVEIKPVAPPIE

SEQ ID NO: 36440 - protein, 123 aa, Zea mays
MVDPDPSTKFKVTAAKLSAIMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 36441 - protein, 250 aa, Solanum tuberosum
MACDEILKAVFPFLEGTELATCMLVCKQWRDIARDDYFWKCLCSKKWPSICKRSSPPTVTYYNLFQNFHRRPYRRTVLPPKLSFSDLEFYIDIWTEEKIIFSDVVPGPVLQKGIWIPPPGICDVLKFHLEGPEYKMTLPVEPRFTIPLCQTVSVSVLVGRKDTNKVACIIKKSLFDYIDRTAYRALAYDYLDFSSPMCLFVSGVRAWISLLFMDHGNEGALDVFGIEMDFCDAANSEDEVLWLLDMLEWK

SEQ ID NO: 36442 - protein, 429 aa, Agrobacterium tumefaciens str. C58
MRLGGRLAGAIEVLADIEGRRRPVADALKDWGLAHRFAGSGDRAAIGNIVYDALRMKLSHAWLMDDDSAASLAYAVLLRQWGKSFAELTAEFDGDKFAPAAPDAERQQAFLSRSLSDAPAYIQGDVPEWVQSSLETAFGERWLAEAQALNERPTLDLRANTLKATRDKVLKALEESGAEATRIARQGLRIPAGEGPSRLPNVTAELSFQKGWFEVQDEGSQIVADLAGAREGEQVLDYCAGGGGKTLAMAASMNNKGQVHAFDADRKRLAPIIERLKRAGTRNVQVHDRAAGLAPFQEKFDRVLVDAPCTGTGTWRRRPDTKWRLTARNLEERVQQQGEALSQAKGFVRPGGELLYVTCSVLPEENEQQVRRFCEENPEFAIGSALERWQSIFSGNANKPHSSDGKTVTLTPATTDTDGFFFCLMKRKA

SEQ ID NO: 36443 - protein, 439 aa, Mycobacterium avium subsp. paratuberculosis K-10
MHERSSHRPAGRGPPASRGPSPKLLQGIGFAVSRRTMMRRLSRRYGNVFTLRLPMWGPVVMVSDPQLAKQIFTTTPDELGNIQPNLSRLFGSGSVFGLEGDDHRRRRRLLAPPFHGKSMKNYESIIEEETLRETAGWPEGESFPTLPPMMRITLNAILRAVFGAEGAELDELRRLIPPWVTLGSRLAALPKPQRYPRFGPWGQLDRWRRHYDGVIERLIAAEQADPNFAERTDVLALLLRSTYDDGAAMSHKEIGDELLTLLAAGHETTASTLAWAFERISRHPELLARLVEEADNGGNELRQATILEVQRARTVIDFAGRHVYPDVYRLGEWVIPRGYSIIVGIAQIHDNPDVFPDPRRFDPQRFIDNKPSALSWIPFGGGTRRCVGAAFANMEMDVVLRTVLRHFTIETTDAPDEPWHCRGVAFTPKHGGRIVVHRR

SEQ ID NO: 36444 - protein, 297 aa, Salmonella enterica subsp. enterica serovar Typhi str. CT18
MAKALQGVMAALLTPFDHQQQLDSESLRRLVRFNIGQGIDGLYVGGSTGEAFVQSLAEREQVLEIVAEEAKGKITLIAHVGTVSTAESQQLASAAKRYGFDAVSAVTPFYYPFSFEEHCDHYRAIIDSADGLPMVVYNIPALSGVKLTLDQINTLVTLPGVNALKQTSGDLFQMEQIRRAHPDLVLYNGYDEIFASGLLAGADGGIGSTYNIMGWRYQGIVQALREGDVAKAQRLQTECNKVIDLLIKTGVFRGLKTVLHYMDVVSVPLCRKPFAPVDEKYLPALKALAQQLMEEKA

SEQ ID NO: 36445 - protein, 414 aa, Streptomyces coelicolor A3(2)
MTPAGSELRRTLGLGDAAVVGLGSMIGAGIFAALAPAAGAAGSGLLLALAGAAVVAYCNALSSARLAARYPASGGTYVYGRERLGEFWGYLAGWSFIVGKTASCAAMALTVGAYVWPEQAHTVAVAAVVALTAVNYGGIQKSAWLTRVIVAVVLAVLASVVVVCLGSGRSDAGRLDIGLSGGAGGVLQAAGLLFFAFAGYARIATLGEEVRDPRRTIPRAIPLALGLTLAVYGCVAVAVLSVLGPVGLGQATAPLADAVRTAGLPGLVPVVRAGAAVAALGSLLALILGVSRTTLAMARDRHLPQALAAVHPRFQVPHRAELAVGAVVAVLAATVDVRGAIGFSSFGVLVYYAVANASAWTLDPSRLSRVVPALGLIGCVVLAFSLPAVSVVVGVGVLAVGVVAYGVRGQQVPR

SEQ ID NO: 36446 - protein, 91 aa, Zea mays
  misc_feature (25)..(25): Xaa can be any naturally occurring amino acid
  misc_feature (30)..(30): Xaa can be any naturally occurring amino acid
GLKAYRKNDGSILILSHKKNAISIXNGAEXMCMPATTVEQLVDAVKQTVLANKSWVPQTGKGSLYIRPLIIVSSAVLGHALAPEYSFMISV

SEQ ID NO: 36447 - protein, 387 aa, Glycine max
HLQCQGVGGDALPSYMRGAVYWEPNKPLTIEEFNMPRPKAGEVLIKTKACGVCHSDLHVMKGEIPFSSPCVVGHEITGEVVEHGALTDSKTIERLPVGSRVVGAFIMPCGNCSYCSKGHDDLCEAFFAYNRAKGTLYDGETRLFFRNSGKPAFMYSMGGLAEYCVVPANGVSVLPDSLPYTESAILGCAVFTAYGAMAHAAQVRPGDSVAVIGTGGVGSSCLQIARAFGASDIIAVDVRDEKLQKAKTFGATHTVNSAKEDPIEKILEITGGKGVDVAVEALGKPQTFAQCTQSVKDGGKAVMIGLAQAGSLGEVDINRLVRRKIQVIGSYGGRARQDLPKLIRLAETGIFNLGHAVSRTYTFDEAGKAFQDLNEGKIVGRAVIEII

SEQ ID NO: 36448 - protein, 481 aa, Yarrowia lipolytica CLIB122
MSQAPVLSTEPEFETVAPLVRETPSNDYLNKYYCLPQLTEYLNSHEYKSIALQFPANDVADSALVVRLLKQTVDPSISLFILADTNYSPCCVDVVGANHIKADLVVHFGSACLNPVTMPVVYVFCNPEIDVKVMVDQLTEQIKDAEQPNILLDSDSKYYPEMPTMFKALREAFPDKIIVRSFIPNPQETLGLSEEETKPDAEEGYLYRRTHDDLDPQETMLIYVGTPSSSLALHYSTRFGATAYFNPVSGQAETPKTAIMKRYRYMNMARAAQTIGILINSLSMSETKEMSKKLQKAIAESGKKSYTFVVGKPNVAKLANFEVVDVWAVFGCGIGGIILENEEQYFKPVVSVYELGLALQPELSWTGEWEIDSNKVDLNVEVDEDEVDEPFFNPVTGKFIDHKPLHVQEYSDDEETQALVKSIGGSLTIKNTVTTAAIQLQQREWQGLGHDYGSGEEDGADLEEGRGGIARGYAVGDDERM

SEQ ID NO: 36449 - protein, 436 aa, Robiginitalea biformata HTCC2501
MKSLDHIPVTKMERAGKLVQTGVKLGGNYMKYYGKKLVKPSTDRSQLDEDNARDVYDGLKSLKGSALKVAQMLSMEKNLLPRAYVERFSLAQFSVPPLSAPLVRKTFRTYFGAYPEELYDRFEPESVNAASIGQVHRASKDGKALAVKIQYPGVSESISSDLALVKPIAMRMFNLSGKDSDKYFREVEDKLLEETDYLLELEQSRSITNACSHLPGLRFPEYYPQWSSRRILTMDWMVGEHLGDFTKKSFPSETGDRLGQALWDFYMFQIHGLRKVHADPHPGNFLVGEDGSLIAIDFGCIKEIPESFYNPYFELAERENIENDAILTAKLQELEILTPSDSPEELTYFKALFREMLELFTSPFNEEVFDFSSTEFWGQIADLSQRYSQDTQIRKMNANRGSRHFLYINRTFFGLYNLLHDLKARVRVNNYQEYLD

SEQ ID NO: 36450 - protein, 311 aa, Oryza sativa (indica cultivar-group)
MDSSNQKFIDLLNQDSPNHAEKPSHNSPPQQFPNNFPQSQFTQSFNPHFLHNFYPFRSPSNYPPYGHSPPSFQGTPPSFQGIPHQGNWAQPNLASLQGFHLQENMVHSPNQGFGIANHEAIFALQHPSVRATAKSSSHGSESSTPCPARQQEAPVNLESSSESSEDEVRRATRTNWTEEENLRLISAWLSNSVDPIDGNDKKGEYYWKDVADEFNNNRPTNGHKRTVKQLKTHWGNVKKDIGKFCGVYAQVRRTCTSGHSDDMIMEKAHLWYKNQLNQKKPFTLEYMWRELKDQPKWRSIIKKGRKQEQED

SEQ ID NO: 36451 - protein, 173 aa, Yarrowia lipolytica CLIB122
MADERSKLEQAGEGTNFSSDEIDRLRKRFMKLDTDASGILETNEFLSLPGVAANPLASRLMDVFDENHSGDVDFQEFINGLSTFSTKGNKKEKLRFAFKVYDIDRDGYISNGELFIVLKMMVGNNLKDAQLQQIVDKTIMEADKDGDGKISFEEFEAQVGGTNVYQSMTLDLF

SEQ ID NO: 36452 - protein, 837 aa, Arabidopsis thaliana
MLRRLGWLIGLSQRSRQTKSIDAEPYVARVKPVLMIDTVQEIAIYIHRFHNLDLFQQGWYQIKISMRWEDGDNNSCGIPSRVVQYEALDSTSNDSYGVWKIDDKDSSFLTQPFRIKYARQDVRLCMMVSFTMPLERYEGSATSAVILKFELLYSPIMEDIPVTHSDACAAAVHEFRIPPKALSGVHSYCPVHFDTFHAVLIDVSVHVSVMKSAAYKRPAILSSDASNGKNLTSGNIQSSKKAFTQIASADKKLVSFVKALLGARDTLLEEMQRLSKAVGQTVDLSEFVSSMDNALLSDSGSTGKSVEVEGSGQGKLQNNLEKLNGPFDLASDDWLHNFSKEHLSRTFHLLGTQLHYLWNTFLTLHRDNYTKILEYLRDIWTKDRRAEWSIWMVYSKVEMPHHFISGMEDISNHSSHKRVSTGLKLNDPAQVASTRAELHRRSIAQMRINNRAIQDMHIFGDPMRVPIVIIERVWNAPRRTFSDNSYMRHVDRIDSSLLNGHDDESGTKKHINPQHTGRELKIVVFVHGFQASIFLMFSECGHHLDLRLIRNQWLLIDPKIEFLMSEANEERTHGDFREMGQRLAQEVVSFFKRKKDKHARYGRLKNIKLSFVGHSIGNVIIRAAIADSLMDPYRKYFHTYISLSGPHLGYLYSSNSLFNSGLWLLKKLKSTQVIHQLTLTDDPDLQNTFFYKLCKVEKDVNISSRSCTIVTNRPLFFGSEMLVLKLFSAKDVVQFQEYNSPVFASARIESCQPASFDNSKRGVAFLEMLNNCMDQIRGPSPETPHHQRVFMRCDVNFDTTLYGRNLNSFIGRAAHIEFLESDVFARFIMWSFQDLFR

SEQ ID NO: 36453 - protein, 891 aa, Oryza sativa (japonica cultivar-group)
MPPRKDPNGGAFPSEPAPPQPAKAKGKKKDENKDDDLSEEDQALKEQLELYVVRAQDPDPGVQKLALESMRQEIRSATSSMTSVPKPLKFLRPHYGILKAYFETMPESELKKYMADILSVLALTMSAEGERESLKYRMIGSEGDIGSWGHEYVRNLAGEIAQEFQKRQDDGMTTDSLKELVEQIVSFHMKHNAEPEAVDLLMEVEKLDLLVKHVDSTNYKRTCLYLTSSSKYLPAPDDMSALKIAFEIYMKFGDFANALRIALLLDDKSLELKQIFTATDDFHLKKQFAFIIARHGLSTDIDDDIAADENEKEALQDIISNIKLSEGYLTLARDIEVMEPKSPEDIYKVHLIDGRGATSSSLDSARQNLAATFVNAFVNAGFGQDKLMTAPSDSSGSGSSGNWLFKNKEHGKASAAASLGMILLWDSDSGLAQLDKYLHSNDIHVVAGALLGIGIVSCGVKSDCDPAFALISEYFSRDESIIRIGAILGLGIAYAGSQKEEVRENLTAFLSDSQVPLEVLVFAAISLGLVFVGSCNEEIAQTIICVLMEHSEPELAEPIIRLLPVALGLLYLGKQESVEATAEVSKTFDEKIRNYCDVTLMSLAYAGTGNVLKVQKLLGICSEHLEKGETHQGPAVLGISLISMAEELGAEMAVRSLERLLQYGEQNIRRAVPLALGLLCISNPKVNVMDTMSRLSHDADAEVSMAAIISLGLIGAGTNNARIAGMLRNLSSYYYKEAGHLFCVRIAQGLVHLGKGLLTLSPYHSDRFLLSPIALAGLVTVLHACLDMKSIILGKYHYMLYILALAMQPRMLLTVDEDLKPLSVPVCVGQAVDVVGQAGRPKTITGFQTHSTPVLLAAGERAELATEKYLPLTPVLEGFVILRNNPEYHED

SEQ ID NO: 36454 - protein, 874 aa, Silicibacter pomeroyi DSS-3
MLPVRTWCLRRLQTPLFCTQTRGAAVQNNPNTTLITSTAPVATSTHGGRAKCLQRLVRLDLPVPRTVALSFGAVHDIAQGQLPDIAAIVSQFDPTALLCVRPSSEDPDWGGPGAVLNIGMNDARFVELSDRMGAEAAAALYLRFVQTFAIHVARLDPDVFDEIEADGREGLRQSLRAYEDETDESFPQDPGEQLAAVLRSMARAWEGTSARLLRQAKGAPADAGLGLVVQEMIPGLGQGECGSGVLQLVEPATGLPQITGRYLSQSQGRDALGAGAEALYLEKDPRGISLEDVAPEAFAALKQHAALMREKLREEMQVEFVIESGRVHILDGVRVPRSARAALRIAVRLAEDGIIPQQEAVMRIDPHSVNELLHRQVHPQARRDVLTTGIAASPGAATGKIVFTAAEAQASAARGEPCVLVRRETSPEDVRGMHAAVAVLTERGGMTSHAAVIGRGLGLPCIVGASDMEFQTKARQIKAPDGRVFRTGDILTIDGSTGQVLAGQPEMIDAALDDSFQTLMAWADAERDIGIRANADTPADAQAARNFDAQGIGLCRTEHMFFEPGRLTVMREMIFAATPSGRKAVLERLLPMQRQDFVQLFRIMEGKPVCIRLFDPPLHEFLPTTRSGQRELAEALDLPVSDVTRRVEAMSEYNPMLGLRGVRLGVTVPEIYDMQARAIFEATLEASRKGEPVVPEVMIPLVSAKREVELVKARIDAVASAVASERGQEFDYRLGVMVETPRACLRADEIAACVSFLSFGTNDLTQMTYGLSRDDAGRFMSAYVRQGVFSEDPFHVLDRDGVGELLKLGVERGRRGQPGVTVSVCGEHGGNPESIAFCRAAGFDYVSCSPFRVPVARLAAAQLAISDKLGISSD

SEQ ID NO: 36455 - protein, 330 aa, Magnaporthe grisea 70-15
MDGKRHLNSFQQLEKLGEGTYATVFKGRNRHTGELVALKEIHLDSEEGTPSTAIREISLMKELKHENIVGLHDVIHTENKLMLVFEHMDGDLKKYMDTKGDRGALQPMVIKSFMYQLLKGIDFCHQNRVLHRDLKPQNLLINNKGALKLGDFGLARAFGIPVNTFSNEVVTLWYRAPDVLLGSRTYNTSIDIWSAGCIMAEMFTGRPLFPGTTNEDQIVRIFRIMGTPSERTWPGFSQFPEYKKTFHTYATQDLRNILPQIDATGIDLLGRMLQLRPEMRISAHDALKHPWFNDILMQQHQQQHAIQAQAQAHQARTQSGSTDTFAGAAV

SEQ ID NO: 36456 - protein, 386 aa, Haemophilus influenzae R2866
MSVIKMTDLDLVGKRVFIRADLNVPVKDGKVTSDARIRATIPTLKLALEKGAKVMVTSHLGRPTEGEFKPEDSLQPVVDYLKNAGFNVRLEQDYLNGVEVKEGEIVVLENVRVNKGEKKNDPELGKKYAALCDVFVMDAFGTAHRAQASTYGVAEFAPIACAGPLLAAELDALGKALKEPARPMVAIVGGSKVSTKLEVLNSLSKIADQIIVGGGIANTFIAAAGHNVGKSLYEADLMPVAKELAANTDIPVPVDVRVGLEFSETAAATEKAVNEVKDDESIFDIGDKSAEQLAEIIKNAKTVLWNGPVGVFEFPHFRKGTEIISHAIANSDAFSIAGGGDTLAAIDLFGIADKISYISTGGGAFLEFVEGKVLPAVEILEKRAKN

SEQ ID NO: 36457 - protein, 133 aa, Streptomyces avermitilis MA-4680
MTSTPQPSRPSSLDAEIAARLKRSADGLVPAIAQQYDTGEVLMLGWMDDEALHRTLTTGRCTYWSRSRGEYWVKGDTSGHVQYVKSVALDCDADTVLVKVDQVGAACHTGAHTCFDADVLLKDGDSGVPAADQ

SEQ ID NO: 36458 - protein, 470 aa, Zea mays
MSCWAAGRRSSASAMAENAGARGAKEAVVTSGKRVALGNISNVFRGSWGSGAANSASDAKLSSTKPDDVKKGSYACLRNVNTERGSSRRLASEQFDQAVSLLQKNTSLPSVPDVVSTGCSSPGLSQDCSVSMEDAMSTCNSTESSDVEYLNNNDDPSMTSSSHWWASDRPHFSDSMDVAEFNWRKHSPNHYTYKDPRLSTTLACEIYESLREAETRKMPPTNFLETTQTDMSKTMRAILIDWLVEVTEEYRLVPETLYLTVNYIDRYLSVKEISRHRLQLVGVACLLIAAKYEEICPPLVEELCYITDYSYTKEEVLQMEASVLNNLKFEMTVPTAKCFLRRFVRVAQVPDKGSSLHLEFLVNYICELSLLEYSLLCYLPSMVAASSVFLAKFILMPIKNPWNSSLSYYTRYTPSELRGCVRVLHRLFRLGPGSNLPAIREKYSQHKYKFVAKKYCPQSIPTKFFQDLTS

SEQ ID NO: 36459 - protein, 164 aa, Coccidioides immitis RS
MSSTATSKITLTSSDGVEMSMERQVAERSVLIKNMLEDLGDSGEPIPIPNVNESVLRKVVEWCEHHKNDPPSTGDDDNDSRRKTTDIDEWDQKFMQVDQEMLFEIILAANYLDIKALLDVGCKTVANMIKGKSPEEIRKTFNIQNDFTPEEEDQIRRENEWAEE

SEQ ID NO: 36460 - protein, 319 aa, Bacillus halodurans C-125
MNRGVICLGEALIDFIPMDSTNEIYQKSPGGAPANVAVGLAKLGAKSTFVGKVGDDLLGRFLKETLTKANVNTEHMLFSKEVRTGATFVTLAANGERSFDFYINPSADRFLEKGEIAPTLFEEHGVLHFGSISLISEPARTATRHAVSLAKKNGLMISYDPNLRLNLWEDEEQARLLITSMLGEADVLKISEEELAFITGEQTIEAGLDQLVAYNIPLVFVTLGEKGSIVSYNGIQRKIPAMAVQTVDTTGAGDAFVSAILFKLQEERKQVAELSIKEVEQMARFASVSGGLAAATKGAMTALPTLEKVNDILRNEQME

SEQ ID NO: 36461 - protein, 1119 aa, Cuscuta pentagona
MSSSRPSQSSSNSARSKHSARIIAQTSIDAKLHAEFEESGDSFDYSSSIRVTSVNTGEQKPRSDKVTTAYLHQIQKAKFIQPFGCLLALDEKTFRVIAFSENAPDMLTMVSHAVPSVGDLPVLGIGTDIRTIFTAPSGAALQKALGFGEVSLLNPILVHCKTSGKPFYAIVHRVTGSLIVDFEPVKPYEAPMTAAGALQSYKLAAKAIARLQSLPSGSLERFCDTIVQEVFELTGYDRVMAYKFHDDDHGEVVSEITKPGLEPYLGLHYPATDIPQAARFLFMKNKVRMICDCQAKHVKVVQDEKLLFDLTLCGSTLRAPHTCHLQYMENMNSIASLVMAIVVNDGDDEEEEERSGSGKRKRLWGLVVCHNTTPRFVPFPLRYACEFLAQVFAIHVNKELELENQIVEKNILRTQTLLCDILLRDAVLGIVSQSQSPNMMDLVKCDGAVLLYKSKIHRLGITPTDFQLQDIVYRLNEHHMDSTGLSTDSLYDAGFPGALSLGLCGMASVRISEKDWLFWFRSHTASEVRWGGVKHEPDDGRKMHPRSSFKAFLEVVETRSLPWKDYEMDGIHSLQLIMRNAFFNEADTVATNVIHAKLNDLRIDGLQELEAVTSEMVRLIETAMVPIIAVGVDGLVNGWNTKIAELTGLSVDEAIGNHLLTLVEDSSVHTVKKMLNLALQGEEEKNVQFEIMTHGIRSECGPISLVVNACASRDVQESVVGVCFIAQDITGQKTVMDKFTRIEGDYRAIIQNPNPLIPPIFGTDEFGWCSEWNSAMTKLSGWRRDEVIDKMVLGEVFGTQKACCRLKSHEAFVTLGVVLNNAITGHESDKTVFGFCTRNGKYVECLLSVTKRLNQDGAVIGLFCFLQLASQELQQALHFQKLSEQTATKRLKVLAYLRKQVKNPLSGIMFSRKMLEGTELGNDQQNILHTSAQCQQQLSKVLDDTDLDCIIEGYLDLEMVEFKLDEVLLASISQVMTKSNGKSLRVINDVAENVLCETLYGDSLRLQQVLAEFLSVAVNFTPSGGQLAVSSSLTKDHLGQSVQLAHLEFRVTHSGGGVPEELLTQMFGSDVDALEEGISLLVSRNLVKLMNGDVQYHREAGRSAFIISVELAVATKPRA

SEQ ID NO: 36462 - protein, 293 aa, Staphylococcus epidermidis ATCC 12228
MSAQDPRNKFKTDNYEKQEQEVPGIQAKMSPQPDCGEDSYHGHHRLDGFKILVTGGDSAIGRAAAIAYAKEGADVAINYLPSEQQDADDVKQIIENVGQKAILIPGDIRDEQFNYDMVEKAYQQLGGLDNVTLVAGHQLYQDELSEFKTQDFTETFETNVYPVFWTVQKALEYLQPGGSITTTSSVQGYNPSPILHDYAATKAAIISLTKSFSAELGPKGIRVNCVAPGPFWSPLQIVGGQPQSAIPTFGQNTPLGRAGQPVECAGTYVLLASDDASYITGQVYGVTGGTQID

SEQ ID NO: 36463 - protein, 418 aa, Coccidioides immitis RS
MVIYEQGPPLVFRHLPGCMNNGHVRGGLGALRGNLPGLLRVKGCREFLSVLLQDLKQQKFTIEAEPSETIGQLKEKISQEKGWDAAQQKLIYSGKILQDVNTIESYNIEEKGFIVCMVSKPKAQPAPSTPAGPSQTPATPAAPSSTPAAPSAPAPATNAPSAPPATPSPATAGATFNDPSALLMGPQSETAVQQMEAMGFARDDIQRAMRAAFFNPDRAIEYLLSGIPDHAEQEAARQQARATAPSNAAAPASTQPAANTESEEPVNLFEAAAQAAQGGGGARGTRGGATTGEGLNNLEFLRNNPHFQQLRQLVQQQPQMLEPILQQVGAGNPQLAQLIGQNQEQFLQLLSEDIDDDAQLPPGAHAISVTEEERDAIERLCRLGFSRDAVIQAYFACDKNEELAANFLFEQPEDEGDN

SEQ ID NO: 36464 - protein, 335 aa, Capsicum chinense
MVHEKQVIDEVSGWLRVFDDGSVDRTWTGPPEVKFMSEPVKPHDDFIDGIAVKDVVADDKSGSRLRIYLPEQNGGSVDKLPVVVHFHGGGFCISQADWFMYYTVYTRLARVANAIIVSVFLPLAPEHSLPAACDSGFAALLYLRDLSRQKINEPWLSNFADFNRVFLIGDSSGGNIVHHVAARAGEEDLSPMKLAGAIPIHPGFVRSKRSKSELEQEQTPFLTLDMVDKFLGFALPMGSNKDHPITCPMGDAAPAVEELKLPPYLYCVADKDLIKDTEMEFYEALKKAKKDVELCISYGVGHSFYLNKIAVEMDPVTGSATEKLFEAIAEFINKH

SEQ ID NO: 36465 - protein, 230 aa, Staphylococcus epidermidis ATCC 12228
MKDAKELKLMTLEDVLSQIENGMTIGIGTGSTIELLIPQIAELIQQKNYTITGVCTSNKTAFLAKELAMNIVDVNDVEKIDLAIDGADEVDSALNLIKGGGGALFREKVIDEMADRFVVVVDESKLVNYLGETFALPVEVDKFNWYQVAKKIERTYDIHVSRRVNEDVPFITDNGNYILDCSLQNRIPAYELHEFLIHLTGVLETGYFLDIADQVIVGTQEGVKILNKET

SEQ ID NO: 36466 - protein, 370 aa, Arabidopsis thaliana
MAENQNCARMTRAAAKRKASSMALDENPVSKKRVVLGELPNMSNVVAVPNQERETLKAKTSVNTSKRQMKKALMIPEASVLIESRSVDPQMCEPFASDICAYLREMEGKPKHRPLPDYIEKVQSDLTPHMRAVLVDWLVEVAEEYKLVSDTLYLTISYVDRFLSVKPINRQKLQLVGVSAMLIASRKYEEIGPPKVEDFCYITDNTFTKQEVVSMEADILLALQFELGSPTIKTFLRRFTRVAQEDFKDSQLQIEFLCCYLSELSMLDYTCVKYLPSLLSASAVFLARFIIRPKQHPWNQMLEEYTKYKAADLQVCVGIIHDLYLSRRGNTLEAVRNKYKQHKYKCVATMPVSPELPLAFFEDITIRGMA

SEQ ID NO: 36467 - protein, 491 aa, Zinnia elegans
  misc_feature (44)..(44): Xaa can be any naturally occurring amino acid
  misc_feature (49)..(49): Xaa can be any naturally occurring amino acid
  misc_feature (465)..(465): Xaa can be any naturally occurring amino acid
  misc_feature (475)..(475): Xaa can be any naturally occurring amino acid
DYLLLSLLSTVTFFFLLLHLATTSSRRKTRLPPGTVGLPFIGEXLQLIXAYKTQNPEPFIDSRVAKYGTLFTTHVFGERTVFSADPETNRFILQNEGRLFESSYPGSILNLVGKHSLSFMRGSLHKRMHSLTMSFANSTIIKDHLLVDIDRLVRLNLDSWTGRVLLLEEAKKITFELTLKQLLSIEPCEWTENLRKIYMLVIEGFFCIPIPMFSITYRRAIKARERVAEELSLVVRERRRESEKGMKKNDMLAALFDGGGDVGGVGLTDAEIVDFLVSLLVAGYDTTSTTMTLAVKFLTDTPRALAQLKEEQDEIRARKTDAGTIEWEDYKSMPFTQCVINETLRVSNIISGVFRRAMTDVDIKGYRIPRGSKVFTSLRAVHLGHENFNDARVFDLWRWQKSSNPTNFMPFGGGPRKCPGNELARVALSVFLHHLVTRFSWEPAEEDKLMFFPTTRTQKRYPIIXESSVVMQSSXVKDTKRKTQVGRRILS

SEQ ID NO: 36468 - protein, 119 aa, Pediococcus pentosaceus ATCC 25745
MNLLIDKITKDQLRSDIPEFRAGDTVRVHAKVVEGDHERIQLFEGVVIKRHGSGISATYTVRKISNGVGVERTFPLHSPRVAKIEVIRHGRVRRAKLYYLRALHGKAARIKEDRRKAFK

SEQ ID NO: 36469 - protein, 151 aa, Oryza sativa
MRASSLFAESVFTTSAAAGRRRCPRLAAVPVTLFFSTGRGSPAMAEEAQQPRGVKVGGIHDAPAGRENDLTTVELARFAVAEHNSKANAMLELERVVKVRQQVVGGFMHYLTVEVKEPGGANKLYEAKVWERAWENFKQLQDFKPLDDATA

SEQ ID NO: 36470 - protein, 540 aa, Francisella tularensis subsp. holarctica
MLFCDDSKKYLKEQNINLKNEFDKDDKRVEKFSLKHQNIYFDYSKNLINNYILKSLLESAEKSSLKDKIKQMFNGAKINSTEHRAVLHTALRDLSSTPLIVDGQDIRQEVTKEKQRVKELVEKVVSGRWRGFSGKKITDIVNIGIGGSDLGPKMVVRALQPYHCTDLKVHFVSNVDADSLLQALHVVDPETTLFIIASKSFSTEETLLNSISAREWLLDHYEDEKAVANHFVAISSKLDKVKEFGIDLEHCYKMWDWVGGRYSLWSSIGMSIAFAIGYDNFEKLLAGAYSVDKYFKETEFSKNIPVIMALLASYYSCTYNSQSQALLPYDERLCYFVDYLQQADMESNGKSVNIAGGTVNYQTGVVLWGGVGTNGQHAFHQLLHQGNIFIPVDFIAIATSHHNYDNHQQALLANCFAQSQALMFGQSYDMVYNELLKSGLNETQAKKLAAHKVIPGNRPSTTILLDELSPYSLGALIALYEHKIFVQGVLWDINSYDQWGVELGKKLGKNILKAMNDDSSDEYQNLDDSTRQLIAKVKNK

SEQ ID NO: 36471 - protein, 247 aa, marine gamma proteobacterium HTCC2143
MTSPVIELSRLIEQASRVVFFTGAGISTESGIPDFRSPGGIWSKIKPIQFQDFVADAEMRKESWRRKFEGSDGMARAKPNSGHLALAKLIGSGKASCVITQNVDNLHQNSGIPDDRVIELHGNATYGKCLDCGCHYDFAPLEIAFKQHGEVPPCEACSGLIKTATISFGQSMPALAMRRAEEATRDCDLFIAIGSSLLVYPAAGFPVLAKQQGAKLVILNREVTDVDEHADLVINDEIGSVLSQAIG

SEQ ID NO: 36472 - protein, 175 aa, Oryza sativa (japonica cultivar-group)
MKLRPKRPGWKSLMPLQLSRKSALRFFLFPKVQAAGQSPDDTPVYLNVYDLTPMNGYVYWAGLGIFHSGIEVHGVEYAFGAHDYPSSGVFEVEPRQCPGFRFRKSIFLGTTCLDPIQVRQFMELQSVNYNGDTYHLITKNCNHFCKDMCYKLTGNKIPKWVNRLARIGTIPLFNH

SEQ ID NO: 36473 - protein, 542 aa, Thermotoga maritima MSB8
MKPIKEIADQLELKDDILYPYGHYIAKIDHRFLKSLENHEDGKLILVTAVTPTPAGEGKTTTSIGLSMSLNRIGKKSIVTLREPSLGPTLGLKGGATGGGRSRVLPSDEINLHFTGDMHAVASAHNLLAAVLDSHIKHGNELKIDITRVFWKRTMDMNDRALRSIVIGLGGSANGFPREDSFIITAASEVMAILALSENMKDLKERLGKIIVALDADRKIVRISDLGIQGAMAVLLKDAINPNLVQTTEGTPALIHCGPFANIAHGTNSIIATKMAMKLSEYTVTEAGFGADLGAEKFIDFVSRVGGFYPNAAVLVATVRALKYHGGANLKNIHEENLEALKEGFKNLRVHVENLRKFNLPVVVALNRFSTDTEKEIAYVVKECEKLGVRVAVSEVFKKGSEGGVELAKAVAEAAKDVEPAYLYEMNDPVEKKIEILAKEIYRAGRVEFSDTAKNALKFIKKHGFDELPVIVAKTPKSISHDPSLRGAPEGYTFVVSDLFVSAGAGFVVALSGDINLMPGLPKKPNALNMDVDDSGNIVGVS

SEQ ID NO: 36474 - protein, 359 aa, Pseudomonas syringae pv. actinidiae
MVIDTAIISKAYDDLRAGFEFAKVYYAVKANPAVEVINLLKDKGSSFDIASIYELDKVMSCGVGPERMSYGNTIKKSKDIRYFYEKGVRLFATDSEADLRNIAKAAPGSKVYVRILTEGSTTADWPLSRKFGCQTDMAMDLLILARDLGLVPYGISFHVGSQQRDISVWDAAIAKVKVIFERLKEEDGIVLKLINMGGGFPANYITRTNSLETYAEEIIRFLKEDFGDDLPEIILEPGRSLISNAGILVSEVVLVARKSRTAVERWVYTDVGKFSGLIETMDEAIKFPIWTEKKGEMEEVVIAGPTCDSADIMYENYKYGLPLNLAIGDRMYWLSTGAYTTSYSAVEFNGFPPLKSFYL

SEQ ID NO: 36475 - protein, 355 aa, Acetobacterium psammolithicum
IGAANNLLAAMLDNHIKQGNELDIDAKRITWRRCMDMNDRQLRNIVDGLGGKGDGVVREDGFDITVASEVMAAFCLASDINDLKARMGRIIVAYNHAGVPVTVTAADLKANGAMAALLKDALKPNLVQTLEGTPAFIHGGPFANIAHGCNSLIATRMAMHFADYVVTEGGFGADLGAEKFLDIKCRMANLKPDAVIIVATVRALKYNGGVAKADLGEENLVALKAGLPNLLKHVENITQVFKLPAVVAINEFPLDTQAELDLVKEECKKLGVNVAISQVWAKGGEGGAELAKEVIRLIDESEGKFEYCYDLDIPIKEKIEAIATRIYGADGVDFAPAALKEMANLTALGFDKVPI

SEQ ID NO: 36476 - protein, 755 aa, Cryptococcus neoformans var. neoformans JEC21
MALRKLQAEIDRTLKSVATGVEVFEATFDKLNYATNTTQKDKLENDLKTQIKKLQRMRDQIKAWLGNGDIKDKTALLENRRLIETQMERFKALEKETKMKAFSKEGLIAQSKLDPAEKAKRDMIDWIGSTTDELSRQIEQTEAEVEALQVGKKKKQAGERLDELEELNERREWHIGRLEVVQRMLENGQLTVGDVEDIQEDVKYFVEANMEEDFDFDNGIYDELNLQDEEDFHDYLHEHPSATDELEPEPEPVVPTQAPKTPAKEKEDKKATPHRLSKSESREKEEEIPPSPVVVKKTPSRKTTLDKDKKDKKDKEKEDKERKERERDEKEREERSSSSQPTPSKPAPLPPIKYAAAAAAAVGGTVSASAPSQTTPSATSEGSRDDIVASPDEIAAAPTSTSFPPPPPGLSRSPSQAATPQTSSPGTPGLQSHAPSTSTGAADMATPSQAPGSAVPPPGYPAPPSSSSAESSRAAVQAQVAAEQAQAQAQAQAQAQAQALVQAQAQAQAQSQLSAAQIQAQLQAAQEVQGQAGVMGNLMQSFEVAKEICEYECFVCGCGWGCVFHYPPGWGKGKGKGRRKCPGPHPGSTKMDWERRAREGERGRSSLSKRRSDDTNELHAALEDSFANAPQQMDAEPPRYYHPQNPIKTPSYYPQSRLPILEDKSIYSRLELDQLFYIFYYMTGTYEQWLAARELKKQSWRFHKQYLTWFQRAHNPQAITSDYEQGGYYYFDWENSWCQRRKSDFRFEYRWLSDH

SEQ ID NO: 36477 - protein, 744 aa, Burkholderia vietnamiensis G4
MEDTGTAQHARSAVTDDVRAHANGHADTDTDAGPPGRPGAPALGLFALVIFGLAYMLPMTVFTTYGIVTRETNGHLTIAYAVTLVAMLLTARSYGHMVRLMPSAGSAYTFASHNFGTSAGFMVGWALLMDYLFIPMISYLAIGIYMKQLFPAVPASVWIVASIVLVTGLNIVGIRLVNRVNLILIASQLVFIAVFVAAAAHVAAGAGLEPALALPAYGDAHAIFAGSAILCLSFLGFDAVSTLSEETREPRRTVPLAILLCTLASGLLFMLIAYAGQVVFPDWHAFKDLDSASFELMRRIGGGALSALFVAVYVAGCFASAMAGQASVTRVLFAMGRDRVLPERVFGQLHARLHTPVRATLAVGAVHHARSRVDDDQLRRARRVRGREPVRDAQLPGAPGTPPRRRLDRVRRAAGARLRDERVAVVGPVAPDLLRRPRLARARALPAAMAHARLHAAGADAVDELNGRAARRRRFRNPEGGMTHERYRRRSRSGPAGARQAPSADALHARRCVSRPGADGVRPRRRLLARRPQRQALLRRARRVVLRAARLQPRRGNRRRDARADGAAAVRHQLGLRPRTGDPARAQAGDARAGRPEPRVLHLERLRVERVGDQAGAPVSPGARRAAAAQVHRAARRVSRHVVRRARIERDDQLPQAFRAADGGRAAREQHEALRAARRRDGSAVHAPSARRDRIADRAGRAGHRRRDRRRAAAERGRQPDAAGRLCARAARAVRPARRAARRR

SEQ ID NO: 36478 - protein, 471 aa, Solanum tuberosum
MVFYRSVSLLSKLRSRAVQQSNVSNSVRWLQVQTSSGLDLRSELVQELIPEQQDRLKKIKSDMKGSIGNITVDMVLGGMRGMTGLLWKPHYLDPDEGIRFRGLSIPECQKVLPAAKPGGEPLPEGLLWLLLTGKVPSKEQVNSIVSGIAESGIISLIIMYTTIDALPVTAHPMTQFATGVMALQVQSEFQKAYEKGIHKSKYWEPTYEDSMNLIAQVPLVAAYVYRRMYKNGDTIPKDESLDYGANFAHMLGFSSSEMHELLMRLYVTIHSDHEGGNVSAHTGHLVASALSDPYLSFAAALNGLAGPLHGLANQEVLLWIKSVVEECGENISKEQLKDYVWKTLNSGKVVPGFGHGVLRKTVPRYTCQREFAMKHLPEDPLFQLVSKLYEVFLLFLQNLAKLKPWPNVDAHSGVLLNYYGLTEARYYTVLFGVSRALGICSQLIWDRALGLPLERPKSVTMEWLENQCKKA

SEQ ID NO: 36479 - protein, 705 aa, Yarrowia lipolytica CLIB122
MGHYVTLATCNLNQWALDFEGNRDRILESIREAKRQGASLRVGPELEITGYGCLDHFLEGDLYLHSWEVYAEILEHPDTSDIILDIGMPVMHKNVKYNCRVISYNREILLIRPKLSLANDGNYREMRYFTPWPKARYVEDYTLPRFVQNVCANESAIVPFGDCVLSTKDAVIGFETCEELFTPQSPHIGMSLDGVEIFTNSSGSHHELRKLNTRMELIREATAKCGGIYLYANQRGCDGDRLYYDGCAVIAVNGEVVAQGSQFSLDDVEVVSATLDLEAVRSYRASKISQCMQAANSPCYARVTCKAELSPSSVTFDSEVYPTPTREIRYHSPEEEIALGPACWMWDYVRRCRAAGFFVPLSGGIDSCATATIVYSMCVLVADAANNGNEQVIKDARVVTGDPDFVPTDPKELCNRIFHTCFMGTENSSKDTRSRAKDLAAAIGAYHTDLNMDSVVSAVRGLFETVTGKRPIFKVHGGSATENLALQNIQARLRMVLAYLFAQLLPWCRGRAGGLLVLGSANVDETLRGYLTKYDCSSADINPIGGISKTDLKKFIAYAEHKFDLPILNDFLTAVPTAELEPITKDYVQSDEVDMGMTYDELSVFGRLRKVEKCGPYSMFIKLYHEWTPRLSAEQIAAKVKRFFWFYAVNRHKTTVLTPSYHAEQYSPDDNRFDLRPFLINPGFSWASKKIDAIVKSLETKKKED

SEQ ID NO: 36480 - protein, 319 aa, Oryza sativa (japonica cultivar-group)
MAASCALTLPSAISVSVSVSSNSPRRFRRSRRVVAMASVGQKVYAPGVAVSEGNGGLPKIDLKSPHGSEAEIYLFGACVTSWKVPSGKDLLFVRPDAVFNGQKPISGGIPHCFPQFGPGTMQQHGFARNMNWSITDSEANEGDPAVTLELKDDSYSRSMWDFSFQALYKVALHSTSLSTTLKITNTDDKPFSFNSALHSYFSASISGVSVKGLKGCKTLNKDPDPKNPLEGKEEREEVTFPGFVDCIYLGAPSELTLDNGLGDKIVISNANWSDAVLWNPHLQMEACYKDFVCVENAKIETLQLGPNQSWVAEQKIELI

SEQ ID NO: 36481 - protein, 412 aa, Escherichia coli K12
MADTRPERRFTRIDRLPPYVFNITAELKMAARRRGEDIIDFSMGNPDGATPPHIVEKLCTVAQRPDTHGYSTSRGIPRLRRAISRWYQDRYDVEIDPESEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKRYDVLVVHDLAYADIVYDGWKAPSIMQVPGARDVAVEFFTLSKSYNMAGWRIGFMVGNKTLVSALARIKSYHDYGTFTPLQVAAIAALEGDQQCVRDIAEQYKRRRDVLVKGLHEAGWMVEMPKASMYVWAKIPEPYAAMGSLEFAKKLLNEAKVCVSPGIGFGDYGDTHVRFALIENRDRIRQAIRGIKAMFRADGLLPASSKHIHENAE

SEQ ID NO: 36482 - protein, 92 aa, Pseudendoclonium akinetum
MKLHQIVKSIESDFFKKDLPVLNVGNIVNVNVLIQEANKKRLQSYQGTIISQHRAGLNSTITVRRISKGVGVARIFPIHSPDIDSIQLVSSK

SEQ ID NO: 36483 - protein, 434 aa, Pseudomonas aeruginosa PAO1
MNPRLAACQALAAVLAGRASLSGALPPQLDKVAPRDRGLTQELAFGAARWQPRLQALAARLLQKPFKAADTDIHALLLIGLYQLLYTRIPPHAAIGETVGCADKLKKGWAKGVLNAVLRRAQREGETLLAEVDRDPSARLGHPRWLLKALKQAWPEQLDALCAANNAHPPMTLRVNRRHGERDAYLAELAEAGIKARACDYSRDGIQLAAPRDVRELPGFAEGRVSVQDEAAQLAAEQLESAPGQRVLDACCAPGGKTCHLLETQPELAEVVAVDLEESRLVRVRENLQRLGLQASLVAADARATGEWWDGKPFQRILLDAPCSATGVIRRHPDIKLARKPEDIAALAHLQGELLDALWPTLEVGGVLLYATCSVMPAENSDSIAAFLARTPGARELDLPGPWGMKQPHGRQLLPQVEGHDGFYYAKLIKISAR

SEQ ID NO: 36484 - protein, 170 aa, Bacillus subtilis subsp. subtilis str. 168
MDLKQYVTIVPDYPKEGVQFKDITTLMDKGDVYRYATDQIVEYAKEKQIDLVVGPEARGFIIGCPVAYALGVGFAPVRKEGKLPREVIKVDYGLEYGKDVLTIHKDAIKPGQRVLITDDLLATGGTIEATIKLVEELGGVVAGIAFLIELSYLDGRNKLEDYDILTLMKY

SEQ ID NO: 36485 - protein, 203 aa, Capsicum chinense
STTILLALVLFIVSGVANAQQCGRQRGGALCGGNLCCSQFGWCGSTPEYCSPSQGCQSQCSGSGPTPEGSAQNVRATYHLYNPQNVGWDLNAVSAYCSTWDANKPLAWRSKYGWTAFCGPVGPRGQASCGKCLRVTNRRTRAQTTVRIVDQCSNGGLDLDINVFRQIDTDGVGNQQGHLMVDYQFVNCGDNVNVPLLSVVDTQ

SEQ ID NO: 36486 - protein, 99 aa, Crocosphaera watsonii WH 8501
MLLIFYPSSAIAQDISDGSKIFTIHCAGCHPNGKNIIRRGKNLKLKALKKNKVDTLDSIMNLVSYGKNNMSAYEERLTQNEIKAVSQYILDKAQNNWRN

SEQ ID NO: 36487 - protein, 429 aa, Magnaporthe grisea 70-15
MPTATSKHHHGRQYDIVVFGATGYTGVFTAEQVAATLPTDVNWAIAGRSQEKLQKIATDLKAKYPDRRQPAIEVCNLNDQDLTTLVKRTFVLLATVGPYSHYGEYAFKACAQNGTHYLDVTGELAWTSIMIKKYEDTAKATGAIMIPQIGFESAPADLITFALAKAVREELNAPTRDVRLSVDMTNPFPSGGTWLSVFAMLDLFSLKLMAELSKPFALSPVPQPSPPKDQVSLLTRLTGLRNFPLIGLVTTSLMGGANKPIVERTWGLQQTEPALRDYSYGPNFSYNEYNRAHGRLFGFAVHLVINVGLPLLTVLWPLRSLLRLLIPYKSGEGPSRETSARQKTTFRAIARPDMPPGSCDKMAFAKADFNGSMYHMTGICIARGAQTILEEYDSLQLKGGVYTPASLGQGFIDRVGEDGFEIKTKIVKS

SEQ ID NO: 36488 - protein, 271 aa, Zinnia elegans
MDDYLSLFVTETTWYNQIVLGTLLPEKLWTPLPHFLQTWLRNYIAGTLVYLISGFLWCFYIYHLKRNVYVPKDAIPTRKAMYLQIYVAMKAMPWYCALRAVSEYMVENGWTRCFSRISDVGWASYISYMTLYLIFVEFGIYWMHRELHDIKPLYKWLHATHHIHNKQNTLSPFAGLAFHAIDGILQAIPHVIALFLVPTHFMTHILLLFMEAIWTANIHDCIHGKFWPVMGAGYHTIHHTTYRHNYGHYTVWMDWMFGTLRDPLEEEAKNM

SEQ ID NO: 36489 - protein, 329 aa, Solanum tuberosum
MAVNGSAPSSGLIVSFGEMLIDFVPTVSGVSLAEAPGFLKAPGGAPANVAIAVTRLGGKSAFVGKLGDDEFGHMLAGILKTNGVQADGINFDKGARTALAFVTLRADGEREFMFYRNPSADMLLTPDELNLDLIRSAKVFHYGSISLIVEPCRSAHLKAMEVAKEAGALLSYDPNLRLPLWSSEEEARKQIKSMWNYADVIKVSDVELEFLTGSNKIDDECAMSLWHPNLKLLLVTLGEKGCNYYTKKFHGSVGGFHVKTVDTTGAGDSFVGALLTKIVDDQAILEDEARLKEVLRFSCACGAITTTKKGAIPALPTVSEVLTLLKGGA

SEQ ID NO: 36490 - protein, 101 aa, Pfiesteria piscicida
MADEAKPEEKDNFDVGPLSVLQKCVKDNSQVLINCRNNRKILARVKAFDRHSNMVLENVREMWTEVPHGGKKKAKPVNKDRFITKLFLRGDSVILVLRNPK

SEQ ID NO: 36491 - protein, 682 aa, Medicago truncatula
MAIFTYASYNNQTKNTSFSMLIIIFTLFYAFFNPAHSISFNFTSFQSNLYLIKFQGDAFSSNNVLQLTKNQLDGPITRSVGRASFDQPLKLYDKETKELTDFTTHFTFIMRAVNLSLFGDGLSFFMAPFQSDIPENSAGGYLGLFSKESALNTSKNQIVAVEFDSYRNDWDPNSDHVGINVNSIQSVQNVSWKSSIKTGAVANAWISYNSTTKNLSVFLTYVNNPTFHENSTLSYNIDLSEVLPEYVRIGFSAATGQWIEIHNILTWSFNSSLKSGNGKNIKVGLGVGLSVGFGSLTCLVGLLWFTFWRKRKVINKGERDNNRDFDASIDEDEFERGTGPKRFTYKELSNSTNGFDEKGKLGEGGFGGVYKGLLEKNNKLEVAVKRVSKGSRQGKKEYISEVRIISKLRHRNLVQLLGWCHEKSELLLVYEYMPNGSLDYHLFGKGVMLTWSVRYKIALGIASSLLYLHEEWEQCVVHRDIKSSNVMLDANFNAKLGDFGLARLVDHELGSQTTVLAGTMGYLAPECVTTGKSSKESDVYSFGVVALEITCGRRSIESNEEAKKIRLVEWVWELYGKGELFEGVDRGLNLEFDERKMECLMVVGLWCCHPDFTMRPSIRQVINVLNFEAPLPSLPSKLPVPMYFAPPMEMCRFSYTSDGLTNTTKGSSTYSSISAGSRKSLL

SEQ ID NO: 36492 - protein, 521 aa, Yarrowia lipolytica CLIB122
MLEILIGVTLFFTLWRVLVLADLKRRQKKSGYGYPPIASNGLLGWRGLVHQLSGFVKDIGPAGWGAQFKEHGKTHLYPVFPTQLLVTRDPDNVKAILATQFKDFSFGIRKEALCPSLGYGIFTVEGSSWSHSRALLRPQFSREQISRLDSVEHHFQEFAQCVDNFKGEYFDIQKLFFAQSMDTSTDFLLGESVGCLKELLETRDGDESSKKFGANFQHAFDRVQRLVALRVVFQENYWIIGDVFFRNEFRQVNELIQKFVQGYVDKALKARAHKAPIYTNPDKYIFLYELARDTTNPRVLRDQVLNILIAGRDTTAATLSWLMFELAQKPHIFHKLRKAVIEDFGTTIENISFESLKQCEYLRYVLNEVLRLHPVVPINLRVALKDTTLPRGGGPNGDEPIFVPKGQKINYAVYWTHRDEQYWGEDAEEFKPERWDTTNHPGPLGKGWEFLPFNGGPRICLGQQFALTEMGYILTRLVQEYSDIGIDEEYHDRPLRVRHSITMSHGDGVHVRLSREGTVVS

SEQ ID NO: 36493 - protein, 464 aa, Burkholderia vietnamiensis G4
MKQSIDALLRADRAHFMHPSTHAYDHESGALPGRIVRGAHGIHIEDHEGRRYIDAFAGLYCVNIGYGRTEVADAMHEQAKQLAYYHTYVGHASDAIIELSSRIIECAPVGMKKVYYGMSGSDANETQVKLVWYYNNVLGRPNKKKIISRERGYHGSGIVTGSLTGLPSFHQHFDLPIDRVKHTVCPHWYRNAPVGMSEAQFVAYCVDELEKLIAREGADTIAAFIAEPVMGTGGIIAPPAGYWPAIQAVLRQHDILLISDEVVCGFGRLGSKMGAQHFGIEPDLITVAKGLTSAYAPLSGVIVGDKVWDVIARGSQAHGPMGHGWTYSGHPVCAAAALANLAILERENLVGNAAEVGAYFGAKLRDAFGAHPLVGEVRSVGMLAALEFMADRDARTPFDPALKIGAQVSAAALRRGVIARAMPHGDILGFAPPLVMTRAEADEIVGIVKEAVDEVAERNLAAVS

SEQ ID NO: 36494 - protein, 512 aa, Francisella tularensis subsp. holarctica
MKKTTLLVILDGWGYSDSDYFNAIKNANTPTWDSIWQEFPKTLINASSLEVGLPRSQMGNSEVGHVNIGCGRVVYQELTKIDKAIEEKTFGDNKAICAAIDNVIKNDSNLHLIGLLSPGGVHSHEEHIFEMIKIAKQKGIKRLYLHAFLDGRDTPPRSAEKSIKKADKLLQDLNLGYIASVCGRYYAMDRDNRWDRVEKAYNAIVNANADFIYDSALEALEQSYARDQSDEFVIPTCIKKDGHLVKVQDNDSVIFMNFRADRAREISHAFTDESFDHFPRKKHLNINFTTLTEYDSKLKCAVAFPPEQPINTLGEVLMKNHKTQLRIAETEKYPHVTFFFNGGREEQFEGEDRILIPSPKVATYDLQPEMSAPEVTDKLVAAINSGKYDCIVCNYANSDMVGHTGNYEAAMQAIEYLDKCIARLKDAILEHDGNMFITADHGNADMMVNPETQKPHTAHTTNLVPFIYVGHKKAQVALEHGKLSDIAPTLLNVMGIAQPKEMTGKTIFNFEK

SEQ ID NO: 36495 - protein, 492 aa, Burkholderia vietnamiensis G4
MLPGHPVLFKSMCYVDGRWIHSDSAATRAVVNPADQSVIGHVPMLERAQIVGAVDAAQRAFGTWRWTPQAARSAALLRWHALILRHLDDLAALLSLEQGKPLAEARGEIRYAASFVEWFANEAKRAVGRTIPTHIDGAHLGTVMEPVGVAALITPWNFPAAMITRKAAAALAVGCTVIVKPAHETPFSALALAQLADEAGFPAGVFNVVLGEPQMAMEALVGDARVRAVSFTGSTRVGRLVTETAAKAGIRKIALELGGNAPFIVTDDADLDDAVRIAVGAKFQTSGQDCCAANRIFVARALYDAFVGRYASAVRALKTGPAFEPGVDVGPLMHQAAFDATVARVDDARARGARIVAGGRPHALGGWFYEPTVIADAAPGMRVYDEENFAPISAVCAFDTLDEVVARANDTEYGLAAYVCATRIDTIFRLVRRLDFAMVSVNGVKFTGAPIPFGGMKASGLGREGGVEGFEPFTETKYFCFGNLGLPVAATA

SEQ ID NO: 36496 - protein, 306 aa, Photobacterium sp. SKA34
MTNAVSEMWQQRHEGKFTGVKQCELGWVSLTPKRSDKVIIVVNGRVETYWKYQELFYDLVKQGYHVYSFDHRGQGVSERLVADHELGYVEHFDDYVEDLHLFMQNIVKPQDYKQHFILGHSMGGAITSLALARYPTLFDRAVLSAPMHGIYVKPHLKPFAEALIGITELFCRQPHYAIGQKPYYAKPFDGNLLTHSQTRYQWFRDLYDVRPELRIGGASNHWVWESIKAARQAIQQANTITISVLLLQGSEDKIVDNACQQQFQQRLNQGSGHCNFQIIEGSRHEILFESDPLRNQAITALLAHFA

SEQ ID NO: 36497 - protein, 122 aa, Triticum aestivum
MATTLMFFRPTMIRASAGSPTKPDPRNRKPVSSNWWAPLFGWPADPDYMGPLQKASEKSDPEREVGLDLGRPRSKFTARCFTEKKAKELRKKTVETSTFHDIMYHSAIASRLASDVSKGYEK

SEQ ID NO: 36498 - protein, 375 aa, Zea mays
MSSLRGVGPELGDFHAHVAVRLAGLSAPGGEEFMSVAWVRRLLEAFLLCQEEFRAAVAEARRRGGGVTAPADAEKLVAEVGERAVRALDVCNAARDGVDQARRWERLAGLAASALLAPAEGQVHEGQLWRARKALSDLSLLLADDAAAASAGAGGGLASFLASHRNRSFGRARASPSRASPSAHLRSLSWSVSRTWSAARQLQAIGAGLAAPRATEASCGFAAPAYAMGCLLHLAAWALVAAVPCPDRAAALQAHHLPAAPPRAAFPWAPPLLALQERLAEEGRRKDRRSSCGLLREIHALDKCAQRLAEAIDAAPVPLTGEREAELREAAAELAAACSAIKDGLDPLERQVRELFHRIVRSRMAGLDPPMANAD

SEQ ID NO: 36499 - protein, 319 aa, Solanum habrochaites
MGSKYSKATNSINDALSSSYLVPFESYRVPLVDLEEATNNFDDKFFIGAGVFGKVYKGVLRDGTKVALKRRKPESSQGIEEFETEIEILSFCSHPHLVSLIGFCDERNEMILIYKYMENGNLKSHLYGSDLPSMSWEQRLEICIGAARGLYYLHTRAVIHRDVKSINILLDENFVPKITDFGISKKGTELDQTHLSTVVQGTLGYLDPEYFIKGRLTEKSDVYSFGVVLFEVLCARSAIVQSLPREMVNLAEWAVESHNNGQLEQIIDPNLADKITPESLRKFGETAVKCLALSSEDRPSMGDVLWKLEYALRLQESVI

SEQ ID NO: 36500 - protein, 274 aa, Pseudomonas aeruginosa PAO1
MDRYCVFGNPIGHSKSPLIHRLFAEQTGEALVYDAQLAPLDDFPGFARRFFEQGKGANVTVPFKEEAYRLVDELSERATRAGAVNTLIRLADGRLRGDNTDGAGLLRDLTANAGVELRGKRVLLLGAGGAVRGVLEPFLGECPAELLIANRTARKAVDLAERFADLGAVHGCGFAEVEGPFDLIVNGTSASLAGDVPPLAQSVIEPGRTVCYDMMYAKEPTAFNRWAAERGAARTLDGLGMLVEQAAEAFFLWRGVRPASAPVLETLRRQLATV

SEQ ID NO: 36501 - protein, 314 aa, Schizosaccharomyces pombe 972h-
MSVQYPPQHSVLLVSSGYDHTIRFWEALSGICSRTIQHADSQVNRLCISPDKKFLAAAGNPHVRLYDINTSSQMPLMTFEGHTNNVTAIAFHCDGKWLATSSEDGTVKVWDMRAPSVQRNYDHKSPVNDLLIHPNQGELLSCDQSGRVRAWDLGENSCTHELIPEEDVPMSSITVGSDGSMLIAGNNKGNCYVWRMLNHQGASLLQPVVKFQAHQRYITRCVLSPDVKHLATCSADATVNIWSTEDMSFMLERRLQGHQRWVWDCAFSADSTYLVTASSDHVARLWELSSGETIRQYSGHHKAAVCVALNDYQI

SEQ ID NO: 36502 - protein, 1003 aa, Coccidioides immitis RS
MAGHDDEEARIETVKDAVTDMKLERQSSTESVAPNGILDTITPKDEPNGHLSSKPSTPSLKPPKSRSRSSNSLAKDEVPEEKVGGDITIKQEPGQPPKLARSASQKLPPRAAPLFTDLPDKTTEATSTFQLMEVCTYANKYLGYTEHAMDCDCAEEWACGEDSDCINRATKMECFGDCGCGDSCQNQRFQRREYAKVSVIKTEKKGYGLRADCDLRPNEFIFEYIGEVINEPQFRRRMIQYDEEGIKHFYFMSLNKGEFVDATKKGNLGRFCNHSCNPNCYVDKWVVGEKLRMGIFAERYIKAGEELVFNYNVDRYGADPQPCYCGEPNCTGFIGGKTQTERATKLSHATIEALGIDDPDGWDTAVARRPRKKKAGEDDEEYVDSLQPKSLDENGVTKVMAALMQCKEKWIAVKLLGRIQRCEDERVRHRVVRMHGYQILNSQLNTWKDDFNVVLQILDILDKFPRLTRNKIIDSKIEGTVSPLQECDDERVAEKAKALLEIWSALEVGYRIPRMKRDPAAVNNTPTANHYERRETAKDDRKPNSSKSRSRSRSRSRSVDVTRNAPRGPAALTRGGGKGHMHSYRPGQRPFRRPFNPLPKGWFAAESNGRTYYYSATGETTWSRPTAPAVQPPPPPKRESKEKTLQDIIDGIMNAKENTPKAKDKSATPATPADAKIPEKKEHKEKWRSYSEEKQKKLYENTLFPHVKYIVDKFKHKLPKDDLKRYAKEVAKKLVNSDFKNNRVEDPTKISDKQVKQVKKYCKEYFDKAVAKHRAYEEKKAERKSKGSVKATTSATIDKAETTSTKAPPQFDGAAETGDEDSDVQLSDAEYEDGQEESSHHSGLKRKRTDDEDFENDHENGGVSPTKRQRSASLPIIPPPPPPMSPSNLVLDDGSREALKRQRTEGAEDDEYGDSTISSGKRQRSETPPPPPPPPPPADIPPENIESENENDKDQEELQDYDVQEANWGKEDNIAIQSPSHSPFPAQSISNHSNTARETDSHS

SEQ ID NO: 36503 - protein, 262 aa, Pfiesteria piscicida
MAKPHALLVFSRHGESEWNVANKFTGWVDVDLSEKGVGEAKAAGELIKQEGLKFDVCHTSYLKRAIKTCNLALESADQLYAPVSKTWRLNERMYGGLTGLDKKETVVKHGAEQVQIWRRSFDLPPPEIDEASPFHPKLEAKYADLDPKDIPKTESLKTVIERVMPYWEGTIMPDLKAGKTVFVAAHGNSIRAIVKYIEGIPDDVIPGLEIPTGTPLVYALDADLKPIACDQAVAPLKYGRYLGDAEKIKAAAEAVKNQTKVG

SEQ ID NO: 36504 - protein, 282 aa, Corynebacterium glutamicum ATCC 13032
MCELSYLNAVVMLKAQRGGNSGLYFGSMTTFITSGGLEISPAGAHIVHAESPEGELLFVSSASQYGEGNAIRGGVPIIAPWFGGLLGLDPAHGWAKRSAWDVTEHDGQIHAEYGRDGLLLDIRANSTKNGFEITLRAYNDTDEARTVQLAFHPYFKVDDVEKIEVRGLDGVDILNRLNNEVETQDGPVTFDGEFDRIALGTPVVRIFDTDRIITIEGDGHDSTVVWNPGESRASTVADIGEGEWRDFVCVEPALLGADQKGVRVAPGQSVTVGMQVSVEKRA

SEQ ID NO: 36505 - protein, 323 aa, marine gamma proteobacterium HTCC2143
MPLDENFTYETIEIPSISDGQVLVEAQWLSLDPYMRGRMSAAKSYAPPIEIGAVIVGEFAGVIIESKHSDFKVGEHVCCQGGWQDHAVVDGDEPSLHKVDASLLPLSAYLGVAGMPGRTAYFGLLEKGRPQEGETVVVSAASGAVGSVVGQIAKMKGCRVVGVAGGQEKCDYVINELGFDACVDYKAGNLNADLAAACPGGIDVYFENVGGDTSRAVAKLLNSGARIPVCGYISNYNDSRENRTETPFHIFGALNPVPEHGFFLVHESEKTPQEMTEELASWINQGKLKYRESVVEGLQNAPEAFRGLLTGKNFGKQLIKITG

SEQ ID NO: 36506 - protein, 651 aa, Medicago truncatula
MAPCFYTLPLFFLSLILLTFHAYSIHFQIPSFNPNDANIIYQGSAAPVDGEVDFNINGNYSCQVGWALYSKKVLLWDSKTGQLTDFTTHYTFIINTRGRSPSFYGHGLAFFLAAYGFEIPPNSSGGLMGLFNTTTMLSSSNHIVHVEFDSFANSEFSETTEHVGINNNSIKSSISTPWNASLHSGDTAEVWIRYNSTTKNLTVSWEYQTTSSPQEKTNLSYQIDFKKVLPEWVTIGFSAATGYNGEVNNLLSWEFNSNLEKSDDSNSKDTRLVVILTVSLGAVIIGVGALVAYVILKRKRKRSEKQKEEAMHLTSMNDDLERGAGPRRFTYKELELATNNFSKDRKLGQGGFGAVFKGYFADLDLQVAVKKISRGSRQGKKEYVTEVKVISQLRHRNLVKLLGWCHDKGEFLLIYEFMPNGSLDSHLFGKRTPLSWGVRHKITLGLASGLLYLHEEWERCVVHRDIKSSNVMLDSSFNVKLGDFGLAKLMDHELGPQTTGLAGTFGYLAPEYVSTGRASKESDVYSFGIVVLEITSGKKATEVMKEKDEEKGMIEWVWDHYGKGELLVAMDENLRKDFDEKQVECLMIVGLWCAHPDVSLRPSIRQAIQVLNFEVSMPNLPPKRPVATYHAPTPSVSSVEASITNSLQDGR

SEQ ID NO: 36507 - protein, 393 aa, Rhodobacter sphaeroides 2.4.1
MISAVLPTYNRAPLAFVAGEGSWLTAEDGSRYLDLGAGIAVNALGHANPALVEVISAQAAKLWHVSNLYRIPEQERLAEKLVEATFADTVFFTNSGTEAAELSIKMVRKYWSEKGQPDRIEILCFEGAFHGRSTGAIAAAGSEKMTKGYGPLMPGFRQLPFGDHEALRAAISEKTAAVMLEPVQGEGGIRVLPDVCLKGLRDACDAVGALLVFDEVQCGMGRTGRLFAHEWAGIEPDIMMVAKGIGGGFPLGAVLAKKAAAAAMTAGTHGSTYGGNPLGCAVGAKVMEIVADPAFLAEVNRKAALFRQKLEGLVAAHPQVFEEVRGAGLMLGLKCRAPNADLVKAAYGQHLLTVPAADNVVRLLPALNIPDEDIAEAVARLDRAAGTLDADAA

SEQ ID NO: 36508 - protein, 524 aa, Agrobacterium tumefaciens str. C58
MSTLGAYFRLARVGWVLVREGVVLALPSDDLPAPAQLLKAALKPFARSKAKRAQRSDRLAVAVERLGPSYVKMGQFLATRPDVVGADFADDLASLQDRMAFFPAAAAKANIEGSLGRSISELYREFGDPIAAASIAQVHPAMVDTPKGPRKVAVKVIRPGVRQRFQNDLEAMYLIADLQQRFVRSARRLRPVEVTRTLEQTTKIEMDLRLEAAALSELAENTRQDPGFRVPEVDWERTGRDVVTMEWIDGVKMSDIEGLKAAGHDLNKLADTLIQSFLRHTLRDGFFHADMHPGNLFVDAKGEIVAVDMGIAGRLGKKERRFLAEILYGFITRDYMRVAEVHFEAGYVPGHHDKASFAQAIRAIGEPIHGQPAETISMGKLLTLLFEVTELFDMETRPELVMLQKTMVVVEGVSRMLNPRFNMWKAADPVVGGWIRDNLGPKRIATDLKDGVKAALKLAEAVPEIAAKTEKLHSELMYMSENGLRFDAQTAEAIGKAEARHTKWGRIALWVIALTLLYIAIRIS

SEQ ID NO: 36509 - protein, 135 aa, Brassica napus
RPDTKFLLSSVAPLQKQKEVASHVLMGLPKNTVILPTLLSPLGKACSRMDLEAVHEILLKTGYRDDEGKENELSFQEWTQPVQEMLNIKKLGDAAFRDKDFKNAIECYSELVVMMTTVPSATVFARRSFSYLMTG

SEQ ID NO: 36510 - protein, 506 aa, Cryptococcus neoformans var. neoformans JEC21
MAPTFTHEFNHAGYKGKVEVPTGIFINGEWASSVDKNAKTIDVYNPTTGEVLTKIPEALEADVNKAVEVAHNAFNNSWGLSVPGFKRGEYLIKIAELMERDLDILASLEALDNGKTFGAAKGFDVIESARTFRYYGGWADKIHGKVIETSSSKLTYTLHEPVGVCGQIIPWNFPLLMFSWKIAPALAAGNTVVIKPSELTPLTAMYMTKLFNEAGLPKGVINVVVGYGQTVGNALAGHPAIDKVAFTGSTAVGRKVMEEASKSNIKKVTLELGGKSANIVFEDADFEEAVKYSAQGIFFNHGQTCCAGSRIYVQKPIYEKFVKAFKEQTSKLKVGDPFDPNTYQGPQVSQIQAERIMSYVDHGKQEGATVITGGKRCGDKGYFIEPTVFGDVTANMKIVKEEIFGPVVVVSPFETEEEALEHANDSVYGLASAVFTSNISRATRVASKLKAGTVWINCYNELHPQVPFGGFKQSGLGRELGEYALENYTEIKAVQINVGAKCAIPT

SEQ ID NO: 36511 - protein, 325 aa, Bacillus subtilis subsp. subtilis str. 168
MKYTFNEEKAFDIVAIGRACIDLNAVEYNRPMEETMTFSKYVGGSPANIAIGSAKLGLKAGFIGKIPDDQHGRFIESYMRKTGVDTTQMIVDQDGHKAGLAFTEILSPEECSILMYRDDVADLYLEPSEVSEDYIANAKMLLVSGTALAKSPSREAVLKAVQYAKKHQVKVVFELDYRPYTWQSSDETAVYYSLVAEQSDIVIGTRDEFDVMENRTGGSNEESVNHLFGHSADLVVIKHGVEGSYAYSKSGEVFRAQAYKTKVLKTFGAGDSYASAFIYGLVSGKDIETALKYGSASASIVVSKHSSSEAMPTAEEIEQLIEAQS

SEQ ID NO: 36512 - protein, 47 aa, Populus trichocarpa x Populus deltoides
  misc_feature (38)..(38): Xaa can be any naturally occurring amino acid
LADLEVALCLCTAIKASVLGINLNVPVALSVLVSACGXSIPPGFKCE

SEQ ID NO: 36513 - protein, 314 aa, Solanum habrochaites
MGSKYSKATNSISDASNSFESYRFPLVDLEEATNNFDDKFVIGESGFGKVYRGVLRDGTKVALKRHNRDSRESIEEFETEIEILPRRSHPHLVSLIGYCDDRNEMILIYDYMENGNLKSHLTGSDLPSMSWEQRLEICIGAARGLLYLHTNGVIHRDVKSTNILLDENFVPKITDFGLSKKGPQLYQTHVSTNVKGTFGYMDPEYVIRQKLTEKSDVYSFGVVLFEVFCARSTIDPYLRREIVTLAEWAVKSHNNGQLEQIVDPNLAAKIRPESLRKFGETAVKCLALSGKDRPSMGDVLWKLEYALCLQESVI

SEQ ID NO: 36514 - protein, 415 aa, Pseudomonas syringae pv. syringae B728a
MDAFNYRDGELFAEGVALSAIAERFGTPTYVYSRAHIEAQYRAYADALSGMPHMVCFAVKANSNLGVLNVLARLGAGFDIVSRGELERVLAAGGKAEKIVFSGVGKTREDMRRALEVGVHCFNVESTDELERLQEVAAELNVRAPISLRVNPDVDAGTHPYISTGLKENKFGIAIAAAEDVYIRASQLPNLEVIGVDCHIGSQLTTLEPFIDALDRLLALVDRLGDCGIHLHHIDLGGGLGVRYRDEEPPLAADYIKAVRERLAGRDLGLLFEPGRFIVANAGALLTRVEYLKHTEHKDFAIVDAAMNDLIRPALYQAWMDVTAVRPRDSEPRAYDIVGPICETGDFLAKGRELALAEGDLLAVHSAGAYGFVMSSNYNTRGRAAEVLVDGSQAFEVRRRETVAELFAGESLLPE

SEQ ID NO: 36515 - protein, 320 aa, Solanum habrochaites
MGSKYSKATNSINDASNLSYGVPFENYRVPFVDLDEATNNFDDKFFIGEGGFGKVYRGVLRDGTKVALKRHNHDSRQSIKEFETEIEILSFCSHPHLVSLIGFCDERNEMILIYDYMENGNLKSHLYGSDLPTMSMSWEQRLEICIGAARGLHYLHTNGVIHRDVKSSNILLDENFVPKITDFGISKTMSELDQTHLSTAVKGNIGYIAPEYALWGQLTEKSDVYSFGVVLLEVLCARPALDLSEMMSLGDETQTMGQLEQIVDPTIAAKIRPESLRMFGETAIKCIAPSSKNRPSMGDVLWKLEYALCLQEPTIQDDPE

SEQ ID NO: 36516 - protein, 362 aa, Kluyveromyces lactis NRRL Y-1140
MPRTITYDIPSHYQLVDLVGEGAYGTVCSAIHKPTNTKVAIKKIQPFSRSMFVTRTLRELKLLKFFHSHENIISVLDIVRPTSWHKFEAVYLVQELMETDLQKIINQQNLSEDHIQYFVYQILRALKSLHSAQVIHRDLKPSNLLLNSNCDLKVCDFGLARCLASSDQSRENMVGFMTEYVATRWYRAPEIMLSFQEYTTAMDIWSCGCILAEMIMGKPLFPGKDYHHQLWIILEVLGSPTLEDFEQIKSKRAKEYISQLPMKKGIPWANVLNKEVNPLAIDLLSKMLTFNPDKRISAVEALEHPYLATYHDPDDEPDYPQLNLEDNFWKIDNEARDKNEEDDIPLELLKKMLYGEVMKPLN

SEQ ID NO: 36517 - protein, 323 aa, Solanum habrochaites
MGTNYSKPTTSINDASNLRNRVPFESFRVPFVDLQEATNNFDDKFLIGVGIFGKVYRGVLRDGTKVALKRRKPESPQGFEEFRTEIEILSHCSHPHLVSLIGYCDERNEMILIYDYMENGNLSKRLYGSDLCLPTMSWEQRLEICIGAARGLHYLHNSAVIHRDVKSTNILLDENFVAKITDFGISKTMPEFDQTHLSTMVQGSIGYIDPEYFIRRQLTKKSDVYSFGVVLFEVLCARPAISRSHMISLAEWAVETQKMGQLEQIVDPTIVAKIRPESLRMFGETAVKCLASSSENRPSMGDVLWKLEYALHLQEPIIQDNPE

SEQ ID NO: 36518 - protein, 174 aa, Salvia miltiorrhiza
CSTGDAMGMNMVSKGVQNVLDFLVNQFPDMDVLGISGNYCSDKKPAAVNWIEGRGKSVVCEAVIKEEVVHKVLKTNVAALVELNMLKNLTGSAIAGALGGFNAHASNIVSAVYIATGQDPAQNVESSHCITMMEAVNGGKDLHVSVSMPSIEVGTVGGGTQLASQSACLNLLGV

SEQ ID NO: 36519 - protein, 329 aa, Shewanella sp. ANA-3
MQVSPRGTASAKLTDFLELANQNIALAKQQNIQYSPQLLRENLNKLAALMSAKPEVSYIADKAWQVKDAQHGDREIGCRVYSPAPNKALPVVLHFHGGGHMCGSVELYDPICRHLASIAQCVVISVEYRLAPEHPYPAGLEDCEYALRHYQSVLTEVQYQQGVSIMGDSAGGALCTSLSQRSLSDSTLNIAKQILVYPSVDYTMASASYQSNGAGFLLETPRVQWYFEQYFQEVAKDAERVKQASPLHGEFNAKLPSTLIFTAGCDPLRDEGIAYANALTAAGVQVQHHQFEDMIHAYMLLQDLVTEECLATYRMIAAFLAEPITATSR

SEQ ID NO: 36520 - protein, 387 aa, Arabidopsis thaliana
MASSRVSDLPHQRGIAGEIKPKNVAGHGRQNRKVLGDIGNLVTGRDVATGKDVAKKAKQPQQQTKAEVIVISPDENEKCKPHFSRRTHIRGTKTFTATLRARSKAASGLKDAVIDIDAVDANNELAAVEYVEDIFKFYRTVEEEGGIKDYIGSQPEINEKMRSILIDWLVDVHRKFELMPETLYLTINLVDRFLSLTMVHRRELQLLGLGAMLIACKYEEIWAPEVNDFVCISDNAYNRKQVLAMEKSILGQVEWYITVPTPYVFLARYVKAAVPCDAEMEKLVFYLAELGLMQYPIVVLNRPSMLAASAVYAARQILKKTPFWTETLKHHTGYSEDEIMEHAKMLMKLRDSASESKLIAVFKKYSVSENAEVALLPSLDDFSVSCA

SEQ ID NO: 36521 - protein, 119 aa, Zea mays
MAMAPCAPASVSSFPARPVRAPSAVRPRAAAIRATAAAAEGGRWWAPLLGWSGKADYLEAPAPVPAVLQDDDAAAARRQFVGGLTEEKARQLRARMAQTESFHDAMYHSAIASRLARSA

SEQ ID NO: 36522 - protein, 461 aa, Bacillus subtilis subsp. subtilis str. 168
MKKDTRKYMIYFFGALGGLLYGYDTGVISGALLFINNDIPLTTLTEGLVVSMLLLGAIFGSALSGTCSDRWGRRKVVFVLSIIFIIGALACAFSQTIGMLIASRVILGLAVGGSTALVPVYLSEMAPTKIRGTLGTMNNLMIVTGILLAYIVNYLFTPFEAWRWMVGLAAVPAVLLLIGIAFMPESPRWLVKRGSEEEARRIMNITHDPKDIEMELAEMKQGEAEKKETTLGVLKAKWIRPMLLIGVGLAIFQQAVGINTVIYYAPTIFTKAGLGTSASALGTMGIGILNVIMCITAMILIDRVGRKKLLIWGSVGITLSLAALSGVLLTLGLSASTAWMTVVFLGVYIVFYQATWGPVVWVLMPELFPSKARGAATGFTTLVLSAANLIVSLVFPLMLSAMGIAWVFMVFSVICLLSFFFAFYMVPETKGKSLEEIEASLKKRFKKKKSTQNQVLNERTL

SEQ ID NO: 36523 - protein, 339 aa, Frankia sp. CcI3
MGIMTITVGINGFGRIGRSYFRALLTSGADIRVAAVNDLTSAQSLADLLKYDSVYGPLPQQVAAEGSSLRVGDTVVEVLSERDPAQLPWRRLGVDVVIESTGVFNDAAKARAHIDAGASKVVVSAAAKNADLTLVIGINDDLYDPQKHTVVSNASCTTNCLAPMARVLDDGLGIECGTMTTIHAYTQDQNLQDGPHPDPRRARAANLSTIPTTTNAASAIGLVLPNLKGKLDGYSVRVPVPVGSLTDLTVRVDRETTVEEVNSLFRKAADGELARILRYTADPVVSADIVKDPASCIFDSLLTQVIEGRHVHIFGWYDNEWGFSNRLIDTTQLVGGATA

SEQ ID NO: 36524 - protein, 545 aa, Oryza sativa (japonica cultivar-group)
MAGGGGRERRGGGRLLVGVLLLTLVVSGHCLESTHHRGLKRRRRKHEIHSPIKTVVVVVMENRSFDHILGWLSRTRPDIDGLNGTQSNRLNASDPSSPEIFVTDEAGYVDSDPGHGFEDIREQIFGSADTSAVPAPMSGFAQNARGMGLGMPQNVMSGFKPESVPVYAALADEFAVFDRWFASVPTSTQPNRLYVHSATSHGLTFNARKDLIHGFPQKTIFDSLEENGLSFGIYYQNIPATLFYQSLRRLKHLVKFHQYSLKFKLHAKWGKLPNYAVIEQRYFDCEMFPANDDHPSHDVARGQRFVKEVYETLRASPQWNETALIITYDEHGGFYDHVPTPVVGVPQPDGIVGPDPYYFKFDRLGVRVPSFLISPWIEKRTVIHEPNGPQDSSQYEHSSIPATVKKLFNLHSNFLTKRDAWAGTFENYFKIRKTPRTDCPEKLPEVTKSLQPFGPKEDSSLSEFQVELIQLASQLNGDHVLNTYPDIGRTMTVGEANRYAEDAVARFLEAGRIALRAGANESALVTMRPALTSRASPSSDLSSEL

SEQ ID NO: 36525 - protein, 438 aa, Francisella tularensis subsp. holarctica
MNFLKPAKALPLLAKEQIQKAYPHWRLRMFLVAYIGYFIYYFGRSSFDVSKQYITTLTPDELGLIGAGLGIAYGISKFLMGNISDRSNAKVFLAIGLFITGLINLLLPSLLSLGVLVMFIAMLVNGWVQGMGWPACARIMTHWFCANERGTKMGIWNTAHNVGAGFLAIAVVPIGLLLFHDDWHGLFYVAGAMCIFVSILVLIFGADTPQSVGLPAIEVYKGYTTAEAHHEQEFSAKEIFLKYVLNNKWVWLIAIANAFVYCARYGLLSWSTYYLVNVKHMSTTTGLLGFALFELPAIPGTIIIGWITDKYFGSRRAPMGVICMLLFICALFVYWYSDTAWVLLLSLSAMGVLIYGPVALIGILALDLVPKKAGGTAAGFTGLFGYFLGTVGAQAVIGIIATMLGWDAVFIFLLGSCVIAIALLAVCWNLSYNQAFSD

SEQ ID NO: 36526 - protein, 233 aa, Oryza sativa (indica cultivar-group)
MDMDSWERLAADARLQDALIGMEEAEGSEGEEEAAEVACPFCDEEFDGFGLCCHIEDEHQAENRAGVYKLIHEVFLSCFHYRVVKVCPICYDAVGMDLVSHITSEHPSFFKGKWRNRRVSHGSHSSTRATLKKDAAYLQYRYGGSTRAASHNTDPDPLLSSFVGNFTNTDLPKDVQQEFRDETDEKSDSLVQKEQKPVESADEPLLPEVKEERTRRSQFVQGLVLSLMFDDIL

SEQ ID NO: 36527 - protein, 668 aa, Ipomoea trifida
MGVPALQVLPGELSCRFFRRCSSTVASNSLLLLKDHLKVKGKNSRVKCFKDLGTITSSSKLCAVRDFYGLEKPNLLRCYCQPAERGNERIFEDEQGRSVHSIAPNGQTSDAAQQFKNDNGTVPSSKTVNNALPKSSTNSIEEEAWNLLRASMVYYCGNPIGTIAANDPSDSSILNYDQVFIRDFIPSGIAFLLKGEYDIVRNFLLHTLQLQPVLLCINTLPSKQSWEKTMDCYSPGQGLMPASFKVRTVPLDNDENATEDVLDPDFGEAAIGRVAPVDSGLWWIILLRAYGKCSGDLSLLERIDVQTGMKMILKLCLADGFDMFPTLLVTDGSCMIDRRMGIHGHPLEIQALFYSALLCAREMLAPEEASIDLITALNNRLLALSFHIREYYWIDVKKLNEIYRYKTEEYSYEAINKFNIYPDQIPPWLVEWMPSKGGYLIGNLQPAHMDFRFFSLGNLWSIVSSLATTDQSHAILDLIETKWEDLVANMPLKICYPALEGQEWRIITGGDPKNTPWSYHNAGSWPTLLWQGSPFSMLIVKVSLVEQKIEDSASKFDAILAVACVKMKRPEIAENAIKVAERRIAGDKWPEYYDTKRGGFIGKQARLFQTWSIAGYLVAKLLVANPEAAKMLITIEDTELLSAFSSILSSNPRRKRSRKGAVKQSYIV

SEQ ID NO: 36528 - protein, 149 aa, Yarrowia lipolytica CLIB122
MFLVNIGLSLIVAFIIIRKVLFPAPEVIEEDEGEQLPPLVFTSYTPRTLAKFNGTDDPRVLMGVKGKVYDVTAGKKFYGPGGPYENFAGRDASRGLAKTSFDPAMLTPIDQPLDTLADLENHELETLDKWEMTIEAKYIHCGVLENEKA

SEQ ID NO: 36529 - protein, 454 aa, Mycobacterium avium subsp. paratuberculosis K-10
MMVLMLNRPEFMESVLAINMLGAIAVPLNFRLTAAEIAFLVQDCQARVVITEAVLAPVATGVRDIESLLDTVVVAGGSSDDTVLGYEDLIDETGAAHQPVDIPNDAAALIMYTSGTTGRPKGAVLTHTNLTGQTMTGLYTNGADINNDVGFIGVPFFHIAGIGNMLTGLLLGIPTVIYPLGAFEPGQLLDVLAAEKVTGIFLVPAQWQAVCAEQRARPRDLKLRVISWGAAPAPDALLREMSAMFPGTQILAAFGQTEMSPVTCMLLGEDAIRKRGSVGKVIPTVAARVVDENMNDVPVGEVGEIVYRAPTLMSGYWNNPEATAEAFAGGWFHSGDLVRMDEDGYVWVVDRKKDMIISGGENIYCAEVENVLASHPDIVEVAVIGRAHEKWGEVPIAVAAVANDNLALEDLDEFLTERLARYKHPKALEIVDALPRNPAGKVLKTELRIRYGGG

SEQ ID NO: 36530 - protein, 141 aa, Triticum aestivum
TKVLLMARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 36531 - protein, 368 aa, Ostreococcus tauri
MRGDGRAMGDAGLAGAYEVGAATLHEYLRARAADAVEASTSAREAEDCENEAAIVRALARTCAKIGRFVRRAGLTDVKAYVEGKNGAVNVHGEEQAALDDAAHEMCVEALREEGSSAWIASEESEDVVAANPRGRIAVVFDPLDGSSNIECGVGVGTIFGLVGVDENSAAASVYARPGNDMRSVGYVMYGASTILVLSFMSTGAVCAFTYDESLDAFVLTKANIRIPTSGNVYSVNQANYRKWDDVMRAYIDECSKEKKSLRYIGSMVADVHRTLLYGGTFHYPADASNPNGKLRAVYECFPMSAIIERAGGLAISAADTRVLDFVPTSAHERMPIHVGSPADIERLSQMYRESPGGAAAVRSTFSPL

SEQ ID NO: 36532 - protein, 1121 aa, Ceratodon purpureus
MSAPKKTYSSTTSAKSKHSVRVAQTTADAALEAVYEMSGDSGDSFDYSKSVGQSAESVPAGAVTAYLQRMQRGGLIQTFGCMVAVEEPNFCVIAYSENASEFLDLMPQAVPSMGEMDVLGIGTDIRTLFTPSSGAALEKAAATQDISLLNPITVHCRRSGKPLYAIAHRIDIGIVIDFEAVKMNDVSVSAAGALQSHKLAAKAITRLQALPGGDIGLLCDTVVEEVRELTGYDRVMAYKFHEDEHGEVVAEIRRMDLEPYLGLHYPATDIPQASRFLFMKNRVRVIADCCASPVKLIQDPDIKQPVSLAGSTLRAPHGCHAQYMGNMGSIASLVMAVIINDNEEDSRGAIQRGRKLWGLVVCHHTSPRTVPFPLRSACEFLMQVFGMQLNMEVELAAQLREKHILRTQTLLCDMLLRDAPIGIVSQTPNIMDLVKCDGAALYYGKRFWLLGTTPTENQIKDIAEWLLEYHKDSTGLSTDSLADRNYPGAHLLGDAVCGMAAAKITAKDFLFWFRSHTAKEVKWGGAKHDPAEKDDGRKMHPRSSFKAFLEVVKRRSLPWEDVEMDAIHSLQLILRGSFQDIDDSDTKTMIHARLNDLKLHGMDELSVVANEMVRLIETATAPILAVDSTGMINGWNAKIAHVTGLPVSEAMGRSLVKDLVLDESVVVVERLLYLASQGEEEQNVEIKLKTFGTQTEKEAVILIVNACSSRDVSDSVVGVCFVGQDVTGQKMFMDKFTRIQGDYKTIVKNPHPLIPPIFGGDEYGYCFEWNPAMEALTGWKHDELVGKLLVGEIFGMEMMCCRLKSQDSMTKFMISLNNAMDGTNTDKFSFSFCNREGKFVEALLSTNKRTNADGVITGVFCFLQIASSELQQALTVQRATEKVAIAKLKELAYIRQEIKNPLCGITFTRQLLEDTDLSDDQKQFLDTSAVCEQQLQKVLNDMDLESIEDGYLELDTAEFEMGTVMDAVISQGMTTSREKGLQIIRETPREISTMRLFGDQIRLQQVLSDFLINAIRFTPSSEGWVKIKVVPTRKRLGGNVHVMHLEFRVSHPGGGLPDELVLEMYDRGKGMTQEGLGLNMCRKLVRLMNGDVQYVRENAQCYFVVYVELPMAQRDDAASQM

SEQ ID NO: 36533 - protein, 208 aa, Thermus thermophilus HB8
MLKAVLFDLDGTLADTDPLHLLAWREVLAPYGLKVDPAFYRERISGRLNPEIVRDLLGLEGKEAERLIAAKEARFRALAQGLRPTPGLPEFLERIREKGLLWGVVTNAPKENARHVLEALGLRPPLLVLAEEVGRGKPDPLPYQLALRRLGVAPEEALAFEDSPSGVRSAVGAGIPTYGLLTGHKGEALLQAGAKGVFRDFREALGLL

SEQ ID NO: 36534 - protein, 440 aa, Silicibacter pomeroyi DSS-3
MSHVFPRHCHAQLPIAVGGEGCYLIDSTGKRYFDASGGAAVSCLGHSNDRVKQAIKDQVDRLAFAHTGFFTSDPAEELADLLIANAPEGIERVYFVSGGSEAVEAAIKLARQYYLEVGQPERRHLIARRQSYHGNTLGALAAGGNAWRRAQFDPLLIGVSHIAPCYEYAERAAGESLVDYGRRAADELEAEILRLGPDTVMGFIAEPVVGATLGAVAAVEGYFSRIREICDTYGVLLILDEVMCGMGRTGHLFACTGEGVRPDIVTIAKGLGAGYQPVGAMLCSGAIYDAVASGSGFFQHGHTYIGHPVATAAGLAVVQEMLEHDLPARVQALGGAMEAALRSRLDQHPHVGDIRGRGLFWGVELVADRAGKTPFDPGLGLAGKLKRAAFARGLICYPMPGTRDGRNGDHVLLAPPFIMEEADATLIAERLTAAMGDVLP

SEQ ID NO: 36535 - protein, 572 aa, Silicibacter pomeroyi DSS-3
MARILITSAIPYINGIKHLGNLVGSQLPADLYARYQRGRGNEVMFLCATDEHGTPAELAAAKAGKPVAEYCAEMHGVQADIARRFGLSFDHFGRSSSAQNHKLTQHFAGKLAENDLIREVSERQVYSNADGRFLPDRYIEGTCPNCGYDKARGDQCENCTKQLDPTDLIEPRSAISGSTDLEVRETKHLYLRQSALKDQLDAWIDSKADWPVLTTSIAKKWLHDGDGLQDRGITRDLDWGIPVKKGEQDWPGMEGKVFYVWFDAPIEYIACAGEWAEAHGKSDAEWERWWRTDKGADDVRYVQFMGKDNVPFHTLSFPATLIGSGEPWKMVDHLKSFNYLNYDGGQFSTSQGRGVFMDQALEILPADYWRWWLLSHAPENSDSEFTWENFQASVNKDLADVLGNFVSRITKFCRSKFGEEVPEGGAYGPQEEALIAELTTRLRAYEGHMEAMEVRKSAQELRAIWAAGNEYLQSAAPWTLFKTDPVQAAAQVRLGLNLIRLYAVLSAPFIPAASARMLEAMQTSDDNWPVDIATALNALAPGHAFTVPEVLFAKISDEDREGWQQRFAGVRS

SEQ ID NO: 36536 - protein, 334 aa, Kluyveromyces lactis NRRL Y-1140
MSEPSAKKQKFANSLEALKATGTTVVADTGDFESIAKFTPQDATTNPSLILAAAKQQAYAKLIDSAVQYGKKQGQNIDEQVEIAVDKLLVEFGTAILKVVPGRVSTEVDARLSFDKDATVKKALEIIKLYEAEGISKDRVLIKIASTWEGIQAAQELEKEHDIHVNLTLLFSFAQAVAAAEANVTLISPFVGRILDWYKASTGETYTAETDPGVISVKSIYNYYKKHGYNTIVMGASFRNVGEIKALAGVDFLTISPKLLDELLSSDEPVAKILDPESAKAEGSERVSFINDEPKFRFELNEDAMATEKLSEGIRKFSADIVTLFDLIKAKIQA

SEQ ID NO: 36537 - protein, 575 aa, Escherichia coli K12
MISGILASPGIAFGKALLLKEDEIVIDRKKISADQVDQEVERFLSGRAKASAQLETIKTKAGETFGEEKEAIFEGHIMLLEDEELEQEIIALIKDKHMTADAAAHEVIEGQASALEELDDEYLKERAADVRDIGKRLLRNILGLKIIDLSAIQDEVILVAADLTPSETAQLNLKKVLGFITDAGGRTSHTSIMARSLELPAIVGTGSVTSQVKNDDYLILDAVNNQVYVNPTNEVIDKMRAVQEQVASEKAELAKLKDLPAITLDGHQVEVCANIGTVRDVEGAERNGAEGVGLYRTEFLFMDRDALPTEEEQFAAYKAVAEACGSQAVIVRTMDIGGDKELPYMNFPKEENPFLGWRAIRIAMDRREILRDQLRAILRASAFGKLRIMFPMIISVEEVRALRKEIEIYKQELRDEGKAFDESIEIGVMVETPAAATIARHLAKEVDFFSIGTNDLTQYTLAVDRGNDMISHLYQPMSPSVLNLIKQVIDASHAEGKWTGMCGELAGDERATLLLLGMGLDEFSMSAISIPRIKKIIRNTNFEDAKVLAEQALAQPTTDELMTLVNKFIEEKTIC

SEQ ID NO: 36538 - protein, 610 aa, Pseudomonas aeruginosa PAO1
MCGLAGWVDYTRKLDDEFPAIFAMTDTLALRGPDAEGIWKHRNALLGHRRLAVIDLSGGVQPMSYRFPTGQEVTLVYTGEVYNHDALRERLRRAGHEFRTRSDTEVVLHAYLQWGERCCEYLTGMFAFAVFDGRDGHLLLVRDRLGIKPLYYARHREGLLFGSEIKSILAHPEFAARLDAVGLVDLLTLSRGTSQTPFREVQELLPGHLLSWRPNSQAKLRRYWEVRRQEHADDLQSTVQRTRELVTRALGAQLHADVPVCSLLSGGLDSTALTGIAQRIAKAEHGGDINSFSVDFVGQAEQFRSDDLRPDQDQPFALLAAQYIGSRHRTVLIDNAELVCERAREEVFRAKDVPFTFGDMDTSLHLMFGEIRRHSTVAISGEGADELFGGYGWFRDPQAVAAARFPWASRVRLPAGFIDAGFNRRCDLLQYQQASYDDGLRQVEHLAGDSPEERRMREFSHLHLKRWMVLLLERKDRLSMCNGLEVRVPYTDHELVEYVYNVPWSIKSRDGEEKWLLKRACADYVPEAVLKRRKSPYPTSANLGYERFLRGSVRRLLEDAVNPVFGIVSREFLAAELEHPEGYFNTQVSRHNLETALALEGWLRLYGLSA

SEQ ID NO: 36539 - protein, 532 aa, Oryza sativa
MVLGAGLRCPASVPWSSLAYGLLGLVLLWQGGRLLHRLWWRPRRLELALRAQGLRGTRYRFLTGDLGEHGRLNREAWARPLPLRCHDIAPRVAPFLHSSVREHGKACFSWFGPIPKVTIANPDLAKDVLSNKFGHLEKHKFQGLTKLLSDGVASHEGEKWVKHRRILNPAFHLEKLKTLQRMLPAFSTCCEELISRWMESLGSEGSYEVDVWPEMQSLTGDVISRTAFGSSYLEGRRIFQLQAEQAERLLKCVQKIIIPGYMSLPTKNNRKMHQIKKEIDSILRGLIGKRMQAMREGESTKDDLLGLLLESNMRHTAEHGQSSQGLTIEEVIEECKLFYFAGMETTSVLLTWTMLLLSMHPEWQDHAREEILGLFGKNKPEYEGLSRLKIMVTMILYEVLRLYPPAVTLTRQTYKQIEIGGVTYPAGVIIELPLLLIHSDPDIWGSDVHKFNPERFAEGISKASKDPGAFLPFSWGPRICIGQNFALLETKMALCMILQHLELELALSYTHAPQSIITLRPTHGAQIKLRAI

SEQ ID NO: 36540 - protein, 173 aa, Brassica napus
GDVLFDPHSGENYERDEDHLALMMELLGVMPRMIALGGRYSRDYFNRQGELRHIRRLRFWPLSKVLMEKYEFSEEDAVAMQDFITPILEFAPEKRPTAAQCLTHPWLNPVPRSLKSLPSPQKPKEEDSTDENKAKEKDEREAMEVGVGNIAIDGSEEKVSARAGRQSARDLRT

SEQ ID NO: 36541 - protein, 979 aa, Arabidopsis thaliana
MQTIIISPLVSHRLCLARAVPCNRLLNNHHRAPPSIRLSNHRSTTSLRLFSSAGSLCVCKSDAEYFAKAAASRDSEMATEDVQDPRIAKIASSIRVIPDFPKPGIMFQDITTLLLDTEAFKDTIALFVDRYKDKGISVVAGVEARGFIFGPPIALAIGAKFVPMRKPKKLPGKVISEEYSLEYGTDTIEMHVGAVEPGERAIIIDDLIATGGTLAAAIRLLERVGVKIVECACVIELPELKGKEKLGETSLFVLLTTLLQEENLKLKSFPIKSLFMAAAILVSPEKEEKMLCACSGEQFRFEDQPGSPESLATRDFSASGLSSRNGGGDWDSKLEDIQVDEAESTLKEALSLNYEEARALLGRLEYQRGNFDAALQVFKGIDIKVLTPRIIKAIVEKTLPCKPRSKAVIVPPTTMSMHSVSLLLEAILLKARSLEELGSYKEAAEECKIILDVVENALPSGMPDGISGFAKLQDIFQKALELLPLLWKKAGNHHETIASYRRALSRPWNLDPQRLAVTQKSLALVLLYGSVEACPKDNIEEAIVLLMLLVKKMVVGDIQWDPELMDHLTYALSMTGQFEVLANYLEQTLPGVYTRGERWYLLSLCYSAAGIDKAAINLLKMALGPSESRQIPHIPLLLFGAKLCSKDPKHSRDGINFAHRLLDLGNSQSEHLLSQAHKFLGVCYGNAARSSKLDSERVFLQKKSLFSLNEAAKRGKADPELDVIFNLSVENAVQRNVQAALDGAVEYSSMVGGVSTKGWKHLAIVLSAEKRLKDAESILDFTMEEAGDIEKIELLRLKAVLQMAQEQPKKAMKTCSSLLGLIRAQEKSEQSEKFETEAWQDLASVYGKLGSWSDAETCLEKARSMCYYSPRGWNETGLCLEAKSLHEEALISFFLSLSIEPDHVPSIVSIAEVMMKSGDESLPTAKSFLMNALRLDPRNHDAWMKLGHVAKKQGLSQQAAEFYQAAYELELSAPVQSFI

SEQ ID NO: 36542 - protein, 303 aa, Ipomoea trifida
KLCRLFTILDSCYAIYRFYVAEVLLALEYLHMLGVVYRDLKPENILVREDGHIMLSDFDLSLRCAVNPKLLKSSSPVGQPPKKMSSPCSDSSCIEPFCLHPSWQVSCFTPRFLSAAAKTRKLKADIAAQVTPLPQLVVEPTSARSNSFVGTHEYLAPEIIKGEGHGSAVDWWTFGIFMYELLYGRTPFKGTTNEDTLGNVVSQCLKFPETPMISSHARDLIRRLLQKEPENRLGSSKGATEIKNHSFFEGLNWALIRCATPPEMPRIFDLGNLISDTNSQKKQGGKCQKEGTSGEENIEFEMF

SEQ ID NO: 36543 - protein, 323 aa, Cyanidium caldarium
MKVNSKTLQSVKEDLLNIEQTLNKLIKVNNPILSAAAKHLLIVESKKIRPAIVLLVAKAIDKNKKIKTSQQRLAEVTEIIHTATLLHDDVVDESIIRRGTKSVNKTFGNKIAVFAGDFLFAQSSWYLANINNLEVVKAISKVITDLAEGELQQNLTQFNTYYSIIKYLEKSFNKTASLIAASCKSCCLLSDFDQSLNSKFYNYGKNLGLAFQIIDDILDITSSSTALGKMTTSDLKLGNLTAPVLFALTKNSKLFKIIEREFCEKSDISEAINIIKETNAIEESFDLAYEHIEAAINSIKDLPTSSEKDSLIEIAYDLLNRYK

SEQ ID NO: 36544 - protein, 338 aa, Cyanidium caldarium
MPNRQDCNLEANKISSQLALTFYYDMLLGRGFEDACAQMYYRGKMFGFVHLYNGQEAISTGVIKSLKTTDYVCSTYRDHVHAISKGVPPRSVMAELFGKETGCSRGRGGSMHLFSSFHRFLGGFAFIGEGIPIALGSAFKSMYSQQVCKSVQELDVTVCFLGDGATNNGQFFECLNMAGLWNLPVIFVVENNQWAIGMAHHRSTSQVEIYKKAAAFGINSCEVDGMDVVAVHKTAKEAILKARKGDGPTLIEALTYRFRGHSLADPDELRSKNEKDIWISRDPIKNFQSYVIRNKLLSQKQLIKVKDEVTQTINDALQFAIISPEPKLQDLHKYVFTH

SEQ ID NO: 36545 - protein, 747 aa, Bacillus subtilis subsp. subtilis str. 168
MCGLAGIINLAAPRSQECTFHILKGMADAISYRGPDDEQYHIDSKVGFAFRRLSILDLVNGQQPFLNEDGSIVVMVNGEIYNYKELKASLHNHMFKTTSDCEVIVHLYEEKGIGFVDDIIGMFSIAIWDKNKNKVFLVRDRFGIKPLFYTELKHELIFASEIKSLFSHPHCPRQFNWKEALSDICLSGEAASNHKETTSFFVNIQNLDAGHYLEINLTTNERKTASYWSLQDILLRQGYRENLHPDDLIEGYRELLADSVHRCLQSDVEVGLFLSGGIDSAAVAHFAAEKQDLHTFTVLSQSTFTNEDAKYAHWLAKDLHLPNHQVLYQLGNDELLQPESYKHLLWICETPFCGPEQLYKFHLHKYAKAIRPNLKVMLTGQGSDEFNGGYSTTLSPAENPSWEGFIESVNTMEMNRLHRLQGNIFRVWEEHFGLSPINLSYLKSNDSSQADPWQSYVLTKYRDLQMYNCWHEDRIAAANHIENRVPFLDHRLVEWVCGIPDGLRKDLLWDKSVLRKSLTNELHTSYTHRPKVPFFYGKDVRYTHKMMFHLLKKNNYQLIEEAFSHSDASSIIQVEHIHAIMTYLEDDPEFTNFEFLLRLVNMGLLSKMTKETPSVQLDITSHLESITIKDWHSQEGDIASRLNISANKCEGQDILALNPGVTLLRPESDSEHCIYIAEEGFIQFIVSEEDVGAWLHILCDINGKDTLHTILDRHGVSLEEVAKYIQEAIEHNIILIKQKNLPEGAYR

SEQ ID NO: 36546 - protein, 327 aa, Cyanidium caldarium
MSMMFLYEALRAAIDEEMGKDSNVFIVGEDVGHYGGSYKVTKDLHVKYGDLRVLDAPIAENSFTGMAIGAAMTGLRPIVEGMNMGFMLLAFNQISNNLSMLQYTSGGNFNIPVVIRGPGGIGKQLAAEHSQRLESCFQSIPGLQIVACSTAYNAKGLLKSAIIEKKPILFLEHVLLYNLKGFVPDEEYYLPLDKAEVVRSGSDVTIVTYSRMRYHVLAAVEKLVLNGQDPEIIDLISLKPLDLHTISKSIKKTHKIVIVEECAQTGGIAAELISLINTYLYDELDSPAVRLSSKDVPIPYNGNLEKSTLIQPDQIVDVVTNLLQYKT

SEQ ID NO: 36547 - protein, 326 aa, Arabidopsis thaliana
MAASNGEKSLIVSFGEMLIDFVPTVSGVSLADAPGFIKAPGGAPANVAIAISRLGGRAAFVGKLGDDEFGHMLAGILKQNGVSAEGINFDTGARTALAFVTLRSDGEREFMFYRNPSADMLLRPDELNLDVIRSAKVFHYGSISLIVEPCRSAHLKAMEVAKEAGALLSYDPNLRLPLWPSKEEAQKQILSIWDKAEVIKVSDEELMFLTGSDKVDDETALSLWHSNLKLLLVTLGEKGCSYYTKSFRGSVDPFHVDAVDTTGAGDSFVGALLCKIVDDRAVLEDEARLREVLRFANACGAITTTKKGAIPALPTESEVQSLLKGN

SEQ ID NO: 36548 - protein, 313 aa, Ostreococcus tauri
  misc_feature (1)..(1): Xaa can be any naturally occurring amino acid
XLRRAIERDRGRDGGESLDPSPDRALWVVWITRAKERLTRTFTSTQAPAVRRRCVAVNAGTGKFIVGGNWKCNGTAASVKDLVKALNAGKIDADVDVYVAPPFVFIPRVQAELNSEKYAIAAQNCWVSEGGAFTGEVSAEMLVDANIPWVILGHSERRALCGETSEFVGEKVKYALSKGLKVALCIGETLDQRESGKTMDVCYAQLKAVNDVITAADWDNVVIAYEPVWAIGTGKVATPDQAQDVHAGIRKWCASNISPEVASKIRIQYGGSVNASNCDELATKEDIDGFLVGGASLIGDAFVTICNSAKNSK

SEQ ID NO: 36549 - protein, 264 aa, Oryza sativa (japonica cultivar-group)
MEREELLEQRATATGPSRDGSATAGRRRRRIAHGAAGDALRVGAMRGGGGGLDFFASRSHAARLVDLITSPWPTRVVTSKHTAPSSHAPRCPRKPRSRVCTGNVVEAVRHECSIMGEIRALHNMDDDEVFAYANRIAAPYDLVMQTKQLGRLPVVQFATGNVATPADAALMMQPGCDGVFVSSGIFKSGDPARRAHAIVQAVTHCRSSRPSTPPPRRPRWHTFAVELCPVCRDREREEEMNGEKERKKNREREIDKWAHRQICL

SEQ ID NO: 36550 - protein, 245 aa, Ostreococcus tauri
MSAALERLDDFKVHAAMYFNAIDVSSEFRADELRLSREAAERGVMISAATKDEASFERHAAQAKAAYEACERFPDGMIERSANEPLIIGLNLLRLLVQNRIAEFHTELEITNAETLADGRVQAVLELERFLMEGAYNKIAANRGALPDPSYEHFMSMLMDTVRDEIASCAQSAYARLSRDDATRLLGFSSASEFEVYARSREWTIDGNGTVIFNEEIAPASAKDIPSASLISQTLLYAKELERIV

SEQ ID NO: 36551 - protein, 348 aa, Brucella abortus
MTGEDMQAIIDAEQSFKFPVLVGDIGGTNARFSILVDSNAEPKEFPVLQTADYATIDEAIQHAILDQTAIQPRSVILAVAGPVDGDEIDLTNCDWVVRPKKMIADLGFEDVTVLNDFEAQALAVVSLEGHHMEQIGGKPEEAVATRVVLGPGTGLGVAGLFRTRHAWVPVPGEGGHIDIGPRTERDYQIFPHIERIEGRVTGEQILSGRGLRNLYLGICAADKITPTLETPVDITSAGLDGSNPQAAETLDLFATYLGRLAGDLALIFMAHGGVYLSGGIPVRILSALKAGSFRATFEDKAPHKAIMRDIPVRVITYQLAALTGLSAFARTPSRFEVSTEGRRWRMRR

SEQ ID NO: 36552 - protein, 623 aa, Rhodopirellula baltica SH 1
MVKNWNCRYKEPNTNLRSFDRRKSHRIFDSMSTDASETNAAPTDAPAKPIKLSPVEKIKQESGFLKGSIDVELADPVDHFDNANIQLLKFHGTYQQDDRDKRAELKKSGGGKAYSMMIRCRIPGGRLSSDQLVAHLDMCDELGDSTLKITTRQTLQLHGILKGDLRETIRRINEVELSTLAACGDVNRNIMCCPAKRVGGIHAQLNEFTDELTEALAPQTPAYHELWLTDPDTGEKTLAGGGEPEASSAPVIDEPLYGPTYLPRKFKVGIALPDDNCIDIYTQDLGFLAVIRDGQIIGYNVSVGGGMGRTPSAKKTFPALAKRMAFVTPEQAIDVAKAVIIVQRDNGNRSDRKVARLKYLIADWGIEKFRAEVEKVFGGPLADCTEDDVHEFDDHMGWQEQGDGKLSYGLNIENGRLYDNEQVQVKAAIRAVCARFNREIRLTSHQSMIFCDIDPSEKEELIEILKSHGLRTTEETSTVRRWSIACVALPTCGLAITESERRLPSIIDSIEEPLAKLGLSNERFTIRMTGCPNGCARPYNADLALVGRAVGKYTLFAGGGWLGNRLAYIYKDQVKDEDVTAELTGIFAAFKANREEGESLGTFCDRVGAEKLAELAEAAPLPA

SEQ ID NO: 36553 - protein, 254 aa, Pichia finlandica
MSYNFHNKVAVVTGALSGIGLSVAKKFLQLGAKVTISDVSGEKKYHETVVALKAQNLNTDNLHYVQADSSKEEDNKKLISETLATFGGLDIVCANAGIGKFAPTHETPFDVWKKVIAVNLNGVFLLDKLAINYWLEKSKPGVIVNMGSVHSFVAAPGLAHYGAAKGGVKLLTQTLALEYASHGIRVNSVNPGYISTPLIDEVPKERLDKLVSLHPIGRLGRPEEVADAVAFLCSQEATFINGVSLPVDGGYTAQ

SEQ ID NO: 36554 - protein, 472 aa, Coccidioides immitis RS
MNPPTPLSASSTTSTASQNSQPPDGEQITQVMEGMHLHGSQKANGAALPQKPPRPRMTNPFSRMFSQTGRAAHREIENMKETASDTSTQSKSSSKSAAVVDGSEKATSPKPTPKQQTDKRPEDKKPGREPVQPMKRFDMLPDGNHVHYLKSAKRQEKLSSMLRDMLGGGKKKDDHVEDQQLSLMSTWVDQLKTERDKLASDKKGGPNNTASLVDKYGKCQEIVGRGAFGIVRISHKVDPKDSKTEQLYAVKEFRRRPQETAKKYQKRLTSEFCISSSLRHPNIIHTLDLMQDSKGDYCEVMEYCAGGDLYTLILAAGKLEVGEADCYFKQLMRGVEYMHEMGVAHRDLKPENLLLTTHGALKITDFGNGECFRMAWEKEAHMTAGLCGSAPYIAPEEYTDKEFDPRAVDVWATGVIYMAMRTGRHLWRVAQKDEDEFYERYLEGRRDEDGYAPIETLHRACRPQFIIQVMSM

SEQ ID NO: 36555 - protein, 300 aa, Synechococcus sp. WH 7805
MTDAGLNQSADAGARLAIRLLQDAAQRGDLDPWDVDVIAVVDGFLDQLKQRIDVPRRMAEAMASRGGSYERDLADSSEAFLAASVLVSLKAEVLEAQTFPPAPVFEEAFEADCADQGWLDPSFDLPRRPEKHLKRRPVAPPPLRRAVTLGELIEQLESIAEQIESDELDMRRRQRQKRYSNREAIAQVAALAHREKLPETTAALGLYLKNWEQALQWVNFETLVEHWSDAAAPDLDKDRVGVFWALLFLSSQGQVELEQFGVLHGPIQLRRVLEPGQIAQLPLTSLDVPAVPPAKAAMAA

SEQ ID NO: 36556 - protein, 614 aa, Magnetospirillum magnetotacticum MS-1
MSETTLKITTGPLPGSRKIYVEGSRPDVRVAMREIDLTPGSGEAPVRVYDCSGPYTDPSMQVDITKGVPRLREQWILERGDVEHYDGRAHKPEDDGLKPGEVIGVPVFDRAAQGLRPLRAKPGKAPTQLAYARAGIITPEMEYVAIRENMKRAELHAAIVRDGEDFGADIPDEVTPEFVRAEIARGRAVLPANVNHPEAEPMIIGRNFLTKINANIGNSAVASSVDEEVEKMVWATRWGADTVMDLSTGRHIHATREWIIRNSPVPIGTVPIYQALEKVDGKAEDLTWEIFRDTLIEQAEQGVDYFTIHAGVLLRYIPLTAKRTTGIVSRGGSIMAKWCLAHHKENFLYTHFEDICELLKAYDVGFSLGDGLRPGSIADANDAAQFGELETLGELTHKAWAHDCQVIIEGPGHVPMHKIKKNVEKQIELCGEAPFYTLGPLVTDIAPGYDHITSAIGAAMIGWFGTAMLCYVTPKEHLGLPDKQDVREGVVTYKLAAHAADLAKGHPGAQVRDNALSRARFEFRWKDQFNLSLDPEKALAFHDQHLPAEGAKLAHFCSMCGPKFCSMKISQEVRDFAAAEQGMAEMSEKFVHDGAEIYHTEPVQAQQQAKPAAE

SEQ ID NO: 36557 - protein, 315 aa, Glycine max
  misc_feature (93)..(93): Xaa can be any naturally occurring amino acid
  misc_feature (136)..(136): Xaa can be any naturally occurring amino acid
MMASPTSPRVLFLSLFVTLSMILHLSSARKLSESDPQLQFQYHRGPLLTGKISVNLIWYGKFKPSQKAIVADFITSLSSSKPLTAQPSVATWXWKATDKYYKNSFPKLALSLGSQIVDENYSLGKSLTTNQILKLXSKGPQRNAINIVLTSAEVAVEGFCSSRCGTHGSSVGARVNGKRYKFAYMWVGNSETQCPGQCAWPFHQPIYGPQNPAPLVAPNNDVGLDGMVINVASLLAGTVTNPFGNGYFQGPKEAPLEAGSACTGVYGKGAYPGYAGNLLVDPTTGASYNANGVNGRKYLLPALVDPKTSSCSTLV

SEQ ID NO: 36558 - protein, 126 aa, Pseudomonas syringae pv. syringae B728a
MTKTVITSDKAPAAIGPYSQAIKAGNTVYMSGQIPLDPSTMELVEGIEAQITQVFENLKSVAEAAGGSFKDIVKLNIFLTDLGHFAKVNELMSTYFTQPYPARAAIGVAALPRGAQVEMDAILVIE

SEQ ID NO: 36559 - protein, 585 aa, Kluyveromyces lactis NRRL Y-1140
MSFQLFAKTNSTVEVFQGYPSFEEISSSKSGNDGTEGKVIQSLLSPCGRFMAKSYESKVVLLIGETWEITLVELPLKNVYDLKFSPSGNFLSTWERPLVDDTEHLNCKIWNLNESPLSTEPKYSYKASTQSSWTLQFSKLDDYAIKSFGKELRIIKLSGEDTFKFDKPFATLTPDQPFTTYQISPAEHPTICTFTKEKSGKPAQLTIWPITTGKITKQIVTKQFFKADSCHLKWSDLGNAILCLTTTDFDHSNKSYYGENNLYLLSFQGVNGALGGESVRVSLGKEGPIHDFNWSPTSRQFGVIYGFMPATITFFDLKGNAIHSLNEQRKNTLEFSPNGKYILVGGFGNLQGSVDILDRHDKFRCISKFSATNTSVCKWSPGGEFILTATTSPRLRVDNGLKIWHYSGTLVFVKEYKELLKVDWRTNCPFRIIKDGYVTNGNKLKDEELKQDPKIRKHQLEIHPVVTQFNLKNPNKSSTNLGAKKTTGAYKPPHARKATVVPGTTKTRAPQSTPTPPLQQSAASQTSPEEKKIRSLLKKLRAIESLKVKQTEGVKLENTQVTKIQSEPKILKELELLGWKGELDS

SEQ ID NO: 36560 - protein, 314 aa, Corynebacterium glutamicum ATCC 13032
MALEPQIKSAPTPVILIVEPYGGSIRQQNPNLPMVFWDDAALTRGDGIFETLLIRDGHACNVRRHGERFKASAALLGLPEPILEDWEKATQMGIESWYSHPNAGEASCTWTLSRGRSSTGLASGWLTITPVSSDKLAQREHGVSVMTSSRGYSIDTGLPGIGKATRGELSKVERTPAPWLTVGAKTLAYAANMAALRYAKSNGFDDVIFTDGDRVLEGATSTVVSFKGDKIRTPSPGGDILPGTTQAALFAHATEKGWRCKEKDLSIDDLFGADSVWLVSSVRGPVRVTRLDGHKLRKPDNEKEIKALITKALG

SEQ ID NO: 36561 - protein, 386 aa, Corynebacterium glutamicum ATCC 13032
MSLMKPSTRSNVQPFRVMQMLDRVHRRRREGKDTLMFCAGQPSTGAPEAVIEEAEIALRSGPLGYTEVIGDREFRERIADWHSATYDVDTNPDNVIVTTGSSGGFVASFIATLDHGDYVAMPTPGYPAYRNILESLGAKVLNLRCTAETRFQPTAQMLEELPHKPKAVIVTSPGNPTGTIIDPEELERIAKWCDDNDAVLISDEDYHGMSFGRPLATAHQFSKNAIVVGTLSKYFSMTGWRVGWIIVPDELVTPIENLQASLSLCAPAIGQAAGRAAFTLEAGAELDAHVEAYREAREVFVDKLPEIGLGTFADPDGGLYLWVDVSAYTDDSEEWALRLLDEAGVAVAPGVDFDPEEGHKWIRLSLCASKEDTIEGVRKIGEFIKK

SEQ ID NO: 36562 - protein, 371 aa, Pisum sativum
MGFLLPTLFLSLLLLFSSHQTKAHQLNNFNTTITTKTTTISNSSNERKLAGTCNLFRGKWVYDASYPLYDPSSCPFIDPQFNCQKYGRPDTQYQKYRWQPLTCSLPRFNALDFLAKYRGKKIMFVGDSLSLNQFNSLACMIHSWVPKTRTSFSKQSAISTITFQDYDLQLFLYRTPYLVDLDRENVGNVLKLDSIKSGDAWRGMDVLIFNTWHWWTHTGNAQPWDYIQEGGKLYKDMNRFIAFYKGLTTWARWVNINVNPTQTKVFFLGISPVHYEGRDWNQPAKSCMRETQPFFGLKYPAGTPMAWVIVNKVLNRLKKPVYFLDVTTLSQYRKDAHPEGYSGVMSTDCSHWCLPGLPDTWNVLLHAALFG

SEQ ID NO: 36563 - protein, 924 aa, Arabidopsis thaliana
MLEPRGADIPILFLVLVVLPVVAYILLGKWSNISEKRVRANLLAQMAAEEALRAETVVNADRGVRFESVATENRAQRTRTKTVSAGGGAVRAEFDAGARETVAEQRSDSVTATCGVTVVAPVNNNELHVCARCFGPAKTRCSRCKSVRYCSGKCQIIHWRVAHKDECVPVESCSSSSERVSFEKDSVLYDHGMDSTMYSNNTTQAAKGKTSKSSVDFASLGISQNDITPQINTQGRKSVGKQHSSKANRESCRRDSATVFDSSDEAASAGGDNKTSHIKHKSRGNSYAAETNPRRHSVDSSAVQMNGQSFVSGMQESHKHENNLGVRSSFGCPNTQYPSNGTRTATLPRTGINKSGEQSCTETSKKGQVAAVSKTVRSKDTGISEESNGISSTMGIMKMMGLRNSTKHDDRYKNLKMLFPYEEFLKFFQCEVFDLSPRGLVNCGNSCYANAVLQSLTCTKPLVAYLLRRSHSRSCSGKDWCLMCELEQHVMMLRESGGPLSASRILSHMRSINCQIGDGSQEDAHEFLRLLVASMQSICLERLGGETKVDPRLQETTLVQHMFGGRLRSKVKCLRCDHESERYENIMDLTLEIYGWVESLQDALTQFTRPEDLDGENMYRCSRCAGYVRARKELSIHEAPNILTIVLKRFQEGRYGKINKCISFPEMLDMIPFMTRTGDVPPLYMLYAVIVHLDTLNASFSGHYISYVKDLRGNWYRIDDSEIHPVPMTQVMSEGAYMLFYMRSYPRPQRGEHNGKAPVHHSQPRNEMKEQRKPVNRFKPRADHKNTESSSSEWSLFTSSDEASFTTESTRDSFSTIDYTDVCHVVDSSSPFAIFNNVYHNVEPSPHNTVACRMFSGTKPETRYFVEQETNHNNTVVLDATPSLYPIPAPYPPHDYYDQSMYVNYETNPEFNNGQDQDRTYSYW

SEQ ID NO: 36564 - protein, 371 aa, Pisum sativum
MGFLLPTLFLSLLLLFSSHQTKAHQLNNFNTTITTKTTTISNSSNERKLAGTCNLFRGKWVYDASYPLYDPSSCPFIDPQFNCQKYGRPDTQYQKYRWQPLTCSLPRFNALDFLAKYRGKKIMFVGDSLSLNQFNSLACMIHSWVPKTRTSFSKQSAISTITFQDYGLQLFLYRTPYLVDLDRENVGNVLKLDSIKSGDAWRGMDVLIFNTWHWWTHTGNAQPWDYIQEGGKLYKDMNRFIAFYKGLTTWARWVNINVNPTQTKVFFLGISPVHYEGRDWNQPAKSCMRETQPFFGLKYPAGTPMAWVIVNKVLNRLKKPVHFLDVTTLSQYRKDAHPEGYSGVMSTDCSHWCLPGLPDTWNVLLHAALFG

SEQ ID NO: 36565 - protein, 204 aa, Pisum sativum
FLPDSKHVTASEDDNWILGCLLLLASSVFWSCWMIMQVPISSSCPDHVLSTFWMCLFATIQSAMFALLKEPDLQAWILPSPLQISCSLYAGIGIAVSFFIQSWCISERGPLYCAMFNPLATVITALVAATFLEEKLYVGSLVGAIGVTVGLYIVLWGKAKDFDGTKQELPQSNMVDDERSNRTDLEEPLLAEKSEYVAEIKMEG

SEQ ID NO: 36566 - protein, 374 aa, Pediococcus pentosaceus ATCC 25745
MAANKDYYDILGVSKDASDDEIKKAYRKLSKKYHPDINKAPDAEQKFKDVNEAYEVLGDSQKRAQYDQFGSADPNAGFGGGGFGGQGGFSDFGGGFEDIFGSFFGGGQRQSPNQPRQGEDLQYQMSLKFEEAIFGKKTTIKYSREALCKTCGGSGAKEGTSPVTCHKCNGTGTIQVTQNTPLGRMVRQQTCDVCNGTGKEIKEKCPTCGGTGHTSQQHEVKVSVPAGVEDGQQMRLQGQGEAGFNGGPYGDLYIIFQVQPSDMYERDGSEIYYNQTISFVQAALGDEIEVPTVHGKVKLKVPAGTQTGTNFRLKGKGAPRLRGNGTGDQHVKVKVTVPKKLNSGQKEALKQFAKASGEEPSGHGKSGFFDKFMN

SEQ ID NO: 36567 - protein, 204 aa, Pisum sativum
FLPDSKHVTASEDDNWILGCLLLLASSVFWSCWMIMQVPISSSCPDHVLSTFWMCLFATIQSAIFALLKEPDLQAWILPSPLQISCSLYAGIGIAVSFFIQSWCISERGPLYCAMFNPLATVITALVAATFLEEKLYVGSLVGAIGVTVGLYIVLWGKAKDFDGTKQELPQSNMVDDERSNRTDLEEPLLAEKSEYVAEIKMEG

SEQ ID NO: 36568 - protein, 263 aa, Crocosphaera watsonii WH 8501
MSMIDKPKILALDFDGVICNGLKEYFQTTLRTYQKLWKDDSQNDLEIWANSFYKLRPVIETGWEMPILLRALVLQYEQDNIESNWHNVCSEIVTKENLNKQQVMSALDGVRDHWIQTDLDNWLALHEFYPGVLEKLGKLLDSSTLLYIVTTKEGRFVKQLLKKQNLSFPEDHIFGKEVKQPKFDTLRQILKINQETPNNLWFIEDLLKTLNKVKSQEYLTEVNLFLADWGYNTIKSHELVKQDSTINLLSLYTFSQDFSEWIK

SEQ ID NO: 36569 - protein, 412 aa, Rickettsia rickettsii
MPIKILMPALSPTMTEGNLARWLKKEGDKVNPGEVIAEIETDKATMEVEAVDEGILAKIVIPQNSQNVPVNSLIAVLSEEGEEKTDIDAFIAKNNSVSPSPKTDANLLKPHESITNVEEQVTVIKHDASKIFASPLAKRLAKMRNIRFESVKGSGPHGRIVKQDILSYTPSTAHNKIVSRNPEEYRLVPNNNIRKIIAKRLLESKQTVPHFYLSIECNVDKLLDIREDINKSFSEDKSTRISVNDFIILAVAKALQEVPNANASWGEDAIRYYNNVDISVAVAIENGLVTPIVKNANQKNILELSREMKALIKKAKDNKLTPEEFQGGGFTISNLGMYGIKNFNAIINPPQSCIMGVGAIAKRAIVKNDQITIATIMDVTLSADHRVVDGAVGAEFLAAFKKFIESPVLMLI

SEQ ID NO: 36570 - protein, 483 aa, Debaryomyces hansenii CBS767
MSPVLKRFLKPRPIISLRFHSSGQSQSINTFQTAVETAEKLVQPQNDNTFNDPFSIVSHEMSNLAKLIANLIGSGHPTLNRVSSYYFEADGKNVRPLIVLLLSKALLNIPIEERNRITIDSSDVTTQPQFAGTPSNDSIAGKSVDESISPLTILHGINPKVILDPLSKPMDELPKFDALNGILPKQRRLAEIVEMIHTASLLHDDVIDLSDTRRGRPSGNIAFSNKMAVLAGDFLLGRASVAIARLRNPEVIELLSTTIANLVEGEFMQLKNTVMSNEGPDSITNDGDIKNIPKATGKVPTVEHEYSVTAPGEVDHNTNVSAAFEYYLHKTYLKTASLMSKLSRAAGVLSGSQDNIIENCYDFGRNLGLCFQIVDDMLDYTSSDTSFGKPSQADLKLGLATAPILFAWKERPELGELIARKFGEEGDVEVARKAVEECGGLEKTREMAQDYCYKALENLRVLPESDARSALEFLTNSVLTRSK

SEQ ID NO: 36571 - protein, 707 aa, Zea mays
  misc_feature (413)..(413): Xaa can be any naturally occurring amino acid
NSRVDPRVRILGVVTPTMAIVLLALLLFPSAYAQPWSVCGNTGNYTAASTYQDNLSQLAASLPKKASSNTSPLFATGTAGAVPDLVYALALCRGDINASACKDCVTIGFEDAQQLCAFNKEATVYYDSCLVSFSNEDFLSTTVNGNENEVTVLMDAQNFTESADYIRLLLFTLLNDTSESAINSIRRFTTARMDISSLPTIYCAVQCTPDLTADECAACLQDFPQVTLQYLDGQRGGRLLGVRCNMRYEIYKFYQGDPMLRIISLASAVPTIGKTPPGTPVTVYPQPPPAAPPAPQMITTPIAAQEETGRKGKLWIIGIAIPLVAILLCSTFTFLWLRRPKKGVLSSQDRAGANRIEENALVWTIEQKSSEFTLFDLSELLEATKSFAEENRLGQGGFGPVYKGQLSDGQDSXIAVKRLASHSGQGFTEFRNEVELIAKLQHTNLVRLLGCCIQAEEKILVYEYLPNKSLDFFIFDERQSSLLNWYKRRAIIEGVAQGLLYLHKHSRLRVVHRDLKASNILLDQDMDPKISDFGLARICSSNDAEGNTKRVVGTYGYMSPEYASEGIYSVKSDVFSFGVLLLEILSAKRNSGFHQYGDFLNLLGYTWHLWEIGRWLDLVEASISKEMHEAEARRYINIALMCVQENADDRPTMSDVVAALNSESVVLPEPKHPAYFNLRVSKSVESAVVVEACSLNEMTITQDPQGR

SEQ ID NO: 36572 - protein, 501 aa, Thermotoga maritima MSB8
MVLVVDYGSQYSRLITRRIRENEVYSEVVFPDDKVDLSKVDAVILSGGPRSVYEEDAPKLPEWFQEYKGPVLAICYGMQLIVKELGGEVRRGRGEYGRTLVELSRDPIFEGIPEKVHVWMSHGDEVVRLPEGFHPIAVSETGVIAAATDGKRFWLLQFHPEVHHTEYGDRMISNFLFNVCKLEKNWKIGDLVEEKIRHIKETIGNKKAILALSGGVDSSVAAVLVHRAIGKNLVCVFVDHGLLRKNEREEVERVFKEHFDMNLVVVDARKRFLEKLRGVTDPEKKRKIIGEEFIRVFEEEAKKHDVEFLVQGTIYSDVIESAASGKTTAKIKSHHNVGGLPEKMNLKLVEPLRDLFKDEVRKVGKYLGIPDRIINRHPFPGPGLAVRVLGEVTEEKLEILREADYIFIETLRKHDYYDKVWQAFAVLLPIKSVGVKGDARAYEYVVALRAVNSVEGMTADWSRIPHDILDEAARRITREVKGVGRVVYDITSKPPATIEWE

SEQ ID NO: 36573 - protein, 493 aa, Mentha x piperita
MAALLVFFSVSLILLAVLFHKRKSSLSSRKRPPPSPLRLPVIGHFHLIGALSHRSFTSLSKRYGEVMLLHFGSAPVLVASSAAAAREIMKNQDVIFASRPRLSIFDRLMYSGKGVAFAPYGEHWRNARSMCMLQLLSAKRVQSFGGIREEETSAMIEKIRRSKPTTVVNLSEMFMALTNGVIHRAVLGRKGDGGDDFNRILIKVIKLLGSFNVGDYVPWLSWINRINGVDAEVEKVGTKLDGSMEGILRKYRRKKVGDDETNFVDTLLQFQRESKDTDPVEDDVIKALIFDMVSAGTDTTFAALEWTMAELIKNPRTLKTLQNEVREVSRNKGGITEDDVDKMPYLKAVSKEILRLHPPFAILLPRELTQDANMLGYDIPRGTVVLVNNWAISRDPSLWENPEEFRPERFLETSIDYKGLHFEMLPFGSGRRGCPGSTFAMALYELALSKLVNEFDFRLGNGDRAEDLDMTEAPGFVVHKKSPLLVLATPRQS

SEQ ID NO: 36574 - protein, 344 aa, Rhodococcus sp. RHA1
MSTLTNRLYRLRSRPEGEVTADNLEWLEEPVAEILDGQALIRTHYLSVDPTNRVWMSAMRSYIPPVELNAVMRGAGVGRVVASRRDDLPVGSFVVGLTGWQDYCVADAASEDMSFTVLPDPLPAPLPAFVGVLGHTGISAYLGVEFGDPRPGETVFVSAAAGAVGSIAGQLAKQRGARVVGIAGGAEKCRYLVEELGFDACIDRHAGDWQKQLDDATPEGIDVDFENVGGEIMDHVFGRLNIGARITLCGLVSEYNDYNGDNAQRGLRNVSQLLMQRATLRGFIVFDHVDRYAEIIGQLSQALSAGTLHSAETVVDGLEHARHTLNRSLAGENRGKVVVKVITE

SEQ ID NO: 36575 - protein, 706 aa, Bordetella pertussis Tohama I
MYPSLPDRLLPGLPAPLGATSDGLGVNFAVFSANAARIELCLFDARGRKELARLPMPECTDEVWHGYLPDAQPGLVYGYRAHGPYNPRAGHRFNPHKLLLDPYATALTGALRWSDALFGYRMQHPRADLSMDRRDSAAGVPKAVVTEPAFHWGATRRPAAAWAHTVIYEAHVRGVSMLRSDLREPIRGTCAALSDPRFIDHLHRLGVTALELMPVHAFLQDRTLVERGLRNYWGYNTLAYFAPEPAYLADGQPHDLRRAIRRLHAAGIEVILDVVYNHTCEGNELGPTLSWRGLDNASYYRLVPGDERRYIDDTGTGNTLNLSHPRVLQMVMDSLRHWAVHYRVDGFRFDLGVTLGREGTGFDAGSGFFDALLQDPVLARVKLISEPWDVGPDGYQLGRHPPGMAEWNDQFRDTARRFWRGDAGMAGALATRLTASRDVFDHRHRRPWSSINFAAAHDGFTLQDVVSFAERHNEANGEDGADGHGENYSSNWGVEGAASSAAIRETRARVQRALLATVMLADGTPMLLAGDEFGNSQGGNNNAYCQDGPMGWLDWAVAQSTPGRALTAYAARLAGLRRAHPSLRATRYGDPAHQWQEGLGAIDWFNGRGAPMTSADWDAPEGRLLVLRRALPDPAQPGRVDVTLLLCNAAAEPRPCVLPAPTLAWTLALDSASPEAPAAPCDGGEAIVGARAVLLLTASVDGAHAP

SEQ ID NO: 36576 - protein, 165 aa, Bacillus cereus
PMVAAMVTPFDINGNIDFAKTTKLVNYLIDNGTTAIVVGGTTGESPTLTSEEKVALYRHVVSVVDKRVPVIAGTGSNNTHASIDLTKKATEVGVDAVMLVAPYYNKPSQEGMYQHFKAIAESTPLPVMPYNVPGRSIVQISVDTVVRLSEIENIVAIKDADGVVY

SEQ ID NO: 36577 - protein, 178 aa, Bacteroides fragilis NCTC 9343
MIMSKEKLIKSIREVPDFPIPGILFYDVTTLFKDSERLQELSDIMYEMYKDKGITKVVGIESRGFIMGPILATRLGAGFIPIRKPGKLPAETMEESYDKEYGKDTVQIHKDALNENDVVLLHDDLLATGGTMKAACNLVKKLHPKKVYVNFIIELKELNGKQVFENDQDVDIQSVLSL

SEQ ID NO: 36578 - protein, 188 aa, Bacillus cereus
SDGGRDVGPQTAKGYIDAANEVIKETGVGQFATVSGRYYSMDRDKRWDRVEKCYSAMVNGEGSTYKSAEECVEDSYANGIYDEFVLPSVIVNEDNTPVATINDDDAVIFYNFRPDRAIQIARVFTNEDFREFDRGEKVPHIPEFVCMTHFSETVNGYVAFKPMNLDNTLGEVVAQAGLKQLRIAATIG

SEQ ID NO: 36579 - protein, 463 aa, Mesorhizobium loti MAFF303099
MAGYDYDLFVIGGGSGGVRAARVAATLGKRVGIAEEYRFGGTCVIRGCVPKKLYVYASQFPEHFADAAGYGWTVPEASFNWQTLVANKDREISRLEAIYKKNVEGAGGETFPSRAMIVDPHVVHLLDDDRTVTADQILIATGGRPAAHPALPGHEHCIFSNEAFDLKELPKAIMIEGGGYIAVEFANIFHGLGVDTTLVYRGKEILSRFDMDLRRTLHETMEKKGIKILCHAVSERVHKRPDGRLDALLTSGQTLTVDQVMLAIGRIPNTENMGLEGIGLEMTQAGAIKVDEYSRTNIDNIWAIGDVTNRVQLTPVAIHEAMCFVETAFKGNPTAPDHDTIATAVFSQPEIGTVGLSEDEAVKRFADVEIYRASFRPMRHTLSGRDEKMLIKLVVDGASRKVLGAHILGPDAGEMAQLLGIPLKAGLSKDDFDRTMAVHPTAAEELVTMYKPTYRVKDGQRVQ

SEQ ID NO: 36580 - protein, 243 aa, Mesorhizobium loti MAFF303099
MDARQLKVEAARAALAHVSDGMRLGIGTGTTAEEFVRLLADKVATGMTVIGVPTSERTAALCRELGVPLSTLEETPELDLTVDGADEVDPELTLIKGGGGALLREKIVAAASQRMIVIADRSKMVETLGRFPLPIEVNQFGLRATEIAIAKTAADLGLSGPITLRMTGGQAFVTDGGHFILDASFGRIPDTRALSNALHAIPGVVEHGLFIGLASTAIIAGGDGIQTVHAARKPGSSTNHDVA

SEQ ID NO: 36581 - protein, 388 aa, Phormidium lapideum
MKLAARVESVSPSMTLIIDAKAKAMKAEGIDVCSFSAGEPDFNTPKHIVEAAKAALEQGKTRYGPAAGEPRLREAIAQKLQRDNGLCYGADNILVTNGGKQSIFNLMLAMIEPGDEVIIPAPFWVSYPEMVKLAEGTPVILPTTVETQFKVSPEQIRQAITPKTKLLVFNTPSNPTGMVYTPDEVRAIAQVAVEAGLWVLSDEIYEKILYDDAQHLSIGAASPEAYERSVVCSGFAKTYAMTGWRVGFLAGPVPLVKAATKIQGHSTSNVCTFAQYGAIAAYENSQDCVQEMLAAFAERRRYMLDALNAMPGLECPKPDGAFYMFPSIAKTGRSSLDFCSELLDQHQVATVPGAAFGADDCIRLSYATDLDTIKRGMERLEKFLHGIL

SEQ ID NO: 36582 - protein, 347 aa, Colwellia psychrerythraea 34H
MNNKKTTSIKRIALLTSGGDAPGMNAAIRSVVLAAHHYHIEVIGFYHGYNGLVCEEHIAMAEPLTLLKVNSIIHLGGTILKSARCQLMHEAKGLQLAADTLNDKNIDALVVIGGDGSFSGLLALQAYWSGQMIGIPGTIDNDLDGTDYTIGFATAVNTGIEAIDKIRDTADAFERIFIVELMGRHCGHITFNVGIACAAEQVLSFENFNANEQSSKLQQLATEITTAKKNRHSSYIIVIAENLWPGGAVELARQLHLQADIECTPCILGHIQRGGSPIAKDRILATKMGVAAVQALIDGESNIMVAEQNNAMNFITLDEAIKHKKVVSKQLIDAQQNILALTAQTQC

SEQ ID NO: 36583 - protein, 430 aa, Bacillus subtilis subsp. subtilis str. 168
MRSYEKSKTAFKEAQKLMPGGVNSPVRAFKSVDMDPIFMERGKGSKIFDIDGNEYIDYVLSWGPLILGHTNDRVVESLKKVAEYGTSFGAPTEVENELAKLVIDRVPSVEIVRMVSSGTEATMSALRLARGYTGRNKILKFEGCYHGHGDSLLIKAGSGVATLGLPDSPGVPEGIAKNTITVPYNDLESVKLAFQQFGEDIAGVIVEPVAGNMGVVPPQEGFLQGLRDITEQYGSLLIFDEVMTGFRVDYNCAQGYFGVTPDLTCLGKVIGGGLPVGAYGGKAEIMEQIAPSGPIYQAGTLSGNPLAMTAGLETLKQLTPESYKNFIKKGDRLEEGISKTAGAHGIPHTFNRAGSMIGFFFTNEPVINYETAKSSDLKLFASYYKGMANEGVFLPPSQFEGLFLSTAHTDEDIENTIQAAEKVFAEISRR

SEQ ID NO: 36584 - protein, 183 aa, Aspergillus nidulans FGSC A4
MASSTGAGWAQLRQQARSLETQTESLFHTYSQYASMTKLPPQPAEEEIRNEHQIRDLLEKRESLLAQLARLLDSEATLTSSALKQNNLARHREVLAEHKRELSRLTAAIAELRDRANLLSNVRSDINAYRSSNPAAAESEYMLEERRRIDESHGVIDGVLSQAARHFRALTGGLWALPAKSRG

SEQ ID NO: 36585 - protein, 394 aa, Zea mays
  misc_feature (236)..(236): Xaa can be any naturally occurring amino acid
MFRLRNCILPHLLFSSRRSSSCITPLHRLLSGSAATTASNPFTVADYLVARCGLSREQVLKASKIKRILDLRSPSKPDVVLAFLAGLDISGTDLTTVIANDPRLLCTDVGKTLSLRVAELRSLGLSSHQVGQVVIAAQIRFRSPSFLRNFEFWLGLFGSFDELLRFVKMNGNLLSVNLEKVAMPNLALLQRCGMEISDIPNTFLSRILVRSTEHLQETLARVSEFGIQQGSWVFPXAFMRFAILNREKLDSNIQLFEKLGWSRDDIASAVRKAPNILSLTPERVHKKLDFLMGVVGLQMAVIVYRPVLLLHSVERRLLPRYYLMKFLKNRGLMSSSLSFLTIASMGNDNLLDKLVHPHEMSVPGLAAAYASSCAGKHQWELLDDMTKGKRKRKC

SEQ ID NO: 36586 - protein, 447 aa, Bacillus halodurans C-125
MSIIQFPKEMKWGVATASYQIEGAINAGGRGASIWDVFAKTPGKVKNGDNGDVACDSYHRYEEDIEIMKDLGVDMYRFSVAWPRIFPNGTGEVSREGLDYYHRLVDRLTENGIQPMCTLYHWDLPQALQEKGGWDNRDTIDAFVRYAEVMFKEFGDKINHWITFNELWCVSFLSNYIGVHAPGNTDLQLATNVAHHLLVAHGKAVQSYRKMGLDGQIGYAPNVEWNEPFSNQMEDAEACKRGNGWFIEWFMDPVFKGAYPSFLVEWFEKKGITVPIEAGDMETIQQPIDFLGINYYTGSVARYKENEGLFDLEKVDAGYEKTDIGWNIYPEGFYKVLYYITEQYGQIPIYITENGSCYNDEPVNGQVKDEGRIRYLSQHLTALKRSMESGVNIKGYMAWSLLDNFEWAEGYSMRFGIVHVNYRTLERTKKDSFYWYKQMIANQFFEL

SEQ ID NO: 36587 - protein, 315 aa, Mycobacterium smegmatis str. MC2 155
MRFELSALIDPQLLSLVEESREFYADRPPGRGPAGVSELLALRETMPEPAECWPPPSVETVSAGGRSVPVRIHAPISRPAAGVLLEIHSGGFYLGSAADSDVRNRRLVNALGVAVVSVDYRLAPEHPWPAAPDDCETAALWLVENAEQRFGTTRLVMTGLSAGSTLVTTTLVRLRDRGIFAFSGAVAECGTYDLSTRTPAGRLIADEYFLRAYAGHAPDRTAPDISPIFASLEKLPPILMVVGAEDILLEDNLAMAARLVAAGVEVDLRVYPASPHAFTGHPTSMARAALEAIDSWIRERLSAEPLTAPSVGIWS

SEQ ID NO: 36588 - protein, 484 aa, Frankia sp. CcI3
MDLPPSAAPLRALPAESLPRPVLTAVRAWPAGAGEVSAYFYDPAAAARNAAALRACLPMWAEVCYAVKANSFPPILDALLRGTGPDIPRSGRERSDSSPGASPTDARSDARSDARSDARSDARTGASGRGIDGFEVSSAHEVRLAQAAYGRVDSARRPRLVASGPGKSMTLLTALVSADVDVVNVESFGELRRLDAVAARLGRRVRAAVRVNPAQVGLAGSLQMGGRPSAFGIPETEVPAALELAADLAHIDVVGFHVHAVSGNLDAAAHLGYVRWCLDFAVRTAAVAGIELRMVDVGGGFGVPFEPDRRGDRPFDLIRFGEGLSSLPVPDGTRVIFEPGRMLVADSGWYAAEVIDVKHSYGTEFVILRGGIHHFALPTSWEIVHNFAVVERSGRNGGPEPEHTREAVVEGRPVTVVGELCTPEDTLARDITVDRVRPGDVVVFPMAGAYGYEFALPDFLGHPRARRIELRGTRHAPFPTDRSS

SEQ ID NO: 36589 - protein, 335 aa, Populus alba x Populus tremuloides
MVVASPTQIHGEKLLAIELPVIDLSGERSMVSNLIVKACEEYGFFKVRNHGVPHDIIARMENESSNFFAKTFDEKQKAGLANSFGYGCKNIGFNGDTGEVEYLLFNTNPLSIAERSKTISNDPTEFSSAMSGYIEAVRELACELLDLMAEGLWVPDRSVFSRLIRDDDSDSIIRLNHYPPMPILCKDKDSSSPCNHNRVGFGEHSDPQILTILRSNDVGGLQISLNDGVWVPVTPDPSAFCVNVGDLLQAMTNGRFVSVRHKALTNSYKSRMSMAYFAAPPLNARIAVPPEMVTPIKPALYRPFSWAEFKKAAFALRLGDSRLGLFRMEEYEQVA

SEQ ID NO: 36590 - protein, 336 aa, Rhodococcus sp. RHA1
MEETTGESATKAHRCRDEDPCRPFMSDLHPQVLELLASLSTNPPAQPWEVSITAYRAVGEKLIGLAGDLNPHCDVRDLEIPLRGRVLNARSYSPKGTTGAAPCVVYFHGGGFVRGSLDSHDRLCRELSVQGALRVISVAYRLAPENTYPSAHADAIESFCWVADHSDELRIDGEALAVAGDSSGGMLAAATAATLNARTDGASVKAQGLLCPVLDLTLSSDSVNRYGSAPLLSRAALEWCIDQYVPNVWLRKSPEVSPLFRVNLNNAPPALIINAEIDPVSDDASRYASKLRASGVAVVHREHAGMPHSFFLLAGAVDEGERAITGFAEGLSRLLR

SEQ ID NO: 36591 - protein, 355 aa, Pisum sativum
MADQDNSTRRPQREAKKRAVAALCEQRKRKRVALGDITNDVVSETEKLVSDSHSHTQKKKKRNIAKSPVPEKLEDPQLCEPYVSDIHDYLRNLEVDPSKRPLPDYIQKVQRDINANMRGVLVDWLVEVAEEYKLVADTLYFSVSYIDRFLSLNDLSRQKLQLLGVSSMLIASKYEEIKPPEVEDFCYITDNTYSKEEVLSMEAEILKTLKFELGGPTIKTFLRRFITKVGQEGVDASELQFEFLCCYLAELSLLDYNCVKFLPSMVAASVVFLARFMLNPKSRPWNSAICQFTSYKPADLKECVLNMHDLYLGRKGATLQAVRDKYKQHKFKCVATTPSPPEISLSFFEFRGADP

SEQ ID NO: 36592 - protein, 489 aa, Burkholderia vietnamiensis G4
MTSYDQSPVRHLLEAGRLERFFIDGDWVAPDGGGRFAVVCPSTEDTLCEIPLGSARDADRAVQAARHAFAGWAATSPQERAALLDRVHRLLLERAERFATALALEMGAPLGYARSAHVPLAAEHIRVARDNLTDYPFRKQRGTTAIVREPIGVCALITPWNWPIYQITAKVGPALAAGCTVVLKPSELSPLSALLFAEVLADAGVPAGVFNLVSGTGAEVGAALSSHPLVDMVSITGSTRAGVLVAQAAAPTVKRVAQELGGKSPNVVLPDADLERAIAPGVAAAFRNMGQSCSAPTRMIVPRAALGAVEALAVAAAQRCVVGDPFADATTHGPLANRAQFERVAQMIDVGVAEGAKLIAGGPGRPAGCERGFYARPTIFSDVRTGMAIAQQEIFGPVLAILPYDSIDEAVSIANDTVYGLGAHVQGTDRERTRAVAARIRAGQVHLNYPAWDPQAPFGGYKQSGNGREYGVEGMEEYMEVKSILGYYD

SEQ ID NO: 36593 - protein, 108 aa, Zea mays
  misc_feature (45)..(45): Xaa can be any naturally occurring amino acid
  misc_feature (69)..(69): Xaa can be any naturally occurring amino acid
NFQLQSLHGKSRVRVYTVWRRPAAAVGYAIANWNVNDSIVYDWLXPDTPTATTTCNFTTDSIINTVHVXAKECTEVVSMAEFATILGRHFTILYPDVSEATVTIAERP

SEQ ID NO: 36594 - protein, 500 aa, Rhodococcus sp. RHA1
MSSNLANNLVETARLLGDRPAIRLDETTLDYAEFYRAAAAVAGDLRSRGIRSGDRVGIVLPNVPAFPVIFYGILMVGAVAVPINPMLKEREITYYLDDSGMALIYGSRSRGDLVAKAALAKKIPALLVDDRGPSDADLTGNPIDEPVERSRDDTAVLLYTSGTTGSPKGAELTHENMSTNASTTAETLIQTGSSDVILGCLPLFHVFGLTCGLNAAVKSGALLTLIPKFDAESALRVLVRDEVTVLEGVPTMYSAMLNSPEADSVELSHLRCCIVGGAPMPVEVLKAFEQRFGCEIYEGYGLSETAPIACFNQPGHPRKAGTIGIPVRGCTLRLVDDGDNEIVGCDEAGEIQIRGENVMKGYWARPAATAEAISDGWFRTGDIATRDSDGYYSIVDRKKDIIIRGGYNVYPREVEEVLYEHPAVAEAAVVGIKHTHLGEEIGAAVSLKRGAHVEPSEIIEFVRARLAEYKYPRQIWFVPSLPKGPTGKILRRQVDPPTVG

SEQ ID NO: 36595 - protein, 1139 aa, Bordetella pertussis Tohama I
MQQLGATRRYAASDLVGFLACEHLTQLDLRALDAGQAPAAADDEQMALVQAKGQAHEQAWLERLRARHPDLADVTRAGPDLAARLAATRAAMAAGAPVIYQAALCHGPYVGHADFLLRTECPSALGDYGYEALDTKLARSPRASFVLQLSFYAWLLEHAQGVAPRSMHVVLGSGRELALRVADYAHYLRQVLRRFEAAIAAEPAPPTYPEPCEHCPQCRWRVACEARRVADDHLSLVAGMSRQQARRLNAQGVATLAQLGALPEHAQVAGIEAGTLQRLRAQAALQWRARVDGARHYELLAAQDEGPRGLARLPRPDPGDMFFDMEGDPLEDGGLEYLFGLYVIDDGAERFVPFWAHDRRQEKQAFEAFMDFVAERLRRHPDAHIYHYAPYEATALKKLMSLHGTREAEVDHLLRAGKLVDLYRVVREGLRISEPSYSIKYVERFYLPRRAGEVTNAGASIVYYERWKATDEPRLLQDIADYNRDDVISTWRLRDWLCGIRPAALPWHNEAGQQDLDAARAVIGEMTEAERRLLPYRAALADDLPADEAAWSPRDAFRALAWHLLDFHRREQKPAWWAWFARAEATDGELIEDAECLGGLARDDAAPPVRQAQSLRYTYRYPAQETKLRTGARCTDVRTGASLANLVVDPHARLASFTCSARKPAPPPRMALGPAAPVNNKELVNAVFRYGDAVCRAPDGMSMPMRAVDALLRREPPRIRGLARGAPLVAPHAELLPQVLDVVARMDETTLFLQGPPGAGKTYTGSRVLLQLLRAGRRVAVSSNSHHAINNLLRGLERLAEREGFALRGAKKSTSAGDDSCLGGAQIEDVFDNKDVDPARHQLVAGTAWLFARPEFEQAFDYLFVDEAGQVSLANLVAMGQCARNIVLLGDQMQLGQPSQGTHPGRSGESALDYLLDGQATIAASQGVFLDTSYRMHPEICGFISEAIYDGRLRAAPATAAHRLLLDEAAGRELPAHGIRYVPVPHDGNTQSSREEAARVAELCALLLRQRHVDEAGAPAPLTLDDILFVAPYNVQVNTLRAALPDGARVGTVDKFQGQEAQVVIVSMATSSGDYLPRDLEFLFSRNRLNVAISRARTLAILVASPALTAVRCRSAEQMALVNTLCWVAETGSASPYQV

SEQ ID NO: 36596 - protein, 327 aa, Psychrobacter arcticus 273-4
MTTLAQYLNTNAASPALNDVITTVTDVGKTISQLLRKGALADILGEAGNQNVQGEDQKKLDVLANDLLLDALAKNTHCAGVASEELDDAIPANAEGSLLVLFDPLDGSSNIDINMAVGTIFSILPYQHQGKVSENSDFLQAGNQQLAAGYLLYGTSTVLALTITDNVVMFSLDPDTNDYVLIEENVTVDADTSEYAINASNYRYWRAPMQQYIDELIAGEIGVRGRDFNTRWVAAMVGDVHRILCRGGLFTYPFDTKYANKAGKLRLMYEANPMSLLIERAGGGATDAVNRILDIEPTDIHQRVPVVLGSKNEVDYVKNLHLNYAEK

SEQ ID NO: 36597 - protein, 351 aa, Nocardioides sp. JS614
MTQIMQALVVREPNVLEIAEVPVPEPGRNEVLARVRSVSICGTDAHLINGDYPGFWPPQFPFTPGHEWAGDVVALGEGADTFGWRVGDRVAGTSHSACGACQKCVEGQYNLCENYGRPALHAQYGHNAQGVNATYAVHNVKSIFRLPDEVSFDVGALADPASIALHVARRGNIKPGDTVAVTGAGAIGLLAADAALIDGAARVIVVGRGHRLERAAALGFETVDTRTGDPVAEVRGLTSGLGADVVLECAGVPETLIWGMAMLRRGGRCAMVGIPTEDVSLKCQPLVLDELELVGSRASAGEMRRVLPFIANGRMRAEELITHHFPLSEYDKALATFNDRASGAIKIIVNP

SEQ ID NO: 36598 - protein, 499 aa, Pseudomonas syringae pv. syringae B728a
MQMTTLTRADWEQRARNLKIEGRAFIQGEYTAASSGETFDCISPVDGRMLAKVASCDAADAQRAVDSARSAFNSGVWSRLAPAKRKATMIRFAGLLEQNAEELALLETLDMGKPISDSLGVDIPGGARALSWSGEAIDKLYDEVAATPHDQLGLVTREPVGVVAAIVPWNFPLMMACWKLGPALSTGNSVILKPSEKSPLTAIRIAQLAIEAGIPAGVLNVLPGYGHTVGKALALHMDVDTVVFTGSTKIAKQLMIYAGESNMKRVWLEAGGKSPNIVFADAPDLQAAASAAASAIAFNQGEVCTAGSRLLVERSIKDRFLPMVIEALSAWKPGNPLDPATTVGALVDTQQMNTVLSYIEAGHSDGAKLVAGGKRILQETGGTYVEPTIFDGVNNAMKIAQEEIFGPVLSVLTFDTAEEAIQIANDTQYGLAAAVWTANISKAHLTAKALRAGSVWVNQYDGGDMTAPFGGFKQSGNGRDKSLHAFDKYTELKSTWIKL

SEQ ID NO: 36599 - protein, 195 aa, Bacillus subtilis subsp. subtilis str. 168
MKVTKSEIVISAVKPEQYPEGGLPEIALAGRSNVGKSSFINSLINRKNLARTSSKPGKTQTLNFYIINDELHFVDVPGYGFAKVSKSEREAWGRMIETYITTREELKAVVQIVDLRHAPSNDDVQMYEFLKYYGIPVIVIATKADKIPKGKWDKHAKVVRQTLNIDPEDELILFSSETKKGKDEAWGAIKKMINR

SEQ ID NO: 36600 - protein, 422 aa, Coccidioides immitis RS
MSSNGPVQRKPPAPELASDSTSYRGDTGRHKYARPEGNYGLFLQIVRSLLIVTWFNCCCISIVATQAIGLPLYLVNKRWFYSYMAMTKRFFGITITALTQWSSPTPVRISGDSSMQGQFSLRNDGTVVTKFPERLVLIANHQVYTDWLYLWWVSYTSNMHGYIYIILKESLKYIPFIGQGMMLYGFIFMARKWIEDKPRLQHRLQKLKTSHGKSPDGLPVFDPMWLLIYPEGTNLSRNTKRRSDAYCEKQGIAPRKHTLLPRSTGLFFCLQKLRGTVDYVYDCTVGYEGPPKGSYAESYFTLRSTYLRGRPPKAVNFYWRRFAILDIPLNDQKEFEDWIYKRWGEKDQLLERFAETGRFPPFEPETTSSTGFKEERNQATGSANDGYIESEIRLRHWSEAGRVFTILITLGLVLKFLPQIWN

SEQ ID NO: 36601 - protein, 538 aa, Bacillus halodurans C-125
MMNSPLLLSHFIERAERYFPTKQVISRTLNGKKSLTYQQIGERTRRLASALAQFGIKKGDRVGTFAWNTHRHLEAYFAIPGIGAVLHTINLRLSQDHIAYVINHAEDRVLFVDADVWPLIAQLRDQLSSVEAFVLMSDGELPEVDWPNVFSYEEFIAKGDPSFEFVQSIDETSPAGICYTSATTGKPKGVVYSHRGIYLHSMALGLADTAGLSEKDVLMPVVPMFHVNAWGLPFAATWFGTTQVMPGPQFTPQVLAELIDEEKVTLAAGVPTIWLGLLRELETGVYQTEHLRAILCGGSAAPAAMIQTFEQKYNVPFLHAYGMTETSPLVTVSMVKSYQADLNEEETLELRAKQGLVVPGLEVKVVGPNGEVKPDGAEMGELLIRGPWIADHYYKAEEVSDAFADGWLHTGDVATIDEEGFIKLVDRTKDLIKSGGEWISSVDLENAIMAHEDVFEAAVVSVPDPKWQERPVACVVLKDPNKGSVAEADIRRFLEGKFPSWWLPDRVIFMDELPKTSVGKFLKRALREQVKEQMEANR

SEQ ID NO: 36602 - protein, 801 aa, Staphylococcus epidermidis ATCC 12228
MAKQKLVMIGNGMAGLRTIEEILERSQSQFDITIIGKEPYPNYNRIMLSNILQKKMTVEDTIMNPYDWYQENNIELINNDPVEKVDKENKIVTTSKGIEVEYDICIFATGSKAFVLPIPGSNLPSVIGWRTIDDTNKMIEIAQTKKRAVVIGGGLLGLECARGLLDQGMEVTVLHLADWLMEMQLDRKAGEMLKADLEKQGMKIELQANSKEIIGDKDVEAIKLADGRVIETDLVVMAVGIRPYTEVAKDSGLDVNRGIVVNDYMQTSDSHIYAVGECAEHDGKVYGLVAPLYEQGKVLADYLTGKETKGYKGSTAFTSLKVSGCDLYSAGQIVEDEDVHGVEIFNSVDNIYKKVYLSQGQVVGAVLYGDTDDGSRFYNMMKKHETLEDYTLVSLLHKGDEDAGTSIADMSDDETICGCNGVDKGTIVNAITTKGLTSVDEVTKATKAGNSCGKCKGQIGELLQYTLGDDFIAAKPTGICPCTDLTRDQIVTQIRAKNLKSSKEVRHVLDFKDKDGCPKCRPAINYYLNMVYPFEHRDEKDSRFANERYHANIQNDGTFSVIPQMRGGVTDADQLIRLGEVAKKYNVPLVKVTGSQRVGLYGLKKEELPQVWKDLGMRSASAYGKKTRSVKSCVGKEFCRFGTQYTTRLGIRLEKTFEYIDTPHKFKMGVSGCPRSCVESGVKDFGVISVENGYQIFIGGNGGTDVTVGKLLTTVETEDEVIQLCGALMQYYRETGVYAERTAPWLERMGFENVKNVLLNQEKQKELYLRIMEAKKAVENEPWETIVENKEAQKIFEVEKV

SEQ ID NO: 36603 - protein, 326 aa, Mycobacterium smegmatis str. MC2 155
MTTSPPSPPQGPPLDPDAAARIAGFGKPAPVRDRGLETVRAAIESAPLPSDMPPMAEIVDRTVPASDREIGVRVYRPEQVGHDGAPVILHFHGGGLVMGSVHSFEPLARGLAAAAGAVVVAVDYRLAPEYPPPAQFDDAYAATEWVARHAEELGVDARRLVVAGDSAGGGLAAAVALAARDHGGPAIFAQVLLYPGLDRDMGAQSIVEMPDAPMLSRDDILYMHDLADIGAGSPHDPYRVPAYADDLRGLPQAIVVTGECDPIRDWGERYADRLRAARVQTTLTRYPGMYHGFLMRYEATARGRLALAETGALLRAKFADPLPFAG

SEQ ID NO: 36604 - protein, 203 aa, Brassica napus
MGVIKFGILFFFCFLLELTCDASNPIPSVHDNQVCELCDKYLTLAIDYLQNEDNQNAFVEALHMTCSQIPPLQKQCLAMVDRYTQRFFTQVSLLKPHHICKSLNLCQPPLHSQGNCDACHDTVSQLLPKLKDPQTKLKIIRLLLKECKSLNNYQDKCKKMVFEYGPLMLADLENFLEKKDVCSILGVCPTHSFYVLPAALADS

SEQ ID NO: 36605 - protein, 365 aa, Bacillus subtilis subsp. subtilis str. 168
MKKRIALLPGDGIGPEVLESATDVLKSVAERFNHEFEFEYGLIGGAAIDEHHNPLPEETVAACKNADAILLGAVGGPKWDQNLSELRPEKGLLSIRKQLDLFANLRPVKVFESLSDRSPLKKEYIDNVDFVIVRELTGGLYFGQPSKRYVNTEGEQEAVDTLFYKRTEIERVIREGFKMAAARKGKVTSVDKANVLESSRLWREVAEDVAQEFPDVKLEHMLVDNAAMQLIYAPNQFDVVVTENMFGDILSDEASMLTGSLGMLPSASLSSSGLHLFEPVHGSAPDIAGKGMANPFAAILSAAMLLRTSFGLEEEAKAVEDAVNKVLASGKRTRDLARSEEFSSTQAITEEVKAAIMSENTISNV

SEQ ID NO: 36606 - protein, 595 aa, Bacillus halodurans C-125
MSKSTIDLKQLSIQSSFPNSQKRYVTGSRSDIRVPFREISQHPTVTDSGEAENEPILVYDSSGPYTDESYEVNIEKGLPAIRKSWILERGDCEKYEGRDVRPEDNGFTKDDDPRAAREVFPRTSSHKPLRAKKGANVTQMHYAKKGIVTPEMEFVAIRENVSPEFVRDELARGRAILPSNINHPESEPMIIGRNFHVKINANIGNSAVSSSIAEEVEKMTWATRWGADTIMDLSTGKNIHTTREWIIRNSPVPVGTVPIYQALEKVNGVAEDLTWEVYRDTLIEQAEQGVDYFTIHAGVLLRYIPLTAKRVTGIVSRGGSIMAQWCLYHHKENFLYTHFEEICEIMKTYDIAFSLGDGLRPGSIADANDEAQFAELETLGELTKIAWEHDVQVMVEGPGHVPMHQIKENMDKQLDICQEAPFYTLGPLTTDIAPGYDHITSAIGAAMIGWYGTAMLCYVTPKEHLGLPNKDDVREGVITYKIAAHAADLAKGHPGAQKRDDALSKARFEFRWRDQFNLSLDPERAMEFHDETLPAEGAKTAHFCSMCGPKFCSMRISQDIRTYAKEQGLDTEEAIEKGLEEKADEFKQAGGNLYR

SEQ ID NO: 36607 - protein, 239 aa, Pfiesteria piscicida
MAGRDKQVYFAKLAEQAERYDEMAEHMEGVGNSDGELSVEERNLLSVAYKNAVGSRRAAWRIITSVEQKEKSKGHDDNAAWAREYCTKVEGELQKICDTILGLLDGKLIPAANNGKSKVFYQKMKADYFRYIAEFTNGDAKTKGANSAEAAYADAAAVAEKDLAVTHPIRLGLALNYSVFLYEVQSKPDDACKMARTAFEDAIAELDNVQEDSYKDSTLIMQLLRDNLTLWTSDDAGDQ

SEQ ID NO: 36608 - protein, 415 aa, Hordeum vulgare
MASAPASASAALSTAAPADNGAAKPTEQRPVQVAKRLEKFKTTIFTQMSMLAVKHGAINLGQGFPNFDGPDFVKDAAIEAIKAGKNQYARGYGVPELNSAVAERFLKDSGLHIDPDKEVTVTSGCTEAIAATILGLINPGDEVILFAPFYDSYEATLSMAGANVKAITLRPPDFAVPLEELKAAVSKNTRAIMINTPHNPTGKMFTREELEFIADLCKENDVLLFADEVYDKLAFEADHISMASIPGMYERTVTMNSLGKTFSLTGWKIGWAIAPPHLTWGVRQAHSFLTFATSTPMQSAAAAALRAPDSYFEELKRDYGAKKALLVDGLKAAGFIVYPSSGTYFIMVDHTPFGFDNDVEFCEYLIREVGVVAIPPSVFYLNPEDGKNLVRFTFCKDDDTLRAAVDRMKAKLRKK

SEQ ID NO: 36609 - protein, 268 aa, Chromobacterium violaceum ATCC 12472
MVSPGPAIAWVNDDLVHGGGYPVPVRIYHPEPGAALPVLVFLHGGGHMAGGVSVYDGIHRRLAAASRHIVVAAEYRLSPENPYPAGLDDALCVARHVWDTLDGRGLAYRRRLSLAGDSAGGALCASVSGLAGRDPSLDIARQALIYPCVDYTLDQPSVAENGEGFFLTRARTDWYFDNYFQHGEDRRQASPLHWEAHGQMPATLLITAGHDILRDQGQQYARKLQAAGAEVALLHLEDQVHAFLNMEALVPEVCELAYRRIGAFLNAG

SEQ ID NO: 36610 - protein, 182 aa, Arabidopsis thaliana
MASSMLSSATMVASPAQATMVAPFNGLKSSAAFPATRKANNDITSITSNGGRVNCMQMQVWPPIGKKKFETLSYLPDLTDSELAKEVDYLIRNKWIPCVEFELEHGFVYREHGNSPGYYDGRYWTMWKLPLFGCTDSAQVLKEVEECKKEYPNAFIRIIGFDNTRQVQCISFVAYKPPSFTG

SEQ ID NO: 36611 - protein, 290 aa, Oryza sativa (japonica cultivar-group)
MATTRGQLPVEDVLRVNGSRRFAAALAAASPFASLADALLAARRIWLNEELADWNARYREKFGFVFMICASGRTAPEVLAELKRRYENRPIVELEIAAQEELKITELRLAKLFASEPVAPPSSTVGGPTSQSDKAADRMRIIGAHLGSHTQHSANKAPEITGSSNRTRPPITTHVLDVARGSPASGIEVHLEMWKDASTPPSFNNKDFNGWATLGSSVTNNDGRSGQLMDIVNNVAPGFYRISFNTSKYAPSGFFPYVSIIFEIKKNQTTEHFHVPLLHSPFSFTTYRGS

SEQ ID NO: 36612 - protein, 152 aa, Arabidopsis thaliana
MEDVEETYIMVKPDGIQRGLVGEIISRFEKKGFKLIGLKMFQCPKELAEEHYKDLSAKSFFPNLIEYITSGPVVCMAWEGVGVVASARKLIGKTDPLQAEPGTIRGDLAVQTGRNIVHGSDSPENGKREIGLWFKEGELCKWDSALATWLRE

SEQ ID NO: 36613 - protein, 372 aa, Zea mays
  misc_feature (206)..(206): Xaa can be any naturally occurring amino acid
MLWVARLSGLLSAAMVVVVLSPSLQSFPPAEAIRSSQFDGSVRFPGQIAGGARGVAFRRAPPFRNAADCGAGADNGTGANVCDPWLVHIAITLDNEYLRGSVAAVHSVVQHARCPESVFFHFLVSDPGLGDLVRAVFPQLRFKVYYLDPGRVRGLISTSVRQALEQPLNYARNYLAELLEPCVRRAIYLDSDLVVVDDVAKLWRTXLGGRTVGAPEYCHANFTKYFTGRFWSDQRFAGTFAGRRPCYFNTGVMVVDLERWRQAGYTQRIERWMEVQKSAAGRIYELGSLPPFLLVFAGHVAPIEHRWNQHGLGGDNVLGSCRDLHPGPVSLLHWSGSGKPWARLGAGRPCPLDALWAPFDLYDPGGGAEESR

SEQ ID NO: 36614 - protein, 327 aa, Rickettsia rickettsii
MNIIVKIQQDLKDEVTKLNNLIISCLKSDEELIEKVGKYLLEAGGKRIRPLLTIITAKMFDYKGDNHIKLASAVEFIHTATLLHDDVVDDSTLRRFKPTANVIWGSKTSILVGDFLFSQSFKLMVASGSIKAMHVLAKASAIISEGEVVQLVKLNERRIITIDEYQQIVKSKTAELFGTACAVGTIIAEQVDHISKDMQDFGKLLGTIFQVIDDLLDYLGNDKQVGKNIGDDFLEGKVTLPLIFLYNKLAQDKQLWLENIIKCDKRTKDDFVKIHDLMVKHEIYNETVNYLSNLENAASKLLNKIPVQNIYKDYLFSIIKFMLDRSY

SEQ ID NO: 36615 - protein, 408 aa, Bacillus subtilis subsp. subtilis str. 168
MGGMALTGNKAVVYKGKGTVAVEDIGYPELILRDGPGVPKANVNRKCEHGVILKVITTNICGSDQHMVRGRTTAPEGLVLGHEITGEVIETGRDVEFIKKGDIVSVPFNIACGRCVMCKTQKTHVCLNVNPDRPGSAYGYVDMGGWVGGQSEYVMVPYADFQLLVFPDKEQALEKILDLTMLSDIFPTGFHGAYTAGVQTGSTVYIAGAGPVGLAAAHSAQLLGASTVIVGDLNEDRLAQARSFGCETVNVQKHDRLGEQIEQILGEPTVDAAVDCVGFEASGHGNQGEAPAAVLNSIMDVTQVGGSLGIPGLYVTEDPGAKDADAKTGSLKIRFGLGWAKAHTFVTGQTPAMTYNRNLMKAILSGRAQIAKAVNATVISLDDAPKGYSDFDKGAAKKFVIDPHGTLK

SEQ ID NO: 36616 - protein, 452 aa, Photobacterium sp. SKA34
MAKHFDYICIGGGSGGIASANRAAMYGAKVAIIEAKALGGTCVNVGCVPKKVMWHGAQIAEAMHLYAKDYGFNVDVKGFDWSKLVESREAYISRIHTSYDNVLGNNKVEVINGFAKFVDTKTIEVNGEHYTADHILIAVGGEPTIPAIPGAEHGIDSNGFFELNEQPKRTAIIGAGYIAVEIAGVLSALGTDTHLFVRKESPLRSFDPLIVETLVEVMATEGPTLHTHSVPKEVVKEADGSITLHFENGESHNTDVLIWAIGRHPTTDKINLETTGVATNDRGYIKVDEYQETNVKGIYCVGDIMEGGIELTPIAVKAGRQLSERLFNNKPDAKMDYSLVPTVVFSHPPIGTIGLTEPEAIAQYGEENVKVYKSGFTSMYTAVTSHRQPCKMKLVCAGDDEKVVGLHGIGFTVDEMIQGFGVAIKMGATKADFDSVVAIHPTGSEEFVTMRG

SEQ ID NO: 36617 - protein, 393 aa, Oryza sativa (japonica cultivar-group)
MVHHLRRHMISLLLRPAYPHPTAAISPLSSLRRLLLFSTTAAPVSPEPFAVEDYLVATWGLTGAQARKASKKLSHLRSPSKPDAVLAFLSDLGLPPRKIAAVATADPRFLCADVESNLARRVDELGGLGLSRSQIARLVPLALTCFRSSSVGTNLGFWLQIVGSFDKILKALRMNSSLLGSDLEKVVKPNLELLKQCGMSDFATSFPLYTSRLFTANPIYLRDAVARVEELGLDRSSRMFRHGLIAVAFTSKESVARKIQVMEELGFSRDELLMIIRKAPQLVASSEEKIRQAAEFLKRDVGLEGRYIAHRPVLFLYSLERRLLPRHHLLKVLRMKGLLDCELDYYNTAAMSERKFVRKFVDPYKCHIPGLADAYTSSCAGETANGVASLLGV

SEQ ID NO: 36618 - protein, 843 aa, Thermotoga maritima MSB8
MKTKLWLLLVLLLSALIFSETTIVVHYHRYDGKYDGWNLWIWPVEPVSQEGKAYQFTGEDDFGKVAVVKLPMDLTKVGIIVRLNEWQAKDVAKDRFIEIKDGKAEVWILQGVEEIFYEKPDTSPRIFFAQARSNKVIEAFLTNPVDTKKKELFKVTVDGKEIPVSRVEKADPTDIDVTNYVRIVLSESLKEEDLRKDVELIIEGYKPARVIMMEILDDYYYDGELGAVYSPEKTIFRVWSPVSKWVKVLLFKNGEDTEPYQVVNMEYKGNGVWEAVVEGDLDGVFYLYQLENYGKIRTTVDPYSKAVYANSKKSAVVNLARTNPEGWENDRGPKIEGYEDAIIYEIHIADITGLENSGVKNKGLYLGLTEENTKGPGGVTTGLSHLVELGVTHVHILPFFDFYTGDELDKDFEKYYNWGYDPYLFMVPEGRYSTDPKNPHTRIREVKEMVKALHKHGIGVIMDMVFPHTYGIGELSAFDQTVPYYFYRIDKTGAYLNESGCGNVIASERPMMRKFIVDTVTYWVKEYHIDGFRFDQMGLIDKKTMLEVERALHKIDPTIILYGEPWGGWGAPIRFGKSDVAGTHVAAFNDEFRDAIRGSVFNPSVKGFVMGGYGKETKIKRGVVGSINYDGKLIKSFALDPEETINYAACHDNHTLWDKNYLAAKADKKKEWTEEELKNAQKLAGAILLTSQGVPFLHGGQDFCRTKNFNDNSYNAPISINGFDYERKLQFIDVFNYHKGLIKLRKEHPAFRLKNAEEIKKHLEFLPGGRRIVAFMLKDHAGGDPWKDIVVIYNGNLEKTTYKLPEGKWNVVVNSQKAGTEVIETVEGTIELDPLSAYVLYRE

SEQ ID NO: 36619 - protein, 461 aa, Sulfitobacter sp. EE-36
MNTQNMPAPDGATPAHPIPVEADLAKADVGLIDFAKKAGKNIFSVIPDATRTQSYLKGPAKIHYVCDPDMVTELLAGVGRRFPKAEFTHNVIGPVVGNGMILSEGEKWRAQRHRYAPLFAARNLPVLTRHFAQTGDELADFFARTAGEVDVSDAAQEATLTNISRVMFSGNEAVSKQDVRQGMRRFTDYISYMSLFDLMGLPKWVPRLKWLRSKKAIRDLRQLTHDVIANRRAQRHAEAVDFLDLLIEALETDKEDVETTVDNLLTFVAAGYETSANTIAWGLYLLAMHPEVQTDLRAEVMEACGDGPIGFHDLPKMPKLHAHVRETLRMYPAGALFARDATDEVTIKDVTFKKGDVIMFPVYALHRNELLWDNAALYQHDRFLDCKYPRGQYIPFGDGPRICIGAQYAETEIMVLLASALRRASFELTDHPVAPPNLTFTMRPDGPLMLRAVPVDQAAVE

SEQ ID NO: 36620 - protein, 165 aa, Zea mays
  misc_feature (35)..(35): Xaa can be any naturally occurring amino acid
PFCYEDLFFSQPPIPFYHIAFGGVLSTVGGLENLXAAKKFFASTIRLSGGRDSKALFGVCLGSSAIFPLPKARNKEPEGSALQSLSAKVLLINFNPPAPSNGAPSLSACYMWHEPRLVSCWLSPFGLSCFVRVVSLILCGLILVFFCGPGPPLVPWFLSKVLPKT

SEQ ID NO: 36621 - protein, 466 aa, Fusobacterium mortiferum
SFPKNFLWGSATAAYQVEGAWNQDGKGPSIWDLYSKLPGTTFEGTNGDIAADHYNRYKEDVKTMAEMGLKTYRFSIAWTRIFPEGSGKINEKGIEFYSNLIDELLKYNIEPMITLYHWDLPQALQDKYAGWESREIIDDFVEYARVCFKNFGDRVKYWIVMNEPNVFIGLGYGIALHPPGGKDRKKELNAGHITALANAKAIKLFREIVPNGMIGSSIAYGPAYAASESEEDKLALEKYYNYNVWWWFDPYFKGEYPADMLKYNQEKYGAPEILDGDMELLKSAKSDFIGINYYCTQMIADNKEGVGYNGMNTTGEKNSQKENGVPGLFKNVRNTNLEYTDWDWAIDPDGLRYGMVQLKERYNLPIIISENGLGAVDPIDEEGNIQDIPRIDYLREHIIACEKAIEEGVDLLGYCTWSYIDLLSWLNGYKKQYGFIYVDRKNNLERKKKASYFWYKDVIASNGEKL

SEQ ID NO: 36622 - protein, 394 aa, Carboxydothermus hydrogenoformans Z-2901
MKYLIIGNSAAGIFAAESLRKLDPAGEITVLTDEPYEVYGRCLTSYFIAGDIVEEQIFIRPKDFYEKNRINLKKGEKVVRIDFNEKKVITFKNSYQYDRLLIASGARAKKLSLPGSNLPGVFTLRTLDDAKNILDYSRKAEQAVIVGGGLVSLKGAYGLLKRGVKVTVVVASRQILSQVLDYEAAGLVQQNLEKQGMKFLLGEDVLEFLGEDKIFEVKLTNGQVIKADLVLIGKGVTPNVDFLPEPEKFLEGIPVDQYLRTPWEGVWAAGDVAKTFDVAHGKYRVNALWPIAAEQGRVAAMNMVGQNYVYQGSIGMNSLEFFGYNTIAAGITRQEEGYTVIKRRQGANYLKLVLEGEKLKGYILSGEVRGAGKLTQLIRSGSKIKQFPSFLKIF

SEQ ID NO: 36623 - protein, 432 aa, Lactobacillus johnsonii NCC 533
MSVITDIHAREVLDSRGNPTVEAEVYTELGGFGRAIVPSGASTGEHEAVELRDGDKSRFLGQGVLTAVENVNGEIAKAVIGLDVTDQRLIDQTMIDLDGTPNKGRLGANAMLAVSLASARAAADELGLPLYEYLGGPNAHVLPTPMMNVINGGKHADNNVDIQEFMIMPVGAKSLHEAVRMGAETFHTLKSLLQERGESTAVGDEGGFAPNLKNNEEPFEILVEAIQRAGYKPGQDISIAFDCAASEFYNKDTKKYVTVADGREYTAEEWTSLMEDIVDKYPVISIEDPLDENDWEGWKVFTERLGDKVQIVGDDLFVTNTNYLEKGIKMGVANSILIKLNQIGTLTETFEAIEMAKEAGYTAVVSHRSGETEDTTIADLVVATNAGQIKTGSMSRTDRIAKYNQLMRIEEALGSTAQYKGIHSFYNLHKQF

SEQ ID NO: 36624 - protein, 406 aa, Xanthomonas oryzae pv. oryzae KACC10331
MCPRSWWFIIETMDSRLPYAGGYSRRSQDIAPFHVMSLLARANALEQAGHDVIHLEIGEPDFTTAAPIVAAGQAALAAGHTRYTAARGLPALREAIAGFYAQRYACNVDPERILITPGGSGALLLASSLLVDPGKHWLLADPGYPCNRHFLRLVEGAAQLVPVGADTDYQLTPALVETCWNSDSVGALVASPANPTGSVLSRSQLAALSQTLHARGGHLVVDEIYHGLTYGLDAHSVLEVDDSAFLLSSFSKYFGMTGWRLGWLIAPPDAVPELEKLAQNLYISASTIAQHAALACFTPESIAIFEARRAEFQQRRDYLLPALRALGFDIAVEPQGAFYLYANISGFSNDAQAFCAHFLETEHVAFTPGIDFGHSRANQHVRIAYTQSLPRLQQAVTRIARGLSRL

SEQ ID NO: 36625 - protein, 893 aa, Arabidopsis thaliana
MEFRFENLLGAPYRGGNAVITKNTQLISPVGNRVSVTDLSKNHSVTLPLETSTNICRLASSPDGTFLLAVDEQNRCLFINLPRRVVLHRITFKDKVGALKFSPNGKFIAVGIGKLVEIWRSPGFRRAVLPFERVRTFANSDDKVVSLEWSLDSDYLLVGSRDLAARLFCVRKLKGVLNKPFLFLGHRDSVVGCFFGVDKMTNKVNRAFTIARDGYIFSWGYTEKDVKMDESEDGHSEPPSPVTPDRADEVMVENGGGVGTELKKRKEYDGKGLESDEEGDDDDEEYMHRGKWVLLRKDGCNQASAKVTACDYHQGLDMVVVGFSNGVFGLYQMPDFICIHLLSISRQKLTTAVFNERGNWLTFGCAKLGQLLVWDWRTETYILKQQGHYFDVNCVTYSPDSQLLATGADDNKVKVWNVMSGTCFITFTEHTNAVTALHFMADNHSLLSASLDGTVRAWDFKRYKNYKTYTTPTPRQFVSLTADPSGDVVCAGTLDSFEIFVWSKKTGQIKDILSGHEAPVHGLMFSPLTQLLASSSWDYTVRLWDVFASKGTVETFRHNHDVLTVAFRPDGKQLASSTLDGQINFWDTIEGVLMYTIEGRRDIAGGRVMTDRRSAANSSSGKCFTTLCYSADGGYILAAGTSRYICMYDIADQISHNLSLDGVLDFLHSKKMTEAGPIDLIDDDNSDEEGGIDKQSRGNLGYDLPGSRPNRGRPIIRTKSLSIAPTGRSFAAATTEGVLIFSIDDTFIFDPTDLDIDVTPEAVEAAIEEDEVSRALALSMRLNEDSLIKKCIFAVAPADIKAVAISVRQKYLERLMEALVDLLENCPHLEFILHWCQEICKAHGSSIQRNYRTLLPALRSLQKAITRAHQDLADMCSSNEYTLRYLCSVPNNH

SEQ ID NO: 36626 - protein, 697 aa, Oryza sativa
  misc_feature (514)..(514): Xaa can be any naturally occurring amino acid
MCRGSVLLLRVHAALLLLAALPALIAGQPWEICGENGNYTANSTYQANLKQLAAALHKNVSSGTGGGRLFASGAVGAVPDAVYALALCRGDINASACADCVGTIFQDAQQLCPYRKEVSIVYDSCYLRFSNLDFLSSADNSGVVDLYNTGTVSGDVGRYDRAVTGLLNATARYAAGNTNASSRLFATGVMVGFDAQFPKIYAMAQCSPDLSPAQCGLCLGAMVARWWQTFEPNTQGARSVGARCNMRVELYSFYNVPSMLQLQAEAVAPSPSPAPAPAGKPPAVPGTTGGKRRNGAGKVLAIVMPIVAAILAVTVIGFCFWRRRRPEKTPPPGPLRSASRSEDFESIESLFLDLSTLRIATDNFSENNKLGEGGFGVVYKGSLPHGEEIAVKRLSQSSVQGMGELKNELVLVAKLQHKNLVRLVGVCLEEHERMLVYEYMPNRSLDTILFDAEKSSLLDWGRRLKIINGVARGMQYLHEDSQLKIVHRDLKASNVLLDSDYNPKISDFGLARLXFGGDQTQDVTNRVVGTYGYMAPEYAMRGHYSVKSDVFSFGVLVLEIVTGRRNSGSYYSEQSGDLLSIIWEHWTMGTIMEMVDRSMGERAAGGEIARCIHVGLLCVQENPASRPAMSAVNVMLSSGTVSLKAPSRPAFYIRKGGGDDGGGTGSYSGSFVGTLPSSGRSAPMSPNEVSITELEPR

SEQ ID NO: 36627 - protein, 402 aa, Pfiesteria piscicida
MAAAVAMEVEGARAGIQSYYDTNIQELEARIRERKLNNRRLEAQRNELNARVRLLREELHMLLEPASNCGEIIKAMGKDKILVKCGQEGKYVVDKDKDITIEECKPNARVALRSDSYVLHKILPSKVDPLVQLMRVEKTPDSTYEMVGGVDKQIKEIKEVIELPIKHPEIFESLGIAQPKGVLLYGPPGTGKTLLARAVAHHTQCCFIRVSGGELVQKYIGEGSRMVRELFVMAREHAPSIIFMDEVDSIGSSRVEGSEGGDSEVQRTMLELLNQLDGFEAATNIKVIMATNRIDILDEALLRPGRIDRKVEFPNPNEEARLEILKIHSRKMNLKRGINLRKIATQMTGASGAESKAVCTEAGMFALRERRQHVTEDDFQMAVSKVMKKDSDKNMSVMQLMR

SEQ ID NO: 36628 - protein, 515 aa, Mycobacterium smegmatis str. MC2 155
MSEPFYITTAIAYPNGVPHIGHAYEYIATDAIARFKRLDGYDVRYLTGTDVHGQKMAETAAKEGIPAAELARRNSDVFQRLQEKLNISFDRFIRTSDADHYEASKAIWKRMADAGDIYLDAYKGWYSIRDERFFTENETTEQPDGTRIATETGAPVTWTEEQTYFFRLSAYTDRLLALYEEHPEFIGPDARRNEIVSFVSGGLKDLSISRTTFDWGVPVPDHPDHVMYVWVDALTNYLTGVGFPDTESESFRRYWPADLHMIGKDIIRFHTVYWPAFLMSAGLPLPKRIFAHGWLLNRGEKMSKSIGNVVDPVNLVDTFGLDQVRYFLLREVPFGQDGSYNEDAIIGRVNADLANELGNLAQRSLSMVAKNLGAAVPDPGEFTDEDTALLAAADALLERVREHFDVPAMHLALEAIWSVLGAANRYFSAQEPWVLRKSDAAEDQQRFRTVLYTTLEVVRIASLLLQPVMPESTAKLLDLLGQPTDERDFSAIANRIKPGTSLPAPSGIFPRYQND

SEQ ID NO: 36629 - protein, 114 aa, Cyanidium caldarium
MEKQIMFKNIIIVVAVTLCALFTNEHVVYSANLEHGEQIFSANCAACHAGGNNVIMPEKTLKAEALEANNIKNISAIANQVKNGKNAMPSFSRLSDSDIEDVANYVLSKADKGW

SEQ ID NO: 36630 - protein, 467 aa, Bacillus subtilis subsp. subtilis str. 168
MNTNQDNGNQLQRTMKSRHLFMISLGGVIGTGFFLGTGFTINQAGPLGAVLSYLVGGFIMFLTMLCLGELAVAFPVSGSFQTYATKFISPAFGFAFGWLYWLGWAVTCAIEFLSAGQLMQRWFPHIDVWIWCLVFAALMFILNAITTKAFAESEFWFSGIKILIILLFIILGGAAMFGLIDLKGGEQAPFLTHFYEDGLFPNGIKAMLITMITVNFAFQGTELIGVAAGESEDPEKTIPRSIKQTVWRTLVFFVLSIIVIAGMIPWKQAGVVESPFVAVFEQIGIPYAADIMNFVILIALLSVANSGLYASTRILYAMANEGQAFKALGKTNQRGVPMYSLIVTMAVACLSLLTKFAQAETVYMVLLSLAGMSAQVGWITISLSQIMFRRKYIREGGKIEDLKFKTPLYPVLPLIGLTLNTVVLISLAFDPEQRIALYCGVPFMIICYIIYHVVIKKRQQANRQLEL

SEQ ID NO: 36631 - protein, 242 aa, Wolbachia endosymbiont of Drosophila melanogaster
MSFLIVANWKMNGMRSSFVDFIGKLNNKSNEITSKLVICPPFTSFPSSIELNNNIDIGAQNCHHKKFGSYTGEISAEMLKELGCTYVMLGHSERANEKDSEIKLKSEIAIESGLHPIICVGENSEDYKNEKTKEVIEYQCKNRLPTHGEYTVAYEPIWAIGTGHVPNNDAIAKVIEVIKLCTSKKHIIYGGSVSSENIENLLSISNLSGVLIGSASLDFDHFYKIIQQVEKKFSLINSKISN

SEQ ID NO: 36632 - protein, 306 aa, Bacteroides fragilis NCTC 9343
MRKVIGIGETILDIIFRNDQPSAAVPGGSVFNGIVSLGRMGVNVCFISETGNDHVGNIILQFMRDNHIPTDHVNVFPDGKSPVSLAFLNEHSDAEYIFYKDYPKQRLDVLFPSINEDDIIVIGSYYALNPVLRDKILELLDIAKEKRAIVYYDPNFRSSHKNEAMKLAPTIIENLEYADIVRGSLEDFYYMYGIKDVEKIYKDKIKFYCPLFLCTAGAERISLRTNAISKEYPVAPLEAVSTIGAGDNFNAGLIYGMLKYDVRYRDLQHLSEETWDKVIQCGQDFAAEVCKSFNNSISGEFAANYR

SEQ ID NO: 36633 - protein, 399 aa, Oryza sativa (japonica cultivar-group)
MATSSLLPLHLPTRPSAVKASAAATAAAAPTPQSLEESFGRKGLRFAADPATGAPTAELSVRNGSSLQLRLADGLVTSYRPKVYWKDDGCREVLHTVAGAGAGGEVKGGVGLALSEVSSSGAAESLLVGSEWSVVDADSDSYDAVQLVNDNWVLDLHPVLSRQAQTELDSLMTILASQQLQHTEQDVELGCTKGSGTLEVTYVVTLYPLSMATAVMVKNNGKKPVSLTSAMLSHIKFDKRRGTAVEGLRGCPYCSHPPPAAGFALLTPAEAMKREDGGWFGGGGGEEPRQGVWTVEDNLYTILKKKVSRVYAAPPEERKKRIYSTAPSKFTTIDQNSGLGFRVVRMGYEDMYLCSPGEMYRKFGKDYFLCTGTASMLVPVVVNPGEEWRAAQVIEHDNL

SEQ ID NO: 36634 - protein, 474 aa, Escherichia coli O157:H7 EDL933 [sequence omitted]

SEQ ID NO: 36635 - protein, 148 aa, Triticum aestivum
  misc_feature (132)..(132): Xaa can be any naturally occurring amino acid
GNPGRPTRPRTRGADTIFLPPQRTPGRAQPPYRLPRCRGRRTGEPHTRRLPRRANRKTATWENRKKSRKTTPGDAEKPPDREDEGTVGRPEKYDYPKLRQGKIEEPAARAQKSKHQAERTGAGRATTPGIHXFRGPKGARTLQRAGKG

SEQ ID NO: 36636 - protein, 228 aa, Oryza sativa
SDCYSRVETDLQAGAQDKYELLWIILIASCAALIIQSLAARLGVVTGKHLAEHCRAEYPKATNFILWILAELAVVACDIPEVIGTAYALNMLFKIPVWCGALITGLSTLMLLLLQQYGVRKLEFLIAILVSLITTCFLLELGYSKPNSSEVVRGLFVPELKGNGATRLAISLLGAMVMPHNLFLHSALVLSRKVPRSVHGIKEACRFYMIESAFALTIAFLINISIIS

SEQ ID NO: 36637 - protein, 353 aa, Leptospira interrogans serovar Lai str. 56601
MISENLGENQTEKIPLKGRTLKELSEIMITLGEKPFRAKQIYHGLYVNRYETWDQFTTFSKIFKEKLEELCSLTHLQVVKQLKSVDGTQKFTFTSESGNGKEFEAVWIPSGDGGRKTICISSQIGCTLNCKFCATAKLEFQGNLKAHEIVDQILQVEKIVGDKATNVVFMGMGEPLHNYFNVIRAASIFHDPDAFNLGAKRITISTSGVVNGIRRFIENKEPYNFAISLNHPDPKGRLQIMDIEEKFSLPELLQAAKDFTRELKRRITFEYVMIPGVNMGFENANKLVKIAKSLDCKINVIPLNTEFFGWRRPTREEIAEFIALLEPAGVPILNRRSPGKDIFGACGMLASKS

SEQ ID NO: 36638 - protein, 667 aa, Escherichia coli K12
MSRKDLANAIRALSMDAVQKANSGHPGAPMGMADIAEVLWNDFLKHNPTDPTWYDRDRFILSNGHASMLLYSLLHLTGYDLPLEELKNFRQLHSKTPGHPEIGYTPGVETTTGPLGQGLANAVGLAIAERTLAAQFNQPDHEIVDHFTYVFMGDGCLMEGISHEVCSLAGTLGLGKLIGFYDHNGISIDGETEGWFTDDTAKRFEAYHWHVIHEIDGHDPQAVKEAILEAQSVKDKPSLIICRTVIGFGSPNKAGKEEAHGAPLGEEEVALARQKLGWHHPPFEIPKEIYHAWDAREKGEKAQQSWNEKFAAYKKAHPQLAEEFTRRMSGGLPKDWEKTTQKYINELQANPAKIATRKASQNTLNAYGPMLPELLGGSADLAPSNLTIWKGSVSLKEDPAGNYIHYGVREFGMTAIANGIAHHGGFVPYTATFLMFVEYARNAARMAALMKARQIMVYTHDSIGLGEDGPTHQAVEQLASLRLTPNFSTWRPCDQVEAAVGWKLAVERHNGPTALILSRQNLAQVERTPDQVKEIARGGYVLKDSGGKPDIILIATGSEMEITLQAAEKLAGEGRNVRVVSLPSTDIFDAQDEEYRESVLPSNVAARVAVEAGIADYWYKYVGLKGAIVGMTGYGESAPADKLFPFFGFTAENIVAKAHKVLGVKGA

SEQ ID NO: 36639 - protein, 288 aa, Escherichia coli O157:H7 EDL933
MAEKKQWHETLHDQFGQYFAVDNVLYHEKTDHQDLIIFENAAFGRVMALDGVVQTTERDEFIYHEMMTHVPLLAHGHAKHVLIIGGGDGAMLREVTRHKNVESITMVEIDAGVVSFCRQYLPNHNAGSYDDPRFKLVIDDGVNFVNQTSQTFDVIISDCTDPIGPGESLFTSAFYEGCKRCLNPGGIFVAQNGVCFLQQEEAIDSHRKLSHYFSDVGFYQAAIPTYYGGIMTFAWATDNDALRHLSTEIIQARFLASGLKCRYYNPAVHTAAFALPQYLQDALASQPS

SEQ ID NO: 36640 - protein, 222 aa, Cryptococcus neoformans var. neoformans JEC21
MAGGDALLYTPFLTHSPTSTPYTMPAYHSAFNQDTSVRQVGNTAILPITTKIRGPAPLSSDPTQPDIIDESLDLFRANCLFRNFEIKGPADRLLIYLILFISDCLTKLAPTAGKPSPSYQEATKVLQTLSVDNFALPGDAGFPLNSLYHPPASRVDADHLRSYLTQTRCELALRLCDRLYPQEQVIGPDGQPTGQLGPRATKPSKWWMSFQKRRFMGRSLGV

SEQ ID NO: 36641 - protein, 472 aa, Chromobacterium violaceum ATCC 12472
MSDLTFADLGLADPLLRAVADTGYTTPTPIQAQAIPQVLQGGDLLAAAQTGTGKTAGFTLPLLQLLMCSPSHHAGRPRALVLTPTRELAAQVEESVRTYSKYLPLKSLVMFGGVNINPQIKALRAPVDILVATPGRLLDHVGQKTVDLSGVEILVLDEADRMLDMGFIHDIKKVLAKLPAQRQNLLFSATFSDEIKALADKLLDNPKLVEVARRNTTNELVSQKVHLVDRDKKTELLIHLIREQNWFQVLVFTRTKHGANRLAEKLDKIGIPAAAIHGNKSQNARTRALADFKSGELQVLVATDIAARGLDIDQLPHVVNFELPNVPEDYVHRIGRTGRAGSPGEALSLVCVDEFSFLRDIEKLIKMSIERFTVPGFEADLNVKPEPIPMGGGARGRGQGQGRGGQGQGQRHGQGQGQPRNAPAKPRHQTESKPAGHGRNGGPRQGQGAGQGGRAAKPAAAKSALFSPPKNR

SEQ ID NO: 36642 - protein, 339 aa, Oryza sativa (japonica cultivar-group)
MDHEADAYRTDLMTITRYVLNEQSRNPEARGDLTILLSHIVLGCKFVASAVNKAGLAKLIGLAGETNVQAKEQKKLDVLSNEVFVKALVSSGRTCVLVSEEDEEATFVDPALRGKYCVCFDPLDGSSNIDCGVSIGTIFGIYMIKDKENVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQAK

SEQ ID NO: 36643 - protein, 605 aa, Legionella pneumophila str. Lens
MFGFISDLLTAAVSSLDELLQDTPAHQIILGTAALYFLYNQYHNPSISRWYLSRNNASMKQRIIDSAYALAKNLPGVNQIIEKELNKELSSTREKLRIQRSGMTLREEIPEEGLSPQDILSAFDVDVEKCHFDFLSVNNDSPEREFLVGGGDGKDSGALYAIHPKELTELLKEVYGATALTNPLHDKWPRINAMQAEVIRWCQNLFHGSKEGYGLLTHGGTTSIIEAMAAYVIRARAKGIDYPEIVVPETAHAAFKKAAELTGAILITVPVDKKTGAVNPRVMSSYITRNTAVIVGSAPSFMNGIHDPVSELGQLAKKKNVPFHVDACLGGFLTAFLDTSSEPMDFRVPGVTSISADLHKYGCCPKGTSVCLFSEDSPALSVYAALNWSGGLYATPGILDGSTSGARVAEVYATLSYYGKNKYQEIAKSIIKLRNAIQKELTALVEEGNGLTSEDIYVYGNPQWSILGFRSNTCNAHFIADELEKRGWKLNLLQNPDGFHLCLTHVHTLVRGFETQFIKDLREAVIDVKNYPPGKKASGNVKVYGAVGMMPIELQKEICKQYQKARLDFTAASHGSLGIFTTSPTEEDDGLRNRKVGEQKVQTSL

SEQ ID NO: 36644 - protein, 1046 aa, Wolbachia endosymbiont of Drosophila melanogaster
MISSIQEPNELRKRLQGFYRTDEKSYIRYLVEKAELSADSKNRIYNIAKQVIEKIKHNKLSIVDSFMQQYSLSNDEGIALMCLAESLLRIPDDYTIDEIIKDKIANQEWNKYLGHSSSLFVNASTWSLMIGSSILRDNEGDSKFYYAISKLLKNLGEPIIRKAVKQAMSMLGNHFVVGETIEEALRYAKLDDNSKFLYSFDMLGETAHTAEDAEEYFNSYMHSIKAIGESTEINDCFKSHGVSIKLSALHPRYEFGQFDNIAEELRAKLLELCHEAKKYNISLCIDAEETERLEMSLILFEQLRLDESLSEWEGLGLAVQAYQKRALSVLDFVEDVAIRSKHKIMVRLVKGAYWDSEIKRTQELGLNDYSVFTRKSYTDVSYFVCAQKLLSKPNSFYPCFGTHNVYTFASIMELADKNHPGFEFQRLHGMAKDLYDYAMSELATNVSCRVYAPVGEHSDLLPYLIRRLLENGANSSFVNQISDPNVKIDELISDPLEKAINFNYEPHPGIPLPQDILGPERKNSLGMDISDSVIVSQFADDIKGFSEKKWQIGPIIDGKALFDNAEFIEVVNPAHLENVIGEVSSATSDQALNALEIAHSAFAKWQNVSAEERAKCLEKAADLLEERMKELIYILIVEAGKILSDAIAEVREAIDFLRYYAMIAKNELSDWKKLPGPTGEDNFIFFEGRGVFLCISPWNFPLAIFIGQVSAALAAGNAVLAKPAEQTPIIAYEAVKILHEAGIPKNVLHLIPGDGGYLGKILVPDNRIAGVAFTGSTQTAQIINKMLANRDGPIVPLIAETGGLNAMIVDSSALLEQVAMDALLSAFRSSGQRCSALRVLFIQEDIAEKQIKMICGAAQELKIGDPIQLSTDIGPIIDKASIDMLTQHTQKMSEDEDSNLLFKVPMDTNSHNGYFFPPYIYEIQKISQLKQEVFGPILHIIRFNKSQLNEVISDINSTGYGLTFSLQSRIQSQIETISKKISVGNVYINRNQIGAAVGIQPFGGRGLSGTGPKAGGPHYLQRFSTEKVVSVNTTAFGGNTTLMCLD

SEQ ID NO: 36645 - protein, 412 aa, Rickettsia hulinii
ELKIRGKIFKLPILKASIGEDVIDISRVSAEADCFTYDPGFMSTASCQSTITYIDGDKGILRHRGYDIKDLAEKSDFLEVAYLLIYGELPSGEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPYTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKELGQLDNNPLLQIAIELEAIALKDEYFIERKLYPNVDFYSGIIYKAMGIPSQMFTVLFAIARTVGWMAQWKEMHEDPEQKISRPRQLYTGG

SEQ ID NO: 36646 - protein, 819 aa, Magnetospirillum magnetotacticum MS-1
MNAVPRQKLVVIGNGMAGMRTVEELLAIAPARYDITVFGAEPHPNYNRIMLSSVLAGEKQVDDIVINSRAWYAENGITLHTGDPVVAINRAAKTVSSATGLVVTYDRLLLATGSKPLMPPLPGLDLPGVVAFRDIADVEKMLDAAEKQQRAVVIGGGLLGLEAAWGLKRRGMPVALVHLMPTLMERQLDVEAGGLLQKDLTERGLHFFTSGQTEEIMGAEEGCAKGVKLTDGREIPADLVVVAIGIRPNVDLAKAAGLDINRGIEVGDDMATSDPAIFSVGECVEHRGQIFGLVAPIWEQAKVCASRLAGRDEAHYETPPLSTRLKITGIDVFSAGQLAAQDEADEELVYRDTARGIYKKLVIRSDRVVGAVMYGDVADGSWYFQLIREKADVSAIRDRMIFGQAYADTGCKGHGGGVNVAAMSDDAQVCGCNGVSKGAIVKAITEKGLTSLDEVKAHTKASASCGQCASVVQAILAHVTGEVVESKAAGMCGCTDLSHDEVRKEILRQELKNQDAVRSALGWRHADGCAKCRPALNYYLLCAWPAEYVDDYQSRFINERAHANIQKDGTYSVIPRMWGGLTNPTELRAIADVVDKFKIPTVKVTGGQRLDLLGVRKEDLPAVWADLGKAGLVSGHGYAKGLRTVKTCVGSEWCRFGTQDSTGLGVKLEKMMWGSWTPHKVKLAVSGCPRNCAEATIKDMGVVCVEAGYDISVGGNGGIELRGTDHLVRVATEAEVLEYCAAFMQIYREEAHYLERTAPWVERVGMDYVTKRVVEDEEGRKAAHARFLFSQKYAQTDPWAERASGAVDAHEFKTLAEVG

SEQ ID NO: 36647 - protein, 220 aa, Escherichia coli O157:H7 EDL933
MKDIDTLISNNALWSKMLVEEDPGFFEKLAQAQKPRFLWIGCSDSRVPAERLTGLEPGELFVHRNVANLVIHTDLNCLSVVQYAVDVLEVEHIIICGHYGCGGVQAAVENPELGLINNWLLHIRDIWFKHSSLLDEMPQERRLDTLCELNVMEQVYNLGHSTIMQSAWKRGQKVTIHGWAYGIHDGLLRDLDVTATNRETLEQRYRHGISNLKLKHANHK

SEQ ID NO: 36648 - protein, 204 aa, Arabidopsis thaliana
MGLIVDDDNDGEVLIPPPNFSMVEDGIYRSGFPELENFGFLSTLNLRSIIYLCPEPYPEDNLKSLASNNIKLFQFGIEGKTDPPTPMPKDTVLSALRVLVDVRNHPILIHCKRGKHRTGCLVGCLRKVQNWCLSSVLEEYQKCAGLKWRQRDLRFIEDFDVLRLKQCLYSIIYQYNGYGLKRRKLLYQEENVVQEQQKPQATKG

SEQ ID NO: 36649 - protein, 259 aa, Bacillus subtilis
MKRRIGLLLSMVGVFMLLAGCSSVKEPITADSPHFWDKYVVYPLSELITYVAKLTGDNYGLSIILVTILIRLLILPLMIKQLRSSKAMQALQPEMQKLKEKYSSKDQKTQQKLQQETMALFQKHGVNPLAGCFPILIQMPILIGFYHAIMRTQAISEHSFLWFDLGEKDPYYILPIVAGVATFVQQKLMMAGNAQQNPQMAMMLWIMPIMIIVFAINFPAALSLYWVVGNLFMIAQTFLIKGPDIKKNPEPQKAGGKKK

SEQ ID NO: 36650 - protein, 966 aa, Colwellia psychrerythraea 34H
MITYYDPKTEPAANQSADLSKDLGTPPSKSTVQVSVEIDGVTIVVPEGTSVLRAAAIADINIPKLCASDNLEAFGSCRLCAVEIEGMRGMPASCTTPVREGMKVQTQNPKIATLRRNVMELYISDHPLDCLTCPANGDCELQDMAGAVGLREVRYGFEGKNHLDGATDSSNPYFSFDDSKCISCSRCVRACEEVQGTFALTVEGRGFDSRISTGQDTNFLESDCVSCGACVQACPTATLTEKSVIDNGQPDHSIITTCAYCGVGCSFRADMQGDKVLRMVPDKNGKANQGHSCVKGRFAFGYATHQDRITSPMIRDNIEQDWREVSWEEALAFAAKRLTDIQEEHGRNSIGAITSSRCTNEETYLVQKLVRAVFQNNNVDTCARVCHSPTGYGLKATLNESAGTQTFESVMKADVVLIIGANPTDAHPVFGSLLKRRLRQGAKLVVADPRSIDLIDSPHTKAQHHLKLRPGTNVALINALAHVIVDEGLEDADFIQSRCDDASFQQWYKHIQDQRHSPESTTEITGVDATELRAAARLYANAGNGAIYYGLGVTEHSQGSSSVMAIANLAMVSGNIGREGVGVNPLRGQNNVQGSCDMGSFPHELPGYRHVSDESTRNLFEQEWQVSLDCEPGLRIPNMFEAAIHGDFKGLYCQGEDIAQSDPNTQHVQKALSSMKCIIVQDIFLNETAKYAHVFLPGSSFMEKNGTFTNAERRISRVRKLMPALAGKEDWQVTIELAKVLGYEMNYEHPSEIMDEIARLTPTFSGVSYERLDQLGSIQWPCNEKSPLGTPIMHTEDFVGEKGKFAITEYVATPEKANKHFPLLLTTGRILSQYNVGAQTRRTANQVWHDEDVLEIHPNDAEDRGINDGDWVGIASRAGTTALRALISQRVQPGVVYTTFHHPLSGANVVTTDNSDWATNCPEYKVTAVQATKVDEPSQWQAEYAQFSQRQAKYLKNKNGGEVAKT

SEQ ID NO: 36651 - protein, 316 aa, Kineococcus radiotolerans SRS30216
MTGTTSTGSPRSRTVVVGEALVDVVRTAGSATGTEHPGGSPLNVAYGLGRLEHDVALLTRLGDDEHGALLRAHLDRAGVQLFPGTVDADPTAVARAEIDAEGKATYDFDLLWRVPEVELAPDVTLVHTGSIGAAVSPGAETALSLLRSVRGRATTSYDPNVRPAFFDGPARALARVEEFVDAADVVKASDEDLAWLLPGEDPEVVAHRWQTRGPALVVVTRGSAGAIAVSGAGTLHVPAPRVDVVDTVGAGDAFMSGLLHALHEHDLLGAQGLPRLRHLGLGTLESLVATAIRSASITCSRAGANPPTRAELTAPA

SEQ ID NO: 36652 - protein, 292 aa, Zea mays
MDQYEKVEKIGEGTYGVVYKGKDRHTNETIALKKIRLEQEDEGVPSTAIREISLLKEMQHRNIVRLQDVVHNDKCIYLVFEYLDLDLKKHMDSSTDFKNHRIVKSFLYQILRGIAYCHSHRVLHRDLKPQNLLIDRRNNLLKLADFGLARAFGIPVRTFTHEVVTLWYRAPEILLGARHYSTPVDVWSVGCIFAEMVNQKALFPGDSEIDELFKIFRILGTPTKETWPGVASLPDYKSTFPKWPPVDLATVVPTLEPSGIDLLSKMLRLDPSKRITARAALEHDYFRDLEHA

SEQ ID NO: 36653 - protein, 287 aa, Arabidopsis thaliana
MERIQKDVTQSMRGIRVTEQQEHGSGVMELLQVVDIDSNVEDPQCCSLYAADIYDNIHVAELQQRPLANYMELVQRDIDPDMRKILIDWLVEVSDDYKLVPDTLYLTVNLIDRFLSNSYIERQRLQLLGVSCMLIASKYEELSAPGVEEFCFITANTYTRPEVLSMEIQILNFVHFRLSVPTTTTFLRRFIQPAQASYKVPFIELEYLANYLAELTLVEYSFLRFLPSLIAASAVFLARWTLDQTDHPWNPTLQHYTRYEVAELKNTVLAMEDLQLKHQWLYSRCHP

SEQ ID NO: 36654 - protein, 451 aa, Zea mays
  misc_feature (107)..(107): Xaa can be any naturally occurring amino acid
  misc_feature (344)..(344): Xaa can be any naturally occurring amino acid
  misc_feature (386)..(386): Xaa can be any naturally occurring amino acid
  misc_feature (420)..(420): Xaa can be any naturally occurring amino acid
  misc_feature (436)..(436): Xaa can be any naturally occurring amino acid
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGXWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDKTYDLNFKEENNDGSNKISGDSLKDLYKSFVSEYPIESIEDPFDQDDWSTYAKLTDEIGQKVQIVGDDLLVTNPTRVAKAXINEKTCNALLLKVNQIGSVTESIEAVRMSKRAGWGVMASPQXSGETEDTFIADLSVGLSTGQIKTGAPCRSERLAXKYNQLLRIEEELGDAXAVYAGAKFRAPVEPY

SEQ ID NO: 36655 - protein, 252 aa, Streptococcus pyogenes M1 GAS
MSRKPIIAGNWKMNKNPQEAKAFVEAVASKLPSTDLVDVAVAAPAVDLVTTIEAAKDSVLKVAAQNCYFENTGAFTGETSPKVLAEMGADYVVIGHSERRDYFHETDEDINKKAKAIFANGLTPIVCCGESLETYEAGKAVEFVGAQVSAALAGLSAEQVASLVLAYEPIWAIGTGKSATQDDAQNMCKAVRDVVAADFGQEVADKVRVQYGGSVKPENVKDYMACPDVDGALVGGASLEADSFLALLDFLN

SEQ ID NO: 36656 - protein, 222 aa, Brassica napus
  misc_feature (181)..(181): Xaa can be any naturally occurring amino acid
HASGAVTRPPHLSIVTEFLPRGSLYRLIHRPNNQLDERKRLRMALDAARGMNYLHSCNPVIVHRDLKSPNLLVDKNWVVKVCDFGLSRMKLSTYLSSKSTAGTAEWMAPEVLRNEPADEKCDVYSYGVILWELFTLQQPWGKMNPMQVVGAVGFQHRRLEIPESVDPRIADIISKCWQTDXRLRPSFAEIMTSLKQLQKPIMSPNVQRATPSTSSMITEQEQ

SEQ ID NO: 36657 - protein, 540 aa, Amorpha fruticosa
MAFETEEPKEFIFRSKLPEIPISKHLPLHSYCFENLSEFGSRPCLISAPTGDVYTYYDVELTARRVASGLNKLGVQQGDVIMLLLPNSPEFVFSFLGASYRGAMITAANPFFTSAEIAKQAKASNTKLLITQASYYDKVKDLDVKLVFVDSPPDGHMHYSELREADESDMPEVKTNPDDVVALPYSSGTTGLPKGVMLSHKGLATSIAQQVDGENPNLYFHNEDVILCVLPLFHIYSLNSVLLCGLRAKAAILLMPKFEINALLGLIQKHRVTIAPIVPPIVLAIAKSPDLEKYDLSSIRVLKSGGASLGKELEDTVRAKFPKAKLGQGYGMTEAGPVLTMCLAFAKEPIDVKPGACGTVVRNAEMKIVDPETGNSLPRNQSGEICIRGDQIMKGYLNDQEATQRTIDKEGWLHTGDIGYIDDDDELFIVDRLKELIKYKGFQVAPAELEALLLSHPKITDAAVVPMKDEAAGEVPVAFVVRSNGHTDTTEDEIKQFISKQVVFYKRISRVFFIDAIPKSPSGKILRKDLRAKLAAGVPN

SEQ ID NO: 36658 - protein, 265 aa, Thermosynechococcus elongatus BP-1
MIRDNPCGTLDQVKFRRGKSRGVRPKVLAGNWKMHKTQQEAVAFLQEFLGELVDTPSDREVVLCVPYTCLSVLSKSLHGTRVKLGAQNVHWADQGAFTGEISPPMLVELGVRYVIIGHSERRQYFGETDATVNQRLRAAQSHGLTPILCVGETKAQRAAGETENHIFQQLALDLVDVDQTNLVIAYEPIWAIGTGDTCEETEANRVIGLIRSQLHNPDVPIQYGGSVNANNIDAIMAQPEIDGVLVGGASLQPQSFGRIVNYKPL

SEQ ID NO: 36659 - protein, 516 aa, Gentiana scabra
MPIKMSPIYATLTLHLAAALFLFFHVQKLVHYLHGKATGHRLPPGPTGWPILGALPLLGNMPHVTFANMAKKYGPVMYLKVGSHGLAIASTPDAAKAFLKTLDLNFANRPPNAGATHLAYNAQDMVFAHYGPKWKLLRKLSNLHMLGGKALENWADVRKTELGYMLKAMFESSQNNEPVMISEMLTYAMANMLSQVILSRRVFNKKGAKSNEFKDMVVELMTSAGYFNIGDFIPSIGWMDLQGIEGGMKRLHKKFDVLLTRLLDDHERTSHERKQKPDFLDFVIANGDNSDGERLNTDNIKALLLNLFTAGTDTSSSIIEWALAELLKNRTLLTRAQDEMDWVIGRDRRLLESDIPNLPYLQAICKETFRKHPSTPLNLPRIASEPCEVNGYYIPKGTRLNVNIWAIGRDPSVWGDNPNEFDPERFLYGKNAKIDPRGNDFELIPFGAGRRICAGTRMGILLVEYILGTLVHSFDLKLGLPEEELNMDETFGLALQKAVPLAAMLIPRLPLHVYAP

SEQ ID NO: 36660 - protein, 475 aa, Mycobacterium smegmatis str. MC2 155
MSQPDRTLGFPDGFVWGTATASYQIEGAVTAGGRAPSIWDTFSHKPGAVHNGDNGDVADDHYHRYREDVGLLADLGVTHYRFSLAWPRLQPDGKGPINTEGLDFYQRLVDELLAHDIQPWVTLYHWDLPQTLEDAGGWPARDTAQRFADYAAMTHGKLHDRIRHWTTLNEPWCSAFLGYAAGAHAPGRTEPAAALAAAHHLMFGHGLAVAAMRAQDGDSQLGITVNLTPVSPATEEPADVDAARRVDAVSNRLFLDALLRGRYPADLSADVAMISDFGFVQPGDEAVIAAPLDFLGVNYYFRETVRFGTGAPSDNPHARAWVGSTDVEPVRTGLPTTAMGWEIDPTGLYDVLSWVHREYGPVPIYVTENGAAFDDDAEADGSIRDDDRITFLDSHFRATLRAIDDGADIRGYFVWSLLDNFEWAYGYAKRFGLIHVDYATQVRTPKASARWFAEVTRRNGVPHVFRQNDAPADIR

SEQ ID NO: 36661 - protein, 376 aa, Buchnera aphidicola (Cinara tujafilina)
MNKEYTISVLPGDGIGPEIMLQAYKILDIINKNCMIKINIHQYDIGGIALDKYGTALPQKTLDGCKKSDAILFGSVGGPKWSSLPANIQPERGGLLPLRKFFNFFINIRPAKLYKILGYLSPLKNEIVKNGIDIICVRELIGGIYFGSPKGRKKINSKNFYAFDTETYSTYEIERIATIAFQLASKRKNIVCSIDKANVLESSILWREVVTHVSKKFPNIKLTHLYIDNAIMQIIKKPNTFDVLLCSNLFGDILSDECAILTGSIGMLPSASLNDTLFGLYEPSGGSAPELTGKNIANPIAQILSLAMLFRYSLKLNDISNLIELAVLKTLKDGYRTFDITDNENYITTDMMGTKISKKLLQMIRKNEKNIISKNF

SEQ ID NO: 36662 - protein, 855 aa, Rhizobium leguminosarum
MSGTHEPVDLTNCDREPIHQLGSVQPFGFLLAVSSDWIVIRASANLAEFLGVTEANALGRPVISLISPEALHAIRNKLTTLRGSDVVERIFGIALTPDQNSFDLAVHLNEGQVIIEGERCQEDRHDAASLSMRSMMSRLDHTETLEAFFREGARQARALTGFDRVMVYRFDESGSGEVVAEAARAGIGSFLGLHYPASDIPVQARALYLRNLFRIIADVDAVPVPILPPLDEHGQPLDLSMSVLRSVSPIHIEYLKNMGVGASLSISIVVDGKLWGLFACHHYGPRLPSAQSRSTAELFGQMFASRLESRERRLALDYETKARRIADRLLTSVADNASLLDDPAWLIEALADAIPADGIGVWINGRLALAGIGPDERSFAALVRHLNRNAAGRIYAVDRLAETYPDLEVDDAVAGMLAIPISRSPRDYVVLFRQELVRTVRWGGDPHKPVEYGPNGPRLTPRKSFEAWSELVRGRSLPFTEAERRVAETIRVTLIEVVLRLTDEVSMARQTANERQELLIAELNHRVRNILSLITGIIRQSQATSVSLGDYIRQLEGRIQSLARAHDQITRDHWAPASLRQLLLAETAAYLGKNAQRIQMGGEDVLLEPQAFSTAALVFHELMTNSAKYGSLSGTGSGTVQLRWHRDDEGNLRIGWREKDGPPVVEPKRHGFGSTIIRRSIPYDLGGKAEVRYVEDGLEADFSIPARHVVGPTSERSNPLPVGATGRKTIPDDQPLSGLNVLLVENNLIIAMDGEDILRRLGADVATAPSVTEAMEILAGQSFDLALLDVNLGDETSFGIADRLAADGVPFVFATGYGEGIAQANSHSDAPVLQKPYTMEGVTDILARVPLPRRE

SEQ ID NO: 36663 - protein, 251 aa, Pseudomonas syringae pv. tomato str. DC3000
MRRPMVAGNWKMHGTRASVAELIEGLVKQALPGSVDIAVMPASLFTSRVIEGLQGTSIIVGAQDAAIQAEQGALTGEIASSQLADAGCKLVLVGHSERRQLIGEQDEVLNKKFAAIQASGLTPVLCIGETLEERKAGQTLEVVGRQLDSVIAEFGIGALVNAVIAYEPVWAIGTGLTASPQEAQEVHAAIRAQLAKENAEVAQGVRLLYGGSVKAANAVELFSMPDIDGGLIGGASLNADEFGAICRAAGN

SEQ ID NO: 36664 - protein, 380 aa, Arabidopsis thaliana
MMMSDLPLDLVEEILSRVSATSLKRLRSTCKQWNTLFKKRSFSQKHFHIAPKESMVLMLKEYRVCSMNINLNVSPPSVEFQGTLGIKDDSHSNLGQVEIVEVYHCDGLLLCATRDNRLVVWNPCLGETRWIQLKDECRRYSTFALGYENNKFCRRNYKILRYWGWFHDHIPDDGGRFRFEIYDFRSDSWKVLDDVPDDRFPPVSVVSLKGNTYWFGSNKKDFLRSFDFTTERFNHIGLPPSRDHGFMALSVVGEEQLSVLQEIETSKMEIFVTNKVGTEEAALLWSKSFIVDLPIGGHCSEVFASLLINEEKKVALCCNLDFETDGNLIFTIGEDNKYYSEIPYATNKPWWLCRFSEKFTKKWWWFPFIYNYVPSLVQIL

SEQ ID NO: 36665 - protein, 441 aa, Burkholderia thailandensis E264
MTPPSSVAARPASDPLNDGYRKVAFRLIPLIFVCYLFNYLDRVNVGFAKLQMLSELNMSETVYGLGAGIFFVGYVLAGVPSNLVLRRVGARVWIAIIMIAWGALSSALLFVKTPASFYALRFFTGIAEAGFFPGMVLYLTQWFSAEHRGRAIALFMSAIPVSGVIGGPLSGWMLDHFSAGQGGLAGWQWLFLLQGAPTIVLGVAVFVLLQDRIDDARWLSGDEKAALNRALATTTADAARASAGQPRTLRDILLNGAVWKFGIVYFSIQMGVYAINFWLPSIIRSLGVAGSGAIGWLSAIPYLFASVAMIAVGKSADARQERRWHLSVPMAVGVAGLLMAAQSGGAIVPAMIGLVLATAGALTALAMFWPLPTLVLTGSAAAGGVALINSLGQVAGFVSPYIVGWIKDATQRTDLALYILSSTMAVGIVLVMRTHARRAGR

SEQ ID NO: 36666 - protein, 151 aa, Nectria haematococca
MSTAARRRLMRDFKRMQTDPPAGVSASPVPDNVMTWNAVIIGPADTPFEDGTFRLVMQFEEQYPNKPPQVKFISEMFHPNVYATGELCLDILQNRWSPTYDVAAVLTSIQSLLNDPNTGSPANVEASNLYKDNRKEYTKRVRETVEKSWED

SEQ ID NO: 36667 - protein, 162 aa, Triticum aestivum
MGVVSAVADAVVVLFSLTIAVGVPLIDAQAVLSHDAYPAQLRDLKRWYAAEFDDYLMAHPPPFFRGLLCLELAFLWPLSVATVYGVLARRRWAATTSLMVGVTTLTSLSAIFGEMLGSGKATTKLLQMYVPYAVFAVIAILRGLCSCSAPASPASSARKKRV

SEQ ID NO: 36668 - protein, 470 aa, Rhodopirellula baltica SH 1
MPQITSRIGRRLGETRWMLRIWALNRNAIVFGNSSSPGSVIVAELAHHNLDIKRVAILFAGGPAPAANAVISTAAFSFLEEGAQVFGIKHGYSRLAEYTAAGPLQEGTDYIRFTHDSLTHARSSRGIMIGTARTNPGKHVSSPEHLKDPELVAPLRRVYEGLCSLEVDALISIGGDDTLKTANKLKMFQDNLPGDARRFPVVHLPKTIDNDYSGIDFTFGFFTAVETLAEEIRNLNYDAAAGRAYFLCEAMGRSAGWLAYGAAIAGEASMVLSVEDITGALADEEVVNQETGETRKIMAMDRVIDRMVDMMLAREREGRQYGTIVIAEGMAEYLPAKYLEGVTRDDHGHINISLVNLSAVMSRLLAARYNERTGRTRKVNGLQMGYESRCAPPHAYDVMLGSQLGVGAYRALVEEKLNGVMVSVSGQFDLHFVPFEELVDPQTLVTKVRFIEQNSDFHRLARFLETCVDN

SEQ ID NO: 36669 - protein, 428 aa, Arabidopsis thaliana
MTMTTTISHLPTELLDEIISRVPLKSTRAVRLTCKNWDSLFKNRSFMKEEAAAKEGESRMIVLMDKNLFAMSIFFNGIDIDPSAEQRGKLTCLYDDSEQVKISQVFHCEGLLLCVLEDDKCSLVVWNPYWGQTRWIEPRYFSRIQNCYGRYMYVYALGYNNKSRSHKILRFIDGAFDFPFWYEIYDFDSDLWTTLDVTPQWFINFPPRGCYNRGVTLKGNTYWCAIRRKSNTNWFVDLDHIICFDFTSERFGPLMPLPFVRYTSGSLVTLSCVREEKLAVLFCNNATVEVWITTKIETDKISWSKFLTVNMYVDLLEGSFFIDEVKKVAMIFDIPMNRETVYIVGEAGNVKELHLGQPVDVDKHFSPLFVCSYVPSLVQIKQPPGCQRKQESSLEKRRCDDENISRLIAHEETYVVYGRYVPSRKKPR

SEQ ID NO: 36670 - protein, 357 aa, Debaryomyces hansenii CBS767
MPDYKLQSDFSFAGGIPEAPFKLHESMTKKLDPEYVKFFNSTLSSNPNIAYTHRVPLEKLRKAGNVIPGQTPLTEMAKTYDIEIPRKHTKAANSIPARVFVPKGNKPSEGWPLLVWFHGGGWVLGGLDTENSFCTKVADLCKCVVVSVDYRLAPQDPFPACVDDSFEAVLWALELGPTELEINSTKICVGGSSAGGNLTAIVTHKYANSELASKLPPICFQLMVVPVTDNSATAETQPSWGENEYTPQLPAEKMIWYRTLYLQKGGDEYINPESSPLFYPNESFVKLPPCFIAAAECDVLRSEAEAYAKKLKQNGIPTEIVIYPGVPHPVMVMDAILQQGRDLIQNTTDALKKAFYN

SEQ ID NO: 36671 - protein, 509 aa, Oryza sativa (japonica cultivar-group)
MATCSWAATTAAAAPPRPPARCRSRVAALRRTAAASAAAASCVLAEAPKGLKVEQADAVEPAAAAAARRDVGPDTVASIILGGGAGTRLFPLTRTRAKPAVPVGGCYRLIDIPMSNCINSKINKIYVLTQFNSQSLNRHIARTYNIGEGVGFGDGFVEVLAATQTTGESGKRWFQGTADAVRQFLWLFEDARLKRIENILILSGDHLYRMDYMDFVQKHVDKGADISVACVPVDESRASDFGLMKTDKNGRITDFLEKPKDESLKSMQLDMGTFGLRPEVADTCKYMASMGIYVFRTDILLRLLRGHYPTANDFGSEVIPMAAKDYNVQAYLFDGYWEDIGTIKSFFEANLALTDQSPNFYFYDPVKPIFTSPRFLPPTKVENCKVLNSIVSHGCFLTECSVDRSVIGVRSRLEPGVQLKDTMMMGADYYQTEAERFSELSDGKVPVGVGENTIIRNCIIDKNARIGKNVMIMNSQNVQEAERPLEGFYIRSGITVVLKNAVIPDGTVI

SEQ ID NO: 36672 - protein, 93 aa, Arabidopsis thaliana
GGPSRPKPRVSLYLSPVPMVAFPLKAVMFVLFTGLNSSVAFQATRRVNTTITSITGTGGGVNCFQVWPPMGKKKFETFFNFLDLTDSEWVKEV

SEQ ID NO: 36673 - protein, 373 aa, Thermosynechococcus elongatus BP-1
MGSWPSWDCSASSCNGWPNPWGSAMKAAVLYGKEDVRIETVPDPTPGPGEVVIRVRAATTCGTDLKVWRRGGHARMLTPPILFGHEAAGEIVALGAGVTGWQVGDRVVANNSAPCGQCFYCQRQAFSLCPHLEFNNGTFAEYLKLPASIVRQNLLPIPESLPFALAALTEPLACVLHGVARSGFDPAMVATWPSPPQIVVLGDGAIGLMFVGVLAQQGARVLAFGGSNQRLAIATTFGAEQTINHHQCGDIPAVVKDWTEGRGADIVIEATGVPEVWETAIACGRPGATINLFGGCPRETTIRVDTERLHYEELTLKGVFHNTPSFVRQALQLIASGTLPFEKLISGQAPLMEIETVLQAMKARQVIKVALQP

SEQ ID NO: 36674 - protein, 324 aa, Mycobacterium smegmatis str. MC2 155
MNEMTELLRESRMGALGTESHAREVRQISLADFGSRFDEIADELWAAATDIGFFQVVEHGIDLAEVDRVFDVAQRFFALPTAVKEKYPLKRGQNAGWEYKSQIRPSVGTADEKESYQFTRPRMDGLWPAPDELDGFRDTIEDFERRCWRLAMDILSCFAVRLGFDREFFARAHDPDAPTYQSTLRLLHYYAFPAELVGRDDVWRAGAHTDFDALTLLFQRSGQPGLQVLPGAEADQQVWTPVHPSDDVITCNIGDMLMRWSDDLLPSNFHRVRAPRPGESLDPRYSVAYFAQANTDVLIESPKGTYPPITAAEYLRRRIAANFG

SEQ ID NO: 36675 - protein, 261 aa, Arabidopsis thaliana
MKLPFLNKNHSTSSYSSNSSSSSWPWPSCNQNPKTLSFRATITFTNPIHDQDDDELDLLDPPEITDSVENVIKGLRSSERLIFESKGETNSILEEATSKREEEDEEEGFMLFSLESDDPYSDFKRSMEEMVEAHALHHDWKSLEKLLLQFLKVNAKTSHRYIFAAFVDLLMNLALDTKKAIINNDISKDDGVSASRAAAAGEASTSCCNSMTLGESPSSPLSFYTSCSSSSSSDETSSMSVRFLPLSSLLEMDEKTKEILV

SEQ ID NO: 36676 - protein, 81 aa, Mycoplasma genitalium G37
MKRCYITTPIYYASGKPHIGHAFTTILADVIKRFKIQNGYEAFLLVGSDEHGNKIESKAKSLNLDPKTFVDINAQAFKLMW

SEQ ID NO: 36677 - protein, 1073 aa, Pseudomonas syringae pv. tomato str. DC3000
MPKRTDIKSILILGAGPIVIGQACEFDYSGAQACKALREEGYRVILVNSNPATIMTDPAMADATYIEPIKWQTVAKIIEKERPDALLPTMGGQTALNCALDLEREGVLEKFGVEMIGANADTIDKAEDRSRFDKAMKSIGLACPRSGIAHSMEEANAVLEKLGFPCIIRPSFTMGGTGGGIAYNREEFEEICARGLDLSPTKELLIDESLIGWKEYEMEVVRDKKDNCIIVCSIENFDPMGVHTGDSITVAPAQTLTDKEYQILRNASLAVLREIGVETGGSNVQFGICPDTGRMVVIEMNPRVSRSSALASKATGFPIARVAAKLAVGYTLDELSNEITGGKTPASFEPSIDYVVTKLPRFAFEKFAKADARLTTQMKSVGEVMAIGRTFQESLQKALRGLEVGVCGLDPKLDLSHPESMSTLKRELTVPGAERIWYVADAFRAGMTVEEIFAMNMIDPWFLVQIEDLVKDEEKIKTLGLSAIDRDLMYRLKRKGFSDARLAKLVGVTEKNLRTHRHKLDVFPVYKRVDTCAAEFATDTAYLYSTYEEECEANPSTRDKIMILGGGPNRIGQGIEFDYCCVHAALALREDGYETIMVNCNPETVSTDYDTSDRLYFEPVTLEDVLEIVRVEKPKGVIVQYGGQTPLKLARALEAAGVPIIGTSPDAIDRAEDRERFQQMVERLNLRQPPNATVRSEDEAIRAAAKIGYPLVVRPSYVLGGRAMEIVYQEDELKRYLREAVQVSNDSPVLLDHFLNCAIEMDVDAVCDGTDVVIGAIMQHIEQAGVHSGDSACSLPPYSLPAHIQDEMREQVKKMALELGVVGLMNVQLALQGEDIYVIEVNPRASRTVPFVSKCIGVSLAMIAARVMAGKTLKELNFTKEIIPNFYSVKEAVFPFAKFPGVDPILGPEMKSTGEVMGVGDTFGEAFAKAQMGASEVLPTGGTAFISVRDDDKPLVEAVARDLINLGFEIVATAGTAKLIEAAGLKVRRVNKVTEGRPHVVDMIKNDEVTLIINTTEGRQSIADSYSIRRNALQHKIYCTTTIAAGEAICEALKFGPEKTVRRLQDLHAGLKA

SEQ ID NO: 36678 - protein, 380 aa, Pseudomonas syringae pv. tomato str. DC3000
MAKRDYYEVLGVERGSSEADLKKAYRRLAMKHHPDRNPDDKASEEMFKEANEAYEVLSDASKRAAYDQYGHAGVDPSMGGGGGFGGGAGGANFSDIFGDVFSDFFGGGRGGGGGGRGGAQRGSDLRYTLELNLEEAVRGTTVNIRVPTLVNCKPCDGSGAKKGSSPVTCPTCGGIGQVRMQQGFFSVQQTCPRCHGHGKIISDPCDSCHGEGRVEESKTLSVKVPPGVDTGDRIRLSGEGEAGAQGGPTGDLYVVINVREHAIFQRDGKHLFCEVPISFTDAALGGELEVPTLDGRVKLKIPEGTQTGKQFRLRGKGVAPVRGGGAGDLMCRVAVETPVNLSKRQRELLEEFRTSLENDESHSPKASGWFEGVKRFFGDL

SEQ ID NO: 36679 - protein, 626 aa, Bifidobacterium longum NCC2705
MVVQHNQPGSTDQSVIRNFCIIAHIDHGKSTVADRILQLSGIVPEREMRDRFLDRMDIEQERGITIKSQAVRVPWTFDGTEYTLGMIDTPGHVDFTYEVSRALAACEGAVLLVDATQGIEAQTLSNLYMAIDHDLAIIPVLNKIDLPSAEPDKHAEEIAGLIGCEPSDVLRVSGKTGEGVADLLDQIVMDVPAPHGDPDAPARALIFDSVYDSYRGIVTYIRMEDGELHDREKVHMMGIGMTHDPIEIGVISPDMTRTKALGAGEVGYIITGAKDVSQSKVGDTLTSAVRPAAEPLPGYRDPKPMVYAGLFPIDNAQFPELRDALDKLKLNDAALIYTPETSVALGFGFRCGFLGLLHMEIVNERLSREFGLDLIQTAPNVTYDVTAEDGSQHHVTNPSEFPDGKIKKIVEPMVAADIITPKEFIGAVMDLCQDHRGIMGTMEYISTDRVEMHYRIPLAEIVFDFFDQLKSRTKGYASLDYHEDGEQSADLVKVDILIQGEKVDAFSAIVHRDKAYSYGVMMTKKLRSLIPRQQFEIPIQAAIGSRIIARENIRALRKDVLAKCYGGDITRKRKLLEKQKAGKKRMKMLGHVEVPQEAFIAALSTGEDSNDRDTKDKIRAAQKTEG

SEQ ID NO: 36680 - protein, 591 aa, Psychrobacter arcticus 273-4
MVTVVENIDPKIKPVPAVIKELEEKYAGKFVVQHTVDEIPTVWVARADLLDVLLFLRKLPKPYVMLFDLSAIDERLRQHRQGLPESDFTVFYHLMSLERNSDVRIKVALSEEDLNVPSATQIWPNANWYEREVWDMFGIVFTGHPHLTRILLPKYWEGHPLRKEYHARATEFTPYFLNTAKQQYEQENLRFVPEEWGMKRSGRDEDFMFLNIGPNHPSAHGAFRLVLQLDGEEVVDCIPDIGYHHRGAEKMAERQTWHSFIPYTDRIDYLGGVMNELPYIMSVEKLAGITIPPRAETIRVMMSEFFRITNNLLFVGTFIQDAGGMTPVFYMFTDRQKAYDVIEAVTGYRMHPAWFRIGGTAHDLPRGWQRLVREFLDWMPKRLDEYVKAALQNSVLKGRTQGVAQYNTKQALAWGVTGAGLRATGLDFDLRKARPYMGYENYDFEVPVGYNGDAYDRCMVKVEEMRQSLRIIRQCMDNMPQGPYKADHPLAVPPPKDRTLNDIETLINHFISVSWGPVMPAGECTTIVEATKGLNSYYITSDKATMSYRTRIRTPTFAHLQQMPSVINGSLVSDAIMYLASIDVVMADCDR

SEQ ID NO: 36681 - protein, 126 aa, Debaryomyces hansenii CBS767
MPAEKLEWSAIDGKEHPVLGPAWKSNGHVFTSGIVGQNYANGRIPESLEEQTELAIANVKKVLEASGSSLDKVFKVLMFISHSDYSATVNKIYGKHFPQKPARSCVVVAFMDAAIKVELEVVASTD

SEQ ID NO: 36682 - protein, 394 aa, Bacillus cereus E33L
MNKKSIRDVDLKGKRVFCRVDFNVPMKEGKITDETRIRAALPTIQYLVEQGAKVILASHLGRPKGQVVEEMRLTPVAARLGELLGKDVKKADEAFGPAVQEMVAAMNEGDVLVLENVRFYAGEEKNDAELAKEFAALADIFVNDAFGAAHRAHASTAGIADYLPAVSGLLMEKELEVLGKALSNPERPFTAIIGGAKVKDKIGVIRHLLDKVDNLIIGGGLAYTFVKALGHEIGLSLCEDDKIELAKEFMQLAKEKGVNFYMPVDVVITEEFSETATTKIVGIDSIPSNWEGVDIGPKTREIYADVIKNSKLVVWNGPMGVFEMTPFAEGTKAVGQALADAEGTYSVIGGGDSAAAVEKFGMADKMSHISTGGGASLEFMEGKELPGVVCLNDK

SEQ ID NO: 36683 - protein, 375 aa, Bifidobacterium longum NCC2705
MTENTHHDPAALDKLAEPFTVLPNDNPASDEKRQSLIDKPAFGQVFSDNMTHMTWTKGEGWSDRRVEPYAPLKMDPGASVLHYAQECFEGLKAYRHADGSTWLFRPDANAERFQNSAKRLYLPELPIDDFLGSVAALVKRDANWVPSRREYTLYMRPFMFASEPFLGVRAPQEVDYCVIASPSGPYFPGGVKPVSIWVEDKWFRTGPGGTGFAKCGGNYAASLLGEYKGVENGCEQVCFVDAATKTYLEELGGMNMMAVHKDGHVETPSLTGNILPGVTRRSLIQLLQDKGHDVVETMIALDQLLEDIKSGEVTEVFACGTAAIITPIGRFKSEKFDVAVADGGSGKLTCELRDELLGIQLGEVEDPHNWMWKVC

SEQ ID NO: 36684 - protein, 182 aa, Psychrobacter arcticus 273-4
MFTTIKKTVIGLFTIVRSMWMVNSHAIRPRDTILYPEVPVPVPPRFRGRIILSRDPDGDERCVACNLCAVACPVGCISLQKAEREDGRWYPEFFRINFSRCIFCGLCEEACPTTAIQMTPDFEMSEYVRQDLVYEKEHLLISGPGKYPDYNYYRVTGMAVADKPKGAAQNEAAPIDLRSLLP

SEQ ID NO: 36685 - protein, 431 aa, Bacillus cereus E33L
MSTIIDVYAREVLDSRGNPTVEVEVYTESGAFGRAIVPSGASTGEHEAVELRDGDKSRYLGKGVMNAVNNVNEAIAPEIVGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERLGDKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEIAVYDGIKSFYNIKR

SEQ ID NO: 36686 - protein, 355 aa, Dianthus caryophyllus
NSTKIAPSRVETLASSGIECIPKEYVRPEEELTSIGDVFEEEKKDDGPQVPTIDLKDIASEDPEVRAKAIHELKKAAMEWGVMHIVNHGISEELINRVKVAGETFFEFPIEEKEKYANDQDSGNVQGYGSKLANNASGQLEWEDYFFHLAYPEEKRDMSIWPKSPEDYIPAVSEYSKELRSLATRIFSALSVALGLEEGRLEKEVGGLEELHLQMKINYYPKCPQPELALGVAAHTDVSALTFILHNMVPGLQLFYEGKWVTAKCVPNSIIMHIGDTIEILSNGKYKSILHRGLVNKEKVRISWAVFCEPPKEKIILKPLLDLVNESDPAQYPPRTFAQHIQHKSSERLRMSNPQ

SEQ ID NO: 36687 - protein, 426 aa, Escherichia coli O157:H7 EDL933
MSKSENLYSAARELIPGGVNSPVRAFTGVGGTPLFIEKADGAYLYDVDGKAYIDYVGSWGPMVLGHNHPAIRNAVIEAAERGLSFGAPTEMEVKMAQLVTELVPTMDMVRMVNSGTEATMSAIRLARGFTGRDKIIKFEGCYHGHADCLLVKAGSGALTLGQPNSPGVPADFAKHTLTCTYNDLASVRAAFEQYPQEIACIIVEPVAGNMNCVPPLPDFLPGLRALCDEFGALLIIDEVMTGFRVALAGAQDYYGVEPDLTCLGKIIGGGMPVGAFGGRRDVMDALAPTGPVYQAGTLSGNPIAMAAGFACLNEVAQPGVHETLDELTTRLAEGLLEAAEEAGIPLVVNHVGGMFGIFFTDAESVTCYQDVMACDVERFKRFFHMMLDEGVYLAPSAFEAGFMSVAHSMEDINNTIDAARRVFAKL

SEQ ID NO: 36688 - protein, 548 aa, Nocardioides sp. JS614
MDTLAGMDAVTHPPAPVNEPNLTYAPGTPERESLLVEIERLEKRQKSLRAYIGGRWKAGGGAEVAVVQPHDHQHVLGVLKNATQADARAAVKAAGEAAPQWRAMDFDDRAAILLKAAELLAGPWRQRLNAATVLGQSKTPFQAEIDAACELIDFWRYNVHYAREILADQPIANSRGIWNRTDHRPLEGFVYAITPFNFTAIAGNLPTAPALMGNTVIWKPSPTQQLAASLTMELLEEAGLPPGVINMLPGDGIDVSAVALAHPDLAGIHFTGSTPTFQHLWREVGNNIENYRSYPRIVGETGGKDFIVAHASADPDVLRTAMIRGAFEFQGQKCSAASRAYVARSVWTRMKDSFLAEIESITVGDPTDFSNFMGAVIDERAFAKHRKAIERAKRSRKLDIVVGGTLDDSAGWFVDPTVVEGGDPTDEMFTTEYFGPILAVHVFEDGDFEKVVRGMESIAPYALTGSVIAQDRRAIAWAQDELRFAAGNFYINDKPTGAVVGQQPFGGGRASGTNDKAGAAVNLLRWTSPRSIKETFVPPTDYRYPYLG

SEQ ID NO: 36689 - protein, 141 aa, Xanthomonas campestris pv. campestris str. ATCC 33913
MALERTLSIIKPDAVAKNVIGEIYSRFEKAGLKVVAAKYKQLSRREAEGFYAVHRERPFFNALVEFMISGPVMIQALEGENAVAAHRDLLGATNPKDAAPGTIRADFADSIDANAAHGSDSVENAANEVAYFFAATEVVSR

SEQ ID NO: 36690 - protein, 566 aa, Kineococcus radiotolerans SRS30216
MDARLGDDGPVRVPRPDPLPRDVPFRRAAAADRARGVRAVGAGPGAAVHGRGPQGVVAEEDHPGRQDGLSVLASTVGIFRTKSVEDAIASTDEPGQRLRKSLSAWDLTVFGVGVIIGTGIFVLTGEAAGTRAGPAVALSFVVSGIVCALAALCYAEFASTVPVAGSAYTFSYASLGEVVAWIIGWDLILELALGASTVAVGWSSYAADLLGQTLGLAVPAWLYSATPSPTQPNLIAAAVVLVLTAVLCVGTKTSARFNAVVVGIKLAVVGVVIVAGLFFVKVSNWSPFVPPTGSAGASSTPADPSLWQDLGLPLGTFGVGGILTAAALVFFAFIGFDIVATAAEETKNPQRDVPRGIFGSLAVCTALYVLVSLVVTGMVRYDEISVEAPLANAFRAVGADVVATLISVGTVAGLLTVMMILMLGQSRVLFAMARDRLIPAWFSKVSERTQVPVRITAITGVVVAVVAAVTPISDLAEMVNIGTLFAFVLVSVGVVVLRRTRPDLPRAFRVPWVPVLPIASALAAVVLMGFLPAVSWVRLGIWMALGLLVYLAYGYRHSRLARRPGA

SEQ ID NO: 36691 - protein, 375 aa, Polyangium cellulosum
MIEESHVIIIGAGPSGLAVGACLRERGIPFVLLEQSDAVGASWRRHYQRLHLHTVKQFSSLPGLAWPRYAPPYPSRAQMVDYLQRYAERFRLEPRFGAEVVRAYRDGSRWVTQTRAGEFTSRALVVATGYSRLPNVPTWPGQERFRGPILHSSTYGSGAAFRGQRVLVVGSGNSGGEIAMDLWEHAAETTVSARSGIHVIPRDPLRLPAQFSALALYGALPPAVGDRLATAFLSRTVGDLSRWGIHRPEIGPGTRAVKEGRIPLIDMGTLALIQQGKIAVVPGPRAFTETGVIFTDGRELPFDAVVLATGYRAGLGDFLEDAARFTDERGYPRWHGAPTPTPGLFFIGFRNPITGQLRDIAAEAPRVARHLRGVN

SEQ ID NO: 36692 - protein, 542 aa, Polyangium cellulosum
MRDAHCEPRGASGKLPPRFRANEEPLMAQAFPASPTTTPSTRTLVVQSPIDGSRLGEVPLMGDAEVHAAVERARLAQRAWAQLPIETRAGRVARVIDAFVERLDDLVDAVVLETGKPRNDALAEWITVVDACHYFTRHAGRILADTSITLHHMKWRGSYVTYVPMGVVAVISPWNLPLAIPMGSVIEALIAGNAVVVKPSEVTPLTLLKAKEVVDAIGIPTDLFQVVTGDARTGAALIDAGVQKVVFTGGVSSGRRVGAACAERLIPCVLELGGKAPLIACDDCEIERTARSIVAGGFINSGQLCISVERVLATEAVHDRLVDRVVALTRELRQGDPRADDVDVGAIIFAKQMDIAEAHIKDAVARGALVATGGRRRPGPGMFFEPTVLTRCTPEMTVMREEIFGPVVPIMKVRDEDEAVRIANDSPLGLHAYVFSRDKTRARAVAERIEAGTVMINDVLVSYCAPEAPFGGIKNSGYGRVHSDDSLRAMCYARHVNHERFAMPLNSPLLFPYTTAKYRGMRAAIRATFKRTPLLGRLADLL

SEQ ID NO: 36693 - protein, 360 aa, Arabidopsis thaliana
METKEFDSYSERKAFDETKTGVKGLIDAHITEIPRIFCLPQGSLSDKKPFVSTTDFAIPIIDFEGLHVSREDIVGKIKDAASNWGFFQVINHGVPLNVLQEIQDGVRRFHEEAPEVKKTYFTRDATKRFVYNSNFDLYSSSSCVNWRDSFACYMAPDPPNPEDLPVACRVAMFEYSKHMMRLGDLLFELLSEALGLRSDKLKSMDCMKGLLLLCHYYPPCPQPDLTIGTNNHSDNSFLTILLQDQIGGLQIFHQDCWVDVSPIPGALVINMGDFLQLITNDKVISVEHRVLANRAATPRISVASFFSTSMRPNSTVYGPIKELLSEENPSKYRVIDLKEYTEGYFKKGLDGTSYLSHYKI

SEQ ID NO: 36694 - protein, 446 aa, Polyangium cellulosum
MASSEDGTRSWSNTKSLALHERAAKVMPGGQANFRGGLLSTPLFFSHARGARLWDVDGNEYVDLINAGGPGILGHNDPEYIDALKRQLDTVYSLGSGICQTEQDIELAEKIASHVPCAERVRFCVTGSEAVHLALRLARAYTKRPYFIRFQTHYHGWFDSVLGGVVDEHPEGRPLPLESEQSFFHTEGRVPDAFKYSFLLPWNDIDVLEETLKKYGHEVAMIHMEPILVNGGGCPPRPGYLERVRELCDQHGIVLGFDEVITGFRVGLGGAQAALGVTPDLATFGKALGGGMPMAAVAGKAEIMDQLRTGKVTGAGTFNGYPLGVAASLATLKILERDDGAVYRRIDMMQARLKEGLLDICKRRGIPALVQGPRGVFFLLFTDKPVIYSFQELMEAALPRQFKFYSTMPEEGTLLMYGGRWYISAALTEADVDCALESADRTLARI

SEQ ID NO: 36695 - protein, 591 aa, Cryptococcus neoformans var. neoformans JEC21
MFFKRNSTDTPKPPKHAPDRDTIPSLEDLGVQLHPDTARYVADSEALAHAIGGNGLKDVFSSGLVLIASFATCMGGLLFGFDQGILTIVLTMKQFLGQFPDIDPDVSSSAAFHKGLMTALLELGALIGALQAGFVADKYSRKSAIGLGSVWFVIGAILQTSSFSYAQLVVGRLVGGLGVGLLSAVAPMYISEIAPPNIRGALLAMEATTINGGIVIMFYITYGSRHIPGDWSFRLPFLVQIAPCILLIFGLWKLPYSPRWLAQAGRDEDALHALVRLRGYPATDPRLQAEWISIRAEAIQNREVIVKSHPSLQGEDFMSEFKLEIASWIDMFKPKLIRRTIIGPTLMMFQQFSGISALVYYSPTLFEQLGLDYTMQLDMSGVLNIIQFVATGLAFFILDRVGRKPPLLFGSVATTICHVIVAVIMAKFSHDWVRYNKEAWVAVAFIFIYIFSYGVGWSPVPWAMPAEVHTSSRRAKGVAITTVFNWLGNFIIGLITPPMLENIKYGTFIFFATFCFLSGLYVWFFCPEPMGKTLEQMDQIFHSNTAHEDNLAKSDIQAAILGISIAGPLSGSAIAGKVGDKDIQQEWIENA

SEQ ID NO: 36696 - protein, 336 aa, Bacteroides fragilis NCTC 9343
MKIGILTSGGDCPGINATIRGVCKTAINHYGMEVVGIHSGFQGLLTKEVESFTEKSLSGLLNLGGTMLGTSREKPFRKQGIISDVDKPALIQRNIAELGLDCVVCIGGNGTQKTAAKFAAMGINIVSVPKTIDNDIWGTDISFGFDSAVSIATDAIDRLHSTASSHKRVMVIEVMGHKAGWIALYSGMAGGGDVILVPEIPYNIKNIGDTILNRLKKGKPYSIVVVAEGIQTDGRKRAAEYIAQEIEYETGIETRETVLGYIQRGGSPTPFDRNLSTRMGGHATELIANGQFGRMIALKGDEISSVALEEVAGKLKLVTEEHDLVVQGRRMGICFG

SEQ ID NO: 36697 - protein, 254 aa, Solanum lycopersicum
AREKAHLEFVEVLNVKEQVVAGMMYYITLAVTDAGKKKIYEANIWVKEWEHFIKVVEFKPVSDDSVKTGDIVDVPDPNIPPLQDLARFAVQDYNKAQNAHLEYVENLNVKEQLVAGTLYYITLVATDAGKKKIYETKIWVKEWEDFKKVVEFKLVGDDSPNPGGITNVPFPNLPEFKDLARFAVQDYNKKENAHLEFVENLNVKEQVVAGIIYYITLVATDAGKKKIYETKILVKGWENFKEVQDFKLVGDAIK

SEQ ID NO: 36698 - protein, 204 aa, Chloranthus spicatus
LCDAEVALIVFSNRGKLYEFCSSSSMLKTLERYQKCNYGAPDTTVSTREMQSSQQEYLKLKARVEALQRSQRNFLGEDLGPLSGKELEQLERQLDMSLKQIRSTRTQYMLDQLTDLQRREQMLCETNKALKRRLDEVTPANPHQGWDPNPHGVSYGRQAAQQQGDGFFHPLECEPTLQIGYQHDQITIAAPGPSVSNYMPGWLA

SEQ ID NO: 36699 - protein, 178 aa, Glycine max
  misc_feature (91)..(91): Xaa can be any naturally occurring amino acid
  misc_feature (100)..(100): Xaa can be any naturally occurring amino acid
  misc_feature (122)..(122): Xaa can be any naturally occurring amino acid
  misc_feature (149)..(149): Xaa can be any naturally occurring amino acid
MASSMISSPAVTTVNRAGPGMVAPFTGLKSMAGFPTRKTNNDITSIASDGGRVQCMQVWPPVGKKKFETLSYLPDLDDAQLAKEVEYLLKXGWIPYLEFXLKHNFVYHKHNKSPIYYNKRYXTICKRAIFICTNTSHILNKRARTNTTXGNNCIRMITCGRHRQLQYISCISYERPSY

SEQ ID NO: 36700 - protein, 339 aa, Glycine max
  misc_feature (31)..(31): Xaa can be any naturally occurring amino acid
MGKVKIGINGFGRIGRLVARVALQRDDVELXVAVNDPFITTDYMTYMFKYDSVHGHWKHHDVTVKDEKTLLFGDKAVTVFGHRNPEEIPWGSTGADIIVESTGVFTDKDKAAAHLKGGAKKVIISAPSKDAPMFVVGVNEHEYKPELDIISNASCTTNCLAPLAKVINDRFGIVEGLMTTVHSITATQKTVDGPSAKDWRGGRAASFNIIPSSTGAAKAVGKVLPALNGKLTGMAFRVPTVDVSVVDLTVRLEKEASYDEIKNAIKEESEGKLKGILGYTEDDVVSTDFVGDNRSSIFDAKAGIALNKNFVKLVSWYDNEWGYSSRVIDLLVIVAKKSF

SEQ ID NO: 36701 - protein, 392 aa, Bacillus subtilis
MEKASGAYFWDVDGNKYIDYLAAYGPIITGHAHPHITEAIKKAAENGVLYGTPTKHEVTFAKMLKEAIPAMDKVRFVNSGTEAVMTTIRVARAYTGRTKIIKFAGCYHGHSDLVLVAAGSGPSTLGTPDSAGVPKSIANEVITVPFNDIDSYKAALEKWGSEIAAVLVEPIVGNFGIVEPKEGFLEQVNELTHNAGALVIYDEVITAFRFMYGGAQDLLQVKPDLTALGKIIGGGLPIGAYGGKQEIMEQVAPLGPAYQAGTMAGNPASILSGIACLEVLKEKGVYEKLDHLGAMLEEGIMKHAETHGITITVNRLKGALTVYFSDEKVENYEQAERSDGETFSTFFKLMLERGINLAPSKYEAWFITTAHTEQDIKDTLTAVEDAFKHLKN

SEQ ID NO: 36702 - protein, 311 aa, Bacteroides fragilis NCTC 9343
MIHIACNIDSNFTIHCAVTLTSLFANNRNSEFCVHIIASTLPEADQKALSSIAESYGNKICFYFPEKDLLNNFSIKKSGNRISIATYYRCLLSRILPVNIDKILYIDCDIVVLNDISEFWNTDITQYAIGCIEDIGSDEEEYYSRLQYDKKYSYFNAGVLLINLKYWREHKIDEMCEQYFLAHSDRIRFNDQDLLNALLYKDKLFVPFRWNVQDTFYRRTYSHKVKEHSGLKEALLHPAILHYTNKKPWNYDSMHPLKQEYFKYLDMTPWKGTRPIIDFQTRVITGFKRLLYITGIKKSKYINLKDYELAQ

SEQ ID NO: 36703 - protein, 401 aa, Xanthomonas campestris pv. campestris str. ATCC 33913
MNEVVIPSVLLDVPVSAAPVHKQNLLDLDREGLEHFFADTLGEARYRAHQVMKWIHHRYVTDFDQMTDLGKALRAKLHQHAEVLVPNVVFDKPSTDGTHKWLLAMGTDGKNAIETVYIPDKGRGTLCVSSQVGCGLNCTFCSTATQGFNRNLTTAEIIGQVWVAARHLGNVPHQQRRLTNVVMMGMGEPLMNFDNVVRAMSVMRDDLGYGLASKRVTLSTSGLVPMIDRLATESDVSLAVSLHAANDVLRESLVPLNKKYPIAELMESCARYLRGNKKRDSVTFEYTLMKGINDQPEHARQLARLMRQFDNAVQSKDAGKVNLIPFNPFPGTRYERSGETEIRAFQKILLDAQVLTMVRRTRGDDIDAACGQLKGQVMDRTRRQAEFRRTLEGQADRDAAA

SEQ ID NO: 36704 - protein, 112 aa, Bifidobacterium longum NCC2705
MSESDDCLFCKIIAGQIPSSKVYEDETTYAFNDINPKAKVHVLVVPKKHYANVAELAADDPTELAHIVSIAQNIADKEFHGAYRLVFNTGLDAGQTVFHVHAHVMTGEKLDE

SEQ ID NO: 36705 - protein, 137 aa, Zea mays
  misc_feature (71)..(71): Xaa can be any naturally occurring amino acid
MARTKQTARKSTGGKAPRKQLATKAARKSAPTTGGVKKPHRYRPGTVALREIRKYQKSTDLLIRKLPFQRXLVREIAQDFKTDLRFQSHAVLALQEAAEAYLVGLFEDTNLCAIHAKRVTIMPKDIQLARRIRGERA

SEQ ID NO: 36706 - protein, 127 aa, Rhodococcus sp. RHA1
MNRQQVSTEHAPSPAGHYSQAIIADGVLYTAGQTPHHPDTWELVGTTIEEQTEQAMRNLAAVLESCGSDFSHVVKATVHLQNPARDFTGFNETYQKFVSHPYPARTTVGSHLGDFLVEIDVVALCPR

SEQ ID NO: 36707 - protein, 340 aa, Mycobacterium smegmatis str. MC2 155
MSSNLKLAVIAGDGIGPEVIAEAVTVLDAVLPGVEKTEYDLGARRYHATGELLSDETIEELRGYDAILLGAIGDPSVPSGVLERGMLLKLRFALDHHVNLRPGRLYPGVTGPLVGNPPIDFVVVREGTEGPYTGNGGALRVGTPHEVATEVSVNTAFGVERVVRDAFARAQDRRKHLTLVHKTNVLAFAGSLWSRTVDRVAQEYPDVEVAYQHIDAATIHMVTDPGRFDVIVTDNLFGDIITDLAAAVCGGIGLAASGNIDATRTNPSMFEPVHGSAPDIAGQGIADPTAAVMSVGLLLSHVGQTEAAARVDKAVSEHLATRGDEKLSTSAVGERIRSLL

SEQ ID NO: 36708 - protein, 673 aa, Triticum aestivum
MAAALLLRGLRSSASRARPAVPSPASAPPPFASSLLHRLYSSAAASAASPPASALGGVTDPARIRNVAVIAHVDHGKTTLMDRLLRQCGADIPHERAMDNISLERERGITISSKVTSVSWKENELNMVDTPGHADFGGEVERVVGMVEGAVLVVDAGEGPLAQTKFVLSKALKYGLRPILLLNKVDRPSVSEETCNEVESLVFDLFANLGATEEQLDFPVLYASAKEGWASLKFTKCPPDSEKNMSPLLDSIVQHVRSPKADLEAPFQMLVSMMERDFYLGRILTGRVTSGVIRVGDKVHGLRITDEGVQKIEDGKVVKLMKKKGTSMAVIEAAGAGDIISMAGLSGPAIGHTVANPEVLTALPAVELDPPTISMTFGVNDSPLAGRDGTHVTGAKIGNRLMAEAETNLAINVLPGPLSESYEVQGRGELQLGILIENMRREGFELSVSPPRVMYKTERGERLEPIEEVTVEVDEEHIGFVLETLNNRKGELLDMGPVPGTTGRTRVFMTCPSRGLVGVKGVFNSFTRGTGFMHRAFQAYAKYRGPLGTVRKGVLVSVGRGFITSHALMSLEARGTLFVSPGMETYEGMIVGEHSRDSDLEINPVRTKELTNIRAPGKDENIRLSPPRLMTLEEAIGYVAVDELIEVTPKVIRLRKKYLDANKRKMMKNKIMQ

SEQ ID NO: 36709 - protein, 206 aa, Glycine max
  misc_feature (106)..(106): Xaa can be any naturally occurring amino acid
  misc_feature (114)..(115): Xaa can be any naturally occurring amino acid
  misc_feature (173)..(173): Xaa can be any naturally occurring amino acid
MSDVEEYRCFIGGLAWSTSDRKLKDTFEKFGKLIEAKVVVDKFSGRSRGFGFVTFDDKKAMDEAIDAMNGMDLDGRTITVDRAQPQQGSTRGDGDRYRDRGRDRDXDHGGGGGXXSNGGECFKCGKPGHFARECPSEGSRGGKYGGRESTYGGSSGGGYGPDRADRSSGGRSXGDGGSHGDSGSDRFYRDRSGPYERERRGSGGFR

SEQ ID NO: 36710 - protein, 269 aa, Oryza sativa (japonica cultivar-group)
MTTARFVSPSLSRVSPSPAGRVSGSSWLSRAGVALPARPHGLSLHLRPPAMASAAAAGNGSPSAPEDSTALSRIGEVKRVTKETNVHVKINLDGTGVADCSTGIPFLDHMLDQLASHGLFDVCVKAKGDTHIDDHHSNEDIALAIGTALLEALGDRKGINRFGHFTAPLDEAAVEVILDLSGRPHLSCGLSIPTERVGTYDTQLVEHFFQSLVNTSGMTLHIRQLAGKNSHHIIEATFKAFARALRQATEYDLRRRGTVPSSKGVLSRS

SEQ ID NO: 36711 - protein, 323 aa, Triticum aestivum
MEVEATGPRRAQQQPCKNGSAKQLPSDAAKPLRLNPLLVINFLLMVVGSAFGPLLLRAYFLHGGTRKWLSSLLQTAGWPLLLAPLSASFLSRRRSHKDRGSVAPLFLMSPRLLATTVAIGFMTGLDDLLYAYGLAYLPVSTSSILISTQLAFTAAFALLLVRQRFTAFSVNAVVLLSVGAAMLGMNAGGDRPAGVTRAQYSAGFGMTLGAAALYGLMLPVMELSQAKHAARTGAGVTYTLVMEMQIVIGVTGTALSAGGMLGNNDFPGYPKRKPGGFGLGPRWATTLLLGRLGPLGDQVVFCLGTHWGALLSYGLKGLAPPRG

SEQ ID NO: 36712 - protein, 266 aa, Gossypium hirsutum
LSIEEVEVAPPQKDEVRIKILFTSLCHIDVYFWDAKGQNPLFPRILGHEAGGIVESVGEGVTDLKPGDHVLPIFTGECKECPHCLSEESNMCDLLRINTDRVGMINDGKSRFSINGKPIYHFLGTSTFSEYTVVHVGQVAKINPHAPLDKVCVLSCGMSTGFGATVNVAKPKKGQSVAIFGLGAVGLAAAEGARVSGASRIIGIDLNPSRFEQANKFGVTDFVNPKDYNKPVQEVIVEMTGGGVDRSVECTGSIQAMISAFECVHD

SEQ ID NO: 36713 - protein, 431 aa, Arabidopsis thaliana
MEMESCKLFIGGISWETSEDRLRDYFHSFGEVLEAVIMKDRATGRARGFGFVVFADPNVAERVVLLKHIIDGKIVEAKKAVPRDDHVVFNKSNSSLQGSPGPSNSKKIFVGGLASSVTEAEFKKYFAQFGMITDVVVMYDHRTQRPRGFGFISYDSEEAVDKVLQKTFHELNGKMVEVKLAVPKDMALNTMRNQMNVNSFGTSRISSLLNEYTQGFSPSPISGYGVKPEVRYSPAVGNRGGFSPFGHGYGIELNFEPNQTQNYGSGSSGGFGRPFSPGYAASLGRFGSQMESGGASVGNGSVLNAAPKNHLWGNGGLGYMSNSPISRSSFSGNSGMSSLGSIGDNWGTAARARSSYHGERGGVGLEAMRGVHVGGYSSGSSILEADSLYSDSMWLSLPAKAEEGLGMGPLDFMSRGPAGYINRQPNGGIAA

SEQ ID NO: 36714 - protein, 292 aa, Xanthomonas campestris pv. campestris str. ATCC 33913
MAKHRPLHQQVIVITGASSGIGLCTALAAAEAGASVVLVARSAGVLQEVADLLTTQGHQAIAVVADVTEPAQLQHAADTAIARFGRIDTWVNNAGVAIFGLLQDVDDHDSRRMFDINFWGVVYGSRIALPHLAASGGALINIGSEASEAVVPWQGMYSASKHAVKGFTDSLRIEIEGLAKQPVSVVLIQPTAVDTPYPQHARNYMQAEPQLPPPLIEPMRVANAILHAAEHGGRDVKVGAMANANITVTRLMPRVADALSAMRSKTQQQDRAAVDPAGTLYRAGESGRINGE

SEQ ID NO: 36715 - protein, 405 aa, Leptospira interrogans serovar Lai str. 56601
MMYEKTAEHFEQKYKNLPEGHLLVNLGPSHPATHGILQNVIQIDGERIVEAESVIGYVHRCFEKLGERYTYNQFLVCTDRMNYVSTPLNNIGWILAVEKMMQIEVPDRVTYVRMIISELSRIIDHIICTGILGVDLGAFSGMLHLFHHRENIYQIIEKLTGARLTTTFCRIGGLEKDIYPDFVKEVKLVCKGLKPAIEEFNSLLLKNKIFLGRTEGIGGISAENAIAYGYTGPNLRAAGVDWDVRKDEPYLFYDKVDFDIPIGEDGSVLHRSLVRMEEMRQSIRIIEQLVDGIPSGPWHADLPHAYLPEKHKVYNNMEELIYHFKIIMHGVKVPPGEYYMATEAANGELGFYIVSEGEKSPWRVHVRRPCFWYYQSFAELVRGGLLADSVATMSSLNVIAGELDC

SEQ ID NO: 36716 - protein, 178 aa, Leptospira interrogans serovar Lai str. 56601
MKEKVESFLKEKFPHFLDSQEEVISNVPVFFLKVEGIVSVLTALKNDPTLHYNFLNDLTAVDWLGKKEPRFEVNYLLRSENKASSKIRIKVRLEDGESVPSITSVFKGADWPEREVYDLFGISFIGHPNLDRILMPDNFQGHPLRKDFPLEGFGQDYLIEDLLHIHVNEDITKEGGKK

SEQ ID NO: 36717 - protein, 398 aa, Oryza sativa (japonica cultivar-group)
MGGSHHLFRFLAADDHPFFPTFPTSSSSFLLDDTHPFFFPPSSSCPLGFTSPPSSSCPLGFTSSYDLDAAFHHHLDLDLDLDLFLPTPTPPVTTSCPALRDPFLLHHSLAHRVSALELAAPRSKYTYEAESAGRKIKWTTHDKPDGDRTFKWEAQIDTPNDDGFDRKWKWESKASAAGTTKLKWAKEVKGKGFLHPWSHAYSVEEVFGDDDHHHKADKTAENKVKQHNKDTSAKEEKKKTNKSNVQIVEIDDNTAGCVAINKAFASSYAKGKRKQLSPQDAALLIQMNYRAHLAHRSQVLRCLRHLAVAKAKLKDIRSLFYNISYRRRISHDSEERQRFADKIIALLATVDALEGPDYMVRNAKRSMLEELEGMLEIVGPQSLGKPRTLSRRKFENHI

SEQ ID NO: 36718 - protein, 114 aa, Thermosynechococcus elongatus BP-1
MTTETIFSRIIRREIPADIVHEDELCLAFRDINPQAPVHILVIPKKPIPQLSLAEPEDHRVLGHLLLTAKRIAEAEGLTNGYRVVINNGPDGGQTVYHLHLHLLGGRPMQWPPG

SEQ ID NO: 36719 - protein, 389 aa, Xanthomonas campestris pv. campestris str. ATCC 33913
MRALCWNGVNDLRVETVPDPVLVNPRDVILKVGLSTTCGSDLHFIDGYLPTMREGDVIGHEFMGTVVEVGPAVKNVRVGQRVVVPSFISCGGCWHCERKEYSLCDNTNPHWEMQESLLGHPTAGIYGYTHAFGGYAGSHATYIRVPHADVGCFEVPDEVSDEDALFLSDAGPTGFMGADFCNIQPGDTVAVWGCGGVGLMAQQSARILGAERVIAIDRLPERLAMARDVLGVEVIDYSTVDSVVDVLREMTGGRGPDACIDAVGMEAHGTGMGHAYDRVKQALHLHTDRGQALREAILACRKGGILSVLGVYGLMDKFPLGAVMNKGLTMRTAQQHGQLYVPRLLDLARAGRLKSSFLMTHKMPLEEAARGYEMFKHKHEGCVRAAFVP

SEQ ID NO: 36720 - protein, 349 aa, Leifsonia xyli subsp. xyli str. CTCB07
MLATIIHGERDVRLEEVPDPVLSTGGDAIVRVVATCVCGSDLWPYRGVTPTSQPRRIGHEFVGVVEAVGPEVATIEPGDFVIAPFYDCDMTCVNCENGVSASCLHGGWWGADDRSGAFADGGQGQKVRVPHADGSLVATPEYPREELIPSLLALSDVMGTGHHAAVSAGVRPGSTVVVVGDGAVGLCAVLASARLGASRIVAMSRHESRQALAREFGATDIVAERGDAGVAAVKGLLDGIGADCVLEAVGTKESMDQAIRSCRPGGMVGYVGVPNGGPELPVRPLFASNVGVNGGFAPVRNYVEELLRDVWSGAIEPGRVFDLQVPLSDIAEAYAAMDERRAIKALVRP

SEQ ID NO: 36721 - protein, 168 aa, Mycobacterium smegmatis str. MC2 155
MTGRTLTIADFNELSDRQRMHVLFDVCTSTIWARRVLAGGPFPDVDALLDRADRVLAELPDAEIDEALDGHPRIGGRVDNPSSAREQAGVADADAAVRAELAEKNRVYEDKFGYVYLVCASGRSAEELLAILTERLENDPETERRVMRNELAKINRLRLQRLFAEGET

SEQ ID NO: 36722 - protein, 274 aa, Actinobacillus pleuropneumoniae serovar 1 str. 4074
MNQYAVWGNPIAQSKSPRIHQLFGEQTGKSISYVAKLGNELNFENELMQFFAEGAKGANITAPFKERAFSLADEYSESCLLAEACNTLKRLDDGRLYADNTDGFGLCSDLERLGWLKPHQRVLILGAGGATKGVLFPLLKAKQQITIYNRTLEKAVRLAEKFAKYGKIRTASLEQIAEQQFDLIINATSLGLQGKYVPVAAHLLKSAAVYDMQYAPDMQTPFLNYARECGAVRYQDGLGMLVGQAGFAFKLWENEFPNVEKVLKQLKNEMENAK

SEQ ID NO: 36723 - protein, 328 aa, Aspergillus oryzae
MSEALDLSLLKGTPEQREQISAELLHALKTRGGVKLKNHGLPDKLVHELFDWTRKFFALPHEDKMLAKHPPQANPNRGYCYVGQESISSISGYEKGLPQGRFVRDIKETVDFGSPRDELVDNIWVPEEKLPGFRKFIEDFYETCFKLELEILAALARALGVDEDHMVSLHNKAENEFRILHYPEVPASELADGTATRIAEHTDFGSITMLFQDSVGGLQVEDQQNPGVFRGIESADKTEIILNIGDSMQRLTNDTFRAACHRVTYPPSVKVGSEAVIPERYSIAYFAKPNRSASLFPFKEFITPSTPCRYEDINAWDFQNLRISRLFK

SEQ ID NO: 36724 - protein, 147 aa, Arabidopsis thaliana
MPHGTLEVVLVSAKGLEDADFLNNMDPYVQLTCRTQDQKSNVAEGMGTTPEWNETFIFTVSEGTTELKAKIFDKDVGTEDDAVGEATIPLEPVFVEGSIPPTAYNVVKDEEYKGEIWVALSFKPSGNRSRGMDEESYGGWKNSEASY

SEQ ID NO: 36725 - protein, 103 aa, Arabidopsis thaliana
MASKALILLGLFAILLVVSEVSAARQSGMVKPESEETVQPEGYHGGHGGHGGGGHYGGGGHGHGGHNGGGGHGLDGYGGGHGGHYGGGGGHGLNEPVQTKPGV

SEQ ID NO: 36726 - protein, 748 aa, Aspergillus oryzae
MAADNPTGGPGIVTESTPLLRDQPTPFSRTPKDGRSVTASTYDGDLLPYNSYSTIDWLQGLIKDSARRSQVESPPRHSIRMRVATWWDLTQGWVAAFAVGILTAGVAFAVDVSVETVADWKEGYCARSIWLNRRACCSVAEFDGSCSQWTPWAQGFSSRYAIYVGFALLFGLISVSLTMTTKASMPAANSNNSIGQGQPQKGDKVATGKILYLASGSGIPEIKTILSGFEIPHLLDLKVLVVKAVGAVFAVATGMCLGKEGPFVHISTCVGYLVGSLVPKYAANERKMREMLAVACSAGLSVAFGAPIGGVLFSYEEISTYFPRRVLWRSYLCSLVAAAALKELDPAGTGQLVLFETNYGVDYDVTHYVIFIFLGICGGVFGGVFCQANFAWSKSFRQLRLIKRSPVLEVFLVVLLTALLQYPNQMIRDTGDIVMQRLLVDCNVVSENWICQQEALDEKGGYYAWLISGTFIKLILTTITFGCKVPSGIIIPALDGGALFGRMVGQLIPDISPGIFAMVGSAAFLAGVSRMTVSLAVIMFELTGEVKFIPPFMIAILTAKWVADRICADGVYDLAQHLQGHPFLDSERALAKVRELRTTGETALVEALVPPPETMEAITVFTGPNYRVAPSILRAKLEGLRARGLIDAGLVFVNDQGLCHGYITQAELGDALDAVARLDDDGDINLLDGIFSGLINRSPVSVSAKAPLEYAVEMFDKLGLRYLIVVEEETARVAGVVVKKRLLKLLDE

SEQ ID NO: 36727 - protein, 817 aa, Xanthomonas campestris pv. campestris str. ATCC 33913
MKQPRLVVIGNGMAGIRTVEELLKLMPGMYHITVFGAEPHPNYNRILLSPVLAGEQEFDDIVLNPLQWYRDNGIHLHLNKEVTRIDRVRRRVIAADGTEAEYDRLLIATGSVPFVLPIPGNDLKGVIGYRDIQDTRTMIDTARTRQHAVVIGGGLLGLEAANGLKVRGMEVTVVHLAGWLLERQLDPVAGNLLQQALRARGLEFRLNTATSALLGNAQGEVIGVRFADGSEIPADLVVMAAGIRPNTRLAEEAGIHCSRGIVVNDSLQSFDPRVYAVGECANHRGIAYGLVAPLFEQAKVCANHLAQFGIGIYRGSVASTKLKVTGIDLFSAGDFMGGDGCEEIVLSDPAGGVYKKLVIRDDVLVGACLYGDTSDGGWYFKLLKDGTPIQAQRDQLIFGESALGDSGTGGQDRASAMSDSDEVCGCNGVCKGTIVKAISEQGLFTVDEVKKHTKAASSCGSCTGLVEQILMNCLGSNFQETPKTKAVCACTDLSHGEVRRAIREHKLLTHAQAYAFMEWRTPNGCATCRPAINYYMLSTWPHEAIDDPQSRFINERAHANIQKDGTFSVIPQMKGGVTNASELRRIADVADKYAVPMVKVTGGQRIDLLGVKKEDLVDVWRDLGMQSGHAYGKSIRTVKTCVGSEFCRFGTQNSTQMGIDLETMLANMWSPHKVKLAVSGCPRNCAESGIKDVGIIAVDSGWELHVGGNGGIKTEVARFLVKVTTAEEVREYTGAFLQLYREQAYYLDRTVHYIARVGLDYIRAQVVDDAANRRALYERLLYSLEGLVDPWKARIAGERRQEYQPLRIAAPAATVKE

SEQ ID NO: 36728 - protein, 912 aa, Xanthomonas campestris pv. campestris str. ATCC 33913
MHRTTRSTCCYCGVGCGVLIHSTHDDAGERIVGIEGDPLHPANHGRLCSKGLALPQTAASQQGRVLAPELRRHRDAPRTAVSWDQALNHVTGKLAAIIDQHGPDAVAFYVSGQLLTEDYYVFNKLAKGLLGTNNIDTNSRLCMSSAVTGYKLALGADGPPTCYEDLELAQTVLFAGSNMAYAHPVLFRRLEDARARNPEIRWIVIDPRRTDTAAMADLHLAIEPGTDVALFNGMLHHLIWEGLVDARFVAAQTEDFDALKHMLREYTPRMSAEICGISHEDLVQAAEWFGRSPAALSLYCMGLNQSAHGTDKNLALINLHLATGQIGKPGAGPFSLTGQPNAMGGREVGGMATMLAAHREIGNAQERAEVERAWGVPAGRISATPGAPAVQLFERLRAGTLKAVWIVCTNPVHSMPDIDGVRAALEQAELVIVQDAFSGTDTVPYADVLLPAASWGEKDGTVTNSERCITRVRKAVEPPGQARADWWIAREVARRLEVRLAPQEGAGLFAFDTPAEIFDEHRALTVGRDLDIGGLDHAALDARGPQQWPFPAGATQGQARRYTDGVFATPNGRARFHATPYRKVAEPTSARFPMRLLTGRLRDQWHGMSRSGRAPGAFAHSPEPALRMHPDDAVRRGLQAGELVRVASKRGALVLPLELSDELRSGTVFAAMHWSAQTLASGGINEVSTPAVDTRSQQPELKHAAVRVEKAAFGWHLLAARRGDALALQQALQPLLRDCGYAGLRLHAEPGGDAGGQWAVLHAACERAPSAEWIDRLVAALQLPAGADVLEYRDLRRGLMRRVGWRLQDGHSHIDGVLLTAAQPSAANQSLLDTALRGQPWRGARLAVFAQTQGAPADPIVCTCMHVSSAAIHAAIDDGADLAQLKQRLGCGTVCGSCVPQLTRLCRPSQRA

SEQ ID NO: 36729 - protein, 709 aa, Oryza sativa
  misc_feature (385)..(385): Xaa can be any naturally occurring amino acid
CSCTVRPSTSGSSPENGEEENSPVELVALTVPVSDEPETPVLTFRMWVLGTASCAVLSFLNQFFWYRKEPLTITAISAQIAVVPLGRLMAATLPEHAFFRGRPWEFTLNPGPFNVKEHVLITIFANSGAGTVYAIHVITGVRVFYGKTLSFFISLLVVLTTQMLGFGWAGIFRRYLVEPASMWWPSNLVQVSLFSALHEKEARRKGGLTRNQFFLVAFVCSFAYYIFPGYLFQMLTSLSWICWVFPSSVLAQQLGSGLRGLGVGAIGLDWSSISSYLGSPLASPWFATVNVGVGFFIVMYIITPIAYWFNFYKAQNFPIFSDGLFTSTGQKYNVSSIVDSHFHFDTKAYEKNGPLYLSTSLLVTYGVGFATLAATIVHALLFHGXVPEWWFICILIANIGTTIFACEYYNEELQLPWWGVLFACSIAFFFTLPIGIIKATTNQTPGLNVITEYIIGYLYPGRPVANMCFKVYGYISMKQALAFLEDFKLGHYMKIPPRTMFMAQVVGTSIAAFVYIGTAWWLMETIPNICNTELLPSDSPWTCPGDHVFYDASVTWGLISPRRIFGDLGTYSALNWFFLCGAIAPLLVWFAHKTFPGQNWILLIKTPVLIGATFQMPPATAVNYTTWILVGFLSGYVVYRYRRDWWERHNYLLSGALDAGLAFMAVLIYLCLGLEDISLNWWGNDLDGCPLASCPTAKGIVVKGCAVYT

SEQ ID NO: 36730 - protein, 373 aa, Oryza sativa
  misc_feature (332)..(332): Xaa can be any naturally occurring amino acid
SFRQHLKFVSLAILADVSTDGQWCFVVFWVVPRTPSIKVRWANLKNRLMSMCPSNYPMTFYPEITQPGPSQFYLLKLFSADRKGLLHDVTHILSELELIIHRVKVSTTPDGRVIDLFFITDGMELLHTKERQEETCSMLIATLGPSISCEILLAEGFQQGFSSLPPTISEELFRLELADGDNCSRSICAEMKRVQKATINFDNTLSPAHTLLQINCADQKGLLYDILRTMKDCSIQVTYGRFWSDKKGFREVDLFIKQADGKKIIDPEKQDVLSSRLRSEMLHPLRVMIVNRGPDVELLVANPVELSGKGRPRVFYDATFALKALGICIFSXLKLGGRQHQSVNGRSTDSSWMIAVSSHCQTALSIGTVLSTG

SEQ ID NO: 36731 - protein, 509 aa, Rhodococcus sp. RHA1
MRDTRSKETMTYETMKPDAALAKVPTDLFIGGRWVSPGTGQTLAVENPATGDVIAEIADGGLADMAAALDAAAAAQRDWARTAPRTRSDILRRAYTLMLERSDYLATLTTLEMGKPYAQAQAEVTYAAEYLRWYSEEAVRIGGRYTVTESGVGRIVTMAQPVGPCLFVTPWNFPLAMGTRKIGPALAAGCTCIVKPAKQTPLSMLATASILEEAGVPAGVVNIVPSSDSTRVVAAAMNDPRLRKISFTGSTEVGQSLVRQSADQLLRVSLELGGNAPFIVFDDADVGSAVDAAVQAKLRNNGEACTSANRLYVHSSIAGDFAAELAERFSALTIGPGMDPGTDIGPLIDDKQRRQVQRLVDDAVAKGARVVTGGNPLDRPGCFFAPTVLTEVPGDALLMQEEIFGPVAPIISFDDEPAVLESANSSRYGLAAYVFTRDLDRAIRVAEQLDSGMVAINQGTVSNPAAPFGGVKHSGYGREGGPEGLAEYLETKYVALGAGTAPTSTGGMA

SEQ ID NO: 36732 - protein, 580 aa, Rhodococcus sp. RHA1
MTTTFSDTDLRTDAQAWLDGFSRFLAAELAPTAVFAPQAYWRDVLAFTGDLRTFSDEIPAELLRRQELTKATNIRIAEDRTPPRLVERAGIPCLEVIFEFDTLAGSAVGVARLVDVPERGLLVRSLFTTLDQLADHPERTGEHRPVGQADSSKFGGPNWLDRRIAAQAYENRDPDVLIVGGGQSGLTLAARLGQLDVDALVVDTHARPGDNWRTRYHALTLHNAVWLNDLPYMPFPATWPQFVPKDKLAGWFEAYVEAMEINFWGTTAFIGGDYDEQSQSWVARVRRGDGTVRTLRPKHVVIATGVSGIPYVPELPGLSQFAGRTLHSSEYDDANDFAGQRVVIIGTGNSAHDVAQDLHAHGIDVTMVQRSSTTIVSVDPSAAAADASYLTAPTLEDCDLLSMATVYPDLYTGSQMITATMKELDKDLVAALNRIGFRTDYGEEDTGQQMKFMRRGGGYYLNVGCSDLLISGQVGLVQYADTAGFVAEGLSLTNGDVVEADAVILATGYQTQQEGVRALLGDEIADAVGPIWGYDDEGEVRNTWRRTAQPGLWFSSGNFQLCRIYSKVLAMQIRTELDNG

SEQ ID NO: 36733 - protein, 376 aa, Polyangium cellulosum
MHVEECHVVIVGAGPSGLAVGACLREQGIPFVLLEKSEAVGATWRRHYDRLHLNTIKQLSALPGQPWPEYSAPYPSRVEMVDYLERYAERFRLEPRLGVEVERAYHDGSRWVTRTHAGELRSQALVVATGYSRHPNVPTWPDQERFRGRILHSSAYRSGAEFRGQRVLVVGAGNSASEIALDLWEHCAETTLSVRSGNHVIPRELFKLPAQFNALALFERLPLAVGDRLATAILSRAVGDLSRWGIRRPAVGPGTRALKEGRMPLIDIGTVALIQQGKIKVVPGPRAFTETGVTFTDGRGLPFDVVVLATGYRPGLDDFLENATRYTDEHGCPRWHGAPTPAPGLFFIGFRNPITGQIRDIAAEAPRIARHIQGVN

SEQ ID NO: 36734 - protein, 859 aa, Mycobacterium smegmatis str. MC2 155
MQSTRNVVVVGHGMVGHRFVEALRARDTEGSWRVTVLGEEREAAYDRVGLTGYTEHWDRSLLALPGNEYAGDDLVELHLGSAVVEIDRPARTVRTADGCTFSYDALVLATGSYAFVPPVPGRDLPGCHVYRTLDDLDAIRASAANASKSKSPVGVVIGGGLLGLEAANALRQFGLRTHVLEMSPHLMAAQLDEAGGVLLNRMMRDLGIEVHTAVSTQSIAPAQKRKPLRRSEIDDSLRVSLDDGTAIDAGVVIFAAGVRPRDELAREAGLDMAQRGGVLTDSNCVTSDPNIYAIGEVAAVDGRCYGLVAPGYTTAEVVADRLLGGSAEFPGADMSTKLKLLGVDVASFGDAKGITPNCLEVVVNDPVKQTYAKLVLSDDAKTLLGGILVGDASAYGVLRPMVASELPGDPLALIAPTTGGDAPGLGVGALPDIAQICSCNNVTKGDLTEAIAGGCCDVADLKKCTLAGTSCGSCVPLLKQLLEAQGVEQSKALCEHFSQSRAELFEIISATEIRTFSGLIERFGTGKGCDICKPTIASILASTSSDHILDGEQAALQDSNDHFLANIQRNGSYSVVPRVPGGDITPEQLILIGEIARDFGLYTKITGGQRIDMFGARVEQLPEIWRRLVEGGMESGHAYGKSLRTVKSCVGSDWCRYGQQDSVQMAINLELRYRGLRAPHKIKMGVSGCARECAEARGKDVGVIATDSGWNLYVGGNGGMTPRHAQLLAGDLDDETLIRYIDRFLMFYIRTADRLQRTAPWVEALDGGIDHLRDVVCDDSLGLAEEFEAAMARHVEGYACEWKGVLQDPDKLARFVSFVNAPDTPDPTVSFTERSGRKVPDLRPVSIGMPTIRPLQEMS

SEQ ID NO: 36735 - protein, 218 aa, Actinobacillus pleuropneumoniae serovar 1 str. 4074
MYGQYKKLRNEFTSVLTGKSLTWGGSLIRPEATGYGAVYFADAMLATHGQGFDGKRVVISGSGNVAQYAAEKAIQKGAKVLTVSDSNGYVLFPDSGMTEKQLADLLVLKNERRERLSVYAKEQGVQYFEGQKPWGVKCDIALPCATQNELDGEAAKELVKNGCFCVAKGANMPTTLEGVEVFIAAKILYAPGKAANAGGVAHFRFRNEPKRNALSLDS

SEQ ID NO: 36736 - protein, 244 aa, Mycoplasma genitalium G37
MSKIQVNNIEALNNAMDLALERDQNVVLYGQDAGFEGGVFRATKGLQQKYGSERVWDCPIAENSMAGIGVGAAIGGLKPIVEIQFSGFSFPAMFQIFVHAARIRNRSRGVYTAPLVVRMPMGGGIKALEHHSETLEAIYAQIAGLKTVMPSNPYDTKGLFLAAIESPDPVIFFEPKKLYRAFRQEIPSDYYTVPIGEANLISEGSELTIVSYGPTMFDLINLVYSGELKDKGIELIDLRTISPW

SEQ ID NO: 36737 - protein, 1112 aa, Solanum pimpinellifolium
MMMVSRKVVSSLQFFTLFYLFTVAFASTEEATALLKWKATFKNQNNSFLASWIPSSNACKDWYGVVCFNGRVNTLNITNASVIGTLYAFPFSSLPSLENLDLSKNNIYGTIPPEIGNLTNLVYLDLNNNQISGTIPPQIGLLAKLQIIRIFHNQLNGFIPKEIGYLRSLTKLSLGINFLSGSIPASVGNLNNLSFLYLYNNQLSGSIPEEISYLRSLTELDLSDNALNGSIPASLGNMNNLSFLFLYGNQLSGSIPEEICYLRSLTYLDLSENALNGSIPASLGNLNNLSFLFLYGNQLSGSIPEEIGYLRSLNVLGLSENALNGSIPASLGNLKNLSRLNLVNNQLSGSIPASLGNLNNLSMLYLYNNQLSGSIPASLGNLNNLSMLYLYNNQLSGSIPASLGNLNNLSRLYLYNNQLSGSIPEEIGYLSSLTYLDLSNNSINGFIPASFGNMSNLAFLFLYENQLASSVPEEIGYLRSLNVLDLSENALNGSIPASFGNLNNLSRLNLVNNQLSGSIPEEIGYLRSLNVLDLSENALNGSIPASFGNLNNLSRLNLVNNQLSGSIPEEIGYLRSLNDLGLSENALNGSIPASLGNLNNLSMLYLYNNQLSGSIPEEIGYLSSLTYLSLGNNSLNGLIPASFGNMRNLQALILNDNNLIGEIPSSVCNLTSLEVLYMPRNNLKGKVPQCLGNISNLQVLSMSSNSFSGELPSSISNLTSLQILDFGRNNLEGAIPQCFGNISSLEVFDMQNNKLSGTLPTNFSIGCSLISLNLHGNELEDEIPRSLDNCKKLQVLDLGDNQLNDTFPMWLGTLPELRVLRLTSNKLHGPIRSSRAEIMFPDLRIIDLSRNAFSQDLPTSLFEHLKGMRTVDKTMEEPSYESYYDDSVVVVTKGLELEIVRILSLYTVIDLSSNKFEGHIPSVLGDLIAIRILNVSHNALQGYIPSSLGSLSILESLDLSFNQLSGEIPQQLASLTFLEFLNLSHNYLQGCIPQGPQFRTFESNSYEGNDGLRGYPVSKGCGKDPVSEKNYTVSALEDQESNSEFFNDFWKAALMGYGSGLCIGISIIYILISTGNLRWLARIIEKLEHKIIMQRRKKQRGQRNYRRRNNHF

SEQ ID NO: 36738 - protein, 461 aa, Desulfitobacterium hafniense Y51
MEQYQVGILGGGPGGYVCALRAAQLGLSVVLVEGDRLGGTCLNRGCIPTKALIKSADFWRELQQVEEFGIRAGESSFDFAKMIERKDRIVHNLVLGVEQLFRTAKIPVIKGWGEITEAGRINVETETGQVRLKVENLVVATGSTPFRIPVPGANLDGVMTSDHILDEKTLPEKLVIIGGGVIGLEFASAFQALGVKVTVVEMLPSLLANSDDEIPRRLTSVLKKRGIDIFTKTMVKEIKSAENRLITVVENAKGIQEIFSDRVLLATGRKTNLCGVNAQRLGLQLEGGSIVVDSQMRTSVPNIYAIGDVTGKAMLAHVASAQGMVAAEHIAGHQVEMSYRAVPSVIFTHPEIAAVGATEQELRTAGVKYKVSKFPFSANGKALVLGETMGTVKILANEEGVILGSSIMGPQASSLIQELVLGVEKGLNAEVLAKTIHAHPTLPEAIMESAHGILGKPLHLA

SEQ ID NO: 36739 - protein, 991 aa, Solanum pimpinellifolium
MMMVSRKVVSSLQFFTLFYLFTVAFASTEEATALLKWKATFTNQNNSFLASWTPSSNACKDWYGVVCFNGSVNTLTITNASVIGTLYAFPFSSLPFLENLDLSNNNISVTIPPEIGNLTNLVYLDLNTNQISGTIPPQIGSLAKLQIIRIFNNHLNGFIPEEIGYLRSLTKLSLGINFLSGSIPASLGNLNNLSSLYLYNNQLSGSIPEEIGYLRSLTKLSLGINFLSGSIRASLGDLNNLSSLYLYHNQLSGSIPEEIGYLRSLTKLSLGINFLSGSIPASLGNLNNLSRLDLYNNKLSGSIPEEIGYLRSLTYLDLGENALNGSIPASLGNLNNLFMLYLYNNQLSGSIPEEIGYLRSLTKLSLGNNFLSGSIPASLGKLNNFFSMHLFNNQLSGSIPEEIGYLRSLTYLDLSENALNGSIPASLGNLNNLFMLYLYNNQLSGSIPEEIGYLRSLTYLDLKENALNGSIPASLGNLNNLSRLYLYNNQLSGSIPEEIGYLSSLTNLYLGNNSLNGLIPASFGNMRNLQALFLNDNNLIGEIPSFVCNLTSLELLYMPRNNLKGKVPQCLGNISDLLVLSMSSNSFSGELPSSISNLTSLKILDFGRNNLEGAIPQCFGNISSLQVFDMQNNKLSGTLPTNFSIGCSLISLNLHGNELEDEIPWSLDNCKKLQVLDLGDNQLNDTFPMWLGTLPELRVLRLTSNKLHGPIRSSGVEIMFPDLRIIDLSRNAFSQDLPTSLFEHLKGMRTVDKTMEEPSYEIYYDSVVVVTKGLELEIVRILSLYTVIDLSSNKFEGHIPSVLGDLIAIRVLNVSHNALQGYIPSSLGSLSILESLDLSFNQLSGEIPQQLASLTFLEFLNLSHNYLQGCIPQGPQFRTFESNSYIGNDGLRGYPVSKGCGKDPVSEKNYTVSALEDQESNSEFFNDFWKAALMGYGSGLCIGISIIYILISTGNLRWLARIIEELEHKIIVQRRKKQRGQRNYRRRNNRF

SEQ ID NO: 36740 - protein, 352 aa, Campylobacter jejuni RM1221
MSQKILFIDRDGTLIEEPKSDFQIDTLEKLRFEKDAIPTLLKLKKFGFKFVMVSNQDGLGTPSFPKENFEIAHEKMLDILKSCGIEFQDIFICPHFENENCVCRKPKTAMLEEYIKHELYDKEQSFVIGDRESDMILASNLGVRGLKYGELSWKEIENEILSSFRSASYQRTTKETDIKVKVCLNGGKVSIKTGIDFFDHMLEQIAVHGGIGLEISCKGDLEIDEHHSVEDVALALGACIKKTLGDKIGIARYGFALPMDECLASCAMDFCNRPHLVYKAKFKKSHLGALSTEMIEHFFYSLSYAMGVSLHLKVKGKNDHHKAEGLFKAFAKALKMAVKIESENLASSKGVI

SEQ ID NO: 36741 - protein, 138 aa, Leptospira interrogans serovar Copenhageni str. Fiocruz L1-130
MNQLLREVLTPDAERTQNFTVGDTVKVHYKIVESGKERVQIYEGVVISVANEANGKTFTVRRVSYDVGVERIFPLFSPKIAKIELIRKGKVRRAKLYYLRNLAGKAARIKELKGGKALVSEDRKRQQAAAATKSTTTE

SEQ ID NO: 36742 - protein, 277 aa, Oryza sativa (indica cultivar-group)
MPFPRRDIEAAGAGSGSGDDDSPAAKRGKPEAAGARPSLTRTEAAAAASVLALFLVGIFCVFRAAPRREFEQILRLPRSLADVRLLKDNLAVYARDYQANFILGYCSIYIFMQTFMIPGTIFMSLLAGALFGVVKGGILVVFTATAGASSCYFVSKLIGRPLISWLWPEKLRYFQSEIAKRKEKLLNYMLFLRITPTLPNTFINMASPIVDIPFHIFFAATLIGLIPASYITVKAGRALGDLRSVRELYDSKTLVILFLIGTVAVAPTILKRKRIYE

SEQ ID NO: 36743 - protein, 391 aa, Haemophilus ducreyi 35000HP
MSVKKMADLDLTGKRLFIRADLNVPVKEGKITSDARIRATIPTLKLALQKGAKVMVTSHLGRPTEGVFEEANSLQPVVDYLNASDLGVPVRLVRDYLDGVEVNQNEIVVLENVRINKGEKKNDAELAKKYAALCDIFVMDAFGTAHRAECSTYGIAEFAPIACAGPLLAAELEALGKALKEPQRPMLAIVGGSKVSTKLTVLDSLSKIADQLIVGGGIANIFIAAEGHNVGKSLYEADLIPEAKRLASTTHIPVPVDVRVGTEFSETATATEKLVSEVTADESIFDIGDKSAEELAHIIKSAKTIFWNGPVGVFEFANFRKGTEIISNAIAEATANGAFSIAGGGDTLAAIDLFGIADKISYISTGGGAFLEFVEGKVLPAVEILEKRANS

SEQ ID NO: 36744 - protein, 871 aa, Thermosynechococcus elongatus BP-1
MTLDAADLDAITQEARHCFLYEDAPEYLLLLEQWAEQVVTDPERHYTAEDYNTLMRAAHSLKGGAGIAQLSELQALSHRLEDILEALKEGRLGDRPRAHHLLVQGIEQAQELLAAAKQNHSLTPTPPYQALLAALTELLSTVSDPSSPPTVAPPDLRTALTQTLEESLQLLEASATDAERETALAQLIATAHTLGKQYPLPWLQQLAAELPKLAADLPLGELVPAIVAECRQLQQAELVKLLPPEPTPPPPAETAPPQDSYLRIPVSRLDRLGNTVSELLIGQERLTLYQQQFLRANRELKQRLDQFRPIRDQVQTFYDRLATPLGGPGRPTNGHNDFDALEFDRYTELHTALQDFQELLVRIQETGADIDLLSRDLQEALDLNRQHLNSLYAELTNSRLVPFRQLAQMFVTAVQALGDRHHKPVQLVIEGGDTLVDQVILQQLKAPLTHLVRNAFDHGLEPPKQRQQLGKSPTGTIWLRARLRGNAVEIQVADDGRGIDLQRVSQKAVELRLCSAEQVPHLSREQILEFLFVPGFSTAKQVSDLSGRGVGLDVVREQVQRSRGHLQITTEPQRGTTFTLTLPLTLSLLPMVLCQVGELTLAIPDLSIREVIALKEYTDIRHPSATIDWQGQSIPLYPLHQLLPYQRPLSGPTRPLGVGVVVDVAGQAVALAVNYLIAERELVVKPFDQTVPVPPYVMGCTVLGSGEVVPVLAPDNFTVLLRPVEVRASPMESPQQPITPQVLIVDDSITVRRLLDRVLRQAGYNVVQCRDGKEALDFLLAAGDQVSLVITDIEMPRLDGYDLLEAIRLSARLRHLPVAMLTSRGGDTHRQKALQLGANGYITKPFQPQGILQTVTQLLTGRHGGVATLSQ

SEQ ID NO: 36745 - protein, 499 aa, Citrus sinensis
MNASMMMINSMSVSPDMPSSSPFQSQSLSTPTSSPPSTSLPLRTIPGSYGWPLLGPISDRLDYFWFQGPETFFRKRIEKHKSTVFRTNIPPTWPLFLNVNPNVIAVLDCKSFAHLFDMEIVEKKNILVGDFMPSVKFTGGLRVSAYLDTSEPKHAQLKGFAMDTLKRSSKLWVSEVVSSLDTLFDTVEKELSEKNSISYMVPLQKCVFNFLSKSIVGADPKADAEIAENGFSMLDKWLALQILPTVSINILQPLEEIFLHSFAYPFALVSGDYNKLHNFVEKEGKEVVQRGQDEFGLTKEEAIHNLLFILGFNAFGGFSILLPKLINAIASDTTGLQAKLRSEVKEKCGTSALTFESVKSLELVQSVVYETLRLNPPVPLQFARARKDFQLSSYDSVYDIKKGELLCGYQPLVMRDSKVFDDAESFKAERFMGEKGSELLSYLYWSNGPQTGTPNDMNKQCAGKDYVTLVACLTVAYVFQRYESITGNSSSITAVEKAK

SEQ ID NO: 36746 - protein, 311 aa, Brassica napus
MSSLVFKLFLFVSLFQISISARKLAQDEPNQFQSLKYHKGALLSGKISINLFWYGKFKPAQRAIISDFITSLSHSSSDQPSVATWWKTTEKYYKLAAGDKTPSPSLSLTLKSQILDETYSLGKSLTDRDIRKLASKGDQYDAVNVVLTSADVAVTGFGMSRCGTHGHARGNAGKRGSKFAYIWVGNSETQCPGQCAWPFHAPVYGPQSPPLVAPNNDVGLDGMVINLASLLAGTATNPFGNGYYQGPQNAPLEAASACPGVYGKGAYPGYAGNLLVDTTTGGSFNAYGANGRKFLLPALYDPTTSDCSTMV

SEQ ID NO: 36747 - protein, 428 aa, Haemophilus ducreyi 35000HP
MAKETIIIVGGGAGGLELATYLGNKLSRKNKAHVLLIDRNTTHLWKPLLHEVATGSLDEGIDALSYRAHAKNHGFEFQQGTLIAVDREQKQITLAPIYNEQNELLVKERQVAYDKLVIAIGSKSNDFGTKGVAEHCIFLDDIKQAKLFQKRMMELFLQFSHSDNQDVKIAIVGGGATGIELSAELYNTAKHLHEYGFGKLHRASLKVTLVEASERLIPALTQKVSNSALYELRKAGVDVKLNTMITEAVENGLITQTGEKIEANLIVWSAGVKAPDFVKNLGFETNHLNQIEVKETLQTTVDDAVYVIGDCASLMQDGKPIPPRAQAAHQMATQCGKNIIAALTGKELKPFKFNDRGSLLSFSHFGTVGTLMGNLVSGNMFIEGKIARLAYLSLYRMHQVALHGWFKTGLILLVGQINRLLRPSMKLH

SEQ ID NO: 36748 - protein, 217 aa, Oryza sativa (japonica cultivar-group)
MKEVVLHVYDVTNSDSEKTNNTILQINRIFKDRIGLGGIFHSAVQVRLRAASQIPPSEGRICFCFAFAFLPPPDLADFGWFSLALFCSDPGGAQVYGEEEWSFGFCENGSGVFSCPIGKNPMYTYRECIVLGETECSIATVNRILRELSREWPGHSYDLLSRNCNHFCDVLCERLAVPKLPGWVNRFANAGDTAVVVAENTAVKNSIYNGIKLQQSL

SEQ ID NO: 36749 - protein, 350 aa, Rhodopseudomonas palustris CGA009
MATTFAAAIRDGLATALAVDDDVICFGLGTDDPKGVFGTTLDLHKQFGPDRVFDMPTSEAAMTGFAIGAALNGMRPVMTHQRLDFALLSLDQLVNNAAKWRFMFGGKRGVPITIRMIIGRGWGQGPTHSQSLQSWFAHIPGLKVVMPTTAEDAKGLLLGAIFDDDPVIFLEHRWLHNMKGEVPAGDVRSPLGKARIVRQGDAVTIVAMSYMTVEALHAVDHLAAQGIACDLIDLRSIRPLDWPAVIASVQKTGRLLALDSGHLTGGVAGEIVARVATDHFASLKSAPQRLAAPDVPEATSPALTKNYHVRAEHIAEAVGRMLGREVEIASLVAQRTFPHDVPGTWFSGPF

SEQ ID NO: 36750 - protein, 174 aa, Desulfitobacterium hafniense Y51
MSKSWYTSTKFRQNMFQGNHKGVLAMKVQDIMQTNVITISPNTEIREIAKLLCDHHISGVPVIDLFGNLIGIVSEGDLLHKETHPRVPEAVGFLGALIYYRGVKQYESDLKKLVALKASEIMTHEVITLDKDASIEEAASLMINHNVKRLPIMENGKMVGIITRKDVIKVLIEE

SEQ ID NO: 36751 - protein, 222 aa, Medicago truncatula
MDRNNNHFNTQNYSNYSFNYENPNNYPNPNQFFNQRPQNITNFGFTPNFNQSSSVPNFHAYYGSMMRYSSQTPLFNGYMSMENENFPSVGASQYPEFSTQITPDGMAVANEVTQNLEDSTPKSKKSKEPTWNTQQNLVLISAWIKYGTSSVVGRNQRGKTYWGKIAEYCNECCSFDSPRDLVACRNRFNYMSKVINKWIGAYESVKRLQGSGSEDDVLAKAQ

SEQ ID NO: 36752 - protein, 285 aa, Cryptococcus neoformans var. neoformans JEC21
MPQQEQLPSKDYGIREIWADNLESEFAALRQAVERYPYISMDTEFPGIVARPIGNFKTGSDYHFQTMRCNVDMLKIIQLGITLCDENGDSPEVSTWQFNFAFSLGEDMFAPDSIDLLKSSGIDFKRNEEEGIDVEYFGELLITSGLVLFDNIKWVSFHSGYDFGYLLKILTCEPLPADETDFFRLLFIWFPCIYDIKHIVRSIKTLRGGLQEIAESLGVKRIGPQHQAGSDSLLTAAVFFRIQTIYFDGHLNDDYYKNYLYGFSSGRLGKASPAAAGENLVDKPY

SEQ ID NO: 36753 - protein, 335 aa, Methanopyrus kandleri AV19
MNASPTVVVIPGDGIGPEVIDAALKVVRAVLGDELEIVEEQAGYSLWKKRGVTIEDETIERCREADAMLFGACTTPEDPEAKSPIVTLRKELGLYANVRPARSWPVPRPVDTEFDLVIVRENTEGLYTGCECEIHDGVTVALRKISEEGTRRVAEVACDLAEERSGRVTIVHKANVLKLTCGTFKRVAAETVERRGLEWDDEYVDAAAYKLVREPDSFDVILTSNLFGDILSDLAAGLMGSLGLAPSANLGDDAALFEPVHGSAPDIAGKGIANPVAAILSAAMMLDHLGYGEEARIIERAVEEVLREGVRTPDLGGSATTEEVAEAIAERVATG

SEQ ID NO: 36754 - protein, 125 aa, Yersinia pestis CO92
MIIKTQNAPAAIGPYSQGVVAGNLLFISGCCPFSEKDGSVVGIDITEQTIQAMKNLKAIVEATGSYMNDVVKTTCFISDMNNFQSFNTIYAGYFPSGTFPARSCVEVARLPKDVLIEVEAIVSLK

SEQ ID NO: 36755 - protein, 300 aa, Arabidopsis thaliana
  misc_feature (127)..(127): Xaa can be any naturally occurring amino acid
MLKVPEHQVAGHIASDGKLGPLVDDQGRFFKPLQGDSRGEHEAKFYESFTSNKKVPDHIHRYFPVYHGTQLVEASDGSGKLPHLVLDDVVSGYANPSVMDVKIGSRTWYPDVSEEYFKKCIKKDRQXTTVSLGFRVSGFKIFDHQESSFWRAEKKLVLGYNADGARLALRKFVSSNSPADSNLTPNCAFASEVYGGCNGILAQLLELKDWFETQTLYHFNSCSILMIYENESILMKGGDDAPAPRAQVKLVNFAHVLDGNGVIDHNFLGGLCSFIKFIKDILQSVEKHDETDTSLLENGR

SEQ ID NO: 36756 - protein, 637 aa, Corynebacterium diphtheriae NCTC 13129
MSAAPVHPVDAVPAAPKLVALGLQHVLAFYAGAVIVPLLIAASLNLDTATTIHLINADLLTCGIATLIQSVGIGKHVGVRLPIVQGVTTTAVAPIIAIGLGVTDGQGGVESLPTVYGAVIVAGLFTFFATPIFAKFLRFFPPVVTGSVLLVMGTSLLAVSANDFINYAEAQPETRDLFYAFGTLAVIILAQRFFRGFLGTLAVLIGLVSGTVVALLLGHANLDEVGNAAAFGITTPFYFGMPQFNITACFSMIIVMIITMVETTGDVFATGEIVKKRIRKSDVQRALRADGLSTFLGGVMNSFPYTCFAQNVGLVRITGVKSRWVAASAAGFMIILGLLPKAGAVVASIPSPVLGAASLALFANVAWVGLQTIAKTDLADSRNAAIVTTALGLAMLVTFKPSVAEAFPEWARIFVSSGMSIGAITAILLNLLFFHVGKQSGSAVARNVSGDGITLDEINALDRDEFVATLRPLFNKETWPLEQAWESRPFTDVHELREAIQVAVLTAPSEQREALIHDYPDTSAVLLATDAESRAISADRGSLGINELDDVETQQVLELSKEYRERFGMPFVYFLDTNDTVASIVNAGLRRLANSDVQEHRVALTEIVEIANDRFDILLADANPVRSAWDRKFTEVE

SEQ ID NO: 36757 - protein, 519 aa, Synechococcus sp. PCC 7002
MTDAATIQKIKLTKIEQAKQAKPGLAIKDELATLAQAGWEAMDQDDLIIRLKFLGLFHRPVTPGKFMLRLRTPHGILNSAQVRALAEIVQRYGEDGSADITTRQNIQLRGIRLEDTPEILTKLKQVGLTTVQSGHDNVRNITGSPVAGIDPEEYFDTRELAAQLQNMITNYGEGSLEFSDLPRKFNICLEGAPDNSSHVEINDIGFVPAFKDGQFGFNVLVGGYFSAQRQAEGISINVWVPPNEAVLAVSRGILALYTRHSAEEGLRGNRAKARVLWLVEAWGVNAFRARLEAEIGQSLEPAAPEHALTMDKRDHIGVYAQKQAGYHYVGLHVPAGRLTAEDMFEVARLAETYGNGEIRATVEENFIIPYVKSENVEALLQEPLLEKFSVNPSTLVRSFVSCTGNRYCNFALVETKEQGLALARELDAELDIPQRVRMHWTGCPNSCGQAQVGDIGFIGSKAKVDGAIVEAVNVLTGGTVGNQASLGAPVAQKVPCGDTLKATVKHILIEQFGATPKSE

SEQ ID NO: 36758 - protein, 443 aa, Thermococcus kodakarensis KOD1
MNEIKGIERAVQVEVPRPRFLLLAFTDINGSLKGMEIPMERYEEAVEDGVSFDGSSIPGFEGIEDSDLIFKADPSTYAEIPWEGIGRVYGYIYKGDEPYQADPRGILKRVLERLEKEGLKAHIGPEPEFYIFKKNGTWELHIPDSGGYFDLVGLDKAREIRREIALYMPYLGLKPEVLHHEVGKAQHEIDFRYDEALRTADNIVSFKHVVKAVAELHGYYATFMPKPIYGFPGNGMHLHISLWKDGENVFIGEDGLSDTALHFIGGILKHAKALAALTNPTVNSYKRLVPGYEAPVYISWGYRNRSALIRVPAFKGSGARIEYRCPDPSANPYLALAGILMVGLDGIKKKVEPDSYVETNVYEMDDAERERLGIDTLPGSLGEALEELKKDKTVREALGGAYKNFIDYKEREWEEYIEYLSSRDIPIDTKKVTEWELERYFYV

SEQ ID NO: 36759 - protein, 130 aa, Methanopyrus kandleri AV19
MTLMDPLADAMATIKNNEMVGNKECVIEPASKLIGRVLKVMQEYGYIGSFEFIDDGRSGKFLVKLVGRINDCGVIKPRHPVKKDEWEYWEQRYLPARDFGLLIVTTPEGVMSHYEAKERGIGGRLLAYVY

SEQ ID NO: 36760 - protein, 434 aa, Triticum aestivum
MSSSPTPAPDAGAAAMAVDDSSETDQLDSMSTEDIVRATRLLDNEVRVLKDELQRNNLELENVKDKIKENQEKIKLNKQLPYLVGNIVEILEMNPEDEAEEDGANIDLDSQRKGKCVVLKTSTRQTIFLPVIGLVDPDNLKPGDLVGVNKDSYLILDTLPSEYDSRVKAMEVDEKPTEDYNDIGGLEKEIQELVEAIVLPMTHKEQFQKLGIRPPKGVLLYGPPGTGKTLMARACAAQTNATFLKLAGPQLVQMFIGDGAKLVRDAFELAKEKAPCIIFIDEIDAIGTKRFDSEVSGDREVQRTMLELLNQLDGFSSDERIKVIAATNRADILDPALLRSGRLDRKIEFPHPTEEARARILQIHSRKMNVHPDVNFEELARSTDDFNGAQLKAVCVEAGMLALRRDATEVIHEDFNEGIIQVQAKKKSSLNYYA

SEQ ID NO: 36761 - protein, 175 aa, Triticum aestivum
MAPTVMASSATSVVPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 36762 - protein, 426 aa, Oryza sativa (japonica cultivar-group)
MAAASASAMARRAASWPRLLLLSRAFAAAAAEPKRVLVPVADGTEPVEAAATADVLNRAGARVTVATADPAGDDRGLLVEAAFGVKLVADGRVADLEGEAFDLIALPGGMPGSANLRDCKVLEKMVKKQAEQGGLYAAICATPAVTLAHWGLLKGLKATCYPSFMEKFTAEIIPVNSRVVVDRNAVTSQGPATAIEYALALVEQLYGKEKSEEVAGPLYVRPQPGVDYVIDEFNSVEWKCSGTPQVLVPVANGSEEMEALNLIDILRRAGANVTVASVEDKLQVVTRRHKFNLIADIMVEEAAKREFDLIVMPGGLPGAQKLSSTKVLVDLLKKQAESNKPYGAICASPAYVLEPHGLLKGKKATSFPPMAHLLTDQSACDSRVVVDGNLITSKAPGSATEFALAIVEKLFGREKAVSIAKELIFM

SEQ ID NO: 36763 - protein, 256 aa, Zea mays
PSNPTAYVADLDFYKDLVAFAKKHDIFILSDLAYAEVYFDEDKPPPSVLQVPGALDVTVEFTSMSKTFSMAGWRMGFAVGNERIIAALARVKSYLDYGAFTPVQVAATAALNGPDDCIREMRDTYRKRRDALVESFGRAGWDIPPPQASMFAWAPLPKAFEAVGSMQFATLMVEKSGVVVSPGVAFGEHGEGFVRIAMVENEQRIRQAARGVRRFLESGIETLHNVVPLANDADPSRLLNLMIAPLNVGIAGLGTV

SEQ ID NO: 36764 - protein, 532 aa, Citrus sinensis
MASTSLSFSLLPTEFQSPRKSSKLYTPRVRSAAIRPRPITASISEKQSVPVPPPIIISPSDEQPTKLPIRKIPGSYGLPYLGPIKDRQDYFYNLGRDEFFKSKIQKYGSTVFRANMPPGPFISSNPKVIVLLDGKSFPVLFDVSKVEKKDLFTGTYMPSTDLTGGYRVLSYLDPSEPNHAKLKQLLFFLLMNRRDKVIPELHSTYTEAFETLERDLAAKGKADFSGANEQAAFNFLARAWFGKNPADTTLGSDAPTLIGKWILFQLAPLLSLGLPKLVEEPLLRTRPLPPALVKKDYQRLYDFFHESSGFVLDEAEKLGVSREEACHNLVFATCFNSFGGMKILFPNMVKWIGRGGVKLHMQLAEEIRSVVRSNGGKVTMAGMEQMPLMKSVVYEVLRMEPPVALQYGKAKRDLIISSHEASFEVKEGEMLFGYQPFATKDPKIFEQAEEFVADRFVGEGEKMLKHVLWSNGPETENPPVGNKQCAGKDFVVLASRLLLVELFLRYDSFDIQVGKSAIGSSVTLTSLKRASF

SEQ ID NO: 36765 - protein, 103 aa, Ralstonia solanacearum GMI1000
MSTTHEKIDQIVKSHPVVLFMKGTAQFPMCGFSGRAVQILKACGVDQPYTVNVLEDDEIRQGIKEYANWPTIPQLYVKGEFIGGSDIMMEMYQSGELQPLLAA

SEQ ID NO: 36766 - protein, 191 aa, Triticum aestivum
MESSSSSLLLSSYAGSNKRARGADLEVVSSAEAEAAKRMRPEDLLDLLDDDTNAAAAGDLASVMRSLEEEICADDLTPPQPELGFLLEASDDELGLPPAAAASSSSDDAEGWEPEVTAGVFGEQIWSFEDEIEGAYAFGGVAYSPEAAAATAAADAEWGDDGFDAGLFGFGDESLGPSDVDVLRQETMPAV

SEQ ID NO: 36767 - protein, 227 aa, Coccidioides immitis RS
MSSSTGNGWAQLRQQARSLETQTESLFHTYAQYASAAQIPAQPSEEEQRIEVQLKDLLERREYLISQLARLLDSESGLTASALKQNNLSRHRAVLQEHQHELRRLHNAISETRDRVNLLSNIRSDISAYRASNPPIAEADYMLEERAHLDNSHNMMDSVLSQAYAVNNNFVLQRETLASINRRIIGAASQVPGVNSLINQIGAKRRRDGLLLGIFIGICFLMLLYFR

SEQ ID NO: 36768 - protein, 520 aa, Wolbachia endosymbiont of Drosophila melanogaster
MSAIAIIDFGSQFTQLIARQVRGMGVYCEIFPSNISFETISKFNGFILSGGPQSVNDDCSETSRVVHEIIKLNEATSVPILGICYGQQLICHYFGAKVKESFKQEFGRTKIKILKESPIVKDTWDVNSEVDVLMNHADSVDTIPQGFTVIASGVINQTIAMIVNEQRKIYCTQFHPEVKPTTNGSKLLSNFLDIANCKRDWTMKSFIEEQKEKIKNVVGEKKVIAAVSGGVDSSVAAALTHKAIGKQLNCIFIDTGLLRKNQTIAMLKEIPINYVDKSNLFLSRLKGITDPEEKRKIIGNTFIEVFEEEAKKIGDVDFLMQGTIYSDVVESGHASDNTSTIKSHHNVGGLPEKMNLKLVEPLRYLFKDEVRLLGKEIGLSDEIIFQHPFPGPGLAVRIISEVDKEKVQILQEVDEIYINTMKNYDLYDKIWQAFAVLLPIKTVGVMGDGRTYGYVCALRAVTSSDGMTADAFPFEDKDQHLLVFWDFLRNVGSIIVNNVPGVNRVVYDITSKPPATIEWE

SEQ ID NO: 36769 - protein, 429 aa, Bifidobacterium longum NCC2705
MSNIFQWQLHGDGKTLAPGEVVEPDERLTWVRTAGIGAQHVIAMFGATFLVPILTGFDPSTTLFFTAMSTALFLLINRNVLPSYLGSSFGFIAPITAVSTANKGIAVASFGIMVTGILLALVGVLVHYAGSKWIDIIMPPVVNGAIVAIIGFNLAPSVWTNFQAAPDTALVTLLAVLLVAVLFKGLLGRLNILVGVIIGYVYACIRGQVDFSAIGDAAWIGFPKFHLPQADFSILPMFIPVVLVLVAENVGHVKSVAQMTGRDYDNQIGTALMADGLGTTLAGFGGGSGTTTYGENIGVMAATKVYSTAAYWCAAAFALILSLCPKFGAVINTIPAGVLGGVTTLLYGMIGMIGIRIWVENKVNFDKPLNIMVAAITMIIAIGQFAFTVGGISFNGIAIGTIVILVAYHGLKAIGKATGTIAKDDPDIL

SEQ ID NO: 36770 - protein, 384 aa, Thermococcus kodakarensis KOD1
MFPERGASEEEVLRELEEKTREDLTFDSGKILGSMCTYPHPFAVKVVMKYIDRNLGDPGLHIGSQKIEKEAVDMLANLLGLEKGYGHIVSGGTEANILAVRAMRNLAGIEKPELILPESAHFSFIKAAEMLGVKLVWAELNDDYTVNVKDVEKKITDRTIGIVGIAGTTGLGVVDDIPALSDLALDYGLPLHVDAAFGGFVIPFAKALGYEIPDFDFRLKGVKSITIDPHKMGMVPIPAGGIIFREKKFLDSISVLAPYLAGGKIWQATITGTRPGANALAVWAMIKHLGFDGYKEVVKEKMELARWFASELKKIPGIYLIREPVLNIVSFGSEKLEELEKELKARGWGVSAHRGYIRIVVMPHVKREHLEEFLRDLREIAKRL

SEQ ID NO: 36771 - protein, 354 aa, Arabidopsis thaliana
MKIEEDLGFINILKRATKLLCGNINLVLFLFLCSLPLFCFLIFFELSLQTTVSLASQYLVRQLTNWDYYYVPQDASVLENLIPLLIQTFLLYLFPYGLIDLFTTTTIVSASWTVHTSEEEPLRFGQLVRRTVEICQNRLEGCLITSLYVLLLSTPVFFGFLFVATNYFHIISLTGSGENSYYYSINIEEDAEGYYRSSSVNSPVKMLFDAVLAMFHGAIFLGLLAMFSKWSAGWNMGLVVSVLEEEENGQSIYGTDALTLSSNYGKGHEKRGLQVMLVFLVFAIAMRMPCFCFKCTESSNGNRVLYTSFYVGLICVGNMIKWVACVVFYEDCRTSVLEKKGDVEIGSKGKTFVA

SEQ ID NO: 36772 - protein, 210 aa, Triticum aestivum
  misc_feature (96)..(96): Xaa can be any naturally occurring amino acid
  misc_feature (116)..(116): Xaa can be any naturally occurring amino acid
GELGPTSHAPGRHAAGLAWSRPRLYLIGHCLSCSGWLVLQAPVLKKYPARLSVTSYTCFFGVIQFLIIAAFFERDAGAWVFHSGSEVFTILYAGFXIASGVAFAVQIWCIDRGGPXVFVAVYQPVQTLVVAIMASLTLGEKFYLGGIIGAALIITGLYLVLWGKSEERSRIGKEAAVMAAASSGSGEREVRSAKLASSITQPLLPPSDNV

SEQ ID NO: 36773 - protein, 394 aa, Haemophilus ducreyi 35000HP
MMTSDQIKQLDANYIAQTYAKFDLALSHGQGCEVWDFDGNKYLDFTSGIGVNSLGWADPDWLEAVIAQLHKLSHTSNLFYTEPSARLAKHLVQVSGLKRVFFANSGAEANEGAIKVARKYSHDKYGDTRSTIISLVNSFHGRTISTLAATGQKLFHQHFFPFTAGFEHLIANDLNAFKTRIAQNDICAIILEVVQGEGGVCSLDQAYLQAVQGLCQVQDILLIIDEVQTGIGRTGTMFAYQQFELKPDIVTLAKGLAGGLPIGAFLLADKVAETLAKGDHGSTFGANPVSCAAANAVLTKLEPLFLTEVMRKGQKLRKALQSLPHVKSISGLGLMIGVEFDEHINVADVVTNCLKQGVLFLTAKTKLRMLPPLIINDEQLERGVTVLAQVLSEM

SEQ ID NO: 36774 - protein, 659 aa, Aspergillus nidulans FGSC A4
MLPSSHTAVEPGRPIPGVQDHHSNYFVAEHAQTSILRLSHSLLENAVDVKLYPIYFSTYSSGFSCALMPKRIARGGNGLNAELPSCRGRPISQDSIPLDSHTASCAMSSHRADFDSIPIVDLSTLNSPHIQNARNSQSPSGRPALRLGSSTSSPLYGEKPSNPELEKPAEGALSEAFDIGYELAGDIRKGPGDPPPQDEYGLYGDNQWPDERLLPGFRKIYLEYFSQTLELSRKLIKMNALALGQEEHLFDSAVEYPGVLSRMLHYPPQPVEGQEIPGQAAHTDHVPALQVRNNQGHWVAAPPIPGTLVVNIGDCLATWSNNRFKSTIHRVVNLTGEERLGGHRLRRQLPFQRAIHGGRIGNRAPQGQGRNPCSDTPAYEVIPVSTPNRTGKGNNYAYLVTDEPTKQSVIIDPANPPEVVPELEAQTKAGKINLTAIVNTHHHWDHAGGNNEVLKTFKVPVIGGKDCQSVTKTPAHGEVFKIGDRISVTALHTPCHTQDSICYFMQDGEQKAVFTGDTLFIGGMTEWINAESSAAAGCGRFFEGTAPEMHKALNETLASLPEDTKVYPGHEYTKGNVKFCLAVSQSEPVKKLQAFAEANQQTQGMFTIGDEKLHNVFMRVTASHPTTTSRPKAYGSRTPRFRRKQARPIPSRSWLLCAR

SEQ ID NO: 36775 - protein, 823 aa, Arabidopsis thaliana
MAPHSLKKNYRCSRSLKQFYGGGPFIVSSDGSFIACACGDVINIVDSTDSSVKSTIEGESDTLTALALSPDDKLLFSAGHSRQIRVWDLETLKCIRSWKGHEGPVMGMACHASGGLLATAGADRKVLVWDVDGGFCTHYFRGHKGVVSSILFHPDSNKNILISGSDDATVRVWDLNAKNTEKKCLAIMEKHFSAVTSIALSEDGLTLFSAGRDKVVNLWDLHDYSCKATVATYEVLEAVTTVSSGTPFASFVASLDQKKSKKKESDSQATYFITVGERGVVRIWKSEGSICLYEQKSSDITVSSDDEESKRGFTAAAMLPSDHGLLCVTADQQFFFYSVVENVEETELVLSKRLVGYNEEIADMKFLGDEEQFLAVATNLEEVRVYDVATMSCSYVLAGHKEVVLSLDTCVSSSGNVLIVTGSKDKTVRLWNATSKSCIGVGTGHNGDILAVAFAKKSFSFFVSGSGDRTLKVWSLDGISEDSEEPINLKTRSVVAAHDKDINSVAVARNDSLVCTGSEDRTASIWRLPDLVHVVTLKGHKRRIFSVEFSTVDQCVMTASGDKTVKIWAISDGSCLKTFEGHTSSVLRASFITDGTQFVSCGADGLLKLWNVNTSECIATYDQHEDKVWALAVGKKTEMIATGGGDAVINLWHDSTASDKEDDFRKEEEAILRGQELENAVLDAEYTKAIRLAFELCRPHKVFELFSGLCRKRDSDEQIVKALQGLEKEEFRLLFEYVREWNTKPKLCHIAQFVLYKTFNILPPTEIVQVKGIGELLEGLIPYSQRHFSRIDRFVRSSFLLDYTLGEMSVIDPETVETEYPKD

SEQ ID NO: 36776 - protein, 196 aa, Brassica napus
  misc_feature (130)..(130): Xaa can be any naturally occurring amino acid
  misc_feature (164)..(164): Xaa can be any naturally occurring amino acid
FLSIVFLQSIGAVNTILRRQSDGKLLGYNTDCIGSISAIEDGLRSSSGPSSVPSSPLAGKTVVVIGAGGAGKALAYGAKEKGANVVIANRTYERALELAEAIGGKALSLTDLDNFHPEDGMVLANTTSMXALKHYALVFDAVYTPRITRLLREAEECGAITVSXSEMFVRQAYEQFEIFTGLPAPKELYWQIMSKY

SEQ ID NO: 36777 - protein, 425 aa, Medicago truncatula
MAVEYTCCESEFFIHILVIIFLVVFAGLMSGLTLGLMSLSLVDLEVLAKSGTPNDRKHAVKILPVVRNQHLLLCTLLICNAAAMEALPIFLDSLVTAWGAILISVTLILLFGEIIPQSVCSRYGLAIGASVTPFVRVLVWICYPVAFPISKLLDYLLGHRNEALFRRAELKTLVDLHGNEAGKGGELTHDETTIIAGALELSEKTASDAMTPISETFAIDINSKLDRELMTEILEKGHSRVPVYYEQSTNIIGLILIKNLLTIHPEDESPVKSVTIRRIPRVPESMPLYDILNEFQKGHSHMAVVVRQCDKTKQPSSKNDSNDSVKEVKVDIDGEKPLQEKVLKPKIPIQKWKSFPNTNKSNRGGSRSRKWSKNMYSDILEIDGSPLPNIPEEEEAVGIITMEDVIEELLQEEIFDETDHHFEDS

SEQ ID NO: 36778 - protein, 361 aa, Alkaliphilus metalliredigenes QYMF
MAYQITLIPGDGIGPEVIKEAVRVLETVGDTFGHQFDFEEVLVGGCAYDATGEPLPRESLDSCQKSDAVLLGAVGGEKWDGLPGHQRPEAALLGLRKGLGLYANLRPAILHESLKNACPLRSDIVGEGIDICIVRELMGGIYFGEKGRRTNNDDMGEEAFDVEAYSVGEVERIGRLAFEMALKRDRKVTSVDKANVLESSRLWRSVMIEIAKDYPEVTLEHMYVDNAAMQLIRNPRQFDVLVTTNMFGDILSDEASMITGSIGMLPSASLGEGKFGMYEPIHGSAPDIAGQDKANPIATILSAAMMLRISFDLENEAKEIEEAVTRVLEGGYRTPDIMSDGCKLVGTAEMGNLIIQAMSFE

SEQ ID NO: 36779 - protein, 367 aa, Pyrococcus furiosus DSM 3638
AHHHHHHGSKVVIVGNGPGGFELAKQLSQTYEVTVIDKEPVPYYSKPMLSHYIAGFIPRNRLFPYSLDWYRKRGIEIRLAEEAKLIDRGRKVVITEKGEVPYDTLVLATGARAREPQIKGKEYLLTLRTIFDADRIKESIENSGEAIIIGGGFIGLELAGNLAEAGYHVKLIHRGAMFLGLDEELSNMIKDMLEETGVKFFLNSELLEANEEGVLTNSGFIEGKVKICAIGIVPNVDLARRSGIHTGRGILIDDNFRTSAKDVYAIGDCAEYSGIIAGTAKAAMEQARVLADILKGEPRRYNFKFRSTVFKFGKLQIAIIGNTKGEGKWIEDNTKVFYENGKIIGAVVFNDIRKATKLEKEILDFYS

SEQ ID NO: 36780 - protein, 135 aa, Zea mays
MKLEVMPKQRVLEAEQREEAMEMSGLDLWKHEKPPRICSLPPPLPAPPACDEAALVPPLNFAMVDDGIFRSGFPETANFRFLKSLNLRSIVYLCPEPYPETNTEFLEKNGIRLHQFGIEGRKHLELFSFLLCLAA

SEQ ID NO: 36781 - protein, 491 aa, Zea mays
MLPSFVSPTASAAASVTPPPRPIPGSYGPPVLGPLRDRLDYFWFQSQDEFFRKRAAAHRSTVFRTNIPPTFPFFVGVDPRVVAIVDAAAFTALFDPDLVDKRDILIGPYNPGAGFTGGTRVGVYLDTQEEEHARVKTFAMDLLHRSARTWSADFRASVGAMLDAVDAEFGKDDGSDKKPSASYLVPLQQCIFRFLCKAFVGADPSADWLVDNFGFTILDIWLALQILPTQKIGLVQPLEELLIHSFPLPSFLIWPGYYVLYRFIEKHGAEAVAYAEAQHGIGKKDAINNILFVLGFNAFGGFSVFLPFLVAKVGGAPALRERLRDEVRRAMVGKDGEDGFATVREAMPLVRSTVYEMLRMQPPAVPLGRAGAAYQVSAGEVLCGYQPLAMRDPEVFERPEEFVPERFLGDDGARLLQHLFWSNGPETAQPGPGNKQCAAKEVVVDTACMLLAELFRRYDDFEVEGTSFTKLVKRQASPSVAQAAAAAGAQQ

SEQ ID NO: 36782 - protein, 831 aa, Rhodococcus sp. RHA1
MANTPSSSKLLVVGNGMAGARTVEEILNRGGGERFAITMIGDEPYGNYNRIMLSHVLSGEAATDDEDLILNPMGWYTANGVKLHAGDRAVVLDRFAKTVTCESGRVVDYDVLIIATGSNTFFPNMDGLREHDGRLARGVFGFRNIADTNGMLQMAQARDDVSAVVIGGGLLGLEAAYGLRTQGLTVNVVHSPGHLMNQQLDERGGSVLRAEIEKLGVGVHTSMRTTAVLRDEAGLVTGVSFVDGSTLDADMVVVTAGIRPNTELARAAGLVVERGVVVDDQMRCEDEGSVYAVGECAQHRGETYGLVAPVWEQSVILAEVLTGSNPEAAYVGSRTTTKLKVAGVDVAAMGVKGPETADDEFVQYYEPRSGTYKSLVVRDGKLIGATLMGDISKAGFLTQAFDGKVPLPEERISMLFDVGSQSAATSVADLPDDQQVCNCNGVSKGDLVACVHSGAKTLTDVCAQTRAGKGCGSCKGLVADIVACAAGGELEADPSADWYVPCIPMTKPELIATIRERDLRAVSQVFAELATDAKEDASAKMPLASLLRTIWGPDWVDERGALFINDRVHANIQRDGTFSVVPQMKGGVTTPEQLRTIADVADKYGVPLVKVTGGQRIDLLGIKKEDLPKVWGDLDMPSGFAYGKSMRTVKTCVGTDFCRYGLGDSTSLGIALEERFQGLETPAKLKLAVAGCPRNCSEALCKDFGVVAVGDGRWEIYVGGAAGAHIRKGDLLATVESPKAVVELGGRFIQYYRENAKWLERTYDFVPRVGLEHLQALLVRDEEDIVTGLDERIQTAVDGYRDPWKERSAPKSPAQFAPSLPLLPLPQVPVR

SEQ ID NO: 36783 - protein, 355 aa, Arabidopsis thaliana
MRESEEYGRDKNEEEEESHRDGKKEKEDSFKSYPFSPKTESRLPMLQRKLHQVSMGKQFDKKITWTIKNFASLLSDLIYSDHFVVGGCKWHLRAYPKGYNNANSLSLFLGVAVPTSLPSGWRRHTKFRLTLVNQLSDKLSQSKLNELEQWFDEKTTNWGLSSMCPLNEIHAKDSGFLLNGELKIVVEIKVLETIGKLDVTEETSTITETVDVNGFQLLPSQAKSVSRMFAKHPELASDLRPKNPNLRTGYMSLLLSLIETLSQLPQQMSKDDLLDAYDALGSMRDAGFKLDWLEKKLYEVSEKKENEEASETGLQEMEEELKDMKQKCLEMEALVEKEKAKVSTAKAPISFDDIV

SEQ ID NO: 36784 - protein, 783 aa, Coprinopsis cinerea okayama7#130
MTTIIAGGLGETAGEIIEIEIFATDPQDGQWNAQGRHDETGTVFPSAILLPEVQNGVIHHHAPVHDLEIEAMTAIETETTGGAQTLTETETGIIGLTTITVPTTVNGREEATRIVVESIPIVHNLLPSQPPPPPAAPPSEPIEPRPPSDTPPPPPPPDPRLMNNPPPPPTGAVKRPSLPPTLPNKPVFSSVPPPSLKPKPPAPPPAPPKIRVVKRRTASKRTDKQDMEAYGRVFVGCGQQSDYEVTTKLGEGTFGEVHKAIQKATGASVALKRILMHHEKEGMPVTALREIKILKALKHPCIVNILDMFVVRSSEKDPLSVYMVFPYMDHDLAGLLENERVKLQPSQIKLYMKQLLEGTEYMHRNHILHRDMKAANLLISNTGNLRIADFGLARSFDTNITKGGSTRKYTNCVVTRWYRPPELLLGARQYGGEVDIWGIGCVLGEMFNRRPILPGSSDLDQLEKIWYLCGTPTQHSWPNFDALPGCDGVKHFKSNHIRRVKMTYESVGAETADLLDKLLVCNPKERITAAQALEHEYFWTDPLPADPKTLPVYEASHEFDKRGQRNHQPMMGHHQPSKYQDPSHRLPPPAGNPQRRQGNHRGPPGPWPGAPPLSHGPHAHPPGPGSYNMNQGPPPGMSGPPPPGFRPGPPGGIPMNPNMGPGPYPGGRPQFNGPGGPRPPGPGAYSLPPNPGGRPPFRGPHNGPPGPPGGPGRMGGPGLPPRPSVSLPPKPAAPLGGGVALGTVPRSNVPMPGRRPQPPQPHPPPPSTGSGNGYAPNGGLNYG

SEQ ID NO: 36785 - protein, 123 aa, Glycine max
MLYIIGLGLGDEKDITLKGLEAVKKCDKVYMEAYTSLLSFGLSTNGISNLEKLYGKPIILADREMVEEKAHEILSEADHGHVAFLVVGDPFGATTHTDLVVRANKMGIEVKVVHNASVMNAIG

SEQ ID NO: 36786 - protein, 321 aa, Glycine max
MMMMMSRSGANRVANTAMFVAKGLSGEVGGLRALYGGGVRSESTLALSEKEKIEKKVGLSSAGGNKEEKVIVSYWGIQPSKITKKDGTEWKWNCFSPWGTYKADLSIDLEKHMPPTTFLDKMAFWTVKVLRYPTDVFFQRRYGCRAMMLETVAAVPGMVAGMLLHCKSLRRFEHSGGWFKALLEEAENERMHLMTFMEVAKPKWYERALVITVQGVFFNAYFLGYLLSPKFAHRMFGYLEEEAIHSYTEFLKELDKGNIENVPAPAIAIDYWQLPPGSTLRDVVMVVRADEAHHRDVNHFASDIHYQGRELREAAAPIGYH

SEQ ID NO: 36787 - protein, 209 aa, Corynebacterium diphtheriae NCTC 13129
MAKLETAEFDRDPQGVWETLLEANGRFVRGEPLRPNQDAARREELTKGQAPRACVFTCGDSRVPAELLFDSGFGDIFVVRTAGEVIDSGVLASIEFAVLGLGVEVVVVLGHESCGAVAATVAVLEGAEVPTGHQRTLVEQITPSILEAKFEGHDTPDDFERHHAAAMVNRIMQTSPAITEAVENGQTALIAARYRLSDGAVETIKTCGF

SEQ ID NO: 36788 - protein, 632 aa, Campylobacter jejuni RM1221
MDIQILQEQANTLRFLSADMVQKANSGHPGAPLGLADILSVLSYHLKHNPKNPTWLNRDRLVFSGGHASALLYSFLHLSGYDLSLEDLKNFRQLHSKTPGHPEISTLGVEIATGPLGQGVANAVGFAMAAKKAQNLLGSDLIDHKIYCLCGDGDLQEGISYEACSLAGLHKLDNFILIYDSNNISIEGDVGLAFNENVKMRFEAQGFEVLSINGHDYEEINKALEQAKKSTKPCLIIAKTTIAKGAGELEGSHKSHGAPLGEEVIKKAKEQAGFDPNISFHIPQASKIRFESAVELGDLEEAKWKDKLEKSAKKELLERLLNPDFNKIAYPDFKGKDLATRDSNGEILNVLAKNLEGFLGGSADLGPSNKTELHGMGDFVEGKNIHFGIREHAMAAINNAFARYGIFLPFSATFFIFSEYLKPAARIAALMKIKHFFIFTHDSIGVGEDGPTHQPIEQLSTFRAMPNFLTFRPADGVENVKAWQIALNADIPSAFVLSRQKLKALNEPVFGDVKNGAYLLKESKEAKFTLLASGSEVWLCLESANELEKQGFACNVVSMPCFELFEKQDKAYQERLLKGEVIGVEAAHSNELYKFCHKVYGIESFGESGKDKDVFEHFGFSVSKLVNFILSK

SEQ ID NO: 36789 - protein, 509 aa, Debaryomyces hansenii CBS767
MSKRSASDELAPQSGNSAVKTTKDSLPPANAAEEQADDVDMGEFEDPYGDEFESDGEIIEVDSANEEDDDMDEEGKNKKIEELEREEEKEPESTIYLPHKSKPLGPDEVLEADPSVYEMLHNVNLPWPCLTVDVLPDNLGNERRTYPASLYVTTATQASRAKDNEIITMKLSSLSKTLVKDEDDEEQDEDEDDDNEDVDPIMDSETIPLKHTTNRIRVSPHASETGEYLTATMSESGEVLIYDLSSQYKAFDTPGYMIPKSSKRPIHTVRNHGNVEGYGLDWSPLINTGSLLSGDCSGRIYATSRTSSNWVTDKTPFFASDSSIEDIQWSTGENTVFATAGCDGYVRVWDTRSKKHKPAISVAASKTDVNVISWSDKINHLLASGHDDGSWGVWDLRNFNAQTTPSPVAHYDFHKSAITSISFNPLDESIIAVSSEDNTVTLWDLAVEADDEEITEQRKELQELHDIPPQLLFVHWQRDVKDVRWHKQIPGCLVSTGGDGLNIWKTISV

SEQ ID NO: 36790 - protein, 92 aa, Mesostigma viride
CLVASTNRGCKAITLSGGVSTNVVRDGMTRAPVVRFETVRRACELKQFAESPDNFALLADKFNGTSRFAQLSGLHAAVAGRNVYLRFESTTG

SEQ ID NO: 36791 - protein, 250 aa, Kluyveromyces lactis NRRL Y-1140
MSGFRNRIQSWGKGLGTVLSDSIGDESSEKTSRSIQHNHYEEDDALPPVHLIGYSEKTKNRLLSKEMCEELRQLMPTRIQLYTEWTLLYSLEQHGASLHSLYDKLKYDTNNNARVGYVIVIRDRKGGIFGGYANETFHPTDSRRYYGNGECFLWKMEKVPDLQLHDKHDCKQDSHNWQLRGFPYTGENEFSIYCTSTFLSMGAGDGHYGLWIDDGLFRGVTFPSMTFGNDILSREGSKFHIVGVEVWRVG

SEQ ID NO: 36792 - protein, 78 aa, Arabidopsis thaliana
  misc_feature (72)..(72): Xaa can be any naturally occurring amino acid
MAPSMRLCFSMDASPARGGFDRAFYGLKSSAAFPATRKANNDITFITSNGGRVNCMQEWPPTGKKKFETLSXYPPDLT

SEQ ID NO: 36793 - protein, 439 aa, Bradyrhizobium japonicum USDA 110
MTTTTGSDEQTQGYFPRWKLKTSGVIMPEERLSWGQTIVSGLQHCVAMSGSTIIAPLLMGFDPNVAVLFSGVGTLIFFVIVAGRVPSYLGSSFAFIAVVLAATGYAGQGPNPNISVALGGIVGAGVLYGAIALIVMWSGVGWVERLMPPAVTGAVVAAIGLNLAPVAVKAVSANAFDTWIGLATVLIIGVVAVAAPGLWRRLPIILGAIGGYLLYFLFANGLGFGKPIDFALLSAASWLGLPKFTTPTFQADAIFLIAPVAVILVAENLGHIKAVGAMTGRSLDAYLGRALFADSLATIVAACGGGTGVTTYAENIGVMAATKVYSTLLFALAATVSILLGFSPKFGALILSIPGPVIGGLSIVLFGLIAAMAGRIWVENKVDFANPANLITVAVALTAGAGDLTLKFGAFTIGGIGTATFGAIILYQILTSSLAQHAE

SEQ ID NO: 36794 - protein, 91 aa, Cyanophora paradoxa
LVASTNRGAKALSESGGVQTVLLKSGITRAPCVRMPSAVRAAELKAWIEDEANYAAVCDAFNSTSRFARLQECKVALAGRSVYIRFRCSSG

SEQ ID NO: 36795 - protein, 442 aa, Desulfitobacterium hafniense Y51
MGFTKEECLKYVQENDVRFIRMQFTDIFGQMKNIAITHNQLAQALDEGVLFDGSAIKGFAGVEASDMLLLPDPSTFTLIPWRPQQGKVARIICDVKNHDGSQFEGDPRYILKRTLQKAHDLGYVFQVGPECEFFLFHTDEEGQPTTITHDAAGYCDLAPIDQGENTRREICLVLEEMGFEIETSHHESAAGQHEIDFKYTDALTAADHIMTFKYVVKIVSQRNGLHATFMPKPLHGVNGSGMHINMSLAKEGRNVFIHPENPGELSETAKQFIAGLLEHIKGITAVANPLVNSYKRLTPGYEAPVHIAWSPMNRSPLLRVPSPRGAGTRLELRSPDPSCNPYLTLALLLEAGLDGLQREMKVPEPVNENIYNLTPEQEKALSLERLPSNLLLALEEMEKDPLIQATLGRHIFTKYIAAKAREWKAYDEMVHQWEIDSYLKIY

SEQ ID NO: 36796 - protein, 456 aa, Actinobacillus pleuropneumoniae serovar 1 str. 4074
MTKHYDYLAIGGGSGGIASINRAASYGKKCAIVEAKHLGGTCVNVGCVPKKVMFYGAHIAEAINSYAPDYGFDVTVNNFDFVKLIESREAYISRIHTSYNNVLAKNNVDVLNGFAKFVAAKTVEVTYADGSSEQVTADHILIATGGRPSIPAIKGAEYGIDSDGFFALREVPKRVAVVGAGYIAVEIAGVLNSLGSEMHLFVRQHAPLRMQDPLIVDTLLEVLAQDGITLHTQAIPQEVRKNADGSLVLTLADGREATVDCLIWAIGREPACDKINLDAVGVKTNAKGQIIVDKFQNTNVPNVYAVGDIIEGGIELTPVAVAAGRRLSERLFNNKPNEHLDYNLVPTVIFSHPPIGTVGLTEPQAIEQYGAENVKVYKSSFTAMYTAVTQHRQPCRMKLVCVGKDEKVVGLHGIGFGVDEMIQGFAVAIKMGATKADFDNTVAIHPTGSEEFVTMR

SEQ ID NO: 36797 - protein, 617 aa, Desulfitobacterium hafniense Y51
MCSILGLVNFKRKISPQEIQCLSTMGKTLIHRGPDQNGLEYGEHFAFQHNRLAIIDIEKGRQPMTATHQGYDYTIVYNGELYNTADLRQELLEHGVKFKTYCDTEVVLYAYIIWGEQCSSKLNGIYAFVIYDSKEKKTYLSRDRFGVKPFFYTFVEGALLFASEIKALLKHPQVKPRLDYQGLWQLLYMMPVKEEGTAIFKDIFELPTASHAFYSLAPGASEAELKIAKYWTMEAYENQDSEAAIVATTRDLLVDAIERQLVSDVPLCTFLSGGLDSSIITAVAAQKYQAEGRQLATYSFEHEGNKDHFKQTLFQPQSDDEFAVYLAQHLHTQHQILTAKKEHLVDYLDEAVRYRDYPGMADIDSSLLFYCRQVKEHHTVALSGECSDEVFGGYPWFYRPEMLTRGFFPWIHEPHARISLFKPELVRPQEGFAYTSEIYRRSVEACPLLPDESETMQNSRIASWLSINYFMTSLLERKDRMSMASGLEVRVPFSDHRLVQYVYNVPWEIKFKDGVEKALLRAAMQDYLPPKILYRKKSPFPKTHDPHYEELVFHLFRKRLDSGSGMLAELLQKDVLNRLISPGNNTWFGQLMGLPQLLAWLVQLDYWFEAYQVQLVG

SEQ ID NO: 36798 - protein, 384 aa, Clostridium acetobutylicum ATCC 824
MKFLILSVSAGGGHIHAAFALKKYIAKYLEGSQVKMLDTIKYLNPFLDKVLIGGYLKTLKVSPALFGKLYNFTEKDDNLASLSNKINEFMAYKLIPIIEDFNPDVIICTHPFPTEMVSILKSKESLKTPMLCILTDYAPHSFWIRPQVNSYVVSNSDMVDEMVRRGVNRENIYDLGIPVDPDFIRNFDKIETLNELNLSLNKKTILIMGGSLGIGKIEDIYEALSKSRANIQIIIITGNNKKLYSKLLELAEDSYVETRILGYTRDVNRYMQASDLLLTKPGGLTITEALICRVPLAVFSPIPGQEEKNEDFLLKHNLAISIRDSENCLGIIESLISNPELLQAMKDNCNKFSKPSSGKDICNLLINLINKNQKIDVNNADYRN

SEQ ID NO: 36799 - protein, 414 aa, Aspergillus nidulans FGSC A4
MSTTPSDAPTPTPATSQPAPPVDGNTVAPDVEKLHVSPEGESTPTPAPASESASAPPKESLVQEEPAATPAPQQEIETIDSLNLPSSAADGLIQKPFVRPVNTAKPPPPAKLTPEQQAKYESVLKSVSGWTTVPTTAAKNAPTAPITDDERMFLTRECLLRYLRATKWNAPEAVARLQRTLTWRREYGIEKLTADYISIENETGKQVLLGYDIHGRPCLYLLPSNQNTEKSDRQVQHLVFMLERAIELMPADQETLALIVDYSQTKSGQNASIGQAKDTVHFLQNHYPERLGRALVINMPFIIMGFFKIITPFLDPVTREKLKFNENLTNHVPPSQLMKSVGGDVEFKYDHAAYWPALNKLTELKQKEYRERWIKGGKRIGEYEHYLKTGASPSISQREAEANGSAGPAADKAS

SEQ ID NO: 36800 - protein, 294 aa, Aspergillus oryzae
MESFNSTTALPQMASYTDLIKLAHQNPNLSSMENLWEAYYSYWNNDILATGIITFIAHELIYFGRCLPWIIADAMPGTFNRWRIQDHKAPPSVATQWDCTKYILAIHFIVELPLIVLFHPMMDLCGLKYASPFPDLKTLAAQLAIFFIVEDTYHYWLHRAFHWGPLYRSIHRIHHQYATPFGLTAEYASPWETLLLGLGTIAPPLVLGYFTENVHLITVLVWMGLRQVQAIDSHSGYDFPWSLRRIMPFWGGADWHDDHHRYFVGNYSSSFRYWDILMGTVAGPKNGREHRRRN

SEQ ID NO: 36801 - protein, 196 aa, Triticum aestivum
HYRTSLYKKAGWYRSGIPGISSTHASGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 36802 - protein, 450 aa, Glycine max
MGKTPFSFRRSASRRRPKKTAAPPPPPSPPQHPYAAGFAASPDDNNRLIAAAAGSSALTKAKKKTGNVRLWMRFDRSGRSELVELEKNAIVRHAAIPARDLRILGPVFSHSSNILAREKAMVVNLEFIKAIVTAEEVLLLDPLRQEVLPFVEQLRQQLPGKSQPKLLGGTEEQEGEMHVSNGRQWLPTPEAADGLQSELPFEFQVLEIALEAVCTYLDSNVADLERGAYPVLDELARNVSTKNLEHVRSLKSNLTRLLARVQKVRDEIEHLLDDNEDMAQLYLTRKWLQNQQFEEAHLGATTSNNFPNTSRSVRQLGSIRSESLVTSHYEDDNNVEDLEMLLDAYFMQLDGTRNKILSVREYIDDTEDYVNIQLDNHRNELIQLQLTLTIASFAIAIETLIAGAFGMNIPCNLYNIDGVFWPFVWTTSAACVLLFLLILAYARWKKLLGS

SEQ ID NO: 36803 - protein, 573 aa, Kluyveromyces lactis NRRL Y-1140
MSRVLSRRDIADRIAKGQTIVIYEDSVLNLDKWIKFHPGGDKSIYHMIGRDATDEMNAYHDDQTITKFKIWKIGRIDYPWENMLPPIQGGRFSKIDERDDIGDYDINLTSKWRSVDESNQYTKIPKNDRLASEAEVKIYPKIPQGVVPSLDLKEAYEKKIVVDPAIVSENYDNERVYEDLTNFPSLDVKNQEWIASEYRKLHGEITAAGLYQCNYVRYLKEFLRIGTLFGISFYLLSLKWFAISAICLGFAWQQLVFIAHDAGHISITHNYQVDNIIGMTVASWIGGLSLGWWKRNHNVHHLVTNDPVHDPDIQHLPFFAVSTRLFHNVYSTYYDKFLWFDKFAQKVVPIQHYLYYPILCFGRFNLYRLSWMHVLLGQGPRRGKAAWFRYYELAGLSFFNYWFFYLIIYKQMPTNAERFKYVMISHIATMIVHVQITLSHFAMSTSDLGVTESFPMRQLRTSMDVDCPRWLDFFHGGLQFQVIHHLFPRLPRHNLRDAQSLVIKFCDKVGIKYSIYGFAAGNDVVISHLQQIAQQAHTMLECAKTMKKEATDTEFHTNKHVLAANVNEKRKQE

SEQ ID NO: 36804 - protein, 624 aa, Oryza sativa
MGTRRRRNPVIFLFLWFVMAFELCASLNHEGVALMRFKEMIDADPFDALLDWDEGNASPCSWFGVECSDDGRVVALNLPNLGLKGMLPQEIGTLAHMRSIILHNNSFYGIIPTEMKYLHELKVLDLGYNTFSGPFPSELRNILSLKFLFLEGNKLSGSLPIEYELASMDQTSLNKISTERNEENATRRKLLASKQKRSQKNRMLLSGTSESPLENVTMPKSHPDNITVPHRPVAPRSSSPQPPLPSEPIPSPAPSMPSPAPSVSTTTNGTSGQENKSKTAIYASIGGVACLVVVAMSAALILCYRHRKTSTVVPFSPTASGQLHTATLGGITKFKRSELETACEGFSNIIDTLPRFTLYKGTLPCGAEIAAVSTLVTYASGWTTVAEAQFKDKVEVLSKVSHKNLMNLVGYCEDEEPFTRMMVFEYVSNGTLFEHLHVKEADQLDWQSRLRIAMGVMYCLNYMQQLNPPVLLRDLSTSCIYLTEDNAAKVSDISFWGDKKEDEKSEASDEHITVYKFALLLLETISGRRPYSDDYGLLILWAHRYLIGDKPLMDMVDPTLKSVPEEQVRELTKLVKLCLSEDPMERPTVAEVTAWMQEITGISEEEAIPKNSPLWWAELEIITS

SEQ ID NO: 36805 - protein, 90 aa, Oryza sativa (indica cultivar-group)
MTQMAISSCFHMHESTVDIRRELKLDPYVILETTLKEEDVIVERATVNKECEKCKNPELQYYTKQLRSADEGQTVFYKCANCRHEFNENQ

SEQ ID NO: 36806 - protein, 424 aa, Bacillus subtilis
MSAKQVSKDEEKEALNLFLSTQTIIKEALRKLGYPGDMYELMKEPQRMLTVRIPVKMDNGSVKVFTGYRSQHNDAVGPTKGGVRFHPEVNEEEVKALSIWMTLKCGIANLPYGGGKGGIICDPRTMSFGELERLSRGYVRAISQIVGPTKDIPAPDVYTNSQIMAWMMDEYSRLREFDSPGFITGKPLVLGGSQGRETATAQGVTICIEEAVKKKGIKLQNARIIIQGFGNAGSFLAKFMHDAGAKVIGISDANGGLYNPDGLDIPYLLDKRDSFGMVTNLFTDVITNEELLEKDCDILVPAAISNQITAKNAHNIQASIVVEAANGPTTIDATKILNERGVLLVPDILASAGGVTVSYFEWVQNNQGYYWSEEEVAEKLRSVMVSSFETIYQTAATHKVDMRLAAYMTGIRKSAEASRFRGWV

SEQ ID NO: 36807 - protein, 394 aa, Rhodospirillum rubrum ATCC 11170
MKAANSLFSGLGTTIFSVMSHLAQEYGAINLGQGFPEGLEPADVIAAAARSLAAGPHQYPPMMGLPALRQALAAHEKRFYDLDIDWQTEVMVTSGATEALADALFGLIEPGDEVVLIEPLYDSYLPIIRRAGGIPRLVRLEPPRWSLPREALAAAFSPRTKLILVNSPMNPCAKVFSADEMAFIGDLAIAHDAYIVCDEVYEHLVFDGQSHRPLMAQPGLRERCVRIGSAGKTFSLTNWKVGYVIAAPEVLDPIAKTHQYITFTTPIPLQQAVAEGLAKDDAYFAGLAHDMAARRDRLGAGLRRIGFEVLDCAGTYFLTADFRPLGFAGDDLAFCRHITCEAGVTAVPVSAFYQPGQGGIPTSFARFCFAKRDDALDEAVARLERHFAGGRRNA

SEQ ID NO: 36808 - protein, 379 aa, Blastopirellula marina DSM 3645
MPKRAYDVLVLGAGGVGSAALYQLAKRGIHAAALDRFHPPHRFGSSHGQTRIIRQAYFEHPSYVPLLQRSYELWREIEAASERSLYHEVGLIEIGPTDGIVLPGVMRAAAQFHLEIDRYSAAEAKRLFPQFVFPDDHTVVFERRAGYLKVEDCVAAFLAMAQRHGAEVIADTEVARWGHDGAGYCVSTSTGEYRAAKLIIAGGAGAKVLLRGINAPLQALRKHMHWYEIDDARLQESSGAPCFFFESSHGYFYGFPELAGGEGLKVAEHGGGETWEPSWNDNQSADPEDQRRIEAFLQRSILGVSRRPVRHETCLYTMTPDENFLLGLYPGDKRIAVAAGLSGHGFKFAAVLGEALADLVEQGSSQLPIEFLSPNRFAV

SEQ ID NO: 36809 - protein, 603 aa, Arabidopsis thaliana
MSASWADVADSEKAVSQSKPPYVPPHLRNRPSEPVAAPLPQNDHAGYGGQPAGSRWAPPSSGGGGASGGGYRNDGGRTGYGYGAGGGGGGGGGWNNRSGGWDRREREVNPFGDDAELEPVFTEQENTGINFDAYEDIPVETSGGDVPPPVNTFADIDLGDALNLNIRRCKYVRPTPVQRHAIPILLAERDLMACAQTGSGKTAAFCFPIISGIMKDQHVERPRGSRAVYPFAVILSPTRELACQIHDEAKKFSYQTGVKVVVAYGGTPIHQQLRELERGCDILVATPGRLNDLLERARVSMQMIRFLALDEADRMLDMGFEPQIRKIVEQMDMPPRGVRQTMLFSATFPSQIQRLAADFMSNYIFLAVGRVGSSTDLITQRVEFVQESDKRSHLMDLLHAQRETQDKTKRGADTLENWLCMNEFPATSIHGDRTQQEREVALRSFKTGRTPILVATDVAARGLDIPHVAHVVNFDLPNDIDDYVHRIGRTGRAGKSGIATAFFNENNAQLARSLAELMQEANQEVPEWLTRYASRASFGGGKKRSGGRFGGRDFRREGSYSRGGGGGGGGGGSDYYGGGGYGGGGYGGAPSGGYGAGVTSAWD

SEQ ID NO: 36810 - protein, 202 aa, Triticum aestivum
  misc_feature (86)..(86): Xaa can be any naturally occurring amino acid
MPYTASRPSAPQRARVAAVGAGWKAAAHAASCGAVPGEVARHHEHAAGAGQCCSAVVQAIEAPVGAVWAVVWRFDRPQAYKHFIRXALDGTGRWVGAVGSVREARVVSGLPATSSRERLEILDDERRVLSFRVVGGEHRLSNYRSVTTVHEAASAGAVVVESYVVDVPPGNTADETRTFVDTIVRCNLQSLARTAQQLALAA

SEQ ID NO: 36811 - protein, 140 aa, Ralstonia solanacearum GMI1000
MSRKWLNKVKWDDHGLVPVIVQEQGSNDVLMFAFMNREALQKTVETGEAVFWSRSRKRLWHKGEESGHIQQVHEIRLDCDEDVVLLRVTQVGGIACHTGRHACFFQKFEGTAEDGDWHTVEPVLKNPDDIYAGKPGHNHE

SEQ ID NO: 36812 - protein, 196 aa, Ralstonia solanacearum GMI1000
MSRRAEVTRNTSETQIRVALDLDGTGKQTLNTGVPFLDHMLDQIARHGMVDLDVTATGDTHIDDHHTVEDVGITLGQAVAKAIGDKKGIVRYGHSYVPLDEALSRVVIDFSGRPGLEFHVPFTRARVGSFDVDLSIEFFRGFVNHAGVTLHIDNLRGVNAHHQIETVFKAFGRALRMAVEIDPRAAGTIPSTKGAL

SEQ ID NO: 36813 - protein, 206 aa, Zea mays
  misc_feature (174)..(174): Xaa can be any naturally occurring amino acid
  misc_feature (186)..(186): Xaa can be any naturally occurring amino acid
MQRAVQAVRSHGNVLKYAVLQHISAPKPAMLPAAFSRFMSVSSARLEDRGFETATVADVLKSKGKSADGSWLWCTTEDSVYDAVKSMTQHNVGALVVVKPGQNKSIAGIVTERDYLRKIIVQGRSSKSTKVGDIMTEENKLITVNPDTKVLQAMQLMTENRVRHIPVIDGTGMXGMVSIGDVVRAXVVAEHREELNRLNDYIQGGY

SEQ ID NO: 36814 - protein, 455 aa, Pseudomonas syringae pv. phaseolicola 1448A
MSAHNNPQTLEWQALSSEHHLAPFSDYKQLKEKGPRIITRAEGVYLWDSEGNKILDGMSGLWCVAIGYGREELADAASKQMRELPYYNLFFQTAHPPVLELAKAISEIAPQGMNHVFFTGSGSEGNDTMLRMVRHYWALKGQPDKKTIISRVNGYHGSTVAGASLGGMTYMHEQGDLPIPGVVHIPQPYWFGEGGDMTPDEFGVWAAEQLEKKIIELGVENVGAFIAEPIQGAGGVIVPPDSYWPKIKEILSRYDILFAADEVICGFGRTSEWFGSDFYGLKPDMMTIAKGLTSGYVPMGGLIVRDEIVAVLNEGGDFNHGFTYSGHPVAAAVALENIRILREERIVERVKSETAPYLQKRLRELSNHPLVGEVRGVGLLGAIELVKDKVTRERYTDKGAGMICRTFCFDNGLIMRAVGDTMIIAPPLVISFAEIDELVEKARKCLDLTLAVLLG

SEQ ID NO: 36815 - protein, 327 aa, Pseudoalteromonas tunicata D2
MSGITKFEPIIVADIGGTNARFAVVTDFDATSSQFVIAHHQTFVSAQFDSMQSLLAAYIQALPFAQPQRAALAVAGPMKGQTVNLTNLGWCFTLTELQSQFQLSQLKVINDFAAFAYAAPYLQAEQNLLVKAGTPEQNANIAVMGPGTGFGAAALVFNGESRTVLSCEAGHISLAAVTDLQRQLLVEINKEVSHVSVENVFSGAGLERLYRAMAKVNNLPVEPYTAADISQLALSGQSDICHKTLVQFCEWIGSVAGDLALTFGARGGVFIGGGILPRMQEVLLHCDFSQRFVQKGIMTHYVQDIPVTLVTQDNIPFIGAAASLLVH

SEQ ID NO: 36816 - protein, 335 aa, Pseudoalteromonas tunicata D2
MIRVAINGYGRIGRNVLRALYESGRQNEIKIVAINDLAPANVNAHLTQFDSVHGRFGFPVTLAENAMIVADDSIVLTQERDPANLPWQALNVDIVLECTGLFTTRESAGKHLTAGAKRVIVSAPGTDMDATVVHGVNSDVLTPECHIISNASCTTNCLAPIAKILNDAIGIEQGSMTTIHAYTNDQNLSDVYHPDLYRARSATQSMIPTKTGAAKAVGLVLPELAGKLDGMAVRVPTINVSLVDLTFIAKRETTAAEVNAAIKGFAEGAMADILEYNELPLVSIDFNHNPASSIFDATQTKVDGKLVKVMAWYDNEWGFSNRMLDQVTTLAKLMN

SEQ ID NO: 36817 - protein, 469 aa, Rhodospirillum rubrum ATCC 11170
MSDVKTILEMIKENDVKFVDFRFTDPKGKWQHTAQYVTTIDEESLVEGIMFDGSSIAGWKDINESDMILKPDLKSAFMDPFSAQPQLVLFCDVLEPSTGQPYERCPRSIAKKALSYLASTGIGDTSYFGPEAEFFVFDDVRFDVSMNRVMYEVDSEEGPYVTGKIFDEGNYGHRPPIKGGYFPVPPVDSAQDLRAEMLSTMAEIGMPVEKHHHEVAPSQHELGVRFNTLIEAADDMQKYKYVVHMVAHAYGKTATFMPKPIAGDNGSGMHVHQSIWKDGKPLFAGSGYADLSEMALYYIGGIIKHAKALNAFTNPSTNSYKRLIPGFEAPVLLAYSARNRSASCRIPYVASPKGKRVEVRFPDAAANPYLAFAAMMMAGIDGIENKIHPGDPMDKNLYDLPPEELMGIPTVCGSLREALDSLNADRDFLKKGGVFTDDMIDGYVALKWEEVYNLEHAPHPIEYKMYYSV

SEQ ID NO: 36818 - protein, 1501 aa, Botryotinia fuckeliana
MATSAPFGVLPQSEAVAEKVEEVVQEKTYQNIDHKRKDSDSESSTLDSTREREDATIRTLARQITQKSMEGAYDHNINPFLGSNDPRLDPSSEKFSSRAWTKHLVHLQSRDPERYPNRTAGIAYKNLNAHGFGEPTDYQKTFGNYPLEIIGMSKRVLGLSKPTKIQILRDFDGLIRSGEMLVVLGRPGSGCSTLLKTISGETSGFFVDSNTYINYQGIPMETMHNDFRGECIYQAEVDVHFPQLTVAQTLGFAAKAKAPRNRIPGVTRDQYAEHLRDVTMATFGLSHTFNTKVGNDFIRGVSGGERKRVSIAEAAVGGSPLQCWDNSTRGLDSATALEFVKTLRNSTELSGSTAVVAIYQASQSIYDLFDKVAVLYEGRQIYFGDINAAKTFFVNLGFDCPARQTTADFLTSITSPAERIVRPGFEGRTPYTPDEFAAVWQKSEDRAQLLREIDQFDAEFPIGGQALDDFKNSRKAVQAKGQRIKSPYTISLPMQIRLCVERGFQRLRGDMSLLLTGLIGQSVMALIIGSVFYNLADDTNSLYSRGALLFFSILMAAFQSALEILTLYAQRPIVEKHTKYAFYHPVAEACASMLCDIPNKVFSTIFFDLALYFMTNLRREPGYFFVFFLFTFLCTLTMSMYFRSIASLSRSLSEAMAPAAIFILAIVTYTGFAVPIRDMHPWFRWINYLDPVSYGFEALMINEFHGRKIPCSVFVPSGGNYGNVGADERICSTTGAAAGADYVDGDRYLEVNYGYNHSHLWRNLGVMIAFMFLGLFIYLSASEFISAKKSKGEVLLFRRGRIPYVSKASDEEAKIDDRMTAATVTRTKTVPDAPPSIQKQTAIFHWDDVHYDIKIKGEPRKLLDGVDGWVKPGTLTALMGVSGAGKTTLLDVLASRVTMGVVTGQMLVDGRQRDIGFQRKTGYVQQQDLHLATSTVREALAFSAILRQPKATPHAEKIAYVDEVIKVLEMEEYADAIVGVPGEGLNVEQRKRLTIGVELAAKPALLLFLDEPTSGLDSQTAWSICALLRKLADNGQAILCTIHQPSAILFQEFDRLLFLARGGRTVYFGEIGEHSKVLTNYFERNGAHPCGDLANPAEWMLEVIGASPGASNTIDWPETWKNSPERQQVKSHLAELKTTLSQKQVEHDPTSLNSFAAGFGTQMQVVLVRVFQQYWRTPPYLYSKTALCLCVGLFLGFSFYDTKTSLQGMQNQLFAIFMLFTIFGNLVQQILPHFVTQRSLYEVRERPSKTYSWKVFILSNIIVELPWNTLMAVIIFVTWYYPIGLYRNAEMTNAVNERSGLMFAFIWMFLMFTSTFADFIIAGIDTAENAGNIANLMFSLCLIFCGVLASPTALPGFWIFMYRVSPFTYLVSGMMSTGLANTEVVCDSIEYLHFNPPSAKTCGEYLGPYMSAAGGYLNNPEAMTDCEFCSIKDTNVFLAGVNSYYSDVWRNWGLMWVYLAFNIAGAIGMYWLVRVPKGASQGEDNEEGAKKGWFSKKKADA

SEQ ID NO: 36819 - protein, 401 aa, Acidobacteria bacterium Ellin345
MATQTKDYYGALGVKKNASAEEIRKAFRKLARKYHPDVNPGDKKAEDKFKEISEANEVLSDPKKRKIYDQLGFYSDNIDPAAAEAYARNGATGAGGFGGYDPRAAQGGQDIPFDFSGFDFSQEAGEPSGGGGFRDIFSSLFGGGRGGHEERPRPQAGTDLEYQVNVPFWDAIRGTTVKLNIQRREVCSNCHGEGEIGGTHTCPQCHGKGKIETGGGPMKFNVTCPTCHGTGKARTQCPVCHGEGAITRNEPLEFKIKAGTRDGQRIRLAGRGNAGTMGGASGDLYIIVKAGEHPVFRREGDDVYVTVPVSAVEAALGTKIEVPTIDGRALLKIPPGTNSGQKLRLREKGVPNAADGTKRGDEIVEVKLIVPKVSDERSKEILRELQKLNPEDPREELWRQV

SEQ ID NO: 36820 - protein, 433 aa, Blastopirellula marina DSM 3645
MDQPAHDIFSHAVARLDKAFLHADIDQEAVQRLKHPKQVLEVTIPVRMDDGSLRIFTGYRVRHDATRGPTKGGIRFHPNVDLAEVKALAFWMTFKCAVANLPFGGGKGGVIVDPKELSRLELERLSRGYIERIADFIGPEVDVPAPDVYTNAMIMGWMMDEYSKIRRQHTPAVITGKPIPLGGSLGRDDATGRGAYHCIKELEAKRGWKPEEQRVAVQGFGNAGQAVARLLHADGYNVVAVSDSRGGIYKESGFDIPSLAHVKNESRHLKAVYCEGSLCESIAADVITNAQLLELEVDILIPAALENQITGENAPRVKADVIVEAANGPLTGEADDILNDKGTLVVPDILANAGGVTVSYFEWTQNRAGYYWPLELVQQRLHETMAREFNTVYNLANHKEIDMRTAAYVVGLNRIGEAIASQGTARYFTAQED

SEQ ID NO: 36821 - protein, 400 aa, Pinus mugo
MGTLLQTHIGSVAFALQKEGGHSASAKDSAFLGVSLVEHGKKEFSFPVIRAKKVTSRNTNVPRIRAQTVAAPVETKDAPASKKTDRKGNVIITGASSGLGLATAKALGESGKWHIIMACRDFLKAERMARSVGIPKENYSVMHLDLASLESVRQFADNFRRSGRPLDVLVCNAAIYLPTAKLPTYTAEGFELSVGTNHLGHFLLSRLLLEDLKTSDFNSKRVIIVGSITGNTNTLAGNVPPKANLGDLRGLAGGLNGVNISPMIDGGEFDGAKAYKDSKVCNMLTMQEFHRRYHEETGITFASLYPGCIATTGLFREHIPLFRLLFPPFQKYITKGFVSEEEAGKRLAQVVSNPSLTKSGVYWSWNNNSGSFENQLSEEASDPEKAKKLWEISEKLVGLA

SEQ ID NO: 36822 - protein, 471 aa, Zea mays
  misc_feature (224)..(224): Xaa can be any naturally occurring amino acid
MAMEAMMSGLNSGVVLSLIAVLWTVVWQNLQHLQLQQFFARQLSRRARRLAAMVDPYLSVTIAEYEGGRMKRSDAYEEVKAYLSDASAHGVRHLRAESAKDADKLVLSMSDGEEVEDDFEGARVWWWAYSKQPPRSDGAAAWWSGGGAAAQEERHFYRLFFLEHQRSLVLDTYLPRVRQLGRAVMVKNRQRKLFTNISTHQWSDGGFMRSAWTHVVFEHPQDVXTLAMDPASKKEVIDDLDAFKAGKEWYERVGKAWKRGYLLHGPPGTGKSAMIAAMANHLDYDVYDIELTEDIDCSLDLTGAREKKKAAEEDGDKDKKDGGGPSKPGEKKDTSSKVTLSGLLNFIDGLWSACGGERIIVFTTNHVKKLDPALIRRGRMDKHIEMSYCGFEAFKFLAKTYLDVDSHPLFDAVGELLREVDMTPADVAENLTPKSLDDGPDSCLADLVKALEEAKKASGAGEDEEDQQHEP

SEQ ID NO: 36823 - protein, 403 aa, Oryza sativa (japonica cultivar-group)
MDATAIGNGALHSNGAGADTKGKPIKCKAAVAHGPGEALVMEEVEVAPPARMEVRLKVLFTSICHTDLSAWKGENELQRKFPRILGHEAAGVVESVGEGVEDLAPGDHVVPIFTGECGACTYCESSKSNLCKTYRVNPFKSTMVTDGGTRFTMIDRSSGARNPVYHFLNTSTFAEYTVIDSACAVKINPKAPLEKMSLLSCGVSTGVGAAWNTANVSKGSTVAIFGLGAIGLAVAEGARLRGASRIIGVDINPEKFSKGKEMGITDFINSKASGKPVHEVIMEMTDGGVDYSFECTGITDVLREAFVSTHDGWGLTVVLGIHATPRMLPLHPMELFDGRRITGCVFGDFKGKSQLPEIVEKCMQGEININFDGFITQELPFADINKAFQLLEEGKSLRCLLHV

SEQ ID NO: 36824 - protein, 345 aa, Zea mays
MMYLVESCVATKGGSGFSVATVVVRLADTWETETTSGSQLEAADDAEMRRSEIIFPTDFIVGAADLSWILKYWRIFNTTRRYKATVGAIAQNGYYVAYDGWGNREEGNLVQPSMVSEYDLGGEGDLFKAPQVIIQEEALLSLDPVAAACSMMNQTIKDAGIQNDALLSEVLYECEKELMEKSAIEETISELMDVKIPMLQAEQLPAMENEKRSIPECSLQKSVSSGCLNSADWMNGAVRPNFLDFQGLDFEAAFGLRRAYSEGDIQNLGANTPRPAANVCVTISDLKTEERKQKLSRYRKKKIKRNFGRKIKYACRKALADSQPRVRGRFAKIEECDLLLLNSST

SEQ ID NO: 36825 - protein, 653 aa, Pseudoalteromonas tunicata D2
MSQNNSNASKPSRRETRQAASDFIYNLTGQPFPNSAKVYVAGQQKGVNVGMREITLGDSFKGGTEENPILEKNDPVRVYDTSGPYTDPDFKLDVRHGLPKFREQWIKDRNDTELLDSVTSQFSQQRMADEGLDHIRFEHLPKIRRAVAGKNVTQMHYARQGIVTPEMEYVAIRENMGRAKLREEILAQQHAGESFGASIPEFITPEFVRDEIARGRAILPNNINHPESEPMIVGRNFLVKVNANIGNSSVTSSIEEEVEKLVWSTRWGADTVMDLSTGRYIHETREWVVRNSPVPIGTVPIYQALEKVNGVAEDLTWEIFRDTLIEQAEQGVDYFTIHAGVLLRYVPMTAKRVTGIVSRGGSIMAKWCLAHHKENFLYTHFEDICEIMKQYDVCFSLGDGLRPGSIADANDEAQFSELRTLGELTKKAWKHDVQVFIEGPGHVPMHMIKANMEEQLKHCDEAPFYTLGPLTTDIAPGYDHITSGIGAAQIAWYGCAMLCYVTPKEHLGLPNKEDVKEGLITYKIAAHAADLAKGHPGAQVRDNALSKARFEFRWHDQFNLGLDPDRAREYHDETLPQESGKVAHFCSMCGPKFCSMKISQEVRDYANDLEARGIDPNNAGDAITIKMVDVEAEMKAKSEEFKKSGSELYHPVG

SEQ ID NO: 36826 - protein, 270 aa, Glycine max
MAGSSINRGERWSLNGMTALVTGGTRGIGHSIVSDLAAFGAAVHTCSRTQTELNKCLQEWQSQGFQVTGSLCDVSSPPQREKLIQEVASTFNGKLNIYVNNVGINIRKPTIEYTAEEYSQIMTVNLDSSFHLCQLAYPLLKASEKGSIVFISSVAGVVSLGTGAVFAASKAAINQLTKNLACEWAKDNIRSNCVVPWATRTPLVEHLLRDQKFVDDIMSRTPIKRIAEPEEVSSLVTFLCLPAASYITGQVICVDGGLTVNGFQPSMRIT

SEQ ID NO: 36827 - protein, 453 aa, Coprinopsis cinerea okayama7#130
MHSFLGTGVFNSDGEMWKFHRGITRPFFSRDRISDFDIFDAHATDALERGKARLAEGHPIDFQDLVARFTLDSAAKFLFGAELGSLSASVPYPPNSGLPNPTSFTLHPSNTFVNAFFNGLNEVAMRSVIGEEWPLREFSKDLVKPYRDIVDQIIEPMVDAALQAAHSDTSEKEKSGRDEPTTLLQQLVSQTKDKGIIMDELLNLFVAGRDTTACTLTFSVYMLAEHPAVVERLRAEVLNKVGEKGRPSYDDIRDMKYLRAFINEVLRLYPPVPINNRQAINDTLFTTKDGAQPIFVPAKTQVIYSVVDMQRRKDLWGPDADEFDPDRFLDERLHRYLIPNPFIFSPFNAGPRICLGQQFAYNEVSFFLIRLLQQFSKFSLALDAQPADSLPPAAWKGKEGLQAKEKIWPGVNLTLFVKVGCILDTSRGKADASDTGWIMVYSEKNSEKSGEFT

SEQ ID NO: 36828 - protein, 430 aa, Desulfitobacterium hafniense Y51
MAIPKQVDPNQGTKKTFKWGARHTVLVFIWLGWFLSFLDRMVITLSLPFIGKEFNIDAAAQGLILSAFFAGYALFQIPGGMLADKLGFRRMLSVGIIWWSAFTTLTGAVFSYPLLLLVRFAFGLGEAVLPGSSYKTLTTYFPSKERGTAIGIQSTANSIGNIFASITAAAIIVVLGWRAVFLVLGIPGVILGIYYWVKFKDNPADHPQMTPEDLAELQADREEEQKQLLADNKSELSFKDIFKTPILWQMIAIWFLADIAIWGFSSWMPSYLMNVRGLSVMKTGIYGSLPFLFGAIGILLGGRAADRYRDKIKWLFVGAAALGGVFIYLLFVAPSTEMTIFYQCLANGLMCFSQGVFWTMVSDSFPASLMGSGSAAVNFGGQVAGLVVPAAMGFMIKASGGSYNAAFLLLVVSLVAAAVLALTIKKRPIA

SEQ ID NO: 36829 - protein, 555 aa, Mycobacterium tuberculosis CDC1551
MTTARPAKARNEGQWALGHREPLNANEELKKAGNPLDVRERIENIYAKQGFDSIDKTDLRGRFRWWGLYTQREQGYDGTWTGDDNIDKLEAKYFMMRVRCDGGALSAAALRTLGQISTEFARDTADISDRQNVQYHWIEVENVPEIWRRLDDVGLQTTEACGDCPRVVLGSPLAGESLDEVLDPTWAIEEIVRRYIGKPDFADLPRKYKTAISGLQDVAHEINDVAFIGVNHPEHGPGLDLWVGGGLSTNPMLAQRVGAWVPLGEVPEVWAAVTSVFRDYGYRRLRAKARLKFLIKDWGIAKFREVLETEYLKRPLIDGPAPEPVKHPIDHVGVQRLKNGLNAVGVAPIAGRVSGTILTAVADLMARAGSDRIRFTPYQKLVILDIPDALLDDLIAGLDALGLQSRPSHWRRNLMACSGIEFCKLSFAETRVRAQHLVPELERRLEDINSQLDVPITVNINGCPNSCARIQIADIGFKGQMIDDGHGGSVEGFQVHLGGHLGLDAGFGRKLRQHKVTSDELGDYIDRVVRNFVKHRSEGERFAQWVIRAEEDDLR

SEQ ID NO: 36830 - protein, 318 aa, Xylella fastidiosa
MYFKAVVLINFKSITVLSLSGIITALVTPFDRDGAFDRDAWIRLLDLQLAGGVQGVVIAGSTGEAATLTDAEYDEMLCSAVVRVGGRVPVLAGTGLSGTAKTISQTKRAADNGAGYALVVTPPYIRPNQGGLKAHYLAVADQGGLPVVLYNVPSRTGCDLLPETVADLAGHPNIVGIKEACASRERVQALLALRRPGFTVFSGDDSSAARSMLDGADGLVSVASNVLPSAYRHLCDLARAGERGAIDLWNARLSDFHAFCGLDSNPIPIKALLQRIGIGYGLRLPLLPLSVCHHDIADHLADQVAALEALSSRKIVAA

SEQ ID NO: 36831 - protein, 416 aa, Rhizopus oryzae
MSLSNKLSIRDLNLKDKRVLIRVDFNVPMKDGAITNNNRIVQALPTVKYALDNGASAVILMSHLGRPNGEAVAKYSLKPVAAEVEKLLGKPVEFLNDCVGTDVEKTCQSAKDGKVILLENLRFHIEEEGSAKVDGQKVKADAEAVKKFRASLTTLADIYINDAFGTAHRAHSSMVGVNLSQRAAGFLMQKELEYFAKALENPSRPFLAILGGAKVSDKIQLIENMLDKVNALIICGGMAFTFKKTLDNVKIGKSLFDEPGSKLVQNLVKKAAEKNVKIVFPVDFITADKFASDAITGYATDDDGIPDGWQGLDCGEQSNKLFREEILKSKTIVWNGPSGVFEFDAFSSGTKAVLDAVIDATKEGATTIIGGGDTATAALKWGAEGQVSHISTGGGASLELLEGKELPGVTALSSKN

SEQ ID NO: 36832 - protein, 416 aa, Rhizopus oryzae
MSLSNKLSIRDLDLKNKRVLIRVDFNVPMKDGAITNNNRIVQALPTVKYALDNGASAVILMSHLGRPNGEAVAKYSLKPVAAEVEKLLGQPVEFLNDCVGPDVEKACQSATGGKVILLENLRFHIEEEGSAKVEGQKVKADAEAVKKFRASLTALADIYVNDAFGTAHRAHSSMVGVDLPQRAAGFLMQKELEYFAKALENPARPFLAILGGAKVSDKIQLIENMLDKVNALIICGGMAFTFKKTLDNVKIGKSLFDEAGSKLVENLVKKAAEKNVKLVFPIDFVTADKFAPDAKTGYATDADGIPDEWEGLDCGEQSSKLFREEILKSKTIVWNGPSGVFEFDAFAKGTKSVLEAVIEATKEGATTIIGGGDTATAALNWDAADKVSHISTGGGASLELLEGKELPGVTALSSKN

SEQ ID NO: 36833 - protein, 300 aa, Aspergillus oryzae
MDLIFNYLDPLIIDSIYDSFRSSLQLRLCSTSHSLSFCSVITDSKLWCRESIYRQSLSIFIVTWFVHWLDLVESQLIELTERLSSSVFFLLLGTVCHYLYFDKALTRHPKYHKNQIRHEIYDSLLSLFGLNVLTVPIFVAQVRGYAKLYDFGSGKVPLWYEFGQFLFFVLFSDTCMYWLHRIFHINFLFNLMHKKHHRYIIPTPFSAYAFDPLEAYIMSLPIYAYSFLWPMSREAQLIVFVTTNIWTILLHDNRDQFHTVHHKNVKLNFGQFLTLWDQLGGTYADPEKYFAGRREGKVKT

SEQ ID NO: 36834 - protein, 414 aa, Campylobacter jejuni RM1221
MLVIEDVRAYEVLDSRGNPTVKAEVTLSDGSVGAAIVPSGASTGSKEALELRDNDERFGGKGVLKAVANVNETIADEILGLDAFNQTQLDDTLRELDGTNNYSNLGANATLGVSMATARAAAAALGMPLYRYLGGANASILPVPMCNIINGGAHANNNVDFQEFMIMPFGFTSFKEALRSVCEIYVILKKELANSGHSTALGDEGGFAPNLANNTEPIDLLMTCIKKAGYENRVKIALDVASTEFFKDGKYHMEGKAFSSEDLIERYVELCAKYPICSIEDGLAENDFEGWIKLTEKLGNKIQLVGDDLFVTNEDILREGIIKKMANAVLIKPNQIGTITQTMRTVRLAQRNNYKCVMSHRSGESEDAFIADFAVALNTGQIKTGALARGERTAKYNRLLEIELESDEYLGEKL

SEQ ID NO: 36835 - protein, 489 aa, Bordetella bronchiseptica RB50
MRIEHLIDGKAVAGKQYFETINPATQETLAEVAAGGEAEVHAAVAAAKAAFPKWAGLPAAERARLVRKLGDLIAAHVPEISRTETNDCGQTIAQTGKQLVPRAADNFYYFAEMCTRVDGHTYPTPTHLNYTLYHPVGVCALISPWNVPFMTATWKVAPCLAFGNTAVLKMSELSPLTAARLGELALEAGIPPGVLNLVHGYGRDAGEPLVAHPDVRAVSFTGSTATGNRIVQAAGLKKFSMELGGKSPFVIFDDADLDRALDAAIFMIFSNNGQRCTAGSRILVQQSIYADFTQKFVERARRIRVGDPLDEGTIVGPLISPAHLAKVRGYIELGSKEGATMLCGGLDRPSYAPELDARVRDGNFVWPTVFADVDNRMKIAQDEIFGPVACLIPFRDEAHAIELANDIEYGLSSYVWTESVGRAHRVAAAIEAGMCFVNSQNVRDLRQPFGGTKASGTGREGGTWSYEVFCEPKNVAVSLGNHHIPHWGA

SEQ ID NO: 36836 - protein, 289 aa, Desulfitobacterium hafniense DCB-2
MTRKLPTFLSENEHGLWMTEDERENLKIDYRIKEIIVEAKSTLQHVMILDSYSFGRMLVLDGAVQTTSLDGHIYNETISHVPLSIHPNPKKVLIIGGGDCGVAKEVCKYSSVEQIDVVEIDPMVVEVCLKHLPEVSGGLADPRVNFIFDDGVNYVQNSPTKYDIVIVDSSDPIGPAEVLIEKSFYRSIFNALEEDGLMVCQSQSPIFHGEVMEQIFERVHDIFPKTKMFTAVVPTYPGGLWSFTLGSKGYVIPNEARMKELDALYVNEQIMASCFSLPEFMNKQLSKYR

SEQ ID NO: 36837 - protein, 439 aa, Thiobacillus denitrificans ATCC 25259
MTISKDDQARLYRYYTEPTLVTELTRKTLALVLAGGEGSRLKDLTAWRAKPAVPIGGKYRIIDFPLSNCVNSGIRRIGVLTQYKSHSLIRHLQRAWGLMRTEVGEFVEILPAQQRTHKKEWYQGTADALFQNLDIMQRHHPEYVLVLGGDHVYTMDYTQMLLYHVQTGADVTVGSVEVPVAEAAAFGVMSVDESLRITEFNEKPREPDSMPGKPGTALVSMGIYVFSKDFLYKALIEDAGATRSSHDFGKDIIPSSISRARIMAFPFRDREGKPGYWRDVGALNCYWQTNMDLCSIEPALNLYDCEWPIWTYQPQYPPAKFIFDDEGRRGEAIDSLVAGGCVLSGARVKRSVLFFATTVGCSSLVKDSVILPKVRIGRNCRISCAIIDKGTVIPDGTVIGEDPVEDAKRFHVTPEGIVLVTPRMLGQNIYARWEDEYDG

SEQ ID NO: 36838 - protein, 499 aa, Arabidopsis thaliana
MATRLLRTNFIRRSYRLPAFSPVGPPTVTVSTAVVPEILSFGQQATEPPLQHPKPTEQSHDGLDLSDQARLFSSIPTSDLLRSTAVLHAAAIGPMVDLGTWVMSSKLMDASVTRGMVLGLVKSTFYDHFCAGEDADAAAERVRSVYEATGLKGMLVYGVEHADDAVSCDDNMQQFIRTIEAAKSLPTSHFSSVVVKITAICPISLLKRVSDLLRWEYKSPNFKLSWKLKSFPVFSESSPLYHTNSEPEPLTAEEERELEAAHGRIQEICRKCQESNVPLLIDAEDTILQPAIDYMAYSSAIMFNADKDRPIVYNTIQAYLRDAGERLHLAVQNAEKENVPMGFKLVRGAYMSSEASLADSLGCKSPVHDTIQDTHSCYNDCMTFLMEKASNGSGFGVVLATHNADSGRLASRKASDLGIDKQNGKIEFAQLYGMSDALSFGLKRAGFNVSKYMPFGPVATAIPYLLRRAYENRGMMPTGAHDRQLMRMELKRRLIAGIA

SEQ ID NO: 36839 - protein, 240 aa, Oryza sativa (japonica cultivar-group)
MLPYATAAEAEAALGRAMTAAESLWFRDVMRLFFLVIGPLQLVSYPTVKMVGIHTGLPLPSLGEMAAQLLVYFLVEDYLNYWIHRLLHGEWGYEKIHRVHHEFTAPIGFAAPYAHWAEVLILGIPSFVGPALAPGHMITFWLWIVLRQMEAIETHSGFDFPFNLTKYIPFYGGAEYHDYHHYVGRQSQSNFASVFTYCDYLYGTDKGYRYHKAYQAKMKALGQTEGEKADSNGLSYAKLD

SEQ ID NO: 36840 - protein, 159 aa, Brassica napus
  misc_feature (25)..(25): Xaa can be any naturally occurring amino acid
RKPLHKRGRKTSVAESSDYRKHESXSPIYHDGFLWRKYGQKQIKESNHQRSYYKFAYTKDQNCEAKKQVQMIQHNPPLYSTIYFGHHTCQLHQAYATFSMDTSDPQDSHMIRFDHPDSSLHQHQNQSQNQIIYLKDENMMMLPDKSEEWSSPSQWMSSE

SEQ ID NO: 36841 - protein, 411 aa, Pseudoalteromonas tunicata D2
MESLYTTNLPQFAYTAEQVQNNEKQVAEQLGFDLSEVMQKAGAAVFQYIEHHYGNHRRLLILLGKGNNAGDGYIVAYLAQQNGYQVTLVSFVDVKSLHGDALGAYLQCQQAGLAVCQSNDLLLQELSAFDLVVDAMFGTGFKGELPEHFGQVCTLVNQHDNLPVISIDVPSGVNATSAAVANNAIKANVTITFIALKQGLLTGRALEHVGKLVFAGLALDELFRDKIKSNVTRFELSQLKKALPNRALAAYKNQLGHVLCIGGNKGMAGAIRLSAEAALRSGAGLVSVATHPDNCAAVLQGRYELMVHGIDAEHQLLALINKASVVVIGPGLGQDVWAQNIWQWMMNAQCLRLVIDADGLNFLAKSDKCTTDNLTERVLTPHAGEAARLLGISNRDVEQDRFDSALQLSQR

SEQ ID NO: 36842 - protein, 540 aa, Rauvolfia serpentina
MATQSSAVIDSNDATRISRSDFPADFIMGTGSSAYQIEGGARDGGRGPSIWDTFTHRRPDMIRGGTNGDVAVDSYHLYKEDVNILKNLGLDAYRFSISWSRVLPGGRLSGGVNKEGINYYNNLIDGLLANGIKPFVTLFHWDVPQALEDEYGGFLSPRIVDDFCEYAELCFWEFGDRVKHWMTLNEPWTFSVHGYATGLYAPGRGRTSPEHVNHPTVQHRCSTVAPQCICSTGNPGTEPYWVTHHLLLAHAAAVELYKNKFQRGQEGQIGISHATQWMEPWDENSASDVEAAARALDFMLGWFMEPITSGDYPKSMKKFVGSRLPKFSPEQSKMLKGSYDFVGLNYYTASYVTNASTNSSGSNNFSYNTDIHVTYETDRNGVPIGPQSGSDWLLIYPEGIRKILVYTKKTYNVPLIYVTENGVDDVKNTNLTLSEARKDSMRLKYLQDHIFNVRQAMNDGVNVKGYFAWSLLDNFEWGEGYGVRFGIIHIDYNDNFARYPKDSAVWLMNSFHKNISKLPAVKRSIREDDEEQVSSKRLRK

SEQ ID NO: 36843 - protein, 99 aa, Pseudoalteromonas tunicata D2
MGRSTTINAISLLKGPGSLVSAKGCLNINQTGSAALASAGMGDVLSGIIAGLMAQQMTGFTATKLAAAIHGAAADNLLDEGARGLLASDLFPQIRRLIG

SEQ ID NO: 36844 - protein, 555 aa, Roseovarius nubinhibens ISM
MYSYNEFDAAFVAERNRQFRAQVERRIDGSLTEDEFKPLRLMNGLYLQLHAYMLRVAIPYGTLNSRQMRQLALLAEKWDKGYGHFTTRQNIQYNWPELRDVPDMLDALAEVEMHAIQTSGNTIRNVTADHFAGAAADEVTDPRPVAELLRQWSTDHPEFQFLPRKFKIAVTGSENDRAVIRAHDIGIQVVERDGQIGYRILVGGGLGRTPMIGKVLNDFVAQEDLLPYVEAVVSVWNLLGRRDNKYKARIKITVHEHGIDDIRARVDAAYARIRPSFGGLDLDLFEDIKSAFAAPAFSQKPTALFDTAYQTDPIFRAWADTNLAEHRAPGYAIVQISLKAHGETPGDATAEQMRVMADLAERFGHDELRISHEQNVILPHVHKSDLPEIHATLKKHGLATANIGLISDIIACPGMDYCALATARSIPVAQQIATRFDELKLEHEIGDLKIKISGCINACGHHHVGHIGILGLDRAGVENYQITLGGDGSENASLGERTGPGFAYDEIIPAIERLIAAYLQHRDNPEETFLAAYRRLGMAPFKAALYDEAQAYAAE

SEQ ID NO: 36845 - protein, 207 aa, Brassica oleracea
MAMLGGVRDLPANENSVEVESLARFAVDEHNKKENALLEFARVVKAKEQVVAGTMHHLTLEIIEAGKKKLYEAKVWVKPWLNFKELQEFKPASDDGAPSTTITPSDLGCKKVSDENASGWREVPGDDPEVQHVADHAVKTIQQRSNSLFPYELQEVVHANAEVTGEAAKYNMVLKLKRGEKEEKFKVEVHKNHEGVLHLNHMEQHHD

SEQ ID NO: 36846 - protein, 332 aa, Thiobacillus denitrificans ATCC 25259
MEWIAGDIGGTKSWLVWIGPPGDGLHPRFERVYPSADFVSAEALLRQFLADSGIQGRPDGLILAVAGPSQAEHVKLTNLDWWIDAAELQLALGIPQVHIVNDFEAAAAGLATLVPADYVEINPGQPDPLGVRAITGAGTGLGLAFLVHDPAGRETSYPTEGGHVDFAPANAMQDRLLKRLRKQYGHVSWERVVSGSAMSELYAFCCVELGTTPCSASCDGACLVAAAAADDIAAEAALDLFVDLYGAWVGNVALLYRPRGGLYIAGGVSAHLQKRIAAPRFMAAALDKGRMRRVVESTPIFLITSPRLGVQGALALREAAAHSRRDRRTHER

SEQ ID NO: 36847 - protein, 560 aa, Thiobacillus denitrificans ATCC 25259
MVSSVLVRTGDTRTSGLSTRPVHRLLQAHHSRMADVHMRELFDTDPQRFERFSLQVGDLLLDYSKNRITDETMDLLVRMAEESDVAGWRERMFRGDKINTTENRAVLHVALRNRSNRPVNVDGEDVMPKVNAVIERMGAFAEQVRGGVWRGYSGALITDVVNIGIGGSDLGPQMVVQALKPYRHPRLKLHFISNVDGAHVKETLEALDPETTLFIVSSKTFTTQETMTNAHYARDWFLARAGDVAHVARHFVAVSTNRDAVTAFGIDAANMFEFWDWVGGRYSLWSAIGLSIVLAVGAERFLELLEGAHEMDEHFRHAPLRQNMPVILALLGIWYNNFFGAESHAILPYDHYLRSLPAYLEQADMESNGKSVDRDGRVVDYPTGQIIWGATGINGQHAFYQLLHQGTKMIPADFIVSITPHTELQEHHDILIANFLAQTEALMRGRTREETLEEMGRSPGDPSVQHRVFEGNHPSNAILLKKLTPHTLGMLIALYEHKIFVEGVIWNLNSYDQWGVELGKQLAGRILPELHADAPVAGHDASTNALINHYRRMTQPHPGL

SEQ ID NO: 36848 - protein, 320 aa, Bordetella bronchiseptica RB50
MAYDPGIQAYVERARRALGDMAGLKALSLAQRRVRADRYAALVREPYPESLEVSDTYIVQPGHEIPVRVYRPRAEGPLPTIVYLHGGSFVAGSPQGHDFITTSLACNTGAQVLSVHYRRAPENPYPAPTDDAYAALCWAQREAELLGVDPERIAVAGDSAGGNLAAACALMARDRGGPALRMQALIYPTLDADLDTPSYLNNTADAFLTREAMAFAVNAFLPQGLDTRDGYALPLRAADHAGLPPAYLLLADHDPLLDDGTRYAARLREAGNAVQLRIGAGMIHGFLRARRLSATADAEFHLLCAALRQALGLPEPAARW

SEQ ID NO: 36849 - protein, 191 aa, Solanum torvum
SSVSRSNSDSWDIEDENAEQLIIEEDSHRGPCAGATTLGCAVPPPPVRQIAPIVPQQPAKVALSQTEKPAPIITPALSEDDEEIIQSVVQGKIPSYSLESKLGDCTRAASIRKEALQRITGKSLEGLPLEGFDYESILGQCCEMPVGYVQIPVGIAGPLLLDGREYSVPMATTEGCLVASTNRGCKAIFVS

SEQ ID NO: 36850 - protein, 324 aa, Pseudomonas syringae pv. phaseolicola 1448A
MNQSSDLIQSAQRTIRLEIEAIQGLLERLDGDFVRACEMILASKGRVVVVGMGKSGHIGNKIAATLASTGTTSFFVHPAEASHGDMGMITRDDIILALSNSGSTHEIVTLLPLIKRLGIKMISLTGDPESILAKAADINLNAHVVHEACPLNLAPTSSTTAALVMGDALAVALLDARGFTAEDFAFSHPGGALGRRLLLKVENVMHSGDALPSVQRGTLLRDALLEMTRKGLGMTAIVEADGTLAGIFTDGDLRRTLDRPVDIRQTIIDEVMTLHGKTAHAEMLAAEALKIMEDNKISALVVVDQYDRPVGAFNLQDLLRAGVM

SEQ ID NO: 36851 - protein, 249 aa, Prochlorococcus marinus str. MIT 9313
MVFNPAQRYKTAKHFIWIAIPRISLLSFAVIISPWSNPALAEKLVPITTSEGMVLLQRSKSVSDYGSLMEAFLTQSNLAYCGVASAVMVLNSLAIPAPPVDGFRNYHFWTQDNIFNSDSSQVVISPAKIRRQGMTLQELQNLLSHHGVSSKRLHGDILSLQAFRSLIKANLDDSSDRLIVNYDRKVIGQKGGGHFSPLAAYDAVTDKVLILDVARYRYPSVWVKTHDLWRAMRTLDGISGLQRGILAIE

SEQ ID NO: 36852 - protein, 159 aa, Striga asiatica
LNFQPGEAFMVRNIASMVPPFDRKKYSGVGAAIEYAVIHLKVENILVIGHSCCGGIKGLMSIPDDGTTQSDFIEEWVNICKLAKTKVKAECNNLDFSEQCTHLEKEAVNVSLGNLLTYPFVREAVVKKTLSLKGGHYDFVKGSFELWNLDFNLSPSMTV

SEQ ID NO: 36853 - protein, 149 aa, Zea mays
  misc_feature (27)..(27): Xaa can be any naturally occurring amino acid
  misc_feature (37)..(37): Xaa can be any naturally occurring amino acid
  misc_feature (45)..(45): Xaa can be any naturally occurring amino acid
MAAAAAMMVSGGRAALVVAGVALRGGXAMAAAQQASXNVRATYHXYNPAQNGWDLNRVSAYCATWDADKPLSWRQKHGWTAFCGPAGQKGQAACGKCIRVCVCATFTFPPAGLSQEIVGLLQVKNRATGASIVARIVDQCSNGGLDLDY

SEQ ID NO: 36854 - protein, 213 aa, Mycobacterium tuberculosis H37Rv
HHHHHHGPNTNPVAAWKALKEGNERFVAGRPQHPSQSVDHRAGLAAGQKPTAVIFGCADSRVAAEIIFDQGLGDMFVVRTAGHVIDSAVLGSIEYAVTVLNVPLIVVLGHDSCGAVNAALAAINDGTLPGGYVRDVVERVAPSVLLGRRDGLSRVDEFEQRHVHETVAILMARSSAISERIAGGSLAIVGVTYQLDDGRAVLRDHIGNIGEEV

SEQ ID NO: 36855 - protein, 576 aa, Oryza sativa (japonica cultivar-group)
MAAAAAAMATATSATAAPPLRIRDAARRTRRRGHVRCAVASGAAEAPAAPGARVSADCVVVGGGISGLCTAQALATKHGVGDVLVTEARARPGGNITTAERAGEGYLWEEGPNSFQPSDPVLTMAVDSGLKDDLVFGDPNAPRFVLWEGKLRPVPSKPGDLPFFDLMSIPGKLRAGLGALGVRAPPPVCVLSPLCILDSLVKFDCAERFRRRFQGREESVEDFVRRNLGAEVFERLIEPFCSGVYAGDPSKLSMKAAFGKVWRLEDTGGSIIGGTIKTIQERGKNPKPPRDPRLPTPKGQTVASFRKGLTMLPDAITSRLGSKVKLSWKLTSITKSDNKGYALVYETPEGVVSVQAKTVVMTIPSYVASDILRPLSISVVIEFGLVIYLSDAADALSIFYYPPVAAVTVSYPKEAIRKECLIDGELQGFGQLHPRSQGVETLGTIYSSSLFPNRAPAGRVLLLNYIGGSTNTGIVSKTESELVEAVDRDLRKMLINPKAVDPLVLGVRVWPQAIPQFLIGHLDHLEAAKSALGKGGYDGLFLGGNYVAGVALGRCVEGAYESASQISDYLTKYAYK

SEQ ID NO: 36856 - protein, 221 aa, Plantago major
MVRGKTQMRRIENATSRQVTFSKRRNGLLKKAFELSVLCDAEVALIIFSPRGKLYEFASSSLQDTIERYQSHIKELQAENPPLEQNTQQLQYETAGLLRKIEQLEAAKRKLLGEGIGACSLEELQQLETQLERSVTSIRTRKTQLYKQQIEQLKEKTKALAAENASICQKYGLQPQKGGGAKLSEERGNAASAEISEVSDVETDLFIGLPESRANKHSLQK

SEQ ID NO: 36857 - protein, 448 aa, Geobacillus stearothermophilus
MKAKTKKYIQVKTAIPGPKAKELLRKKEENVPRGPFHTVPTFAVKGEGALLTDVDGNTFIDLAGAIGSLNVGHCPPKVVEAIQKQAEQYIHPCFHVMMYEPYVELAETLNRITPGNHSKKTFFLNSGAEAVENAVKIARKYTGRRAILSFERGFHGRTLLAMSLTSKVKPYKFGFGPFAPDTYKLPYPYYYRKPAGMTNEELDAELLRRLEDFFLSDVPAEEVAAIIMEPVQGEGGFIVPSKTFVQGVKRICEKYGILFIADEIQTGFGRTGKMFAIEHFDVIPDLITMSKSIGAGVPISAVTGRAEVMDAPNPGEIGGTYGGSPLGCVAALEVIRMLQQEQLVERANVIGQIAIDRFRRLQEKYETVGDVRGLGAMVAVEFVTDAKTKTPNKELTAAILRECHQRGVIVMGAGLYSNVIRLLTPLVITDEQLEEALDVIEEVIAELA

SEQ ID NO: 36858 - protein, 450 aa, Coprinopsis cinerea okayama7#130
MVKPIEPEFEQALNELTNSLQPFLAANPEYTKALEIIQIPERVLQFRVVWEDDQGQPQVNNGFRVQYNSALGPYKGGLRLHPSVNLSILKFLGFEQTFKNALTGLNMGGGKGGSDFDPKGKSDSEIRRFCNAFMMELYRHIGKDTDVPAGDIGTGGREIGFLFGAYKKLRNEFVGMLTGKGLHWGGSFIRPEATGYGVIYYVEHMIARSCPEFSLNKPSTLVAVSGSGNVAQFTALKVIELGATVLSLSDSRGTLIAEEGYTKEFVQEIAKLKRGGGSLEELADTPGYTYHAGKRPWTLLPKVHIALPGATQNEVNKAEAEALVAAGVRIVAEGSNMGCTEEAVEVFEAARKAGKGVWYAPGKASNCGGVAVSGLEMAQNSQRLAWTTEEVDSRLKKIMSDCFSICYDAGAKWSGEDLQDGKILPSLLSGANVAGFIKVADAMREQGEWW

SEQ ID NO: 36859 - protein, 482 aa, Geobacillus stearothermophilus
MIYVNGKWSKGEGKKRPVINPANEEIIIEINEASQQQAVEAIQAARHAFQYTDWPFNPAKRIAALRQLADLLEQNAETFASIETLNTGKPIRESRLDVSDSIQCLRYYADFVEQRAIEEIKRTDGTTSKIIEEPIGVCALIVPWNFPLLLGIWKLAPALAAGNTVVFKPSELTPLSFIELTKLIDSIGLPPGVFNLVPGGGSPVGETLVTHPDVEKISFTGGTKTGRWIYEQGARRLKRVSLELGGKSPLLIFDDADLASTIEWALFASFFNQGEVCVAASRILVQRRVYDSFLDQLTQRLASLRIGDPFAEHTEMGPLISSSHLEKVETYIQIGLQEGGVLLQGGKRMKELGYYLTPAVFAHVRQDMRIVQEEIFGPVITVQPFEHDEEAIKLANDTIYGLAAGLFSRDLERAEQIAGKLRAGTIWINSYHTPYVDAPWGGLKQSGIGRELGPQGFAAFTETKHVNISQHGKPLGWYSSHS

SEQ ID NO: 36860 - protein, 389 aa, Arthrobacter sp.
MSIKKDYDVIVVGAGSMGMAAGYYLSKQGVKTLLVDSFHPPHTNGSHHGDTRIIRHAYGEGREYVPFALRAQELWYELEKETHHKIFTKTGVLVFGPKGEAPFVAETMEAAKEHSLDVDLLEGSEINKRWPGVTVPENYNAIFEKNSGVLFSENCIRAYRELAEANGAKVLTYTPVEDFEIAEDFVKIQTAYGSFTASKLIVSMGAWNSKLLSKLNIEIPLQPYRQVVGFFECDEKKYSNTHGYPAFMVEVPTGIYYGFPSFGGCGLKIGYHTYGQKIDPDTINREFGIYPEDEGNIRKFLETYMPGATGELKSGAVCMYTKTPDEHFVIDLHPQFSNVAIAAGFSGHGFKFSSVVGETLSQLAVTGKTEHDISIFSINRPALKQKETI

SEQ ID NO: 36861 - protein, 451 aa, Ralstonia solanacearum GMI1000
MPPAQSRPAADSVLPLSFSTGVAVRRPDGFLFMSESLIRQDGALMIEGVALEAIAARFGTPTYVYSRAALTANYRAYAAACEGRNARVQYAMKANSNLAVLQIFAQLGAGFDIVSGGELRRVLAAGGKAADVVFSGVGKTADEMRLALEAGVACFNVESIPELHRLNEVAGSLGKTAPVSLRVNPDVDAKTHPYISTGLKGNKFGVAFDEVLPTYRAAAAMPNLRVVGIDCHIGSQITEVSPYLDAIDKVLDVVARLDAEGIRLSHIDVGGGLGITYTDETPPDITAFARTLLDRIEQRGFGDRTVLFEPGRSLVGNAGLLLTRVEFLKPGAAKNFCIVDAAMNDLARPAMYEAYHHIVPVRERGGAPTVYDIVGPVCESGDWLGRDRALDAQPGDLLAILSAGAYGFTMSSNYNTRGRAAEVIVDGDRVHVARERERFEDLIRGEQLLSA

SEQ ID NO: 36862 - protein, 97 aa, Mycobacterium tuberculosis CDC1551
MVGIVSERDVVRQLHTYGASVLSRPVAKIMSTTVATCTKSDTVDKISVLMTENRVRHVPVLDGKKLIGIVSIGDVVKSRMGELEAEQQQLQSYITQG

SEQ ID NO: 36863 - protein, 107 aa, Vicia faba
KGMFSFLKDSAGVVDSPKLQAHAEQVFGMVRDSAIQIRQTGDVFLKDGSLGAIHIQKGVVDPHFVVVKEALLKTIKEASGDKWSEELSIAWEVAYDGLATAIKKAMS

SEQ ID NO: 36864 - protein, 83 aa, Vicia faba
QVFGMVRDSAIQLRTTGDIVLKDGTLGAIHIQKGVVDPHFVVVKEALLKTIKEASGDKWSEELSIAWEVAYDGLATAIKKAMS

SEQ ID NO: 36865 - protein, 391 aa, Pseudomonas syringae pv. phaseolicola 1448A
MQQRCEVAVLGLGAMGAATVYQLAKAGVDVIGVDRYAPPHTQGSSHGDTRITRLSVGEGPQYLPLVRSSHSIWRELEALSGESLFEQCGVLVMTSSPAYDPEDSNDFTHQTIALARTYGVTHEVLSAAAIRERFPQFTPVLDNAVGYFEPEGGFVRPERCIEVQLRLARQHGARLLTHETVTHLQAQGDQVRITTDKVSIIADKVVVSAGMWSAELLCAPFSDLLRVCRQKLFWFELQENAAFAPRSPSFILTHGPGEDDVNYGFPPLPGENSMKVATEQYIEASAADQLDRTVTAREEQEMFQTQVQGKIAGLTPNVVKSSVCAYTVTPDCHFIIDEHPHLKNVTVVSACSGHGFKHSAGLGLALAQRCIHGTSDVDLSAFSLARFTAQN

SEQ ID NO: 36866 - protein, 176 aa, Debaryomyces hansenii CBS767
MASQSMKKLAAANTEILKQIHLLAVIINLIVIMVLLVFNRPKSLIPYLLFSCPAFFCQFIIEQSARPVYDVDRMSGQRKLLKAGEDVKHEGLYEYMFDTMYITWIIDILMIVLGTNKVWWLYSIIPGFAIFKVVGLVKGLKGNKPETKPEEPEAPQKSKRQAKREANKNKVVRNVR

SEQ ID NO: 36867 - protein, 544 aa, Rhodospirillum rubrum ATCC 11170
MTVTVLEVPTTPFAGQKPGTSGLRKKVGVFRQPHYLENFVQAVFDSLDGFQGQTLVVGGDGRFHNREAVQTILKMAAANGFGRVLVGRDGLLSTPAASCVIRAHKAFGGIILSASHNPGGPEGDFGIKYNIGAGGPAPEKITDAIFAATASLSRYRTLENAPEVDLGRIGETDLGGMRVVVIDPVADYAALMETLFDMEAIRRLFRDGFTMCFDAMHAVTGPYAHAILEGRLGAPAGTVINGTPLEDFGGGHPDPNLTYAKDLADLMMGDRAPDFGAASDGDGDRNMILGRGVFVNPSDSLAVLAANAELIPGYRGRMTGVARSMPTSRAVDRVAAKRGWECHETPTGWKFFGTLLDAGRATLCGEESFGTGSDHVREKDGLWAVLAWLNIIAARAQTVRQILADHWGNYGRTFYSRHDHEGLDAAKAEALMADLRAAPLLGQTLGGRKVALHDDFAYTDPIDGSTSQGQGIRIEFEDGARIVVRLSGTGTEGATLRLYLERFEPDPAAHDQDAQVALADLIATIRDLTRLKDRFGSEDPTVIT

SEQ ID NO: 36868 - protein, 282 aa, Zea mays
  misc_feature (122)..(122): Xaa can be any naturally occurring amino acid
MTAVALALPTDDDKDGGRRGVDHSPTAPAPPPPPPPPQELVMVARAVQRLVARNDAVVPPAPDGRGGGRRLGMRAFEAAEGAAAPRIGVPEYLERVHRYAALDPECYVVAYAYVDMAAHRRXPAAAVASRNVHRLLLASLLVASKVLDDFNAFFARVGGVSNAEMNRLELELLDVLDFAVAVDHRVYRRYREHLEKETTLMMLRRDDSHGPPVPVPVPGSGAAPTKSRTAASSVVKPPLTEDRRRPAEAGDADGGGEHDDRRKLPNSATAAASLRELWAFDY

SEQ ID NO: 36869 - protein, 251 aa, Triticum aestivum
VERRATVLAQQWFRPEVVSHLPSAPPYVEEAESSSPRSSPEEDRNARDGHGCSIELVDDFSALDGEVGKRLNDMVPVPHVPKTNGDIPSFDEAFSDHRRLLDRLVLYGLVELKVNGDGNCQFRALSDQFYRTPEHHRFVRQQVVNQLESHPEIYAGYVPMDYREYLKKMPKIGEWGDHVTLQAAADLYGVKIFILTSFRDTCYIEILPVVQKSNRVICLSFWAEVHYNSIYPEGELPVVENRKKRWWHLEF

SEQ ID NO: 36870 - protein, 438 aa, Kluyveromyces lactis NRRL Y-1140
MGQILSNPVIDKEQHSGSDVLTAFGLCAMQGWRMSMEDSHIVDLNISDDEKEHLAYYCVFDGHGGSSVAQFCGSQFSKILQKQDAFKKKSYNEALIQSFIATDEELLKDPVLANDHSGCTATTLLISKLQNVMICANSGDSRTVLSRNHIAKALSYDHKPTLKSEYSRIVTADGFVEMDRVNGNLALSRAIGDFEFKSNPDLAPHEQIVTCVPDLIEHTIDYNSDEFVILACDGIWDCLTSQDCVDLVHYGLKQGLTLEEISSKIIDVCCSPTTEGTGIGCDNMSIIIVALLKEDEDETAWHKRIVAKNYTPPNSFENQRRAVFHFYDFPENDDHVFEVTNKRESDETDYNDDRKVGADRGASSLANLEAILGSGGIQITPGENNLSYIHGTALSEVLASLSGGIRSQIEEEDEDDEEDEADEPTHADEVEESEVKKD

SEQ ID NO: 36871 - protein, 510 aa, Camellia sinensis
MALDTVFLLRELSFATLVILITHIFMRSILSKPLRMLPPGPTGLPLIGAIPHLGSMPHVALAKMAKIYGPIVYLKMGTCGMVVASTPDSARAFLKTLDLNFSNRPPNAGATHLAYGAQDMVFADYGPRWKLLRKLSNLHMLGGKALENWAQVRSSELGHMLKAMYDLSCRGEPVVVAEMLCYAMANMIGQVILSRRVFETKGSESNEFKDMVVELMTTAGYFNIGDFIPSIAWMDLQGIERGMKRLHKKFDVLITKMIEEHKASAYQRKETPDFLDVFMAQQENPGEEKLNTTNIKALLLNLFTAGTDTSSSIIEWALAEMLKDPKILNRAHDEMDRVIGRNRRLQESDLPKLPYLQAICKETFRMHPSTPLNLPRVSAQACRVNGYYIPKNTRLSVNIWAIGRDPDVWERPLEFIPDRFLSGKNAKTDPRGNDFELIPFGAGRRICAGTRMGIVLVEYILGSLVHSFDWKLADDGVELNMDESFGLALQKAVPLSAMVSPRLPPNAYAA

SEQ ID NO: 36872 - protein, 176 aa, Brassica napus
DSGWRALEFLGLDDDKSSVEFDRLKVDLIITDYCMPGMTGYELLKKIKESTSFREVPVVIMSSENVLTRIDRCLEEGAEDFLLKPVKLADVKRLRTYLTGDVKVSDGNKPKVPEDLSRFSSLAMVTPPPPPPPSITSVKSSSLEEIVSSSPPPSESSVSPVGSPIRPMEMRSPGLD

SEQ ID NO: 36873 - protein, 289 aa, Brassica napus
MASERQKQGGVQPGKEHVMDPTPQFSSSDYQPSNKLRGKVALITGGDSGIGRAVSYCFALEGATVAFTYVKGQEEKDAQETLQMLKEAKTSEAKDPIAIPTDLGFDENCKRVVDEVVNAFGRIDVLINNAAEQYESNSIEEIDEPRLERVFRTNIFSYFFLTRHALKHMKEGSSIINTTSVNAYKGHASLLDYTATKGAIVAFTRGLALQLAEKGIRVNGVAPGPIWTPLIPASFNEEKIKNFGTEVPMKRAGQPIEVAPSYVFLACNHCSSYFTGQVLHPNGGAVVNA

SEQ ID NO: 36874 - protein, 368 aa, Oryza sativa (japonica cultivar-group)
MGVYLSTPKTEKLSEDGENDKLKFGLSSMQGWRATMEDAHSALLDIDNDTSFFGVFDGHGGRVVAKFCAKYLHREVLRSEAYSAGDLGNAAHKAFFRMDEMMRGQRGWRELQALGDKINQISGMIEGLIWSPRGSDSNDQHDDWAFEEGPHSDFAGPTCGSTACVAIVRNSQLVVANAGDSRCVISRNGQAYNLSRDHKPELEAERERILKAGGYIQMGRVNGTINLSRAIGDIEFKQNKFLSPDKQMLTANPDINTVELCDDDDFLVLACDGIWDCMSSQQLVDFIHEHINTESSLSAVCERVLDRCLAPSTLGGEGCDNMTMILVQFKKPISQNKNVSPAEQSAADKQPTGDTHWSEIHVTEESSS

SEQ ID NO: 36875 - protein, 66 aa, Arabidopsis thaliana
  misc_feature (27)..(27): Xaa can be any naturally occurring amino acid
MAFSMFFYTDVVTSPAQATMDAPFTGXKSSAYLPDTRKANNDITSITSNGCRGSCMKVWPPIGKKK

SEQ ID NO: 36876 - protein, 114 aa, Oryza sativa (japonica cultivar-group)
MDKGDVAVAVPPSIAGASSSGAKKGKRFEIKKWNAVSLWAWDIVVDNCAICRNHIMDLCIECQANQASATSEECTVAWGVCNHAFHFHCISRWLKTRQVCPLDNSEWEFQKYGH

SEQ ID NO: 36877 - protein, 528 aa, Medicago truncatula
MAAGRQSVLGKRDSYNYKHGSVKEFDYYKNDSGKEDREEGEILVDGDEILLPLEKRRKFSPVVWDLAEKKGKNSSKDGVTKLYVEEQSSEGDDVLSGSSKNSSCVDEESDMQGWNITKSKWACDDDLSPMADDGKYKLTKSKWASDEFSPIGDDDKYKQRRRSSSSEVGGSSDSTITRSDVDEDVSDDSPSDAYENSGMMHVERSFNMCQSCRSVSEFEMIKKINEGTYGVVYKAKDKKTGEIVALKKVKMDMEREGFPISALREMNILLSLDHPSIVDVKEVVVDDNDNNDGTYMVMEHMQYDLKQLLESKSQPFSMGEIKSFMKQLLEGVKYLHDNWILHRDLKTSNILLNKDGKLKICDFGMSRQYGSPLKQYTSLVVTLWYRAPELLLGAKKYSKAIDMWSLGCIMAELISKEPLFKGKTEVEQLDKIFRTLGTPDEKTWPGLSKLPGSKANFVKQRCSMLRMKFPAASFTGLPVLSESGFDLLNKLLAYDPDKRISAEAALRHDWFREGPLPRSDCNPVFSSW

SEQ ID NO: 36878 - protein, 579 aa, Ashbya gossypii ATCC 10895
MLGLYKYTKSYSRAILGSAGVVVKEQGSGNSAQAAEGALDDSDSQSSAMLETASLISCVTCLSDNMDSHSTDPLLLQSNTVIPYAKILNARLALEAPAEGGADDSFTEGARSVQDAEISSKPGSSSSRARAEGGMKSGGVLVDIVFAKPRRNDLVPKTVTLFVEYSSDDFYGGGEADVVEEILRRSYMNTKRNKSILVIINPYGGKGKAHKLYVTKAKPILVASDCQIDVVETKYSSHAAEIAATMDINKYDVIACASGDGIPHEVLNGLFTRPDRVAAFNKLAITQLPCGSGNAMSISCHGTSNPSYASLSLVKATEARVDLMCCTQPSYASSPRVSFLSQTYGVIAESDINTEFMRWIGPARFELGVTLNIFQRRKYPCQLYVKYAAKTKNELREHFTLHKARITQSFRSELMDSGSHLADLPSTDSDLIDDSCFHLKWSLDEPVPQDWEEIDTSLTDNLGIFYVGKMPYIAPDTKFFPAALHDDGAMDMVITDARTPLTRIAPILLSLDKGSHVLQPEVEHSKIEAYRLIPKLKSSIISVDGENFPFEPIQVEVLPRLAKTLLKNGCYVETEFEAL

SEQ ID NO: 36879 - protein, 417 aa, Acidobacteria bacterium Ellin345
MIETLGVLLAGGAGERLYPLTRDRAKPAVNFGGIYRIIDITLSNCINSGLRRVYILTQYKALSLNRHIREGWSGIVGNELGEFIEILPPMKRVSENWYMGTADAVYQNIYSIGSEQPRYVLILSGDHIYKMNYDLMMRQHKDSGADVTLATILIDPSETRHFGVVDVDNQSHVNGFVEKPKSTELRSPYDPSKVSASMGIYIFNTDVLIPVLLKDAEDPNSKHDFGHNILPKMVGEYKIYSFNFIDENKKEALYWRDVGTLDAYYDANLDLVSVAPVFNLYDKAWPIRTHQRQYPPAKFVFAEQGRMGTALDSVVSMGCIVSGGTVRNCVLSPDVRVNSFSEVDSSILFSHVNVGRHCRIRRSIIDRDVHIPEGTVIGYDTESDRQKYHVTDSGITVVTRDYSLFENPVEVDYFTSE

SEQ ID NO: 36880 - protein, 220 aa, Ashbya gossypii ATCC 10895
MNVNRTNKTLSKYKIVFLGEQGVGKTSLITRFMYDTFDDHYQATIGIDFLSKTVYLDDRTIRLQLWDTAGQERFRSLIPSYIRDSHVAIVVYDITNKKSFEYIDKWVEDVRNERGEENLILCIVGNKSDLVDERKVTVEEGENKAKLLNAKIFVETSTKAGFNVGALFKRIAKLLPEFQNGKGTSGLGNGDAEKDGAGTRQGVIDISVPVAKGGDSSCQC

SEQ ID NO: 36881 - protein, 1123 aa, Orobanche minor
MASSQPGRSSTNSAQSRQSARIIAQTSIDAKLDADFEESGSSFDYSTSVRVTNYPAGLSEPRSDKVTTAYLHQIQKGKLIQQFGCLLALDEKTFRVIAYSENAPEMLTMVSHAVPSVGDHPLLGIGSDIRTIFTAPSAAALQKALGFGEVSLLNPILVHCKTSGKPFYAIIHRVTGSLIIDFEPVKPHEVPMTAAGALQSYKLAAKAIACLQALPGGSIERLCDTMVQQVFELTGYDRVMIYKFHEDDHGEVFTEITKPGLEPYVGLHYPATDIPQAARFLFMKNKVRMICDCRANHVKVVQDDNLPFDLTLCGSTLRAPHGCHSQYMENMNSIASLVMSVVVNEGDEDGPDSSSGPYKRKRLWGLVVCHNTCPRFIPFPLRYACEFLVQVFSIHVNKELELENQMLEKNILRTQTLLCDLLLRDVPLGIVSQSPNVMDLVKCDGAILLHKRTKYRLGLTPTDFQIRDIVSWLDEYHQDSTGLSTDSLYDAGFPGALALGNALCGMAAVKITDEDWLFWFRSHTAAEIRWGGAKHELEAKDDGRKMHPRSSFRAFLEVVKTRSLPWKDYEMDGIHSLQLILRNAYKESEEKDLESREIHARLNELQIDGVKEIEAVTSEMVRLIETATVPIFSVGVDGLVNGWNTKISDLTGLSVVEAIGMHFLALVEDSSADTVSKMLGLALQGKEEHDVQFEIKTHGQRSESGPISLIVNACASKDVKENVVGVCFIAQDITTQKSMMDKFTRIEGDYRSIIQNPNPLIPPIFGTDEFGWCSEWNAAMIKLSGWGREAVIDKMLLGEVFGLNKACCRLKNQEAYVNLGVVLNNTVTGQESGKVSFGFFSRSGKYVACLLCVSKKVDSEGSVTGLFCFLQLASPELQQALHIQRISEQTASKRLRVLAYIRREIRSPLSGIIFSRKLMEGTDLNDEQKNIVRTSLHCQSQMNKILEDTDLDHIIEGYLDLEMVEFKLHEVLIASISQVISKSNGKGIKIVDNLAPNLSNETLYGDSLRLQQVLAAFLLIAVDSTPSGGQLGVAATLAKDSIGEFVQLGRLECRITHGGGVPQEILNQMFGDEPTDASEDGISLFISRKLVKLMKGDIQYLREAGRSTFIISVEIAISNKPNL

SEQ ID NO: 36882 - protein, 231 aa, Brassica napus
MSQPCVVLATASYDHTIRFWEAESGRCYRTIQYPDSHVNRLEITPDKRHLAAACNPHIRLFDVNSNSPQPVMTYDSHTNNVMAVGFQCDGKWMYSGSEDGTVKIWDLRAPGCQREYESVAAVNTVVLHPNQTELISGDQNGNIRVWDLRANSCSCELVPEVDTPVRSLTVMWDGTMVVAANNRGTCYVWRLLRGKQTMTEFEPLHKLQAHNGHILKCLLSPANKYLATASS

SEQ ID NO: 36883 - protein, 291 aa, Listeria innocua Clip11262
MTNKITERITGHTELIGLIATPIRHSLSPTMHNEAFAKLGLDYVYLAFEVGDKELKDVVQGFRAMNLRGWNVSMPNKTNIHKYLDKLSPAAELVGAVNTVVNDDGVLTGHITDGTGYMRALKEAGHDIIGKKMTICGAGGAATAICIQAALDGVKEISIFNRKDDFYANAEKTVEKINTKTNCKAQLFDMEDHEQLRKEIAESVIFTNATGVGMKPFEGETLLPSADMLRPELIVSDVVYKPTKTRLLEIAEEQGCQTLNGLGMMLWQGAKAFEIWTHKEMPVDYIKEILF

SEQ ID NO: 36884 - protein, 339 aa, Medicago truncatula
MGGAKIKIGINGFGRIGRLVARVALKRDDVELVAVNDPFITTDYMTYMFKYDSVHGQWKNDELTVKDSKTLLFGEKPVTVFAHRNPEEIPWASTGADIIVESTGVFTDKDKAAAHLKGGAKKVIISAPSKDAPMFVVGVNEKEYKPEFDIISNASCTTNCLAPLAKVINDRFGIVEGLMTTVHSITATQKTVDGPSAKDWRGGRAASFNIIPSSTGAAKAVGKVLPALNGKLTGMAFRVPTVDVSVVDLTVRLEKPATYDQIKAAIKEESEGNLKGILGYTEDDVVSTDFIGDTRSSIFDAKAGIALNDNFVKLVSWYDNELGYSTRVVDLIVHIAKQL

SEQ ID NO: 36885 - protein, 694 aa, Desulfotalea psychrophila LSv54
  misc_feature (134)..(134): Xaa can be any naturally occurring amino acid
MQKTLTTCPYCGSGCTFFLEVENNTITGVSPNRVRAVNNGSLCSKGHFGTDFVHSKDRLTKPLIRKKGVLTPVSWQEAYSYTAQRLLQISEEHGAQAIAGFSSARCTNEENYLFQKMMRAALGTNSVDHCARLXHAPTVAGLTTTLGSGAMTNSIAELDTMGAGDTIFAIGTNTTECHPIIGLGMLRAVKRGARLIVADPRATTLTQHAEVWLRLQPGSDVALLNALGHLILRDGLEDRVYIDAHTENFSAYRSFVEKISLAEAESITAVALADMEKAARILGESANVATYYTMGITQHTSGVDNVMAVSNVAILTGNIGRAKTGVNPLRGQNNVQGACDMGALPDVFPGYQKVSRPEIVEKFSRAWGVELSARPGITIPSVLSGIERDEVKALYVFGENPLRSDPDINHVKHCLEQVEFLVVQDIFLTETAALADVVFPGTTFAEKDGTFSSTERRVQRVRRAVDPIGESRPDWQIISELMVALGYPSSYTHPREIFAEMRSLTPTYAGITYERLENESLQWPCPHENHPGTPVLHVGGAIRGLARFEPAQHRQPAEVPDTDYPLKLTTGRVVAHYHTGTMTRRCWGLNGVAPHELVEIHPHDALCLGIIDGDLVRVASRRGAVEARAQVTTRVIQGLVFMTFHYTESSGNMLTNSAADPITQTPELKICAVSVQKVERKAVSPHNRRKRQMV

SEQ ID NO: 36886 - protein, 252 aa, Listeria innocua Clip11262
MNKVVVKNVTFGEGAPKICVPMVGKTVAALKEEAEMLKTIDLDVVEWRVDFFEDVKDLVKVKAALDEIRAILPETPILFTFRSAKEGGELAVSDEFYFELNETLAGTGKIDLVDVELFNEEADVLRLIETAHKNNVKVVMSNHDFDKTPAKEEIVSRLTRMEALGADLPKIAVMPKSAGDVLTLLDATNTVSEKANQPIITMSMAGTGVISRLAGEVFGSAMTFGAAKKASAPGQIDVNELRHVLDLLHKQF

SEQ ID NO: 36887 - protein, 487 aa, Brassica napus
SILIFSLSAFGWGQPTSIGAPHRTPRERDIPPRPLERATLKNFKSFDSIFLNSLSSFLKRERERRKKEAEDCRKGSMEGSGTWQGLTLVSIVTWICLSSYLRLTQKVRSLVQPWVARQVVGGVPLILQIQKHQSGVLDAFFSGLSCVVSVPFYTAFLPLLFWSGHGRLARQMTLLIAFCDYLGNCIKDIVSAPRPSCPPVRRITATKDEEDNAMEYGLPSSHTLNTVCLSGYLLHYVLSSFEHEESSIQYYGFAFACLLVALIAFGRIYLGMHSVVDIIAGLAIGVLTLGLWLTVNENIDDFITSKQNVSSFWTALSFLLLFAYPTPENPTPSYEYHTAFTGVALGIVTGVQQTYSQFHHEGAPRIFSPELPVTAYIGRVMVGIPTILLVKFCSKSLAKWILPTVSNTLGIPIRSTTYIPKLKLDKGYANGKNTDETKNSVGYSQKMCEFLNQDSFDIDTGIRFLQYAGLPWSVVDLVPSMFSYLNL

SEQ ID NO: 36888 - protein, 113 aa, Triticum aestivum
  misc_feature (34)..(34): Xaa can be any naturally occurring amino acid
  misc_feature (40)..(40): Xaa can be any naturally occurring amino acid
  misc_feature (70)..(70): Xaa can be any naturally occurring amino acid
CLVAAAVCAAAGRGPPRAQQAYQRSVATYHYYRXAQNNWXLCAPAVSAYCATWDASNPLTRRTKNRWTSXCGPAGAHGQAACGKCLRVTNPATEAQTTATIVDQRANAATGHV

SEQ ID NO: 36889 - protein, 129 aa, Pseudomonas fluorescens Pf-5
MSITRYGTGSTAGGGQPRPFARAVEADGWLHVSGQVPALDGEIIHGGIVEQTHQTLRNLVAILEEAGYGLEDVVRVGVWLEDPRDFWSFNKVFGEYFKPEHAPARACVQASMMVDCKVEIDCVAYKKKA

SEQ ID NO: 36890 - protein, 371 aa, Malus x domestica
MGKGGMSDGDHADRCCGEAINGDVQQENMAAWLLGVKNLKIQPYKLPNLGPHDVRVRLKAVGICGSDVHHFKNMRCVDFIVKEPMVIGHECAGIIEEVGSEVEDLVPGDRVALEPGISCKRCNLCKQGRYNLCRKMKFFGSPPNNGCLANQVVHPGDLCFKLPDNVSLEEGAMCEPLSVGIHACRRANVCQETNVLVVGAGPIGLVTLLAARAFGAPRIVIADVNHERLLIAKSLGADAVVKVSTNIEDVAEEVAKIQKVLENGVDVTFDCAGFNKTITTALSATRPGGKVCLVGMGQREMTLPLATREIDVIGIFRYQNTWPLCLEFLRSGKIDVKPLITHRFGFSQKEVEEAFETSARGGNAIKVMFNL

SEQ ID NO: 36891 - protein, 249 aa, Fragaria x ananassa
MVKIGFGSFGDSFSVCSLKSYLAEFIATLLFVFAGVGSAIAYDKLTTDAALDPAGLVAVAVAHAFALFVGVSVAANISGGHLNPAVTFGLAVGGNITILTGIFYWIAQLLGSTVACFLLNFVTSESVPTHGLASGVGAIEGIVFEIIITFGLVYTVYATAADPKKGSLGTIAPIAIGFIVGANILAAGPFSGGSMNPARSFGPAVVSGNFADNWIYWVGPLVGGGLAGLVYGDIFIGSYSSVPVSEDYA

SEQ ID NO: 36892 - protein, 368 aa, Malus x domestica
MGKGGQSCNGVVRDAKPVEQENMAVWLVDVNTIKILPFKLPAIGPNDVRIRIKAVGICGSDIHYLKTMKCGDFQVKDPMVIGHECAGIVDKVGSKVKHLVPGDRVAVEPGISCAHCQQCKGGRYNLCFDMKFFATPPVHGSLANQIVHPADLCFKLPENVSLEEGAMCEPLSVGVHPFRRANVGPETTVLIVGAGPIGLVSVLAARAFGAPRIVIVDMDDRRLAMAKSLGPDGTVKVSTKMEDLDDELAKIKEAMGSEVDVTFDCVGFNKTMSTGLNATRPGGKVCLVGMGHGVTTVPLTPAAAREVDVVGVFAYKNTWPLCLEFLRSGKIDVKPLITHRFGFTEKEVEEAFATSARGGNAIKVMFTL

SEQ ID NO: 36893 - protein, 368 aa, Malus x domestica
MGKGGQSCNGMVRDVKPVEKENMAAWLVDVNTIKILPFKLPTIGPNDVQIRIKAVGICGSDVHYLKTMKCADFEVKEPMVIGHQCAGIVDKVGSEVKHLVPGDRVAVEPGISCAHCQQCKGGRYNLCPDMKFFATPPVHGALANQIVDPADLCFKLPENVSLEEGAMCEPLSVGVHACRRANVGPETTVLIVGAGPIGLVSVLAARAFGAPRIVIVDMDSKRLAVAKSLGADGTVKVSRKMEDLDDEVAKIKETMGAEVDVTFDCVGFNKTMSTGLNATRPGGKVCLVGMGHSMMTVPLTAAAAREVDVVGVFRCKNTWPLCLEFLRSGKIDVKPLITHRFGFTEKEVEEAFATSARGGDAIKVMFNL

SEQ ID NO: 36894 - protein, 149 aa, Desulfitobacterium hafniense DCB-2
MKVQDIMQTNVITISPNTEIREIAKLLCDHHISGVPVIDLFGNLIGIVSEGDLLHKETHPRVPEAVGFLGALIYYRGVKQYESDLKKLVALKASEIMTHEVITLEKDAAIEEAASLMINHNVKRLPIMENGKMVGIITRKDVIKVLIEE

SEQ ID NO: 36895 - protein, 172 aa, Ashbya gossypii ATCC 10895
MSQFVRTVHSRVGREKQRYSALTGARLVAGCVALNEDKTKVIMIQSLAQGSNGNKWVLPKGGVELDEPDFRDSARRETWEEAGVVGEIVRYLGVIEDMRPPKNWSAGGAVHPPRSEFHFYEMRVQELADEYPEKHKRQRHWFTYSEAKTQLQLAKRPELLEALDRSAIVKYL

SEQ ID NO: 36896 - protein, 348 aa, Plantago major
NAAHNMILTHATAFQSYITKVQTNQCGGAPRLCTKGDAGTEPYLAAHNMILAHANAVHSYKTKFQLNQGGKIGITNVSHFFEPLNDTDDDRNAVIRALDWMFGWFTAPVTTGDYPPNMRKTVGNRLPKFSPNERRLVMGSYDFIGVNYYTTWYATLSPKEPGQPDTYLTDRGVTTSYEKDGVPIGEPTGAAWLYIVPRGLYNLLVYAKETYKINLIYITENGCADLLNHDLTVSQAKEDPVRVRYYLEHLWYLLKAIRLGGVNVKRYFLWSLGDNFEWADGYTYRFGTFYIDFVNGQLTRTPKTSAIWWRNFFTKTPPINGPEKRDAAAESEIDSRKRTRSNSNKACG

SEQ ID NO: 36897 - protein, 87 aa, Brassica napus
  misc_feature (54)..(54): Xaa can be any naturally occurring amino acid
  misc_feature (84)..(84): Xaa can be any naturally occurring amino acid
MGDIWTWLISFFFLIALVGIIVYQLVCLADLEFDYINPYDSASRINSVVLPEFXVQGVLCVFYLITGHWFMAILCLPYLYYNFXLYS

SEQ ID NO: 36898 - protein, 200 aa, Listeria innocua Clip11262
MDKQAILDNIHQTWQEEANAISRLPEVTSEEALVKTVETIAECTGKIVVAGCGTSGVAAKKLVHSFNCIERPAVFLTPSDAVHGTLGVLQKEDILILISKGGNTGELLNLIPACKTKGSTLIGVTENPESVIANEADIFFPVSVKKEPDPFNMLATASTMAVIASFDAIIVCLMTYMNYTKEQFSVIHPGGAVGNKLLNK

SEQ ID NO: 36899 - protein, 270 aa, Triticum aestivum
  misc_feature (181)..(181): Xaa can be any naturally occurring amino acid
  misc_feature (212)..(212): Xaa can be any naturally occurring amino acid
  misc_feature (229)..(229): Xaa can be any naturally occurring amino acid
  misc_feature (251)..(251): Xaa can be any naturally occurring amino acid
  misc_feature (261)..(261): Xaa can be any naturally occurring amino acid
PSRKLAICTVWSAADNWCYASVAPRARSSTIVASLGTPAPSKSSSFRPKLIRNTPVQAAPVAPALMDAAVERLKTGFEKFKTEVYDKKPDFFEPLKAGQAPKYMVFACADSRVCPSVTLGLEPGEAFTIRNIANMVPSYCKNKYAGVGSAIEYAVCALKVEVIVVIGHSRCGGIKALLSLXKDGADDSFHFVEDWVRIRLPGKKKVQTECAXMPFDDQCTGRQKEQLTXSLQKLLTYPLFKDGVSNGTPQXLLGAHHDFVXSGKFEKLGA

SEQ ID NO: 36900 - protein, 367 aa, Geobacillus stearothermophilus
MELFKYMETYDYEQVLFCQDKESGLKAIIAIHDTTLGPALGGTRMWMYNSEEEALEDALRLARGMTYKNAAAGLNLGGGKTVIIGDPRKDKNEAMFRAFGRFIQGLNGRYITAEDVGTTVADMDIIYQETDYVTGISPEFGSSGNPSPATAYGVYRGMKAAAKEAFGSDSLEGKVVAVQGVGNVAYHLCRHLHEEGAKLIVTDINKEAVARAVEEFGAKAVDPNDIYGVECDIFAPCALGGIINDQTIPQLKAKVIAGSANNQLKEPRHGDIIHEMGIVYAPDYVINAGGVINVADELYGYNRERAMKKIEQIYDNIEKVFAIAKRDNIPTYVAADRMAEERIETMRKARSQFLQNGHHILSRRRAR

SEQ ID NO: 36901 - protein, 286 aa, Silene vulgaris
VNRIRELPQGSNIVATHTDSPDVYIWDLESQPNRPVNLGTPASRPDLTLTGHQDNAEFALAMCSSEPLVLSGGKDKSVVLWSIHDHISTLATEPGSAKSPNSGSNIKKAGNGNSDNPSIGPRGIYLGHDDTVEDVQFCPSSAQQFCSVGDDSCLILWDARAGLTPVTKVEKAHNADLHCVDWNPHDENLIITGSADNSINLFDRRNLTASGVGSPVHKFQGHDAPVLCVQWSPHNRSVFGSAAEDGLLNIWDYEKVSKMETESGGKKSNHPPGLFFRHAGHRDKVV

SEQ ID NO: 36902 - protein, 431 aa, Vibrio vulnificus
MTKSAELYQKAQQTIPGGVNSPVRAFNGVGGSPIFVERADGAFIFDADGKAYIDYVGSWGPMILGHNHAVIREAVIEAAQRGLSFGAPTEMEIKMAELVSELVPSMEQLRMVSSGTEATMSAIRLARGFTGRDKILKFEGCYHGHADSLLVKAGSGALTLGQPSSPGVPADFAKHTLTATFNDLDSVRELFAANKGEIACIIVEPVAGNMNCIPPVEGFHEGLREICDQEGALLIFDEVMTGFRVALGGAQAHYNIKPDLTTLGKVIGGGMPVGAFGGRKEVMQYIAPTGPVYQAGTLSGNPVAMAAGYACLTLLREEGNEKRLASKTKHLADGFKSLAAQHGIPLVVNQVGGMFGFFFTEQEQITCYEDVTKCDIERFKRFFHLMIDHGVYLAPSAFEASFTSLAHGSKEIEATLEAADRCFAILAAESK

SEQ ID NO: 36903 - protein, 569 aa, Glycine max
MCGILAVLGCVDNSQTKRARIIELSRRLRHRGPDWSGIHCYEDCYLAHQRLAIVDPTSGDQPLYNEDKTVIVTVNGEIYNHKQLRQKLSSHQFRTGSDCEVIAHLYEEHGEEFVNMLDGMFAFILLDTRDKSFIAARDAIGITPLYLGWGHDGSTWFASEMKALSDDCERFISFPPGHIYSSKQGGLRRWYNPPWFSEDIPSTPYDPTLLRETFERAVVKRMMTDVPFGVLLSGGLDSSLVAAVVNRYLAESESARQWGSQLHTFCIGLKGSPDLKAAKEVADYLGTRHHELYFTVQEGIDALEEVIYHIETYDVTTIRASTAMFLMSRKIKALGVKMVLSGEGSDEIFGGYLYFHKAPNKKEFHEETCRKIKALHLYDCLRANKSTAAWGVEARVPFLDKEFINVAMSIDPEWKMIRPDLGRIEKWVLRNAFDDDKNPYLPKHILYRQKEQFSDGVGYSWIDGLKDHANKQVTDATMMAANFIYPENTPTTKEGYLYRTIFEKFFPKNAAKATVPGGPSVACSTAKAVEWDAAWSKNLDPSGRAALGIHDAAYDAVDTKIDEPKNGTL

SEQ ID NO: 36904 - protein, 359 aa, Aspergillus oryzae
MASQKPTYRIASIPGDGIGIEVVDAAIQVVEKLAKTLGTFNIDFTHIPWGTAYYKEHGRYVSEDCLDTLRKFDAGLFGAVGAPDVPDHISLWGLLLALRGPLQLYANVRPVRTFPGTKCPLNTATEGIDWMLVRENSEGEYSGQGGRSHVGQPWEAATEVAMFTRVGIERIMRFAFEVAQSRPRKLLTVVTKSNSMRNGMVLWDQVAAEVAKDFPDVTWDKMLVDAMTVRMVAKPQSIDTIVGTNLHMDILSDLAAALAGSIGVAPSSNLDPTRKNPSIFEPVHGSAFDITGKGVANPVATFWSAAEMLSWLGEKEAAKQLMDCVEKVCAAGILTPDLGGTSNTQGVVDAVKKEIERLV

SEQ ID NO: 36905 - protein, 299 aa, Zea mays
VDEDGELLLRHTLSGHQKSVMMVAWSPDDCQLLTCGQEETIRRWDVKSGKCLHVYEKSATGLISCAWFPDGKQLSGLADQNFCIWDLDGKEVDCWKGQGSTGTSDFAVAKDGNLIISYLEHPNRKLFDRETKHERIIEEGSTITSFSLSEDGDFLLVNLVSEEIHLWNIRNDPVRVNRYNGHKHSRFVIRSCFGGSEQAFIASGSEDSQVYIWHRATGDLIETLAGHSGTVNCVSWNPVNPHMLASASDDHTVRIWGAKVSLKRKDVGSSNCNSNGFHHSNGNAHGNGFAHQCNGNSTK

SEQ ID NO: 36906 - protein, 307 aa, Lactobacillus reuteri
VPSGASTGEHEAVELRDGDKNRFGGKGVLKAVSNVNNIIAKEIVGMEVTDQIAIDKAMIKLDGTPNKGKLGANAILAVSLAAARAAADELQVPLYNYLGGFNAHVLPTPMMNVINGGAHSDNKVDFQEFMIMPVGAPTVREAIRWGSETFHALKKELEAAGKVTSVGDEGGFAPDFANNEEPFEYLIKAIEDAGYKPGKDIAIAFDVAASELWNDEDKKYKLRWSTGEEYTTEEWINYLSGIIEKYPVVSVEDPIDENNWDDWVTITDKLGKKVQLVGDDFFVTNTDYLKKGIQMGAANSILIKLTK

SEQ ID NO: 36907 - protein, 351 aa, Francisella tularensis subsp. holarctica
MKALAKLKKQPGIWMINDAPIPEYGYNDVLIKIKKTAICGTDLHIYNWDKWSQNTIPVPMITGHEFAGEVVAKGDGVTSVDIGDRVSGEGHLVCGQCRNCRAGKRHLCRKTIGIGVNVQGAFAEYLVMPAVNVFKIPDSISDDIASTFDPMGNAIHTALSFNLTGEDVLITGAGPIGLMAVKIARFCGARRIVITDINEYRLQMARDFGATVALNVAPFKNQDELVKQMRKVMSDIGMTEGFDVGLEMSGINSAISMMLDVMNHGGKLSLLGISAGDISVDWGAILFKGLTLKGIYGREMFETWYLMTSMLQAGMDMNPIITHRLHIDEFQKGFEIMKSGQCGKVILDWSS

SEQ ID NO: 36908 - protein, 262 aa, Triticum aestivum
  misc_feature (235)..(235): Xaa can be any naturally occurring amino acid
LLEQVCTKKHSPTGPEFPGYRRPTRPVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVPASAIPDGWMGLDIGPDSVKTFNDALDTTQTIIWNGPMGVFEFDKFAVGTESIAKKLAELSKKGVTTXIIGGGDSLAAVEKVGVADVMNHFSPGG

SEQ ID NO: 36909 - protein, 303 aa, Shewanella sp. ANA-3
MSHILVIGSANADHVMNFEYLPVPGQTLMSRAYRLEHGGKGANQAVACARLCQGDAEVAFICHLGQDSVGNDMRTSWLKDGIKAEGITQVANMSTGTALIFVGDNGENSIGIAAGANADLTPSELEKHYALFANAQFLLIQLETPMETVHHALQTAKRLGITTVLNPAPATSQELDYLKWVDIITPNETEAEALTGIEVNNEEDAELAAQWLHQQGVATVVITLGSKGAFISSAGFTGLIPALTVQAIDTVAAGDTFNGALVVGLSEGMSIAAAVGFANAASAITVTREGAQRAIPYRHEVQR

SEQ ID NO: 36910 - protein, 522 aa, Debaryomyces hansenii CBS767
MSTNSTSEIVDNLSGSFGDTSFFIKTANDLYMNMSWLQLIITTIVLGLSYDQIMYQIRKGSIVGPRLKVWPIIGPFLESLDPKFEEYKAKWDSGPLSCVSIFHKFVVIASSRDLARKILGSPKYVKPCVVDVAIKILRPTNWVFLDGKAHSDYRKSLNGLFSQKALELYIPVQEKYMDLYLEKFVTLDGPTEFFPQFRELLCALSLRTFCGDYITEEQISLITDNYFRITAALELVNFPIIIPYTKTWYGKKIADETMKIFESCAGMSKKHINEDNGKPGCVMDEWIYLMKDAREKHSDDPESKLLIREFSNREISEVIFTFLFASQDASSSLACWLFQVVADRPDIVAKIREEQLRVRDQDPSKPLNLELINEMTYTNNVVKESLRYRPPVLMVPYVVKQSFPVTDTYTAPKGSMIIPTLYPALHDPEVYEDPDSFIPERWENATGDMNKRNWLVFGTGPHICLGKTYVLMLFTSMLGKFVMNSDIIHYPTPLSEEIKVFATIFPKDDLILEWKRRNPLQV

SEQ ID NO: 36911 - protein, 315 aa, Arabidopsis thaliana
MGTALKLPIIDLSSPEKLSTSRLIRQACLDHGFFYLTNHGVSEELMEGVLIESKKLFSLPLDEKMVMARHGFRGYSPLYDEKLESSSTSIGDSKEMFTFGSSEGVLGQLYPNKWPLEELLPLWRPTMECYYKNVMDVGKKLFGLVALALNLEENYFEQVGAFNDQAAVVRLLRYSGESNSSGEETCGASAHSDFGMITLLATDGVAGLQVCRDKDKEPKVWEDVAGIKGTFVVNIGDLMERWTNGLFRSTLHRVVSVGKERFSVAVFVDPDPNCVVECLESCCSETSPPKFPPVRARDYFHERFSQTLASYSGSD

SEQ ID NO: 36912 - protein, 349 aa, Arabidopsis thaliana
MTSIYHDDDDHLTASGKDLWSNFCVLVDAAVMLYEEEEEEQRRKIVSEEEEEFQKRIFCLFPRKTRSSLVKRQQNLIRVSTSSSLIDLNQFPTDSEIEDPQNHLQGLSSSCFIAANSETKTLQNPSSEPCSSLGLFGHKTAEYQKTETKDPPNPNFPCTMSLCLMENTSRKRRAVEQRKRSGGVKKANVAPFSQTARETPEWLVKVMTNMKEAKDAKLIFEKTLFVTDVNPTKNRLSMPFNNLLRNDFLTSVESIIINEDINNNNKIGVGAILVDQRCKKWGVMLKRWEMKKESGKGSWSYNLICGWNDIVEANRLKEGDNITLWSFRCCGILCFAMEQSSSSLALCLC

SEQ ID NO: 36913 - protein, 308 aa, Frankia sp. EAN1pec
MQNTIDLTGRLAVVTGASSGLGLGLATRLAAAGAKVLLPVRDEAKGEAALSHIRAEAPGADVSLRELDLASLKSVEALGDTLNAEGRPIHILINNAGLMTPATRHTTADGLELQFGTNHIGHFALTGWLLPLLNAGHARVTTMTSSAARHAKLNWEDLQSDQAYAPIRAYNQSKLANLLFALELDRRSRAGGWGIVSNAAHPGTTLTGLYAAGPNLGREKSSPIEAAMKRLARWGVLVQGVDRGLLPALYAATSPDAEGGHFYGPDGFGQFTGGPAELEIYRPARDEDAATRLWDVSQRLAGVEFAAV

SEQ ID NO: 36914 - protein, 389 aa, Zea mays
MSMLLIQKQPLPLSVRPRTTLRQCRLPTTRFSAAAADSASRAAPFAVEDYLVAACHLTPAQALKASKVLSHLKSPSRPDAVLAFLSGLGLSDADIAAAVAYDPKLLCSEVERTLAPRLAELRDLGLSPSQIARLALVDPARFRRPTVVSKLQYYVPLFGSFENLLQALRNNAYLLSSDLERVVKPNVAFLVECGLDACDIAKLSIPVPRLITTNPERVRAMVERAEAVGVPRGTGMFRHALLAVAFLSEEKIKAKAEFLKTTFRWSDAEVGVAVSKLPLVLKHSKDRLRRMSEFLITKVGLEPEYIAHRPALLTYSLERRLMPRHYVVNYLKENGLLEQDRSYYTAVQMSESAFMDKFICPYKEAAPSLALDYAAACRGEVPTTFLANV

SEQ ID NO: 36915 - protein, 140 aa, Synechococcus sp. RS9916
MTESHEESLFEQAMARYQDGAAASDVLDDFIAITNAAPRQSAGWTCLAWLQLLCDQPEEALRSARFAVKLNGQDPQARINLSVAMLETQAKGVRDHIQVVQQILAVAPEVTQELQASIADGLARKPGWPALTKVKSWLEI

SEQ ID NO: 36916 - protein, 299 aa, Frankia sp. EAN1pec
MRTILIVGGGYAGFYTAWKLEKKLRRGEARVIVVDPRPYMTYQPFLPEVLAGSVEARHAAVSLRRHLRRAEIVAGRVTRVDHAHKTVTVRPAVGAEYPLEYDIIVVTAGAVTRTLAIPGVTEHAIGKKHVEEAVAIRDRMLTAFDDAAIPDLAAERPGVSTVPNAQHAVRQGKLLARNLIATLRGREPRPYVHHSLGVVATLGLGLGIFQFHRLVIKGFPAWLMHRGYHALAVPTWERKVRVLAVWATAVPFGRDIVSLTSVQHPREAFLAGANPRMPEPAETADARVDIVTAGDAPRS

SEQ ID NO: 36917 - protein, 348 aa, Listeria innocua Clip11262
MKALKLYGKRDLRYEDADMPTIEQPDDVILKVKTVGICGSDISRYSKLGPYVPGMVWGHEFSGEVIEVGSAVTDIEIGDRAAGCPALYCGECEYCKKGEFARCRKLTVIGARHPGAYAEYIKLPAENVVKIPDELDYEAAALVEPSAVVVHGFYHTKLQAGDDVVVVGSGNIGLLAIQWAKVFGARRVIAIDVDDKKLALAKEVGADVVINSLKEDPLEVVAAHTDGLNADLVVEAAGSPITSAQVFAYAKKGGGVVFLGIPYADVTIERFYFEKIVRSELTVWGSWNAISAPFPGKEWQTTIHFLANKQINIEPMITHRLSLAEGPEVFERIYERNEFFGKVLFFPE

SEQ ID NO: 36918 - protein, 108 aa, Ashbya gossypii ATCC 10895
MSDLVNRPRSELTQDELAQLEEFEFKHGPMSLIQEAMTARTPVIISLRNNHKIIARVKSFDRHCNMVLENVKEIWSEREGKKISNKERFISKLFLRGDSVIVVLKAPL

SEQ ID NO: 36919 - protein, 393 aa, Acorus calamus
MTVPATRQDLMIVNMGPHHPSMHGVLRLIVTLDGEDVIDCEPILGYLHRGMEKIAENRTIIQYLPYVTRWDYLATMFTEAITVNGPEQLGNIQIPKRASYIRVIMLELSRIASHLLWLGPFMADIGAQTPFFYIFRERELIYDLFEAATGMRMMHNYFRIGGVAADLPYGWIDKCLDFCDYFLTGIVEYEKLITQNPIFLERVERVGIISGEEAINWGLSGPMLRASGIEWDLRKVDNYECYNEFDWEVQWQKEGDSLARYLVRISEMKESIKIIQQALEGIPGGPYENLEVRRFDKVKDSEWNDFEYRFISKKPSPTFELAKQELYVRVEAPKGELGIFLIGDNSVFPWRWKIRPPGFINLQILPQLVKRMKLADIMTILGSIDIIMGEVDR

SEQ ID NO: 36920 - protein, 362 aa, Schizosaccharomyces pombe 972h-
DPPLTVSSTQRISRPPSLQKSITMVGVEPLYQSNGNEKSSKYNVFSESAHGNHQVLSFSPGSSPSFIEQPSPISPTSTTSEDTNTLEEDTDDQSIKWIRGALIGSGSFGQVYLGMNASSGELMAVKQVILDSVSESKDRHAKLLDALAGEIALLQELSHEHIVQYLGSNLNSDHLNIFLEYVPGGSVAGLLTMYGSFEETLVKNFIKQTLKGLEYLHSRGIVHRDIKGANILVDNKGKIKISDFGISKKLELNSTSTKTGGARPSFQGSSFWMAPEVVKQTMHTEKTDIWSLGCLVIEMLTSKHPYPNCDQMQAIFRIGENILPEFPSNISSSAIDFLEKTFAIDCNLRPTASELLSHPFVS

SEQ ID NO: 36921 - protein, 286 aa, Lychnis flos-jovis
VNRIRELPQNSNIVATHTDSPDVYIWDLESQPNRPVNLGTPASRPDLTLTGHQDNAEFALAMCSSEPLVLSGGKDKSVVLWSIHDHISTLATEPGSAKSTNNGSNIKKAGNGNSDNPSIGPRGIYLGHEDTVEDVQFCPSSAQQFCSVGDDSCLILWDARAGLTPVTKVEKAHNADLHCVDWNPHDENLILTGSADNSINLFDRRNLTASGVGSPVHKFQGHDAPVLCVQWSPHNRSFFGSAAEDGLLNIWDYEKVNKMETESGGKKSNHPAGLFFRHAGHRDKVV

SEQ ID NO: 36922 - protein, 199 aa, Schizosaccharomyces pombe 972h-
MSMELDQSLDAIIASKPKGGIRKRRARSNKPKPTKNAKPAVNTASALKSVISEESKIIVSNLPTDVTEAQVKELFVKSIGPCKRVSLAYGPNGRSKGIATIIFSRPGDATRAYEQYEGRLVDGTRKMKVEIILDPSRQLNSLAARVSPASNASATASKNGAKSSKRKTTRRRRTPNRPKKSAEELDKEMDDYFGSNEKE

SEQ ID NO: 36923 - protein, 319 aa, Herpetosiphon aurantiacus
MDYGFATRAIHAGQDPESVTGAVIVPIYQTSTYAQRGVGDHTGYEYSRTDNPTRTALQTCLAALEEAKHALVFASGLGASTTLMLMLKAGDHVICGDDVYGGTYRLFQRVMTEHGLSFDFIDMADPEAVRAAIKPNTRLIWLETPTNPLLKLAPIAAITRVAREHGIWTIVDNTFASPYNQRPITLGADMVLHSTTKYIGGHSDVVGGAIMTSNDELYEKLKFLQNAAGAVPGPFDCWLVLRGVKTLSIRMRDDERNALAIAQFLTEHPGVEKVIYPGLPSHPQHNLAREQMRGFGGMISILLKGGAEAANAMVSKTKL

SEQ ID NO: 36924 - protein, 102 aa, Striga asiatica
CKRHVDAAAASATKADDKPSPDDDLKNFDADFVKVDQATLFDLILAANYLNIKSLLDLTCQTVADTIKGKTPEEIRKTFNIRNDFTPEEEEEVRRENQWAFE

SEQ ID NO: 36925 - protein, 447 aa, Sinorhizobium meliloti 1021
MTHLLHRAIHAKLPVAVRGEGIRLFDAEGRAYIDASGGAAVSCLGHAHPDVLAALHAQLDRIAYAHTGFFTTEAAERLADRLVADAPDGLDHVYLVSGGSEAVEAALKMARQYFVEKGEPQRRHIIARRQSYHGNTLGALAAGGNEWRRAQFRPLLVETHHIDPCFAYRLQQAGESDTDYAARAAGQLEAKILELGADQVIAFVAETVVGATAGAVPPVADYLKRVRAICDKYGVLLILDEVMCGMGRTGTLHACEQDGVVPDLMTIAKGLGGGYQPVGAVLLSSAIFQAFSEGSGFFQHGHTYMGHPMAAAAGLAVQEVIRRDGLLENVVSMGDYLERCLVERLGNHHHVGDIRGRGLFRAVELVADRATKSPFDPGLKLNARIKKEAMARGLMVYPMGGTIDGQRGDHVLLAPPFILNREDVGQIVERLGDAVDAAIASLTKAAG

SEQ ID NO: 36926 - protein, 404 aa, Mycobacterium leprae TN
MREVPQVLGIVLAGGEGKRLYPLTADRAKPAVPFGGAYRLVDFVLSNLVNARYLRICVLTQYKSHSLDRHISQNWRLSGLAGEYITPVPAQQRFGPHWYTGSADAIYQSLNLIYDEDPDYLVVFGADHVYRMDPEQMLRFHIGSGAGATVAGIRVPRSDATAFGCIDADDSGRIRRFTEKPLKPPGTPDDPDKTFVSMGNYIFTTKVLVDAIRADADDDHSYHDMGGDILPRLVDGGMAAVYDFSQNEVPGATDWDRAYWRDVGTLDAFYDAHMDLVSLRPVFNLYNKRWPIRGESENLAPAKFVNGGSVQESVVGAGSIISAASVRNSVLSSNVVVDNGAIVEGSVIMPGARVGRGAVIRHAILDKNVVVGPGEMVGVDPERDREHFAISAGGVVVVGKGVWI

SEQ ID NO: 36927 - protein, 456 aa, Francisella tularensis subsp. holarctica
MSSQIKQVFARQILDSRGNPTVEVDVVLESGAFGRAAVPSGASTGIREALELRDGNKALFIGKSVYKAVENVNTKIAQAVKGLDALDQRLIDKTMIELDGSENKKNLGANAILGVSLATARAAASHLRKPFYRYLMDVKEYLMPVPMMNVINGGSHADNNVDMQEFMIVPAGFDTFSEALRCGTEVFHTLKKVLIADGYSVAGVGDEGGYAPDLPSNEAAIEAILKAVKEAGYEPGKHVFIALDPASSEFYKDGKYELKSENKSLTTEEMIDYYAAWVEKYPIVSIEDGLAEEDWAGWKLLTEKLGNKVQLVGDDLFVTNPSILAKGIEKGIANSILIKLNQIGTLTETFEAMAMAGQAGYTCVVSHRSGETSDTIIADLAVATCSGQIKTGSLSRSDRIAKYNQLLRIEEELGENAIYPGIKAFVFNSDEEVEEVVQEIIVEDSEAEKVVVQVEE

SEQ ID NO: 36928 - protein, 162 aa, Oryza sativa
FCFFFNLSLWCLELRLCVSLLSTVSRLATIVRSWPWVISVPLWCRVIVCPVEFFLFVPYVLTHMTLGYIRDDLGKFLPIYLSQGILQHDPFEVLDQRGVGELVKLATERGRKARPNLKVGICGEHGGEPLSVAFFAKAGLDYVSCSPFRVPIARLAAAQVLL

SEQ ID NO: 36929 - protein, 315 aa, Zea mays
  misc_feature (42)..(42): Xaa can be any naturally occurring amino acid
HPVGIELYLCPSHGNPVEILSRHLPKEHKESLAVAGSSFISXVVWRRPDIPRVPTSRHRHDGSKRQSILGKPPVTNPAAARPSLPLNSYGAPPGFPNQRHQEEEDVADDAPPGFGPGVARDEDEGAEFNFVNPTHHAANVTARAYMGRPHVPPPSARPAEQMRELVQKYGKRSSVQAPRTWDDDDDDIPEWNPSQATHQTIKQPPPLPHAPQQQPLPPPPVQQMDAYQQQYHITSAVQPQVPVASLTHAYLQIQQTGQAWQQPSNPWWPAQGVAAAAAQMTNIVHHQPQYGVVPGSSGVQGYDYSSASGMAWRPR

SEQ ID NO: 36930 - protein, 302 aa, Pseudomonas syringae pv. phaseolicola 1448A
MQDLLNEILDEVRPLLGQGKVADYIPALGGVRPDQLGIAVYGNDGQVFSAGDAETQFSIQSISKVFSLVQAIGHSGEDIWQRLGHEPSGQPFNSLVQLEFERGRPRNPFINAGALVICDINQARFAAPSLSMRDFVRRLCGNRAITSDSKVAESEYQHRSRNAAAAYLMKSFDNFHGDVEDVLRSYFHHCALSMNCIDLAKAFGFLANQGFCTHSGEQILTARQATQVNSIMATSGLYDEAGNFAYRVGLPGKSGVGGGIVAIVPERASVCVWSPELNAAGNSLVGMAALEKLSARIDWSVF

SEQ ID NO: 36931 - protein, 222 aa, Arabidopsis thaliana
MILSKRPHLMIRKLSEMLVPRSRSAAIKPEEYTASPRSPLDLNFPSPVHSKRFGSGGVGLGIVAALEETSNGINRHDPVRYSGRFRCPEIDLSDEEYTYVTSPNGPTKVYYNDDGFELSENDYRRVHKPMVIVDEPPVIERQSVRGPTEFLSSCCLCKKKLQGKDIYMYKGEMGFCSAECRSVQIMNDERQEQCKTQVSRNADVLSSPYAAGQRLSAGVFVF

SEQ ID NO: 36932 - protein, 313 aa, Oryza sativa (japonica cultivar-group)
MSALYLARGASKVVRRITSETSVELKILTEKWQLLLAGLVFQYIHGLAARGVHYLHRPGPTLQDLGFMILPELGKERGYISETLFTFIFLSFVLWTFHPFILQTKRFYTVLIWRRVLAFLCASQFLRIVTFYSTQLPGPNYHCREGSALARLPHPQNVAEVLLINFPRGVIYGCGDLIFSSHMIFTIVFVVTYQKYGNIRFIKMLAWCIAIAQSLLIIASRKHYSVDVVVAWYTVNLVVFFVDKKLTELPDRSAGSTSVLPVSIKEKDSKLKEDKTRMLNGNSVDSADWRPWTQMNGKHIENGNHLDTETTKT

SEQ ID NO: 36933 - protein, 434 aa, Oryza sativa
  misc_feature (384)..(384): Xaa can be any naturally occurring amino acid
MTMVRIIGPSPAQSSSPTPRRPRPPRPRRRPPTMASAAASSSKPPVVLGCGAVSADYLATVASFPNPDDKIRSLTLKVQGGGNTGNALTAAARLGLRPRIISKVSNDPQGRNILKELQDDGVDTSHILVAEEGNSPFTYIIVDNQTKTRTCIHTPGYPPMVPEELTQENLFAALDGADIVYFDVRLHETALLVAEEASQRKLPILIDAERKRDGLDELLNFASYVVCSAKFPQAWTGASSTPVALVSMLLRLPNIKFIIVTLGEKGCLMLERSTTDASEAEEIDVESLLESLEKKEVLSSSMPKCIASKSNLRISADGIGSISGRLLLGTAEIIPSEELIDTTGAGDAFIGAVLYGLCSGMPPEKMLPFAAQVAACGCRGLGGXLPDCSVPHRHRSPTVVALLDCEGPARYPCWCWEIPWNGWNFNWIVGAFEK

SEQ ID NO: 36934 - protein, 291 aa, Oryza sativa (japonica cultivar-group)
MAASSSSSMASSQPRMMEQSLFYTQPPARAVHTRKVTAVNLHREMSLIRSLMPTFPFVAVDTQFPGVVHPHPRGAGVTADDRYAAVRANADELCLLQLGITLSAADGRLPVDGALVEFMWDFDFAGFDARYHRHAPESVQFLRAQGFDFEAARLAGVPALAFAAELAASGILGLRGVTWVAFGGMYDVAFLLRLATGGAPLPATRLGFLAQVGAVFGTQVFDAKHMASLLHMHGGLAAVGGMLRLPPQLPRRHMAGQNSVMAIQLFMELRRRFNDLGGSLHSCSLKIEGLT

SEQ ID NO: 36935 - protein, 304 aa, Shewanella sp. ANA-3
MSQLYLEDGIKQLASEFIAAGCPSVREQSLEERRQGYIASTVLAGEPEAVFEVKTLSLEGIELTLFKPSVDNNLPVVIYYHGGCFVSGGIATHNQQLRKIANDSGALVVAVSYRLAPEHVYPAAHDDAFNAANLVQQHCQQWGGDDTNITLMGDSAGGHLALVTCLRLKAQGQWLPKKQVLIYPMLDATAKSQSYIDNGDKYIITRDTLLTGFDMYLDWHPRTDVEASPLRSHDLAGLPETHIITAEFDPLLDEGEQLFRNLLDAGVNAHCRRYLGVIHGFFQLAGVSQSARDAMVQITHIIRV

SEQ ID NO: 36936 - protein, 68 aa, Triticum aestivum
LSRAISHYGANRIMWGSDFPYVVPECGYKGAREAISLVAGKIPVSLSDLDWILGKTVSQLFQGAWVTP

SEQ ID NO: 36937 - protein, 661 aa, Debaryomyces hansenii CBS767
MNSLTRGGNSIKRLFGDAYSILRKYSRFIGPGLMVSVAYMDPGNYSTAVAAGSAFKYKLLFLILLSNCLAVFLQILSAKLGAVTGLDLAANCKANLSFRVNIFIYCLAELAIIATDLAEVVGTAISLNILFDLPLLAGVIVTVVDVLIVLMAYKPNGPLIFVRIFESFVSVLVGATVVCFAIELYQVSHEEGINFSTWEVIKGFMPNEKVVDMSDRDGGNGLYLSLAILGATVMPHSLYLGSGLVQARLKDYDIKHGHYKPLTDEPSNSEESADPEHNDEFERNEHPDQCTTNPFEKDEDEDENDHYRPSIHSINDTMTYTIVELVISLFTVALFVNSAILIVAGATLNNNKHKRDDDHDGNDTDDSDDEDDYQNADLFTIYNLLSTHLSPTAGFVFALALLCSGQSAGVVCTLAGQMVLEGFLLWSLPPITRRLITRGLAIIPCLVVVTLAGREGLSNVLNMSQVVLAILLPVVSAPLIWFTCSKEIMKVPIFVRDGDEEVDIMLDDDMDSSISRTITTSSAATLTNGKVKRFKSTEPAIRLQDLRNSHPCAGWDDDEAEASEEQQRLINHNNDSDSEITTSLGANEFQYGQHRRNISAGSDTYANTIIESEEDTYRVKGYKDMSNGPVTAFTAVLVWGFITCLNIYLLGSLILGYDVPL

SEQ ID NO: 36938 - protein, 246 aa, Hordeum vulgare subsp. vulgare
MGRGRVELKRIENKINRQVTFAKRRNGLLKKAYELSVLCDAEVALIVFSNRGKLYEFCSTQSMTKTLDKYQKCSYAGPETTVQNRENEQLKNSRNEYLKLKTRVDNLQRTQRNLLGEDLDSLGIKELESLEKQLDSSLKHIRTTRTQHMVDQLTELQRREQMFSEANKCLRIKLEESNQVHGQQLWEHNNNVLSYERQPEVQPQMHGGNGFFHPLDAAGEPTLHIGYPPESLNSSCMTTFMPPWLP

SEQ ID NO: 36939 - protein, 1105 aa, Arabidopsis thaliana
MDQNSYRRRSSPIRTTTGGSKSVNFSELLQMKYLSSGTMKLTRTFTTCLIVFSVLVAFSMIFHQHPSDSNRIMGFAEARVLDAGVFPNVTNINSDKLLGGLLASGFDEDSCLSRYQSVHYRKPSPYKPSSYLISKLRNYEKLHKRCGPGTESYKKALKQLDQEHIDGDGECKYVVWISFSGLGNRILSLASVFLYALLTDRVLLVDRGKDMDDLFCEPFLGMSWLLPLDFPMTDQFDGLNQESSRCYGYMVKNQVIDTEGTLSHLYLHLVHDYGDHDKMFFCEGDQTFIGKVPWLIVKTDNYFVPSLWLIPGFDDELNKLFPQKATVFHHLGRYLFHPTNQVWGLVTRYYEAYLSHADEKIGIQVRVFDEDPGPFQHVMDQISSCTQKEKLLPEVDTLVERSRHVNTPKHKAVLVTSLNAGYAENLKSMYWEYPTSTGEIIGVHQPSQEGYQQTEKKMHNGKALAEMYLLSLTDNLVTSAWSTFGYVAQGLGGLKPWILYRPENRTTPDPSCGRAMSMEPCFHSPPFYDCKAKTGIDTGTLVPHVRHSIDQQPEDQSGVQEKSCRFLGAMRITEILALFMVLVPVSLVIVAMFGYDQGNGFVQASRFITMEPNVTSSSDDSSLVQRDQEQKDMSLLGGLLVSGFKKESCLSRYQSYLYRKASPYKPSLHLLSKLRAYEELHKRCGPGTRQYTNAERLLKQKQTGEMESQGCKYVVWMSFSGLGNRIISIASVFLYAMLTDRVLLVEGGEQFADLFCEPFLDTTWLLPKDFTLASQFSGFGQNSAHCHGDMLKRKLINESSVSSLSHLYLHLAHDYNEHDKMFFCEEDQNLLKNVPWLIMRTNNFFAPSLFLISSFEEELGMMFPEKGTVFHHLGRYLFHPSNQVWGLITRYYQAYLAKADERIGLQIRVFDEKSGVSPRVTKQIISCVQNENLLPRLSKGEEQYKQPSEEELKLKSVLVTSLTTGYFEILKTMYWENPTVTRDVIGIHQPSHEGHQQTEKLMHNRKAWAEMYLLSLTDKLVISAWSTFGYVAQGLGGLRAWILYKQENQTNPNPPCGRAMSPDPCFHAPPYYDCKAKKGTDTGNVVPHVRHCEDISWGLKLVDNF

SEQ ID NO: 36940 - protein, 166 aa, Striga asiatica
  misc_feature (99)..(99): Xaa can be any naturally occurring amino acid
VCVKSIKLFCSTTKMVNYWKSKVLPKIKKAFENPKKAAAAEACKAFDEAKEQYSKELDEKKTELQPKVVEIYEASSTEIKALVKEPKGSSVKKHSAAVXKFLDELAKIEFPGSKPVCEAATKVGPAYVVGPVSFVLEKVSTFVVVKEEEEEKKVEPPKTEPAAEEA

SEQ ID NO: 36941 - protein, 335 aa, Campylobacter jejuni subsp. jejuni NCTC 11168
MKNLILAIESSCDDSSIAIIDKNTLECKFHKKISQELDHSIYGGVVPELAARLHSEALPKMLKQCKEHFKNLCAIAVTNEPGLSVSLLSGISMAKTLASALNLPLIPINHLKGHIYSLFLEEKISLDMGILLVSGGHTMVLYLKDDASLELLASTNDDSFGESFDKVAKMMNLGYPGGVIIENLAKNAKLKNISFNTPLKHSKELAFSFSGLKNAVRLEILKHENLNEDTKAEIAYAFENTACDHIMDKLEKIFNLYKFKNFGVVGGASANLNLRSRLQNLCQKYNANLKLAPLKFCSDNALMIARAAVDAYEKKEFVSVEEDILSPKNKNFSRI

SEQ ID NO: 36942 - protein, 203 aa, Striga asiatica
SCWRCNLCKEGRYNLCPEMKFFATPPVHGSLANQIVHPADLCCKLPENVSLEEGAMCEPLSVGVHACRRANVGPETNVLVMGAGPIGLVTMLSARAFGSPRIVIVDVDDHRLSVAKELGADETVKVSTNINDVSTEVERIKEAMGGLVDITFDCAGFNKTMTTALGATSSGGKVCLVGLGHTEMTLPPAPAAVREVDVVGIVQ

SEQ ID NO: 36943 - protein, 236 aa, Juglans nigra
QQVDGENPNLYFRSEDVILCVLPLFHIYSLNSVFLCGLRAGAAILLMQKFEIVSLLQLIQKYKVSIMPVVPPIVLAISKSPDLDKYDLSSIKMLKSGGAPLGKEIEETVKAKFPNAKFGQGYGMTEAGPVLSMCLAFAKEPFEVKSGACGTVVRNAEMKIIDPETGSSLPRNQPGEICIRGDQIMKGYINDPEATDRTIDREGWLHTGDVGFIDDDDELFIVDRLKELIKYKGFQV

SEQ ID NO: 36944 - protein, 606 aa, Oryza sativa
IAAHHKTQRRRTHPPGLSSLGIFSSTPETTPKPNQISRRMAAAAVAANGGGDGAQASNAPAPTRLASVYSEVQTSRLKHALPLPSVLRSPFALADGPASSAAGNPGEIAKLFPNLFGQPSVSLVPSPEPASTRPLKVGVVLSGGQAPGGHNVICGIFDYLQEYAKGSVMYGFKGGPAGVMKCKYVELTADYVYPYRNQGGFDMICSGRDKIETPEQFKQAEDTVNKLDLDGLVVIGGDDSNTNACLLAEYFRGKNMKTRVIGCPKTIDGDLKCKEVPTSFGFDTACKIYSEMIGNVMTDARSTGKYYHFVRLMGRAASHITLECALQTHPNVALIGEEVAAKKETLKSVTDYITDIVCKRAELGYNYGVILIPEGLIDFIPEVQKLIAELNEILAHDVVDEAGAWKSKLQPESRQLFDFLPKTIQEQLLLERDPHGNVQVAKIETEKMLIAMVETELEKRKAEGKYPAHFRGQSHFFGYEGRCGLPTIFDSNYCYALGYGSGALLQCGKTGLITSVGNLAAPVEEWTVGGTALTSLMDVERRHGKYKPVIKKAMVELDGAPFKKFASLRDEWSLKNHYISPGPIQFSGPGSNDANHTLMLELGAEA

SEQ ID NO: 36945 - protein, 465 aa, Schizosaccharomyces pombe
MAPISKVFDYLVIGGGSGGLASARRAAKHGAKVALIEASGRLGGTCVNYGCVPKKIMWNIADLVAKMKTAKQNGFPNSQLGSFDWGMIKRKRDAYIGRLNGIYERNVNKDGVAYISGHASFVSPTEVAVDMNDGSGTQVFSAKYILIAVGGHPIWPSHIPGAEYGIDSDGFFELESQPKRVAIVVGAGYIAVELAGVFAALGTETHMFIRQSKFLRKFDPIISDGIMDHFQHIGINVHTNSLEFKKVEKLPSGELCIHQQDGSTFNVDTLLWAIGRAPKIQGLRLEKAGVKTLPNGIIIADTYQRTNVPTVLSLGDVCGKLELTPVAIAAGRRLSDRLFGGIKDAHLDYEEVPSVVFAHPEAGTIGLTEQEAIDKYGESQIKVYNTKFNGLNYSMVEQEDKVPTTYKLVCAGPLQKVVGPTFSWRFSAEILQGFGVAIKMGATKSDFDSCVAIHPTSAEELVTLV

SEQ ID NO: 36946 - protein, 328 aa, Arabidopsis thaliana
MGNSVVRMDCEYEYDSDYSYPDNYMSDYSAYEEESEPEFDYGDDSPFEGIPASFCRRWLQMVRRFRCLTAYPKGYNFIGYLSLYLEVADNGSLPFGWRRHARYTLTLVNQNSKKSFQPNEVQEWFDDSIKWGCPSMFPLNEIHAKDSGFLVNGELKIVAEIDILEVIGDVDVSEGISTVKETIHVNGFQLLPSQAKSVSHIFERHPEIASEIHPKNSSLRTGYMSLLLSLIETLSQSPQELSKDDLCDVYIAIGCMKNAGFKLDWLENKLYEVAQKKEDDEAGETRLREMEEKLKDLKLKCSKMEALVEEEKAKVSAAKAHLSFDDVV

SEQ ID NO: 36947 - protein, 547 aa, Cryptococcus neoformans var. grubii
MSAIIPQVQQLLGQVAQFIPPWFAALPTSVKVVIAVIGIPALVICLNVFQQLCLPRRKDLPPVVFHYIPWFGSAAYYGEDPYKFLFECRDKYGDLFTFILMGRRVTVALGPKGNNLSLGGKISQVSAEEAYTHLTTPVFGKGVVYDCPNEMLMQQKKFIKSGLTTESLQSYPPMITSECEDFFTKEVGISPQKPSATLDLLKSMSELIILTASRTLQGKEVRESLNGQFAKYYEDLDGGFTPLNFMFPNLPLPSYKRRDEAQKAMSDFYLKIMENRRKGESDHEHDMIENLQSCKYRNGVPLSDRDIAHIMIALLMAGQHTSSATSSWTLLHLADRPDVVEALYQEQKQKLGNPDGTFRDYKYEDLKELPIMDSIIRETLRMHAPIHSIYRKVLSDIPVPPSLSAPSENGQYIIPKGHYIMAAPGVSQMDPRIWQDAKVWNPARWHDEKGFAAAAMAQYSKAEQVDYGFGSVSKGTESPYQPFGAGRHRCVGEQFAYTQLSTIFTYVVRNFTLKLAVPKFPETNYRTMIVQPNNPLVTFTLRNAEVK

SEQ ID NO: 36948 - protein, 449 aa, Sinorhizobium meliloti 1021
MTGNKIDSIDPTDEVLPPRSLVLFGLQHVLVMAASPITAVFLVSKALGFSDALTVSLISATFLICGLGTILQSFGPAGFGARLPFIMVPGGAPIAIFLAIAQQTDVQTAVGAVILTAGFYFLALPVFRRLLRYFPPIVVGTMLLLVSVNLVRIYGGTITGKQGSEGFADPMNVGLALATIALTVIFARVFTGTLQRISVMFGLIAGSAIAIGAGYMDLSGIFDGPVIAMPQLLPFGMPKFDFFAALPLIVFSIISMAEATGQTIATAEIVGRRGDAHAIVPATIRGDAVASLVGGLFGTSLIITSGENVGIVRATNVKSRYVTATAGVILVLIALFAPVGRLASALPGPVVGGTAVIVFSIIGVIGIDLLRRVDLREHGPMFTLAAALSMGLLPILVPGVYSQFPPWSQMILANGLAAGTITAVIVNAFFQHLPLEQFQEKCAAVFRPE

SEQ ID NO: 36949 - protein, 523 aa, Vigna unguiculata
MAMASLARRKAYAVVSSSRSSVFLTSLRGFASGSDENDVVVIGGGPGGYVAAIKASQLGLKTTCIEKRGTLGGTCLNVGCIPSKALLHSSHMYHEAKHSFANHGIKLSSVEVDLAGMMAQKDKAVSNLTKGIEGLFKKNKVNYVKGYGKFVSPSEVSVDTIDGGNTVVKGKHIIIATGSDVKSLPGVTIDEKKIVSSTGALALTEIPKKLVVIGAGYIGLEMGSVWGRLGSEVTVVEFASDIVPTMDAEVRKQFQRSLEKQGMKFQLKTKVVGVDTSGDGVKLTLEPAAGGDQTILETDVVLVSAGRTPFTAGLGLDKIGVETDKIRRILVNERFTTNVSGVYAIGDVIPGPMLAHKAEEDGVACVEFIAGKVGHVDYDKVPGVVYTTPEVAYVGKTEEQVKALGVEYRVGKFPFMANSRAKAIDNAEGLVKILAEKETDKILGVHIMAPNAGELIHEAAIALQYDASSEDIARVCHAHPTMSEAVKEAAMATYDKPHSHMKSWLLLHSLLFIFVQQFTMTWR

SEQ ID NO: 36950 - protein, 503 aa, Cryptococcus neoformans var. neoformans JEC21
MRSSPVIEISPASSGTAIFQHNPKGDATLRREWEPGCQPDELYDAFLPAWRASLRRLLVRRLRNESTQMADWQKRVRSEARDKYFYWTAVFGTHTFFMMFLPILFFFGHPLEGRGLLHVVGLGIYISSFAKDLVCTPRPYSPPVIRLSMSTHHHEYGFPSSHSTNSVSIALYLGQWIFKLQDRLGWPTVLLSWLMLAVYMTSVIGGRVYTGMHSIADIVGGSIMGVACWLFWIAIGDRNEAWVNSGSWTVPAIIAPLAFTLIHRHPEPFEACPCFEDAIAVLAVMLGSTLGQWFTVAIWPSIKVQNPTAFYSYNLATIILSIMFRLVFGLGTLFAWRLLAKYTLRQVLPPVFRSCSLLLHSSLPARRFYISTAEHNKEPSQLALRAVPSLLDLQTGEDTGTLPAPSCPSPLLASHALSSRNDITIGPPSNPREGLIKRKKSSCEGGAEWRTATPREEQAQMSVSALTYDIEVATKVGVYSGIGFIATILVPYWFELIENIVLG

SEQ ID NO: 36951 - protein, 277 aa, Mycobacterium avium subsp. paratuberculosis K-10
MNRTERSFDGVGGVRIVYDVWTPEVAPRAVLVLSHGFGEHARRYDHVARRFGAAGLVTYALDHRGHGRSGGKRVLVRDIHEYTTDFDTLVGIATREHHGLKCIVVGHSMGGGIVFAYGVERPDNYDLMVLSGPAVAAQDQVSPLLALAAKVLGVIVPGLPAQELDADAVSRDPEVVAAYRNDPLVYHGKVPAGVGRALLQVGETMPQRAPALTAPLLVVHGSDDRLIPVAGSRRLVECVGSADVELKVYPGLYHEVFNEPEREQVLDDVVGWITARL

SEQ ID NO: 36952 - protein, 502 aa, marine gamma proteobacterium HTCC2143
MERHNTEQKLPTHLYRAQQVRELDRIAIDQENIPGFTLMRRAGKVAFDTLIDRWPEVDKITVVCGVGNNGGDGYVLATLAMQRGIAVEIVQCGDVKKITGDALQARQLALQDGIGSVDFDGERQLDRGVIVDALLGTGLSGDVRDNFAPVIEWINRSQCPVLAIDIPSGLCSDTGRVLGHAVYADQTVSFIGFKQGLLTGSGPDYTGRVAFSDLAVPKAIFQQVVATSQCLDFDELMAALPPRQSTAHKGDFGHVMITGGDSGMAGAATMASQAACRVGAGLVSCATRPEHIPAIISRCPEVMAHGVISGQEIEPLLARATAVVVGPGLGRAPWGEQLLQKVFKLSVPLVIDADALNIIADGRVVKQPYKDNWILTPHPGEAARLLGCSSAEIQQDRFAAVAELQRRFGGTVILKGAGTLVADTETATIGICPYGNPGMAAGGMGDVLSGILGALLAQGLSPAVAARLGVCLHGRAGDIAASSGQRGMMATDLIAHLRQLVN

SEQ ID NO: 36953 - protein, 435 aa, Mycobacterium tuberculosis CDC1551
MGAFASARAPRSSVKPVTATPREFDIVLYGATGFVGKLTAEYLARAGGDARIALAGRSTQRVLAVREALGESAQTWPILTADASLPSTLQAMAARAQVVVTTVGPYTRYGLPLVAACAAAGTDYADLTGEPMFMRNSIDLYHKQAADTGARIVHACGFDSVPSDLSVYALYHAAREDGAGELTDTNCVVRSFKGGFSGGTIASMLEVLSTASNDPDARRQLSDPYMLSPDRGAEPELGPQPDLPSRRGRRLAPELAGVWTAGFIMAPTNTRIVRRSNALLDWAYGRRFRYSETMSVGSTVLAPVVSVVGGGVGNAMFGLASRYIRLLPRGLVKRVVPKPGTGPSAAARERGYYRIETYTTTTTGARYLARMAQDGDPGYKATSVLLGECGLALALDRDKLSDMRGVLTPAAAMGDALLERLPAAGVSLQTTRLAS

SEQ ID NO: 36954 - protein, 145 aa, Triticum aestivum
  misc_feature (33)..(33): Xaa can be any naturally occurring amino acid
  misc_feature (92)..(92): Xaa can be any naturally occurring amino acid
  misc_feature (115)..(115): Xaa can be any naturally occurring amino acid
RAEFGTRNHAPHRARTRTAHRRPRRSGEERRRXVMEEAAAAAGVQLGTSKPQIATQAEMAEARLPIPYRDQCAHLLIPLNKCRVAEFYLPWXCDPERHSYEKCQYELLMERMLQXMQKIRQAQAGAKSRAASHRRALAPSNAKLA

SEQ ID NO: 36955 - protein, 528 aa, Aspergillus oryzae
MANVTGSFVSPSADATVVPQLFQPSGLLGSLLGDFNVWKGLLTLFIAAVIYDQFRYFYQKGSIVGPRWKLPFMGPFLQSVNPKFHEYKAKWDSGELSCVSVFHKFVVIASTRDMSRKIFNSPAYVKPCVVDSAHKLLGEDNWVFLDGKDHVEFRKGLNGLFTRSALSCYLPRQEETFNQYFKHFLEKSKANGYKPTPWMPEFRELMTAISCRTFVGHYMTDEVIQKINDDYYLITAALELVNFPIILPFTKTWYGKKAADMVMEEFAKCAAKSKARMAAGGEVSCIMDAWVKAQQVSAKYREDVAKGIPAEKPPQLLRDFTDEEIAKTVFTFLFASQDATSAASTWLFQLMADRPEVLEKVREENVRLRNGDINAPITMELLDQMEYTRAVVKETLRYRPPVIMVPYLVKKDFPITEKITVLKGSMIIPSVWPATHDEEAYPNPDTFDPDRWITGTAEQNPKNWLVFGTGPHYCLGQTYAQLNLMAMIGKASMEMTWEHTTTPKSEDIKVFATIFPQDDCLLTFRPRA

SEQ ID NO: 36956 - protein, 517 aa, Arabidopsis thaliana
  misc_feature (485)..(485): Xaa can be any naturally occurring amino acid
MDDCSKDIINCLPDNLLCQILSNLSTKEAALTSLLSKRWRYLFALVPNLDFDVLPSLHPEVAMQDQDQTSFIDFVDRVLKLRGKDHINKFSLKCGDGIEDEDVFPWILNTLRHGVSDLSLHVSPSLVYWLPSKVFASKTLVRLKIGPKDGPRVKLRNVCLPKLKTLNLDSVVFEEGKIGFAKLLSGCPVLEELSLLNLAWDRWDSCSVSSKILKRLTLYCAHSSRNPKSVSFDTPNVVYFEYSDNIANKYPKVNFDSLVEASIGIRMTKVQKANARYVSDVDEETEMVGNATDLLMGICNVKTLYLSYDTLETLNLCCQVIPVFNNLTHLTIESHPELGWESLPNLLKSCPNLGTLVFQGLLHKATDRCGDVCMCQGLENSHSCLSSSPVKCLKILKFGETNDDDDMEIEMEQIKNFLEKMPNLEQLIIYYESSIDNDLVRVSSQLQEVPTVASLKCKIQVISDNLSLSSTLPISLSMENGFHLXKNLTGFVELVMRSCLDYHLEAIYGCAHGYKYL

SEQ ID NO: 36957 - protein, 764 aa, Cryptococcus neoformans var. neoformans JEC21
MSSLPEDGISGASADDAGEDVQPANTVGNAVNMRDLSHVFDTSLQMPSESQPGSTVATPSLSPSLISTAEWEQELASSPPANSAVHTSRPFPSASVTSRQNEQPSILNSHYLSPIPSSPSQKSVTAPLNAPDYLSQRTLPPEPAFPFPSIKHITPNEKLTPSNPPVAGSGQASAALSRPNSSASNDGTSASLAGKNEDSSAAMKSVSRPESIAATTNGHDIISHASGEKRPGTAIKSGRSSSSAVKPPAELISKKSFFHKMFHPNQDKHDGKNAVGQSRLHLELPRDAPSNGLASGRVSPSVMGPNTTESPPLTPSGNISDIDSRPPSRAPSRPPSVRRQNSAPGHDISVQTFVDPKNAVTPPVGVLAPQPQRRLSQRSAGSPSRRSASAGQGVTAKKDESAGNSGTKFTLKDLVGLGDNKVKKASAAGSAKGSDRGSTRGSEIGDNNSTASLLKKYGVCDRAAIGKGATAVVRLAHKWDRREEKLYAVKEFRKRRKNETEKDYVKKLTSEFCISSTLHHINVVETVDLVQDEAHHWCEVMEYCPGGDLYAAIKKGGMSSQEVECSFKQIMQGIAYLHSMGVAHRDIKPENLLLDGRGHVKITDFGVSDVFRMCWEKKTHMSKGLCGSEPYIAPELFEQKEYDARLVDVWAAAIVFYCMQFQELPWRIAKPSDPTFAAYMQQYKPQHVVDASGGTHHPTPPPINNLIPRECRSVIKHMLDPDPKTRWTVDEALKDKWLGNVEVCQEGQENSHRHITAGMDIVRV

SEQ ID NO: 36958 - protein, 298 aa, Triticum aestivum
MAAPLPRAPVSSPASRAALCPARSNPCTAAAPSSGALGWRRRQPCPVLSIAPGSARSTPAALAVDPKVEALLDSVKWDVKGLAVAIAQNVDTGAILMQGFANKEALAATISTRKATFYSRSRSSLWTKGETSMNFINVHDIFLDCDRDSIIYLGTPDGPTCHTGAETCYYSSVYDALQGSKSNQERQVATTLYSLEDTISRRKEEIVTEGSGKPSWTKKLLLDNQLLCSKIREEAGELIETLLENEDKSRTASEMADLLYHAMVLLSVRDVKMEEVLEVLRRRFSQSGVEEKASRKKS

SEQ ID NO: 36959 - protein, 430 aa, Acidobacteria bacterium Ellin345
MVAALGGLLFGFDTAVISGATHALTEAYSLSPSLLGVTVSSALWGTVAGSLLAGIPADRIGRRDSLRFMAVLYLVSSLGCAFAWNWPALLVFRVIGGLGIGGSSVIGPMYIAEIAPAKWRGRLVGFFQFNVVFGILLAYFSNYLVGLGCFGANEWRWKLGIPAVPAALFLIMLFGIPRSPRWLVKKQRVPEARESLQLIGEEDYEKELHDIIESIDADHAQGDSLFDRKYLFPIFLAVSIGMFNQLAGINAILYYLNDIFAQAGFNKVSSDLQAVAIGGTNLLFTMLAMSIIDYVGRKTLLLIGAVGTALCLGGVAWIFHVHQHQGYLLWLLVVYIAFFAFSQGAVIWVYISEVFPNRVRAGGQSLGSSAHWIMNAIIAGVFPALAAKSGSIPFAFFAAMTAIQFFVVLFVYPETKGITLEAMQKKLGIS

SEQ ID NO: 36960 - protein, 300 aa, Acidobacteria bacterium Ellin345
MSNFTIVGLGEILWDVFPTYKQLGGAPTNFAYISSLLGDHAVVASRIGTDDLGTAVVDRLNSLQLSTSHLQRDLEHPTGTVQIELDSTGQASFDFTAEVAWDFLAWDAAWEQLAQSTDAVCFGTLAQRSPQSRVTIQRFLRATPSSAIRIFDINLRQSFYSSEVLSESAERADILKLNHEEVLPLMTLLGEHFVDDDAAAAWLCEQFELKLVCITRGSNGSLLVNQEARDEHPGYPVEVADTVGAGDAFTATLVHHYLRGSSLATMNDAANRMGSWVASKPGATPAAEPEFIDAARAVRD

SEQ ID NO: 36961 - protein, 272 aa, Juglans nigra
EDERPKVAYNQFSTEIPIISLAGIDEVHGRRTEICQKIVEACEDWGIFQVVDHGVDASLISDMTRLARDFFAMPPEEKLRFDMSGGKKGGFIVSSHLQGEAVQDWREIVTYFSYPIRTRDYSRWPDKPEGWRKVTEEYSDKLMGLACKLLEVLSEAMGLEKEALTKACVDMDQKVVVNYYPKCPQPDLTLGLKRHTDPGTITLLLQDQVGGLQATRDGGKTWITVQPVEGAFVVNLGDHGHFLSNGRFKNADHQAVVNSNYSRLSIATFQNP

SEQ ID NO: 36962 - protein, 1130 aa, Monotropastrum globosum
MSSSRPTQSSGSSGRSKHSARIIAQTTVDAKLHADFEESGGSFDYSTSVRFTGTVGGDIQPRSDKVTTAYLHQIQRGKLIQPFGCLLAVDEKTFKVIAYSENAPEMLTMVSHAVPSVGDHPLLGIGTDVRTIFTNPSAAALQKAMGYGEVSLLNPILVHCKTSGKPFYAIVHRVTGSLIIDFEPVKPYEVPMTAAGALQSYKLAAKAITRLQSLPSGNMRILCDAMVQEVFELTGYDRVMVYKFHDDDHGEVFSELTKPGLEPYLGLHYPATDIPQAARFLFMKNKIRMICDCHAKQVKVIQDDKLPIDLTLCGSTLRAPHSCHLQYMENMNSIASLVMSVVVNEGDEEGDGGGSSVSSNQQQKIKRLWGLLVCHNTTPRFVPFPLRYACEFLAQVFTIHVNKELELENQIHEKNILRTQTLLCDMLMRDAPLGIVSQSPNVMDLVKCDGAVLLYKDKTYRMGTTPTDFQLRDIVYWLSEYHTDSTGLSTDSLYDAGYPGALAFGDGVCGMAAVKITSNDMLFWFKAQTAAEIQWGGAKHESGERDDGRKMHPRSSFKAFLEVVKTRSLPWKDYEMDAIHSLQLILRNAFKDTKAMDATTDVIHTRLHDLKIEGMEELEAVTSEMVRLIETATVPILAVDVDGLVNGWNLKIAELTGLPVDKAIGRDLLSLVEDSSTGIVKKMLDLALQGKEEQNIQFELKTDESRRDSGPISLVVNACASRDHHENVVGVCFVAQDITGHKTVMDKFTRIEGDYKAIVQNPNPLIPPILGTDEFGWCSEWNLAMEKISGWNREDVINKMLLGEVFGTHVVCCRLKNQEAFVNLGIVLNNAVTGRESEKISFGFFARNGKYVECILCASKKIDGEGAVTGVFCLLQLASPELQQALHVQRLTEQTALKRFKELAYIRRQTRASLSGIMYSWRLMEGTDLRERQKQLLHTSAQCQHQLTKILDDTDLDCIIDGYLDLEMVEFTLYEVLSASISQVTLKSNGKGIHIANPLQEEKMPATLYGDNLRLQQVIADFLSISVNFTPNGGQIVASASLTKDRLGQSVQLVHVEIRITHMGGGVPEGLLNQMFGGDTDTSEEGISLLVSRKLVKLMNGDVQYLREAGKSTFIISVELAAAANKSTCE

SEQ ID NO: 36963 - protein, 338 aa, Acidobacteria bacterium Ellin345
MLPSSVQLTIMSKTGENVVRIEAEALRELADRIAGPMAADFQRAVDLLACCGGRVVVSGMGKSGLIGRKMAATFSSTGAPALFLHPAEAMHGDLGMIARGDVVIALSASGETEEILNLLPTIKRLGAPVITMTCDNLYANGAKRSTLAQAADVALDCSIAQEACTLGLAPTASTTTMLALGDALAMALAEKRGFKEEDFANLHPGGKLGKRLTKVSALMHAGDAIPRVTAETKMSDVIYEMSRKKLGVTTVVKGEKLLGIISDGDLRRLLEHRGKDVMDLTAGECMTSSPKTIHPEAYATAALDLMEQRKITSLAVVDSNGELKGIVHLHDLWGTEML

SEQ ID NO: 36964 - protein, 77 aa, Oryza sativa
  misc_feature (17)..(17): Xaa can be any naturally occurring amino acid
  misc_feature (33)..(33): Xaa can be any naturally occurring amino acid
MAPSVMGSWATNVAHFXGFKYSAGMPVGRRSGXSSFGNVSNGGRIRCMYVWPIEGIKKFETVSLLPPLTVEELLKQI

SEQ ID NO: 36965 - protein, 173 aa, Brassica napus
SIHGDRSQQEREVALKSFKSGRTPILVATDVAARGLDIPHVAHVVNFDLPNDIDDYVHRIGRTGRAGKSGLATAFFNDGNTSMARSLSELMQEANQEVPAWLSRYASRSSFGGGKNKRSGGRFGGRDFRREGSYSRGGGGGGGYYGGGGGGGYGGGYGAPSGGYGGETPSAWD

SEQ ID NO: 36966 - protein, 516 aa, Thermus thermophilus
  misc_feature (322)..(322): Xaa can be any naturally occurring amino acid
MTVEPFRNEPIETFQTEEARRAMREALRRVREEFGRHYPLYIGGEWVDTKERMVSLNPSAPSEVVGTTAKAGKAEAEAALEAAWKAFKTWKDWPQEDRSRLLLKAAALMRRRKRELEATLVYEVGKNWVEASADVAEAIDFIEYYARAALRYRYPAVEVVPYPGEDNESFYVPLGAGVVIAPWNFPVAIFTGMIVGPVAVGNTVIAKPAEDAVVVGAKVFEIFHEAGFPPGVVNFLPGVGEEVGAYLVEHPRIRFINFTGSLEVGLKIYEAAGRLAPGQTWFKRAYVETGGKDAIIVDETADFDLAAEGVVVSAYGFQGQKXSAASRLILTQGAYEPVLERVLKRAERLSVGPAEENPDLGPVVSAEQERKVLSYIEIGKNEGQLVLGGKRLEGEGYFIAPTVFTEVPPKARIAQEEIFGPVLSVIRVKDFAEALEVANDTPYGLTGGVYSRKREHLEWARREFHVGNLYFNRKITGALVGVQPFGGFKLSGTNAKTGALDYLRLFLEMKAVAERF

SEQ ID NO: 36967 - protein, 74 aa, Arabidopsis thaliana
KVKFWGGKKKPFRHHSQKKKKGPIIDKNARIGDNVKIINSDNVQEAARETDGYFIKSGIVTVIKDALIPTGTVI

SEQ ID NO: 36968 - protein, 523 aa, Saccharomyces cerevisiae
MDPFHNGNKRSSISFGSSQRQPYNKNNYLSGTNGPSSAAQDQGRGPSPFGMSGNTTNGGNSKRNSGCDLSATYYASRSPMYSPLDFSPPVFSPNHSQLQQARGYAANIPVVSNLMNPSMASVCEYQSHYPLFGLDWSADDYVCLGSYKEDSRNKLQVLHSNDLLSWESVVDADVVYPVSKIQWVPSQLYPRKLATCSDSLRIWSVSPEERQFQEQINLSLCKYNRQHPANPAAADDMKVIGTFPPITSFDWNTVDTNLIISSSIDTTCIVWDLQSSHYVKTQLIAHDSEVFDVRFLTKSTQLFASCGGDGSVRVFDLRSLAHSTIIYEPPSSSVSGATAGTITPSSKGSDALLRLEPSPYDPNVLATFAADSNKIIILDMRNPESPILNLQGHGSSVNGIKWHPTKRNVLLSCGDDCQVLYWDLNSSFMEINAAGSKSPSIHGTSLEDPDGDTEMTDGGAGSGLNEDPLSLNNNSKQVCKTLETPNMMYANKTQEINNIAWRPQRGDWFGCVSGKKFQNVRVL

SEQ ID NO: 36969 - protein, 299 aa, Sinorhizobium meliloti 1021
MKLEGIYSALLTPFSEDESIDRQAIGALVDFQVRLGIDGVYVGGSSGEAMLQSLDERADYLSDVAAAASGRLTLIAHVGTIATRDALRLSQHAAKSGYQAISAIPPFYYDFSRPEVMAHYRELADVSALPLIVYNFPARTSGFTLPELVELLSHPNIIGIKHTSSDMFQLERIRHAVPDAIVYNGYDEMCLAGFAMGAQGAIGTTYNFMGDLFVALRDCAAAGRIEEARRLQAMANRVIQVLIKVGVMPGSKALLGIMGLPGGPSRRPFRKVEEADLAALREAVAPVLAWRESTSRKSM

SEQ ID NO: 36970 - protein, 1152 aa, Mycobacterium leprae TN
MFVTDETIVYSASDLAAASRCEYALLRDFDARLGRGPVVATTEDELFARTSALGADHEQRHLDQLRHEFGDAVAVIGRPAYTYAGFAAAAEATQRAIANRAPAVYQAAMFDGRFVGFIDFLVRDGEQYRVVDTKLARSPKVTALLQLAAYADALAHSGVPVAPEAELRLGDGMVVSYRICDLIPVYRSQRSLLQRLLDRHYTAGTAVRWQDDEVRSCFRCPQCTEQLRATDDLLLIAGMRISQRSKLLNVGITTIAELADHSGPVPDLSSSALSELTAQAKLQVQQRNTGTPQFEIVDPQPLALLPDPDPGDLFFDFEGDPLWTVDGQEWGLEYLFGVLDSEISGTFRPLWAHNRVEERKALTEFLKMVTKRRKQRPHMHVYHYAPYEKTALLRLAGRYGVCEDEVDELLRSGTLVDLYPLVSKSIRVGAESFSLKALEPLYMGKQLRSGDVTTATDSITCYGRYCELLSAGNFDEAATVLKEIEDYNHYDCRSTRELRNWLLLQAYEAGVVPVGAQPVPEGNTVKDDDELSAILSALSGFTGDVAVGDRTPEQTAIALVAAARGYHRREDKPFWWGHFDRLNFPVGEWADNTDVFVADDASIIIDWHTPPRARKPQRRVRLRGRLARGNLGSAVFALYDPPAPLAMDVHPGRRAAGRAEVVEADDLSIPTEVVIVERVGNDGNTFHQLPFALTPGPPIATTALRDSIESTATTLAASLPQLPRTALIDILLRRIPRTHSGATLPRGTDTVADITAAVLDLDSSYLAVHGPPGTGKTHTAAHVITQLVSNHSWRIGVVAQSHAAVENLLDGVITAGLDARQVAKKRHDRSAPPWQEIDGNDYPTFIADPMGCVIGGTAWDFANRNRVPPGSLDLLVIDEAGQFCLANTIAVAPAAANLMLLGDPQQLPQVSQGTHPEPVNTSALDWLVEGQRTLPNERGYFLDRSYRMHPAICAAVSTLSYEGKLHAHTEYTAARRLNEYQPGVHVLAVHHQGNSTESPEEAGAITAEIERLLGTPWTDEHGTRPLDVSDILVLAPYNAQVALVRQQLMSAGFSGVRVGTVDKFQGGQAPVVFISMTSSSVEVVPRGISFLLNRNRLNVAVSRAQYAAVIVRSETLTEYLPATPVGLIDLGAFLTLTTFNGTGRLESRLDKP

SEQ ID NO: 36971 - protein, 299 aa, Agrobacterium tumefaciens str. C58
MITVFGSINMDLVATAKRLPKPGETVTGDTFSTAAGGKGANQALAARRAGVTVKMAGATGDDTFAAPALTLLRDAGTDLSLVKTAPGPTGTAVILIGEGGENMISVIPAANGEVSAFDATKVVGEMDAGDILMLQFEIPAAAIEAALTAAKAKRITTVINTAPLTADGPRLAGLADIVIANETEFELLIGKNGLSSGERESELKALHDRTGQTLIVTLGADGVIAMRNGKVFSASGLKIEPVDTVGAGDTFCGYLAASLDQGMDFEKALKRAAVAGSLACTRAGAQPSIPQAAEVDAAL

SEQ ID NO: 36972 - protein, 887 aa, Aspergillus oryzae
MDGVQLRDEAAQDRVRAAIEFLDPLASDLQNSYRADIVLMLNRGLRRLIVSIDEIRAHNRELADGLLTSPFDYSQAFDRALKDVIKTIPHRPSRETADEVNYYCAYVGAFGEFSCNPRTLGSTHLNRMISLEGIVTKCSLVRPKIIQSVHYSERKDRFLSRKYRDQTMTASGATSLNVYPQEDDEKNPLITEYGYSTYMDHQTISIQEMPERAPAGQLPRSVDVILDDDLVDRAKPGDRIQLVGIYRSLGNRNANSGSSTFRTLVLANNIIQLSSKSGGGIAQATITDTDIRNINKVSKKKNVFELMSHSLAPSIYGHDYIKKAILLMLLGGMEKNLDNGTHLRGDINIMMVGDPSTAKSQLLRFVLNTAPLAIATTGRGSSGVGLTAAVTSDKETGERRLEAGAMVLGDRGVVCIDEFDKMSDVDRVAIHEVMEQQTVTIAKAGIHTSLNARCSVLAAANPIYGQYDPHKDPHKNIALPDSLLSRFDLLFVVTDDIEDSKDRMVSEHVLRMHRYRQPGTEEGAPVREQLNQTLGVGLEDNQDSNQPTEVFEKFNAMLHAGMANTGRGKKKDVEILSIPFIKKYIQYAKSRVKPVLTKGAADHIVTTYSALRNDELSGNQRRTSPITARTLETLIRLATAHAKSRLSNRVEERDAKVAESLLRFAMFKEVLEDERRKRRKVTTFDEDSESESEEDSDEEDTPAQTASATPRSSRRSGTLRTRAAANRSTTDEMDADGDDASEDGDGLYSASPRGQRLRSSQGTRTQTQSQSQMSVASSQPASQLIDSQTDTSQPQASSASASQPIQPARLTVFRQALGPLMGTRLFTTGDTADVEELIGAVNTAVRGIPSLGESHVFQRPEAIQALRAMNERNELMFLEDDETVYRI

SEQ ID NO: 36973 - protein, 373 aa, Oryza sativa (japonica cultivar-group)
MGGNPAMRAGLALVVVVVAVVVGDVGAALPRFAEAPEYRNGEGCPAAVAGAGVCDPGLVHIAMTLDAHYLRGSMAAIYSLLKHASCPESIFFHFLAAADGGEGCGGGVGELRTAVAASFPSLRFEIYPFRADAVTGLISASVRAALEAPLNYARNYLADLLPKCVPRAIYLDSDVLAVDDVRRLWETRLPAAAVVAAPEYCHANFSRYFTETFWSDPQLGDRVFAGRRRAPCYFNTGVMVIDLRRWRVGNYRRRIEVWMELQKEKRIYELGSLPPFLLVFAGEVEAVDHRWNQHGLGGDNVLGSCRPLHKGPVSLMHWSGKGKPWDRLDAGKPCPLDHTWKSYDLYIAEGDSSSASAPFALSSSALPAAAFSW

SEQ ID NO: 36974 - protein, 278 aa, Rhodococcus sp. RHA1
MTDSGRELDLVIYGATGFVGRLLADYLARTAPDGVRIALAGRSHAKLEATRAALGPRAADWPIILAESSDAVALAELASRTKVVATTVGPYAKYGTELVTAAVAAGTDYVDLTGEVLFVRASIDAHHDKARANGVRIVHSCGYDSIPSDLGVHVLHQKVRADGAGELTDTTLVASLSGGVSGGTIDSLRTQIDLSRGDATLRRLAASPPPRTRSAPTGRKNPTSADNPTSPSSTAPTSPRRSADGRPRSSWAPTTPAPCGAATPSKTGRTGGRSRTGR

SEQ ID NO: 36975 - protein, 587 aa, Cryptococcus neoformans var. neoformans JEC21
MLSADQRQRAPFAHKSSCANLTATQPSALRSPFPPQSHWPTPPSAEGHQLQLTSDRSKWAQYPSPRKISNETCQAGFSDHPYAFGGIGATYSLDTPTSRRHSLPSLFNPNTHRRAFTFPSMSLPNPATVRFISLCFLWYACSAISNNTGKVILNHFKYPVTLTIVQFFFVAFYCAISSQKMLGWTGRLRQPTKNILKGTLPLAAFQVGGHIFGSMAISRVPVSTVHTIKALSPLFTVMAYALLFGVSYSPATYLSLLPLTLGVMLACSFDISFSNIFGLVCALGSTIVFVSQNIFFKKIMPTTSTNEVNSSSKLDKINLLYFSSSMAFILMIPLWIYSDARRLIDLWINPAASESGTSVLFYFFLNGTVHFAQSIIAFALLASTSPVTYSIASLVKRIAVICLAIIWFKQPVHTVQALGIVLTGAGLWMYNNAKRDVDRGEIKMRHVEALREGVLPSTKMDQCILEGSGIELSYKSAHNSPKPTYPNNYIDLPSSTTTAVNKTTFQVPPILDHTSHIEAPYPSPPASISSSTPADITYLGISKGRQHWLSGEGERFRPPVLNSIRSSVMEEARETGVNEGMAAVVTT

SEQ ID NO: 36976 - protein, 268 aa, Arabidopsis thaliana
  misc_feature (123)..(123): Xaa can be any naturally occurring amino acid
MCSLSAIMLLPTKLKPAYSDKRSNSSSSSSLFFNNRRSKKKNQSIVPVARLFGPAIFESSKLKVLFLGVDEKKHPSTLPRTYTLTHSDITAKLTLAISQSINNSQLQGWANRLYRDEVVAEWXKVKGKMSLHVHCHISGGHFLLDLFAKFRYFIFCKELPVVLKAFVHGDGNLLNNYPELQEALVWVYFHSNVNEFNKVECWGPLWEAVSPDGHKTETLPEARCADECSCCFPTVSSIPWSHSLSNEGVNGYSGTQTEGIATPNPEKL

SEQ ID NO: 36977 - protein, 333 aa, Glycine max
MSLGILRSRAISLASKRFLCTNAASAPLPPPPSAASPSRWSFLKYALVGALTGGTAFAGYASYAYSLEEVEEKTRSLRESAKYTAGDGVTALDKFQGLLYSTAMTVPAKAVELYLDARRVIEEQVRSYTEPYTDKLLPDLLPQEQHVFTLVLDLNETLIHYIWTRDTGWQTFKRPGVDAFLEHLAQFYEIVVYTDEQNMFVDPVIERLDTKHCIRYRLSRPATKYQDGKHFRDLSKLNRNPGKVLYLSGHALESCLQPENCLPIKAWQQQDIDDTALLDFIPFLEFVARSSPPDIRPVLASYQGCDIPSEFIRRSKEHQRRMQEQKNRGRFWK

SEQ ID NO: 36978 - protein, 465 aa, Cryptococcus neoformans var. neoformans JEC21
MPHHHSLPTSSADFGDFNSAPASSIQTSSLSQDDLLGSYDETIRHSPSVKSHPSPDPRASNLDLLFLDHNAEEHRRPEPTYSPRSRPTGVLPESVPHARSPRRLSTFSSSTSPTSPPSITDAGCDIIFHPFYDHMDVNATRAMQKMQGHGERGASKRSDKMQLRGQASHSRIAPSSSPPHSRLLDTLATTTKLASKWRSVITHPTSPNTADQTHNGQPKPQIRHAETSPMDITHDTPFASAEQIAGSYIPPTGAPGFTQASVLGMKHHGDGPFEPLTLIGRKDSTSNVLTPEDAIGLKACLPPRQRLTNQWTLLFSLDQHGASLSTLYRLIDIYSVSHQSSGNILVIRDGHGNRFGTYMNEPIVKREGTYYGSGESFLFKLTHSCQTIPYRWTGKNKYFALCEAGFMSFGGGAGAYGLILDSTFTHNSSATCPAYNNDILCELEPLKSQHAQSFQCLGLEVWSTL

SEQ ID NO: 36979 - protein, 623 aa, Oryza sativa (indica cultivar-group)
MASISGAAAAAPSSSGASCGLRLRRDHLPRSSHFRLARPSSITDVSRSCSSSSSSPPRSLSSKQSGHADVLAHGAVDKDPIRLWNRYVEWLYQHKQLGLFVDVSRIGFTEEFLRRMEAPMGRAFAAMRELEKGAIANPDEGRMVGHYWLRNPALAPNSFLRDKIETTLERILAFASDVISAKIRPPSSPAGRFTQILSIGIGGSSLGPQFVAEALAPDNPPLMIRFIDNTDPAGIDHQIAQLGPELASTLVIVISKSGGTPETRNGLLEVQKAFRDAGLEFSKQGVAITQENSLLDNTARIEGWLARFPMFDWVGGRTSEMSAVGLLPAALQGIDIKEMLVGAAQMDEETRNTEIKENPAALLALCWYWASDGIGSKDMVVLPYKDSLLLLSRYLQQLVMESLGKEFDLDGNRVNQGLTVYGNKGSTDQHAYIQQLREGVHNFFVTFIEVLRDRPPGHEWELEPSVTCGDYLFGMLHGTRSALYANDRESITVTVQEVNPRAVGALVALYERAVGLYAYLININAYHQPGVEAGKKAAGEVLALQKRILLVLNEASCKDPAEPLTLDQIADRCHCPEEIEMIYKIIQHMAANDRALIAEGNCGSPRSIKVYLGECNVDDDMNS

SEQ ID NO: 36980 - protein, 321 aa, Hyphomonas neptunium ATCC 15444
MTSRPLVDPELIAFIEAFPTVNIGAENLAAVRQSRDAALAQLPPFPASVRVEEVFIPGPKGAPDVRLKLYRKKDGAEGPRPAILHLHGGGYIMGNPEFMGPMCALWADAYDAVVVAPAYRIAPETAFPGNVEDAYAALAWANARAADLGIDTARIAVAGESAGGGLAASLALLVRDRGEYSFCHQQLIFPMIDDRTAVRADLSPMFGEFVWTNASNHFGWASLLGQPPGSPDVSPYAAAARAESLAGLPPTFISTGALDLFTEENLEYARRLMAEGVPVELHVYPGAPHAYMQMAGARVTRAYMRDALSALARGLGVDWKD

SEQ ID NO: 36981 - protein, 142 aa, Cucumis sativus
HPQKQEGLSFVGIHIPVGRVQADDMDELARLADEYGTGELRLTVEQNIIIPNIQNSKLEALLKESLLQKFSPEPPILMKGLVACTGNQFCGQAIIETKARALKVTEEVQRRVTVTRPVRMHWTGCPNTCGQVQVADIGFMGS

SEQ ID NO: 36982 - protein, 325 aa, Emericella nidulans
MGSVSKANVPKIDVSPLFGDDQAAKMRVAQQIDAASRDTGFFYAVNHGINVQRLSQKTKEFHMSITPEEKWDLAIRAYNKEHQDQVRAGYYLSIPGKKAVESFCYLNPNFTPDHPRIQAKTPTHEVNVWPDETKHPGFQDFAEQYYWDVFGLSSALLKGYALALGKEENFFARHFKPDDTLASVVLIRYPYLDPYPEAAIKTAADGTKLSFEWHEDVSLITVLYQSNVQNLQVETAAGYQDIEADDTGYLINCGSYMAHLTNNYYKAPIHRVKWVNAERQSLPFFVNLGYDSVIDPFDPREPNGKSDREPLSYGDYLQNGLVSLI

SEQ ID NO: 36983 - protein, 433 aa, Acidobacteria bacterium Ellin345
MFDITLVHAREILDSRGNPTVEAEVTLSGGAVGRAAVPSGASTGEHEAVELRDGDNARYLGKGVLKAVENVEGEIAQALGGMDASQQRDIDMRMLDLDGTENKGRLGANAILAVSMASARAVANQLDIPLYRYLGGVNGNILPVPMMNILNGGAHADNNVDFQEFMAMPVGAESFSEALRWGAEVFHTLKGVLKKRGYNTAVGDEGGFAPSLKSNVEAIEVILEAIQQAGYTPGEQIAIALDPAASEFFKDGKYIFKKSDKSEKTSEQMVRWWSDWANKYPIVSIEDGLAEDDWEGWKLLTDELGDKIQLVGDDLFVTNPERLARGIDNGVANSILIKVNQIGTLSETLDAIEMARRNGYTAVISHRSGETEDTFIADLAVATGAGQIKTGSASRTDRVAKYNQLLRIEEQLGAGARFLGIGALNYDGDLSAE

SEQ ID NO: 36984 - protein, 248 aa, Oryza sativa (japonica cultivar-group)
MIIGSNSFRPLASSVPIEAVLFDIDGTLCDSDPLHHVAFQEMLLEIGYNNGVPIDEEFFINNIAGRSDVEAAQNLFPDWPLEKGLKFLEDKEAKYRSLAKERLEPVKGLAKVVQWVKDHGYKRAAVTNAPRINSELMISLLGLTDFFQAVIVGGECEKPKPAPFPYLKALKELQVSADHTFIFEDSASGTRAGVAAGIPVVAVATRNPEKSLLDAGATLIIKDYEDPKLWSALEEIDREEAKLKKADA

SEQ ID NO: 36985 - protein, 193 aa, Glycine max
MDDSHNRKRLRHHSPKHPRLCSNSSDTHPLDSPQFQLSRVDPDLLNMLNDAENVTERDPTMQGLDSVIKSFEEEILSPLPNPNLASEAEVFNPNLGYLLEASDDELGLPPAVAPGEDATNPQTLDSGRVGSDGVDLTGFLGFEDDIVNCGGFGLTGYDDVEGDGGGYVTIDGLFDYAEPGADILWRSESLQAM

SEQ ID NO: 36986 - protein, 93 aa, Triticum aestivum
  misc_feature (61)..(61): Xaa can be any naturally occurring amino acid
  misc_feature (77)..(77): Xaa can be any naturally occurring amino acid
  misc_feature (85)..(85): Xaa can be any naturally occurring amino acid
MAPAVMASSATTVAPFQGLKSTAGLPISRRSGSAGLSSVSNGGRIRCMQVWPIEGIKKFEXTLSYLPPLSTEALLKXVDYLIRSXKWVACLRI

SEQ ID NO: 36987 - protein, 549 aa, Beta vulgaris
MSEGTNKAMSDPPPTTASKVIADFDPLKKPPKRNKFAFACATLASMTSVLLGYDIGVMSGAIIYLKEDWHISDTQIGVLVGILNIYCLFGSFAAGRTSDWIGRRYTIVLAGAIFFVGALLMGFATNYAFLMVGRFVTGIGVGYALMIAPVYTAEVSPASSRGFLTSFPEVFINAGILLGYISNLAFSSLPTHLSWRFMLGIGAIPSIFLAIGVLAMPESPRWLVMQGRLGDAKKVLNRISDSPEEAQLRLSEIKQTAGIPAECDEDIYKVEKTKIKSGNAVWKELFFNPTPAVRRAVIAGIGIHFFQQASGIDAVVLYSPRIFQSAGITNARKQLLATVAVGVVKTLFILVATFQLDKYGRRPLLLTSVGGMIIAILTLAMSLTVIDHSHHKITWAIALCITMVCAVVASFSIGLGPITWVYSSEVFPLRLRAQGTSMGVAVNRVVSGVISIFFLPLSHKITTGGAFFLFGGIAIIAWFFFLTFLPETRGRTLENMHELFEDFRWRESFPGNKSNNDENSTRKQSNGNDKSQVQLGETTTSTTVTNDNH

SEQ ID NO: 36988 - protein, 486 aa, Pseudomonas sp. KL28
MRQIENFIAGEFVASASGKRFDKHSPLDNRIICSVSEAGRGEVDAAVRAARSALQGEWGGLTTEQRIELLYGVANEITRRFDDFVEAEMSDTGQPEHVMKHVFIPRGAANFKVFADVIKNVASESFQMDTPDGRGALNYSIRRPKGVIGVVCPWNAPFMLMTWKVGPALACGNTVVVKPSEESPQTAALLGEVMNAVGIPKGVYNVVHGFGPDSAGEFVTRHPQVDAITFTGETRTGTAIMKAASEGMRDVSFELGGKNAGIVFADADFEAAVESFSRSVFLNTGQVCLGTERVYVERPIFERFVQALKVKAEAVKYGRPDDHQANYGPLISQEHKQKVLSYYRKAVEEGATLVTGGGVPQMPGELAEGAWVQPTIWTGLPETAAVVQEEIFGPCCHISPFDSEDEVVEKANATDYGLSTTIWTSNLARAHRMAGRIDVGITWINSWFLRDLRTPFGGSKQSGIGREGGVHSLEFYTETRNVCVKL

SEQ ID NO: 36989 - protein, 545 aa, Beta vulgaris
MSEGTNKAMSDPPPTTASKVIADFDPLKKPPKRNKFAFACATLASMTSVLLGYDIGVMSGAIIYLKEDWHISDTQIGVLVGILNIYCLFGSFAAGRTSDWIGRRYTIVLAGAIFFVGALLMGFATNYAFLMVGRFVTGIGVGYALMIAPVYTAEVSPASSRGFLTSFPEVFINAGILLGYISNLAFSSLPTHLSWRFMLGIGAIPSIFLAIGVLAMPESPRWLVMQGRLGDAKKVLNRISDSPEEAQLRLSEIKQTAGIPAECDEDIYKVEKTKIKSGNAVWKELFFNPTPAVRRAVIAGIGIHFFQQASGIDAVVLYSPRIFQSAGITNARKQLLATVAVGVVKTLFILVATFQLDKYGRRPLLLTSVGGMIIAILTLAMSLTVIDHSHHKITWAIALCITMVCAVVASFSIGLGPITWVYSSEVFPLRLRAQGTSMGVAVNRVVSGVISIFFLPLSHKITTGGAFFLFGGIAIIAWFFFLTFLPETRGRTLENMHELFEDFRWRESFPGNKSNNDENSTRKQSNGNDKSQVQLGETTTSSVQV

SEQ ID NO: 36990 - protein, 591 aa, Oryza sativa
MCGILAVLGAADWLKHRGPDWSGLYQCEGNFLAQQRLAIVSPLSGDQPLYNADRTIVVVANGEIYNHKKIRKQFASKHTFSTGSDCEVIIPLYEEYGEDFVDMLDGVFAFVLYDTRTKTYMAARDAIGVNPLYIGRGSDGAVWISSEMKALNEDCVEFEIFPPGHLYSSAAGGLRRWYKPQWFAENVPATPYQPLLLREAFEKAVIKRLMTDVPFGVLLSGGLDSSLVAAVTKRHLIKTEAAEKFGAELHSFVVGLEGSPDLIAAREVADHLGTIHHEFHFTVQDGIDAIEEVIYHDETYDVTTIRASTPMFLMARKIKALGVKMVLSGEGSDELLGGYLYFHFAPNKEEFHKETCRKVKALHQYDCLRANKATSAWGLEVRVPFLDKEFINVAMSMDPEWKMYNADLGRIEKWVMRKAFDDEEHPYLPKHILYRQKEQFSDGVGYNWIDGLKAFTEQQVSDEMMKNAAKVYPHNTPVNKEAYYYRMIFERLFPQESARETVPWGPSIACSTPAAIEWVEQWKASHDPSGRLIASHNSASASAKPTPYHANANANGNSNGKANGNCAMAANGTNGVGLVVANGTANGKMEA

SEQ ID NO: 36991 - protein, 328 aa, Arabidopsis thaliana
MAIARTGVYVDDYLEYASTFPAELQRLLNTVRELDERSQSLINQTRQQTKYCLGLASQSSKKGNGNHYNNGGLDEEETIEKMRKEIESSQENALSLCTEKVLLARQAYDLIDSHVKRLDEDLNNFAEDLKQEGKIPPDEPSVLPPLPIVPKAEKRKSFYGTPQPKKIDYRDRDWDRDRDFELMPPPGSNRKDLMPIEEQPIDPNEPTYCVCHQVSFGDMIACDNENVSLLSQHLIIYFLMYSCYDETFCSCFDSAKEVNGFTIHALASHLRPDSKGNGTAPPADSSHSHTNIICTCEKVPLASSLAPSLHDQCHQTHLSCYPTSSKCK

SEQ ID NO: 36992 - protein, 219 aa, Francisella tularensis subsp. holarctica
MIKNIFFDLDGTLVNTVGDLTVATNTMRKHFGLNPVSEDVLANIIGKGYPTTVRKVLALDFDDKDYIESIADEGVKIVSQTYKTLNSANSKVYPNIFKTLDFLKQQNIKMAVVTNKHEEDAIQSLTHLGLVDYFEVIVGGDSTASYKPYPEPLLFVMNKLNAKPEESLMVGDSINDFLCAQDANIKIVIVSYGYHNGIDLKSLESFAYIDDFSTIKNLI

SEQ ID NO: 36993 - protein, 472 aa, Mycobacterium leprae TN
MNVHTAGPRHAEKTRHTATPQRVQPSDDLLRLASNVWPRNITRDETGVACIAGNKLTDLAGEYGTPLFVIDEDDFRFRCREIAAAFGGGENVHYAAKAFLCTEIARWIDEEGLSLDVCSGGELAVALHASFPPERISLHGNNKSVAELKDAVKAGVGYIVLDSTTEIERLDAIAGEAGIVQDVLVRLTVGVEAHTHEFIATAHEDQKFGLSVASGAAMAAVRRVFATDNLRLVGLHSHIGSQIFDVAGFELAAHRVIGLLCDIVGEFDPEKTAQLSIVDLGGGLGISYLPDDDPPPIFELAAKLGAIVSNESAAVGLPVPKLMVEPGRAIAGPGTITLYEVGTIKDVDVSATAHRRYVSIDGGMSDNIRTALYDAQYDVRLVSRTSDAPAAPASIVGKHCESGDIVVRDTWVPDDLKPGDLVGVAATGAYCYSLSSRYNMLGRPAVVAVCAGQARLILRRETVDDLLSLEVR

SEQ ID NO: 36994 - protein, 677 aa, Kluyveromyces lactis NRRL Y-1140
MSDSTDKDRHNKNSSRGIVNTDIEDDNSPSPLDTTDKKGAPELQKPGNPSLFKESALKNSDQLQFRNSFNIPNAVGGTNGIVIPPNVQPLDQQRIPPSYTDHLQVKDTYLTGRTLLYFTSIFVSLGVFLFGYDQGVMSGIITGPYFKTYFNNPTAATIGTMVSILEIGALVSSLLVSNIGEKFGRRFTIKYGSLIFILGGLVQTFSWEMGHMIFGRIISGIGVGLLSTIVPIYQSEISPPHNRGKLACIEFTGNIVGYASSVWVDYACSYIESDTSWRLPLFIQCVMGLLLFLGSFVIVETPRWLLNHDHDIEGLVVIADLHSDGDVLHSKAHEEYKLIKETVLISRLEGEKKSLRFAFKRYRTRMLIAMSSQMFAQLNGINVISYYAPLVFEQAGWVGREALLMTGINSIIYILSTILPWKLVDKWGRKPILLSGALVMGTSLLAIAMSLWANVAATPRLVVVFVIIFNAFFGYSWGPIPWLYPVEIAPAMARSAMASASTATNWLFNWLVGIMTPILQEKIHWRMYLIHTVSCYLSFWCVLKVYPETAGLRLEDMDSVFDDRSSTFSFQSGTSAEIEQQSHLVSGGGEVAPSTRSRKSVYSNAQSMFNKDEIQPPTLTQVLQWKEERTQTKPLKKFIRRGSETVCLIYNKVRNLRSTNDTNQIEYGAVSNNQPPN

SEQ ID NO: 36995 - protein, 228 aa, Staphylococcus epidermidis ATCC 12228
MPKLILCRHGQSEWNAKNLFTGWADVKLSKQGIEEAQSAGKKIYDNQIEIDIAFTSLLTRALETTQYILAGSDQQWIPVYKSWRLNERHYGGLQGLNKDDARKKWGEDQVHQWRRSYDVRPPRESEEQREAYLKNRRYQHIDHRMMPYCESLKDTLERVVPFWTDHISQHLLDDKTVLVSAHGNSIRALIKYLEGLSEEDIVGYEIKTGAPLVYELTDDLVVKDKYYL

SEQ ID NO: 36996 - protein, 262 aa, Arabidopsis thaliana
MAIARTGVYVDDYLEYASTFPAELQRLLNTVRELDERSQSLINQTRQQTKYCLGLASQSSKKGNGNHYNNGGLDEEETIEKMRKEIESSQENALSLCTEKVLLARQAYDLIDSHVKRLDEDLNNFAEDLKQEGKIPPDEPSVLPPLPIVPKAEKRKSFYGTPQPKKIDYRDRDWDRDRDFELMPPPGSNRKDLMPIEEQPIDPNEPTYCVCHQVSFGDMIACDNENCQGGEWFHYTCVGLTPETRFKGKWYCPTCRLLPQSH

SEQ ID NO: 36997 - protein, 756 aa, Rubrobacter xylanophilus DSM 9941
MARSTKKNMEKVRKGWDPSLWAGLKPFGIGEERPNNYAEILRAVWENKDEALYAWRILSRGVCDGCALGVAGLHDWTMDGVHLCNIRLRLLRLNTMPALDTRLLADLASLKQKKSAELKELGRLPYPMIRRRGERGFTRISWERALDEIAGRIRATSPRRTGYYMTSRGEPNENYYVAQKAVRAMGTNSIDNAARICHSPSTVSLKATIGAGATTCSYSDWIGTDLLVFIGSNPANNQPVTTKYMYYAKKAGTKIAVINSYREPGMERYWIPSNLESALFGTKISDRTFLVNVGGDVAFLNGTLKHMIENGWLDRGFIERHTAGFKQMRAALEEQSWEDLERLSGASREEMREFARMVGEASTAVFVWSMGITQHEFGEDNVRAIINLGLTKGFVGRDNCGLMPIRGHSGVQGGAEMGAYSTAFPGGLPVNPENARKLGELYGFEVPSEPGLTTPRMIDAAHDGELDVLVSLGGNFLEVLPDPDYVREALARVPLRVHVDIVLSNQMLIDPADTVILLPAATRYEIPGGVTQTSTERRIMYSPEIPGRRIGEARPEWEIFMELAKRVRPELADKLHFDGTQEIREEIARVVPMYDGIQHLRKSGDQVQYGGPHLCAGWKFDTPDGKAHFSAIALPETGIPEGMFVVTTRRGKQFNSMIHEEKDALTGAVREAVLMSEEDARGLGLANGERVVLRSEAGEFEGRVHIAPIKPRTLQVHWPEGNVLIDRRHRSAVADIPDYNALVRVERAGEREPAAV

SEQ ID NO: 36998 - protein, 658 aa, Magnetospirillum magnetotacticum MS-1
MLLIGLTTFQIQSGHERAVRTASANLADTARITEEQVRGSLRVVRLMLRAIAEAPRNDTQALRRYMATRAKIVPEIRQALVANAQGVVTIATAPQIEGTDVGEYVFFREARVLPAGRDIYVAKPLPIGLDGSLVILISMPLTGPDGRFDGIAAVSLELGFFQALLKSVHSGEDGAGALLATPDGDIITRDPEPEVFAGKNIAKGSAFAQHRDKGGAANTFVHVAATDGIEKVFAIRTLTEPAMPPLVVIVARPLNGVLADWRTEALTMAGVVGALVLTILGLTGLASRHLIAMMASEERYRGLIETQNDLVVRFTLDERVVFANEAFARAHGRDVANAIGMSWRDFVYEEDHDATAQAIAEVTRPPAFRATVESRMRMEGGLRWVSWEGAAIRDMSGRIIEVQAVGRDITDWVENRERQSSLLRELDSSNRELEQFAYVASHDLREPLRMITSYLSLLERRYAASLNEDGHQFLDFARDGAKRMDMMVLDLLEFSRVGRVRDALGEVSLAEVISIAEENLRLRLVESGATLSIAPDLPVVIGSHGELIRLMQNLIGNAVKYRQPDRPLMVTISAERSESGWTCTVADNGIGIAPDYFERIFDIFQRLHSRSEYEGTGIGLAVCRKIVEHHGGRIWVESEPGVGSRFRFTLADQPAQSS

SEQ ID NO: 36999 - protein, 390 aa, Rubrobacter xylanophilus DSM 9941
MRAVVYKGPFEVAVENVEDPKIQDPNDVVVRITSTCICGSDLHMYEGRTAAEPGIVFGHENLGIVEEVGPGVVSLRQGDRVVMPFNVACGFCKNCQRGYTGFCLTVNQGFAGGAYGYVAMGPYTGGQAEYLRVPFADFNCLKLPEGDEHEADFALLADIFPTGYHGTELADVQPGETVAVFGAGPVGLMAAYSAMIRGAERVFVVDRVKERLDKAEEIGCIPVNFDEVDPVEYIKEQTPGNRLSTLSVDNDANRGADKGIDAVGYQAHVRGGEREEPAIVLNTLIECVRPTGALGVPGLYVPSDPGAPDDASKKGQLLVSIGRMFEKGLRMGTGQCNVKRYNAYLRDLIIAGRARPSFVVSHEVPLDQAPEAYEKFDKRIEGYTKVILKP

SEQ ID NO: 37000 - protein, 553 aa, Pediococcus pentosaceus ATCC 25745
MNDIEISQNAEMLPIQTIAKQAGFDEKVVEPYGHYKAKIDIFSEKPNTQLGKLVLVTSINPTPAGEGKSTVTVGLGDALNDLTGSAMIALREPSQGPVMGMKGGATGGGYSQVIPMDDINLHFTGDMHALTAANNTLAALIDNHLQQGNELNIDPRTIVWRRCLDINDRALRNIVIGLGGRFSGVPREDKFDITVASELMAILCLAQDLKDLKERINRILIANNYDGQPIFVKDLHVGGAIATLLKDAIKPNLVQTLGHTPAIIHGGPFANIAHGCNSVLATKTALRHAKYTVTEAGFGADLGAEKFLDIKTPVLGKQPDAIVIVATVRALKYNGGAKLADLKIEDVEALQKGYINLQRHIKNMQRYNIPVTVSINHFISDTDQEVNTLVKLIEAEGISAIVTDAWAKGGAGSKDLANEVIALADTNQGPMTKLYDNNGRIEDKIKTIVQKIYGGSDVEYSPQALKKIKECVANGWDHLPICMAKSQYSFSDDPKQLGAPSDFVMHVNDINIRLGAGFLVVQTGKVLTMPGLPKHPAALDIDIDSKGEITGLF

SEQ ID NO: 37001 - protein, 465 aa, Desulfotalea psychrophila LSv54
MNRRSIMTQEAMKKVIAQNKKNCWHHLTQHSAYDKDGAAPMVVVEGKGMRIKDANGNEFLDAVSGGVWTVNVGYGRESIANAVRDQLVKLCYFAGSAGSVPGAQFAEALLDKMPGMDRVYYSNSGSEANEKCFKIIRQLAHLEGDGKKNKIIYRDRDYHGTTIGALSSTGQFERKAQYGPFAPGFVELTNCCCYRCPFGKKYGECNIECAHALEDLIQAEGPETVGGIILEPITAGGGVIVPVPEYFPIIREICDRHGVLLHIDEVVCGLGRTGKWFGYQHFDVVPDMVTMAKGVASGYAGISCTTTTEAVFDRFKADPSDKMHYFRDISTFGGCTAGPAAALENMAIIIRENLLDNVVKMGDYFSDRLFELKDKYEIIGDVRGKGLFQGLELVKDRTTKEPVDESVAAGVAGHCAAKSRVIIGRTNRSFEKHNNTLAFSPALISSKTEIDEVINALDLAFADQK

SEQ ID NO: 37002 - protein, 217 aa, Agrobacterium tumefaciens str. C58
MSETGTATEKPLFGRPWIFIRGVPAMKFLPPEGPPEIAFAGRSNVGKSSLINALVGHKGLARTSNTPGRTQELNYFVPEGYSGEPGDLPPMALVDMPGYGYAQAPKDHVDAWTKLVFDYLRGRATLKRVYVLIDSRHGIKKNDEEVLSLLDKAAVSYQVVLTKTDKIKDVGVPRLIGETLEKIRKRPAAYPEVLATSSEKSFGLDDLRAEIVRTVLL

SEQ ID NO: 37003 - protein, 339 aa, Oryza sativa
MDHEADAYRTDLMTITRYVLNEQSRNPEARGDLTILLSHIVLGCKFVASAVNKAGLAKLIGLAGETNVQGEEQKKLDVLSNEVFVKALVSSGRTCVLVSEEDEEATFVDPALRGKYCVCFDPLDGSSNIDCGVSIGTIFGIYMIKDKENVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQAK

SEQ ID NO: 37004 - protein, 465 aa, Desulfotalea psychrophila LSv54
MNRRSIMTQEAMKKVIAQNKKNCWHHLTQHSAYDKDGAAPMVVVEGKGMRIKDANGNEFLDAVSGGVWTVNVGYGRESIANAVRDQLVKLCYFAGSAGSIPGAQFAEALLDKMPGMGRVYYSNSGSEANEKCFKIIRQLAHLEGDGTKNKIIYRDRDYHGTTIGALSATGQFERKAQYGPFAPGFVELTNCCCYRCPFGKKYGECNIECAHALEDLIQAEGPETVGGIILEPITAGGGVIVPVPEYFPIIREICDRHGVLLQIDEVVCGLGRTGKWFGYQHFDVVPDMVTMAKGVASGYAGISCTTTTEAVFDRFKADPSDKMHYFRDISTFGGCTAGPAAALENMAIIVRENLLDNVVKMGDYFQDRLFELKDKYEVIGDVRGKGLFQGLELVKDRTTKEPVDESVAAGVAGHCAAKSRVIIGRTNRSFEKHNNTLAFSPALISSKTEIDEVINALDLAFADQK

SEQ ID NO: 37005 - protein, 505 aa, Desulfotalea psychrophila LSv54
MAAQFWERILMDKKAAVTERAELKKSIKPVQAWALALGAILGWGAFVLPGLRFLPQAGPLASCIGFVLGGVMLFSVAISYGNMVSKYKVTGGAFAFSFVGFGPTVAFICGWALVLGYICIIALNATAVSLLTRFVFPGVFEVGMLYSIVGWDVYAGEIAMLVGILCLCGFLNFRGADLVGKIQVFLAFALCASVFIVFGGSVSHETAAVSNLSPLFADNKSPLASIMAIVAIAPWLYVGFDTIPQAAEEFDFPHKRAEKLMLSAIGWGIVLYAMVTIAVACIMPYKELLAMNSPWATGTVANMALGRVGSVILATAVLAAIFTGINGFFIASSRLLFAMGRATILPSWFADIHPKYQTPHKAILFVLAIAVTAPFFGREVLNWVVDMSAVGTVIAYLISCLSAYKVMKHAQNKRGVMHAVLGSISSVVCILLLTVPGSPGAIGMQSWVALCLWVILGAWFYNARMGDFKALTTEEQSTLILGSSRRVFFGKGKKAPAQQPASKEA

SEQ ID NO: 37006 - protein, 818 aa, Pediococcus pentosaceus ATCC 25745
MARSRAKNILIIGAGPTQIGRDTESEAAAVQIIKNFAETDRNLFYVTSDANSVIPRLDVDVKFIEAELTVNSLIQILRENEIDVILPVAGNTVALQLSEQLNESGILKELNVRTMGVTTTTIHNINNPELMNRVLKHIKEPTIPTTVVENVTDALRFAKRVGFPVLIKPIASLTKTNRIKCDNEHQLMEMLESAFKVSITNQVAVEKSVVGYKEIEMIVIRDAEGSKLLINGGENFNPIGVHSGDSIIFSPTQTLTDVEFQSLRTAALKIAEILKIKGVCHVQFALDPTDGKHFITRINPFFDRSSAFAARATGYPIANVVAKILMGQNLREIKLSGVQRHDSLALIEPVMDHIAVRFPTWSFASFKNANQQLNTRMKSTGSVMAFGRSAEEALQKAIRSVDSTTAAEQAALDESQLSEAQLINVLIHPRAGEVYYLLEAIRRGYTVDELAKMTHIDAFYFYKLRHLVKLERRLRDNRFDMAALQEAKYFGFGDTQIAHLWQVRSDEVRDFRIKKAHVFATYKGVEPTAGEFPYLTNTYYSTFEDEDEAVRTTGKKILVLGTANSQVGTNSAAEYTTFQTIQRCQKLGYKVILINNNPNALTLIPDLADKIYLEPLTVENCLNIIHQEKPDKIIAQGKWEIVTQLVLRNVQVEQLPVSRTTRSENIEADYMGVISSINGSINLFGVVGIDEDNMFIPIEVSEALKVKVDPLIKNANQHITNNGIYSVIIKENMHQLQIVSVVPLAVQDLPFLSFAFDQDFAGIITEITLNGSSKIENHPIIQGDYRYSHVYPYTQFGLKKPQNPPFSLAIGAEFQSIK

SEQ ID NO: 37007 - protein, 299 aa, Mycobacterium avium subsp. paratuberculosis K-10
MPNNDVHPDLQRFARFAPRRLVGPRTLPLMRVALAWRGRLGKPVRDVEVITLGSGVGVRLFRPAGAAETTPALLWIHGGGYVLGTAQQDDQLCSRFSRRLGITVASVDYRLAPEHRYPAPLEDCYTALTWLAGLPSVDRYGIAIGGASAGGGLAAALALLARDRAEVSPAFQLLTYPMLDDRSSDTAPSPNYRLWDNRSNRFGWAAYLGDADPHVAVPARRDDLSGLPPAWIGVGTHDLFHDEDLAYAERLRAAGVPCQVETIPGAFHGFDLILPKVQVSQRFFDSQCNSLRAALTPAG

SEQ ID NO: 37008 - protein, 1486 aa, Mougeotia scalaris
MSSRPGHVRNDIRPIRGPSRLSAQANLAAERQDAADAFIQSNYEKAAAGKGEFNYKGLLTTMDGRKPWEVDQMAYLAKMRRSGLGQPYGAMIVVEPPLRHAPKLHLLAYSENVAELLGVDPKEVGLGKNAIGFFSDSSGMVLYREASSRNSFQQPLVLHLRNKPVDFYAILHRGPEGILIDLEPVFPEDKSLSVATLRGISGDRDPTAAITMTEAKESVSGAIRRLQNLPSGSVLSMCQAVVEEVRDLLQYDRVMVYKFHPDQHGEVFAESVRDDMEPFLGLHYPSTDLPQAIRMLLMRVGSRMICDASRPMVKIVQPEVEEKSVDLSESTLRAPHGCHVQYMCNMGSMASITTAIMADERKDDLDPHESSKNKRLWGLIVGHHCGARYTPYPMRKAIEHLAQQFGLLLDREISLAANFHEENILNMQKKLCDMLESNIPLGIVKNSPSIMDLVKCDGAALLFADRFWLLGATPTERQVFDIAEWILKAHGKRSALCTDSLAEAGFPGAADLGEKTCGLVAIKIGPQDFVFWFRSHTAKEVRWGGRRQVQGEIDDDNKLMPRNSFQAFLDVVKKRCLPWEDIELEAINGLRLLLNETLENSRSDAVSNLEGGTDVDGNAMTTRVLLTAQRSIPKPVSALTEEVEVVLACFKTSFLVTDATKEDYPVIFCSEAFSLLSGYKAEDLLGGSCRKLEGYETDELEVSRFLEALEAGSQYSGRQLHYKSDGSPFWDLVTSAAVQDEFDNVVNHVIVYQEVAKYAEGQLPQGKPSIAMASPSTEKGFPVSLIRYDGRLKEKSTRKVNEIVQAMKNPSRAKVDGPLTPGRQGGIAEELKIPMPASPDFSRPQVRHGSIDHSKPSVKPARRRSVVDILMGKPKEEAEAARRGAVSTEEPKVSMDGSDSGKKRRAAKGIDFGTTLERIEYSFLVTDPRLDENPIIFMSDEYIRLTAYTREEHIGGELIYLDGDNTSTSDVRKIRSAAQNNKELSMQFLAYKKNGDTFWALYHFSMVKDSDGTVLYIVNVVKDLGKSMVDDAAFKKAVAKAEKEASSVAEALRDLPDAASEERQWTIHSRAVLPKPHKVEDPAWAAIKKVRAEEGRLGLKHFKPIKPLGNGDSGSVMLVELRGTGQLFAVKVMEKESMIERNKVHRVASEREILDNLDHPFLPTLYASFQTAKHVCFVTDFCPGGELYDFLEVQPGHRFEEKVAQFYAAEILLALEYLHCKGVVYRDLKPENILLTNGGHVVLTDFDLSVLSSTFPKVLRDTKGKRGRSRRPSKEPHPTFVAEPVTRSNSFVGTEEYIAPEIVTGAGHNSSIDWWSFGILLYEMLFGHTPFCGSSMRKTFSNILNREVFFPPEVNVSAEAKDLITLLLVKDADQRLGSKSGAAEIKVHKFFANIDWPLIRFKATAVPKVPVRLDNTVAPSTNAEGGASLENWRLQEVPSGVESARSSGSYLRDSIGSPYVMGASDSPMLKNPDEEYGKWYSSSSQV

SEQ ID NO: 37009 - protein, 355 aa, Zea mays
SRLRRVEAGEARGCRCARRVGGWGCCACWRAAADLTMYIARETSKVWRKVATEVSVELQLLREKWGLLLAGLIFQYIHGLAARGVHYLHRPGPLLQDLGFMALPELGQDKGYLSETIFSSIFISFVLWTFHPFIYHSKRFYTVLIWRRVLAFLVASQFLRIITFYSTQLPGPNYHCREGSKLATLPPPNSVLEVLLINFPRGVLFGCGDLIFSSHMIFTLVFVRTYQKYGSKRFIKFLAWFMAIIQSLLIIASRKHYSVDVVVAWYTVNLVVFFVDNKLPEMPDRTSGLHLLPLSSKEKEGRQKEEKDSKLKDEFHKLLNGNHADPTDRRQRAQMNGRHDEDINHALSEATANGT

SEQ ID NO: 37010 - protein, 415 aa, Mycobacterium avium subsp. paratuberculosis K-10
MWAIARFADRDGGTVPAMAPGMTPYLKWLLRARPADYALAVSLAGASLPVVGRHLEPLAGLTAMGMWGARHAPEVISAATRDMFAPGGGDARRRDRESTQQVSLAALRGLVSAAELESQWPVAQRTPPIWDGVRRHRHLYRRAVHYGHHPAQVLDVWRRKDLPAQPAPVLIFVPGGAWVHGKSMGQGSALMSRLAEQGWVCLAIDYRVAPHHRWPRHIVDVKTAIAWARANVDKFGGDRNFVAIAGCSAGGHLSALAGLTPDDPQYRGMLPEGADTSVDAVVGIYGRYDWEDRSTPERVRFVDFLERVVVRKSIARHPEVFRDASPIARVHRNAPPFLVIHGSKDSVIPVEQARSFVERLRAVSHSTVGYLELPGAGHGYDLIDGERAGAAAHVCSLFLDQVHRSKTRIGAKEVI

SEQ ID NO: 37011 - protein, 159 aa, Brassica napus
MVSGLINENPIVYEIKERRDVRAYSSNTDELSVDAIDQLEVFDHIRDIKDPEHPYSLEQLKVLTEDSVEVDDTKSHVRVTFTPTVEHCSMATIIGLCVRVKLMRSLPSRYKIDIRVAPGTHATEAAVNKQLNDKERVAAALENPNLVEMVDECLSPSFE

SEQ ID NO: 37012 - protein, 260 aa, Bacillus anthracis str. Ames
MLKSYRAVLVSLSLLLVFVLSGCSNATPIDAHSTGIWDHYFVYPISFMIQFVAHHIPGASFGIAIIIMTLVIRSAMIPLAVSQYRSQAKMKKMQPELQKLKQKYGDVSKDLEKQKQYQKEMSELMKSGGWNPLAGCWPLLIQMPIFSALYYAISRTEEIRTSTFLWVNLGHADPYHILPIIAALTTFIQMKVFQSNSTSGEQVQMLKMQQIMMPAMILFMGFAAPSGLVLYWITGNLFTMMQTIVLRKIMEREELQLQKA

SEQ ID NO: 37013 - protein, 1442 aa, Mougeotia scalaris
MDRTIDISDEKWQSRFAAQSSQAAESQYSSDALLNEKYEMASTHGSFVSYKELMKSSAEAPKPWEVDQIAYLEKMRRSGLTQRFGTMLVVEPPLRHAQKLHLLAHSENAVDLLGIEPRELEIGGDILPFFTSESGKALFSEAASKGDSVKTAIVTGRDGETKFYAICHRNACGVIIDLEPVVPKGIHTSYEPNLDTSSPPLSMEAALDIVQPAIQRLKAIPAGSVQEICDTVTREVRELLQYDRVIVYKFHPDQHGEVFAESAKEGLDPYVGLHYPSTDLPQAIRVLLLRVGIRMICDATQSMVKIIQPDDVEPVDLSDSTLRAPHGCHAQYMINMGSLSSITFAIVVESDKTVRAGEEPEKERTLWGIIVGHHSIPRFTPYPLRKAVQSLAETFGSLLTREIALAASWHEEKTLNMQKKLCDMLEADIPLGIVIDSPNIQDLVKCDGAALFFSGRFWLLGSTPTERQVADLAEWILKHHSKKGAVCTDSLAEAGYPNADELGSKTCGMVAVKVGKRDFVFWFREHTAKVVRWAGQRQKKEEIDDESKMMPRNSFKAFMEIVRKRCLPWEDIELEAINGLRLMLQDALDVSRGADIPVVVGGTTIEGDPFDGAGYHESTSEKPVSAITSEVEAALSAVEACFLITDATQESRPIIYCSHVFSTLTGYSAGELEGGTLEKLEGLETDVAAASKLHLALSGRTQYSGRLLHYKKDGTPFWNLITCGPIKNGQNEVVNFVIVFQELAKYHEISSVPPNLVDGDLSAPEKGFPVSLIRYDGRLKEKSSRIVDEIIRLVKNPATIADSLALLGQMSAMASPSVSQVESVPVVEHRERHSSMHIAKPAATKTSRRRSLVEVLLGKGKEIEAPVKEAFDSDVKSDDGKKRRAAKGIDLGTTLERLDYGFLVIDTRLDECPIIFMSDRYILQTQHTREENIGGDILFLDGEESSPAEVDKIRKAVQNNDELSLQLVAYRKNGDKFWALYHLSVAKDKDGNALYIINVVKDLGEAQISDAAFRKEDAEARKEAAEITRALHDLPDTAAYELWTVHSKFVASKPHRAWDSAWTAIKEVREKEGRLCLKHFKPIKPLGNGDSGSVVLVELRGTGHVFAAKIMEKERMIERNKVHRIASEREILNQLDHPFLPSLYASFQTTKHVCFITNFCPGGELYDFLEIQPYHRFEEHVAQFYAAEILISLEYLHCQGVVYRDLKPENILLAEDGHIVLTDFDLSILSSTFPKLIREANGTSKRKSSRRPSKERAPTFVAEPTMRSNSFVGTEEYISPEIVTGEGHGPSIDWWSFGILIYEMLYGETPFCGSSMNKTFHNILNKEVAFPSPVPVSDMAKDLITSLLIKDSEKRLGSKLGAAEIKVHPFFHGINWPLIRNKKVVPPKVPNKLNSVVGGHEEQDISSNHWRLQDTNNDSNRSFPNMSFDGSIIDATEDRSTW

SEQ ID NO: 37014 - protein, 461 aa, Salmonella enterica subsp. enterica serovar Typhi str. CT18
MAEKKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGISEITAIGVYVQFWFPEMAQWIPALIAVGLVALANLAAVRLYGEIEFWFAMIKVTTIIVMIIIGLGVIFFGFGNGGQAIGFGNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAVAKVSRHGVPVAGVALSILILLVGSCLNYIIPNPQRVFVYVYSASVLPGMVPWFVILISQLRFRRAHKEAIADHPFRSIMFPWANYLTMAFLVCVLIGMYFNEDTRMSLFVGVIFLLAVTLVYKVFGLNRHGTAHKVGE

SEQ ID NO: 37015 - protein, 104 aa, Phaseolus vulgaris
LKVPNILVIGHSRCGGIQRLMSHPEDGSVPFDFIDDWVKIGLPAKIDVLKEYEGYDFKEQCKFCEKESVNNSLVNLRTYPYVERGIRNKSIGLLGGYYDFVNPA

SEQ ID NO: 37016 - protein, 644 aa, Solanum lycopersicum
MGANHSREDLELSDSESESEYGSESRTREEEEDEDNYSDAKTTPSSTDRKQSKTPSSLDDVEAKLKALKLKYGTPHAKTPTAKNAVKLYLHVGGNTANSKWVVSDKVTAYSFVKSGSEDGSDDDENEETEENAWWVLKIGSKVRAKIDENLQLKAFKEQKRVDFVANGVWAVRFFGEEEYKAFIDLYQSCLFENTYGFEANDENRVKVYGKDFMGWANPEAADDSMWEDAGDSFAKSPASEKKTPLRVNHDLREEFEEAAKGGAIQSLALGALDNSFLISDSGIQVVRNYTHGISGKGVCVNFDKERSAVPNSTPRKALLLRAETNMLLMSPVTDRKPHSRGLHQFDIETGKVVSEWKFEKDGTDITMRDITNDSKGAQMDPSGSTFLGLDDNRLCRWDMRDRHGMVQNLVDESTPVLNWTQGHQFSRGTNFQCFATTGDGSIVVGSLDGKIRLYSSSSMRQAKTAFPGLGSPITHVDVTYDGKWILGTTDTYLILICTLFIDKNGTTKTGFAGRMGNKISAPRLLKLNPLDSHMAGANKFRSAQFSWVTENGKQERHLVATVGKFSVIWNFQQVKDGSHECYQNQVGLKSCYCYKIVLRDDSIVESRFMHDKYAVSDSPEAPLVVATPMKVSSFSISSRRLQI

SEQ ID NO: 37017 - protein, 370 aa, Oryza sativa (japonica cultivar-group)
MAASEQRVVAVIMVGGPTKGTRFRPLSLNVPKPLFPLAGQPMVHHPISACRRIPNLAQIYLVGFYEEREFALYVSSISNELRVPVRYLREDKPHGSAGGLYSFRDYIMEDSPSHIVLLNCDVCSSFPLPDMLEAHKKYGGMGTLLVNKVSAESANQFGELVADPETNELLHYTEKPETFVSDLINCGVYIFTPNIFNAIEDVLKQKKDRANLRRVSSFEALHSATKALPADYVRLDQDILSPLAGKKELYTYQTLDFWEQIKTPGMSLRCSGLYLSQFRHTSPHLLASGDGKRSATIIGDVYIHPSAKVHPTAKIGPNVSISANARIGAGARLIHCIILDDVEIMENAVVIHSIVGWKSTVGKWSRVQAR

SEQ ID NO: 37018 - protein, 357 aa, Oryza sativa (japonica cultivar-group)
MAASEQRVVAVIMVGGPTKGTRFRPLSLNVPKPLFPLAGQPMVHHPISACRRIPNLAQIYLVGFYEEREFALYVSSISNELRVPVRYLREDKPHGSAGGLYSFRDYIMEDSPSHIVLLNCDVCSSFPLPDMLEAHKKYGGMGTLLVNKVSAESANQFGELVADPETNELLHYTEKPETFVSDLINCGVYIFTPNIFNAIEDVLKQKKDRANLRRVSSFEALHSATKALPADYVRLDQDILSPLAGKKELYTYQTLDFWEQIKTPGMSLRCSGLYLSQFRHTSPHLLASGDGKRSATIIGDVYIHPSAKVHPTAKIGPNVSISANARIGAGARLIHCIILDDVEIMLLYTQLWGGSQP

SEQ ID NO: 37019 - protein, 1124 aa, Mougeotia scalaris
MSSSKRSQSSGRSSTQTRIQNRVTQASADAKLSTAFEVSSSSGGDSFDYTKSVTASLNPTEPLAAKSVTAYLQRMQRGSIIQSFGCMMAVEPGTFRIIAYSENVSEMLGVTPQSVPTGDQQNAIGIGTDVRSLLSPSSVSVVEKAVAANDVSMMNPITVYSLATQKPFFAILHMNDVGLVIDLEPISSSSDSAMFSAGAVQSHKLAAKAISRLQSLPGGDICGLCDVVVEEVRELTGYDRVMAYKFHDDEHGEVVAEIRRSDLEPYLGLHYPATDIPQASRFLFIKNRIRMICDCTSPQVKVVQDSRIPQEMSLAGSTMRGVHGCHTQYMMNMGSTASLVMSVTINDTNEIAGGPGMKGRKLWGLIVCHHSTPRHIPFPIRSACEFLMQVFGLQLNMEVELAAQHREKHILRTQTLLCDMLLRDAPMGIVSQSPNVMDLVKCDGAALLFGGRCWLLGISPTQEQVKDIATWLISSHTDTTGLSTDSLVDAGYPKARELGVDVCGMAAARITENDFLFWFRGHAQKEVKWAGAKDGGSEEDGSRMHPRSSFKAFLEVVKQRSLPWEDVEMDAIHSLQLILRGSFQDIEDKEDRKIVHARLKEMHLQGMEELSSVASEMVRLIETATAPILAVDTAGCVNGWNFKISELTGLSIPEVMGKSLVKDLTHPSSKDTVEKLLYMALNGEEEQNVEIRLKTWGMQQGKGPVILMVNACASRDVSEKVVGVCFVAQDVTGEKIVQDKFTRIQGDYTTIVRSHNSLIPPIFGSDESGFCVEWNPAMERLSGVKREEAIGKMLTRELFGGILRLKNVDGLTKFMIVLNAAMSSHDTDKFPFTFYDRSGKIVEVLLTTSKRCNSEGVVTGVFCFLHTASSELQQALTVQKAAERVAEVKAKELAYIRQEIQNPLDGIHFARSFMEHTVLSEDQKQLIETSATCEKQLRRILADMDLASIEKGYLELETGEFSMATVMNSVVSQGMIQSTQKNLQLYCDTPPDFKSLSVFGDQVRLQQVLADFLLNAVQFTPPSGWVEIKVEPVVKKLPGGVSVAKLDFRVSHPGEGLPEDLIDQMFDRADARVKSQEGLGLSICRKLVRLMNGEVQYRREGERNFFLLQLELPLAQRDDQASMK

SEQ ID NO: 37020 - protein, 139 aa, Synechococcus sp. WH 7805
MDATQDSLFQQAMARYQDGVPAEDLLGDFETITAAAPRQSAGWTCLTWLQLLCDQPDDALRSGRMAIKLNPQDPQARINLCLAMLETKAKGVRDHIEVVQQVLAVAPEVAGDLRESIDDGLRRRPEWPALLKVKAWLEL

SEQ ID NO: 37021 - protein, 371 aa, Aspergillus niger
MSGTRAYNILVLPGDGIGPEVMAEAIKVLRTFNSSSMQFHLQEELIGGISIDTHGHSVTQPVKDAAVAADAVLFAAVGGSKVDHIRRGLDGPEGGLLQVRKAMDIYANLRPCSVDVPSREIARDFSPFRQEVIEGVDFVVVRENCGGAYFGKKVEEENYAMDEWGYSTTEIQRIARLAAELALRHDPPWPVISLDKANVLASSRLWRRVVENTISVEYPQVKLVHQLADSASLIMATDPRVLNGVILADNTFGDMLSDQAGSLIGTLGVLPSASLDGLPHPGKQEKVRGLYEPTHGSAPTIAGKNIANPTAMILCVSLMFRYSFNMENEARQIEDAVRAVLDRGLRTPDLGGNSSTQEFGDAVVAALQGKY

SEQ ID NO: 37022 - protein, 301 aa, Synechococcus sp. RS9916
MVSEISRSQRADAGARLAIRLLQDAAQRGDLDPWDVDVIAVVDGFLDQLRQRIEVPRQVHAALQGRGGSYERDLADSSEAFLAASVLVGLKAELLEAQTFPPEPVFEEGFEAELGDQGWLDPDFNLPRRPERHLERRPVAPPPLRRPVTLGELIEQLESIAEQLETDELEMRRRQKKKRFSNREAIAQVAALAHREKLPETTAALGVFLQEWEEGLHWTDFEQLVLRWCEVAPPDLDTDRVGVFWALLFLSSQGQVELQQEGSLHGPLQLKRLLAPGSMAQLPITRLDVPAVVPAGEAVAA

SEQ ID NO: 37023 - protein, 116 aa, Oryza sativa (japonica cultivar-group)
MGCAGSTPMGAPESDATKKIRKPKPWKHPQPITMVQLTKMREEFWDTAPHYGGRKEIWDALRVAAESEVSLAQAIVESAAIIVSNTDLTLCYDERGAKYELPKYVLSEPTNLIQDS

SEQ ID NO: 37024 - protein, 393 aa, Synechococcus sp. RS9916
MKAMILAAGKGTRVQPITHVIPKPMIPILQKPVMEFLLELLKEHGVKEVMVNVSHLAEEIENYFRDGQRFGVEIAYSFEGRIEDGELIGDALGSAGGLKKIQDFQPFFDDTFVVLCGDALIDLDLSEAVRRHREKGAIASIVTKRVPRDQVSSYGVVVTDDAGRISAFQEKPTVDEALSDTINTGIYIFEPEIFAHIPSGQAFDIGSDLFPKLVEQDAPFYALPMDFEWVDIGKVPDYWQAIRSVLLGEVRQVGIPGKEVRPGVFTGLNVAANWDKINVQGPVYVGGMTKIEDGATLIGPAMIGPSCSICEGAVIDNSIIFDYSRIGPGVQLVEKLVFGRYCVGKDGDHFDLQEAALDWLITDARRADLIEPSPQQKAMAELLGTDLTPTPGG

SEQ ID NO: 37025 - protein, 242 aa, Pseudomonas aeruginosa PAO1
MPDRMRGVKSDSPEQESADDALKRIVDGFQHFRREVFPEQQALFKKLANSQRPRAMFITCADSRIVPELITQSSPGDLFVTRNVGNVVPPYGQMNGGVSTAIEYAVLALGVHHIIVCGHSDCGAMRAVLDPQTLERMPTVKAWLRHAEVARTVVADNCDCGASHDTLGVLTEENVVAQLDHLRTHPSVASRLASGQLFIHGWVYDIESAQIRAYDAKQGRFLPLDGEHPVPMATPAPRYLSS

SEQ ID NO: 37026 - protein, 466 aa, Pseudomonas putida
MKSYDVVIIGGGPGGYNAAIRAGQLGLTVACVEGRSTLGGTCLNVGCMPSKALLHASELYEAASGDEFAHLGIEVKPTLNLAQMMKQKDESVTGLTKGIEYLFRKNKVDWIKGWGRLDGVGKVVVKAEDGSETALQAKDIVIATGSEPTPLPGVTIDNQRIIDSTGALSLPQVPKHLVVIGAGVIGLELGSVWRRLGSQVTVIEYLDRICPGTDTETAKTLQKALAKQGMVFKLGSKVTQATASADGVSLVLEPAAGGTAESLQADYVLVAIGRRPYTKGLNLESVGLETDKRGMLAQRTPPTSVPGVWVIGDVTSGPMLAHKAEDEAVACIERIAGKPHEVNYNLIPGVIYTRPELATVGKTEEQLKAEGRAYKVGKFPFTANSRAKINHETEGFAKVIADAETDEVLGVHLVGPSVSEMIGEFCVAMEFSASAEDIALTCHPHPTRSEALRQAAMNVDGMAMQI

SEQ ID NO: 37027 - protein, 292 aa, Escherichia coli K12
MFTGSIVAIVTPMDEKGNVCRASLKKLIDYHVASGTSAIVSVGTTGESATLNHDEHADVVMMTLDLADGRIPVIAGTGANATAEAISLTQRFNDSGIVGCLTVTPYYNRPSQEGLYQHFKAIAEHTDLPQILYNVPSRTGCDLLPETVGRLAKVKNIIGIKEATGNLTRVNQIKELVSDDFVLLSGDDASALDFMQLGGHGVISVTANVAARDMAQMCKLAAEGHFAEARVINQRLMPLHNKLFVEPNPIPVKWACKELGLVATDTLRLPMTPITDSGRETVRAALKHAGLL

SEQ ID NO: 37028 - protein, 374 aa, Bacillus halodurans C-125
MERGPLIFSASIGNGHNQAAKALQVEFQNKGYQPEIIDTFYSLSPALHKFMLTSYVNLLKVGPRIWQKIYFQAEKYPLFLFLDQFATFFVESLHATVKSNRCSFLVSTHPFVTAFLVRLKSKKQLNLPLYTVITDFVLHPAYLRPEIDGYFTSDPNFTDFAKLNNVSDDRFFPTGIPIPNLESIDQPKWKVRNDLGLDPQRKVLIIAGGGIGLTNYAQVIRALECLPEPIQLLCMIGHNYQVKEKISRIKSKHELKVIEFTDKFLLYLKASDAILSKAGGLTMAESLVCETPIIIHQPVPGHEEHNAKFLIDAGAALRVKGSKEIPTTIKRVLYEEACFGPMIENARKLKKPNAANEIVEQMLLLVKEQQHAFR

SEQ ID NO: 37029 - protein, 458 aa, Staphylococcus epidermidis ATCC 12228
MAKQLQRELNNRHIQLIAIGGAIGTGLFLGSGQTISLTGPSLLFTYMLIGIVLFAFMRALGELLLSNSKFNSFVDIANEYLGPFGGFVIGWTYWVCWIVSSMSDLTAMGQYFAYWYPQVPHWLTVLFIVLLLISFNLLGARLFGELEFWFSIIKVVTIITMVIVGLVLIFLSFKTEYGHASFGNLIHHGGMFPHGAAGFLMSFQIAVYSFIGIELIGVTAGETKNPEKTIPKAINNVPIRILLFYIGGLLVIMSVIPWFKVDPDSSPFVKLFTLIGVPFAAGIVNFVVLTAAASATNSGIYSNSRILFGLAKQGLGPKVLTKTNSNGVPYLSMLVSSITLLIAALLNFIFPDAIKLFIYVTTLSTVLFLVVWGMIIVSYIAYVKKNPEQHQSSAFKLWGGKIIAYIVLSFFIFIFILLFFSKDTRVAIFISPLWFIFLFFYYKKYKNNAESLADRQRH

SEQ ID NO: 37030 - protein, 354 aa, Pfiesteria piscicida
  misc_feature (333)..(333): Xaa can be any naturally occurring amino acid
MMVDAKRRRVEDHVELRTYAAQRILGKGSFGVVYQAQVLETNDVVAVKSVNVQGNERELHILSELDGHPNIVRLNGAFVSSEGDGLAPKLNLVLEFVSDTLHRVIKHYNVLQKVMDAYFIKLYHYQLLRVLGFLHGHGVVHSDVKPQNLLLDGRKHLLKLCDFGSARRLLPGELSRPYVCSRFYRAPECTLGSTGYSTAIDLWSAGCVLGEMILGQPLFCGRDGINQLAAIIEVLGTPSVSDVRAMNPHCPEYEFDPRVPPQSWDTIFRCRASHEATELADALMRYDPSSRVPALNALLLDFFEELRHCSADRRAAQLMLFDFSEDEPWWVGXELRAALVPTWAKSSLPALQPC

SEQ ID NO: 37031 - protein, 107 aa, Glycine max
  misc_feature (5)..(5): Xaa can be any naturally occurring amino acid
  misc_feature (8)..(9): Xaa can be any naturally occurring amino acid
  misc_feature (11)..(11): Xaa can be any naturally occurring amino acid
  misc_feature (15)..(16): Xaa can be any naturally occurring amino acid
  misc_feature (25)..(25): Xaa can be any naturally occurring amino acid
  misc_feature (29)..(29): Xaa can be any naturally occurring amino acid
  misc_feature (37)..(37): Xaa can be any naturally occurring amino acid
  misc_feature (43)..(43): Xaa can be any naturally occurring amino acid
  misc_feature (46)..(46): Xaa can be any naturally occurring amino acid
  misc_feature (49)..(50): Xaa can be any naturally occurring amino acid
  misc_feature (67)..(67): Xaa can be any naturally occurring amino acid
  misc_feature (75)..(75): Xaa can be any naturally occurring amino acid
  misc_feature (79)..(79): Xaa can be any naturally occurring amino acid
  misc_feature (86)..(86): Xaa can be any naturally occurring amino acid
  misc_feature (89)..(89): Xaa can be any naturally occurring amino acid
  misc_feature (92)..(92): Xaa can be any naturally occurring amino acid
MSILXKGXXAXITEXXNDNLKEEFXLIRXIVDKYNYXAMDTEXPGXVLXXVGNMKNIDHYNYQTLTXNVDMLKLXQLGXTFYDENXNLXPAXGEPLLWQFNFRESTS

SEQ ID NO: 37032 - protein, 368 aa, Oryza sativa
MAAATAAAETPPTLLEYMGQAGAADDLVVLVAHVQSACKRIAALVASPGNAELSRGKAGGGVAVAAGRDAPKPLDELSNEIILSSLRRSGKVAVMASEENHLPIWVSNDSPYVVVTDPLDGSRNIEVSIPTGTIFGIYNRLAELDHLPEEERAQLNSLQSGTHLVASGFGAGTHGFTLDHLTGEFVLTHPSIQIPPRGQIYSVNDARYFDWPEGLRKYIDTIRQGKGQHPKKYSARYVCSLVADFHRTLIYGGVAMNPRDHLRLVYEANPLSFLAEQAGGRGSDGKSRILSIQPVKLHQRLPLFLGGMEDMLELESYGDVQQKVNPGYESVHFSAMWSGRLADGTIKTRGHFRTCDCDETCCNIQTSG

SEQ ID NO: 37033 - protein, 560 aa, Bacillus subtilis subsp. subtilis str. 168
MQSQKPWLAEYPNDIPHELPLPNKTLQSILTDSAARFPDKTAISFYGKKLTFHDILTDALKLAAFLQCNGLQKGDRVAVMLPNCPQTVISYYGVLFAGGIVVQTNPLYTEHELEYQLRDAQVSVIITLDLLFPKAIKMKTLSIVDQILITSVKDYLPFPKNILYPLTQKQKVHIDFDKTANIHTFASCMKQEKTELLTIPKIDPEHDIAVLQYTGGTTGAPKGVMLTHQNILANTEMCAAWMYDVKEGAEKVLGIVPFFHVYGLTAVMNYSIKLGFEMILLPKFDPLETLKIIDKHKPTLFPGAPTIYIGLLHHPELQHYDLSSIKSCLSGSAALPVEVKQKFEKVTGGKLVEGYGLSEASPVTHANFIWGKNKPGSIGCPWPSTDAAIYSEETGELAAPYEHGEIIVKGPQVMKGYWNKPEETAAVLRDGWLFTGDMGYMDEEGFFYIADRKKDIIIAGGYNIYPREVEEALYEHEAIQEIVVAGVPDSYRGETVKAFVVLKKGAKADTEELDAFARSRLAPYKVPKAYEFRKELPKTAVGKILRRRLLEEETENHHIK

SEQ ID NO: 37034 - protein, 277 aa, Zea mays
  misc_feature (144)..(144): Xaa can be any naturally occurring amino acid
MQMHHVGGGAADIPEAARPSRYESQKRRDWHTFGQYLRNHRPPLELARCSGAHVLEFLRYLDQFGKTKVHAAGCPFFGHPSPPAPCPCPLRQAWGSLDALVGRLRAAFEEHGGRPEANPFGARAVRLYLREVRDSQAKARGIAXYEKKRRKRPSSSASSQSSPQAATSPRQQAAPASSPILSDAAAERADVRAFVSDAGHGHGHGHQQQHHFFMPHPQFLHGFSLLPGNPEAVAGNGNGSSSSASVAASSGDEIALALAAAEEAHAAGCMLPLSVFN

SEQ ID NO: 37035 - protein, 482 aa, Aspergillus oryzae
MNENDENRPSTRLTRAKAAALSAGDVSTAATKKPLESKKAATSTATAGTTRKRAALGDVSNVTKGENGAAKEGKKPAGAKVGLTSKATMQAGGVAKLTRTNSSRTTALTNKTTNTKKPTEDKEKRSGPGSIKDSAQKRQKTTKDNALVEEPPRKKVEVEKKLTEKKLVAEEAPAKENVEAPVEPKTLQKPSQDLVEDLDTEDLDDPLMVAEYVVEIFEYMKDLELETLPNPHYIDHQPDLEWKMRGILVDWLIEVHTRFRLLPETLFLAVNIIDRFLSAEVVALDRLQLVGVAAMFIASKYEEVLSPHVANFSHVADETFTDKEILDAERHILATLEYNMSYPNPMNFLRRISKADNYDIQTRTLGKYLMEISLLDHRFMAYRQSHVSAAAMYLARLILERGPWDATLAYYAGYDEEQIDPVFRLMIDYLHRPVCHEAFFKKYASKKFLKASILTRQWAKKYHHLYIDSSLSEPYNYIKDHE

SEQ ID NO: 37036 - protein, 493 aa, Mycobacterium avium subsp. paratuberculosis K-10
MSDIQTQAKTEYDKLFIGGKWTEPSTSEVIEVHCPATGEYVGKVPLAAAADVDAAVAAARAAFDNGPWPTTPPKERAAVIANALKVMEERKDLFTGLLAAETGQPPTSVETMHWMSSIGALNFFAGPAVDQVKWKEVRTGGYGQSIVHREPIGVVGAIVAWNVPLFLAVNKLGPALLAGCTVVLKPAAETPLSANALAEAFAEAGLPEGVLSVVPGGIETGQALTSNTDVDIFSFTGSSAVGREIGRRGADMLKPCTLELGGKSAAIVLDDVDLPSALPMLVFSGIMNSGQACVAQTRILAPRSRYDEIVDAVSTFVQSLPVGLPSDPAAQIGSLISEKQRARVEGYIAKGIEEGARLVCGGGRPEGLDSGFFVQPTVFADVDNKMTIAQEEIFGPVLSIIPYDTEEDAIKIANDSVYGLAGSVWTADVQRGIAVSEKIRTGTYAINWYAFDRCCPFGGYKNSGIGRENGPEGVEHFTQQKSVLMPMGYTLEG

SEQ ID NO: 37037 - protein, 469 aa, Aspergillus oryzae
MTSAEVEGTVATENPVSAQGNISPSEEDSDSGESGDEWETQSLYEDAIQVLRDDQLREGVVPDACTLDEAIAFRKRLHEVGKAAFVEETIAQDKVTAKKLCTAFGIMPPAFLEGAPDEAYHPLLAIAISQEFSRRQKLPQYNTIDDAVKLLQESKNIIVLTGAGISTSLGIPDFRSKDTGLYSQLAHLGLSDPQEVFDIQIFREDPGIFYSIAKDILPTEKKYSPTHGFIRLLQDKGKLLTNYTQNIDNIEANAGILPEKIVQCHGSFATATCVKCQYKVSGDALFEDIKKGNVPECTSCQKDIEEDALRPQGQKRKRSTNGTHKSRKSDGDESSEEEDYELPTPGVMKPDITFFGEDLPDEFGQRLIRHDRDKVDLVIVIGTSLKVAPVAEVPGVLPRRVPQIYISRTPVSHTGFDIDLLGDCDVVVSELCRRAGWDFKHEMIPPDEKVEITLAEGYESRHVFKVVGA

SEQ ID NO: 37038 - protein, 133 aa, Glycine max
LLSTGVCPHAAIREDISINLGPLEELSNLFKADILLCESGGDNLAANFSRELADYIIYIIDVSGGDKIPRKGGPGITQADLLVINKTDLAPAIGADLAVMQRDALRMRDGGPFVFAQVKHKIGVEEIGNLVLS

SEQ ID NO: 37039 - protein, 233 aa, Aspergillus oryzae
MGREDQIEEREVLDSIFPEEITDLSDTSYRISIALDAPDDDVEEAEQPVLLLQVTYPADYPDVAPELEISAPPNAPKHPRLDVQEDRDRLLESLQPTIEENLGMAMVFTLVSALKENAEQLMSERVNAVHAQKEMEAAKAEEEENRKFQGTAVTRETFIEWLEKFKAEMEEEEKRQREEKEAEDKKANKKTPAKEEKKMTGRQLWERGLAGKADLDEEGEDALPAVEKMKIAA

SEQ ID NO: 37040 - protein, 397 aa, Oryza sativa
MRMEGGGGGGHGHHGGGGGGHGHHGGIGGGEAQIKGTLTHGGRYVQYNVYGNLFEVSSKYVPPIRPVGRGACGIICAVVNAQTRQEVAIKKIGNAFDNQIDAKRTLREIKLLRHMDHDNALVVISIKDIIRPPRRENFNDVYIVYELMDTDLHHLLRSNQPLTDDHCQYFLYQVLRGLKYVHSANVLHRDLRPSNLLLNAKCDLKIGDFGLARTTNETDFMMEYVVTRWYRAPELLLNCSEYTAAIDIWSVGCILGEIVTREPLFPGKDYVHQLRLITELIGSPDDSSLGFLRSDNARRYVRSLPQYPKQQFRARFPTMSSGAMDLLERMLVFDPSKRITVDEALCHPYLASLHEIYDEPVCPAPFSFDFEQPSLTEEDIKEIIWREALKFNPEPIH

SEQ ID NO: 37041 - protein, 388 aa, Thermotoga maritima MSB8
MMEYWIRRALEVVKTPFLLFDLSVVEKKYLEMKAALKKADIYYAVKANSHPRIISLLARLGSNFDVASKGEIEKLLALGVDGKRMSFGNTIKREEDIAFAYKNGIRLFAVDSEMEVEKVAINAPGSFVFVRVETDGADADWPLSRKFGTNPEHALQLLSYASKMKLIPAGLSFHVGSQNLNPESWKKAIEIAGRVFKKAMRSGLNLFLLNVGGGFPVQHTKPIPSMEEIGKAIEEAIDENLWFVHNLKVIAEPGRYMVGEAGWLVTKVLLKSERSGEKWVYIDAGVFHGLAETIQNFEYEIRVLGKEREELEEYHLAGPTCDSVDVIYDRIFLPKSITLNDLVCFINAGAYTVEYNTRFNGIEPPKMVFIEELTEISIEEKIKTRVLD

SEQ ID NO: 37042 - protein, 214 aa, Synechococcus sp. RS9916
MFGFLKQVGDYTRDAVDAARNLTQGLAVTFDHMKRRPVTVQYPYEKLIPSERYRGRIHYEFDKCIACEVCVRVCPINLPVVDWVMNKATKKKELRNYSIDFGVCIFCGNCVEYCPTNCLSMTEEYELAAFDRHSLNFDNVALGRLPTSVTTDPSVQPLRELAYLPAGEMDPHGVAADRPRAGQLPDQVLATLPKPAANEGESSTTAPSKEENAG

SEQ ID NO: 37043 - protein, 328 aa, Triticum aestivum
MSDDSRTVPQEQLPSDDLHPPPMPVINVGHLNLDPATRARVVEDITKACRDLGYFQIINHGISQSVMDGAVDAASDFFKLPSETKEEFASDDLRRPVRYDTSSKDGISMSRAYLKHYAHPLSEWVQYWPEKPPIYREYMGNFATEVRRVALQLMEAILEGLGLGKDYQHEKFEQGLQLMSVNCYPKESEGDTAIGLAPHSDYGFLTILFTSCRGLEVVDRNSNSWKVVQPLPHALHVHVGDHMEVLSNGKIKTVVHRAVLNPEEARISMASINGFAMHEKVSSARELVNEQNPEKYTASSFNDFLDYLTSNLDNKHRNFLESLRMQGA

SEQ ID NO: 37044 - protein, 369 aa, Oryza sativa (japonica cultivar-group)
MDREALRMVCSREFWRMAVLWTVSLLYSYILLFFLRRGAPVPRLRPMPEPDDDAARRRRRRPVCVITGATSGLGKAAAAALAREGYHVILAGRSSQLLSETVQQIRDQQPDAHLEAFQIDLSSYKSIKKFETSLNQWIKDSNMEHSIQLLVNNAGILAKSYRITEDGLDEMIQANYIGPFVLTNILLPLLKNSSTPSRVVNLTSFTHRCVSEINLSEKGLSGVRFGHWPARRSYLLASTYEYTKFCLLMFSYELHRQLHLSSGVSVMAADPGVVQTGIMRELPPCLSWLALSVLRLLNLLQQPDTGVDAVLDAALAPPDSSGKYFFGGKGRTITSSQLSYNVEVAKKLWAESLALFNELQNRVCELRTS

SEQ ID NO: 37045 - protein, 398 aa, Synechococcus sp. RS9916
MGVAQASADEIRHERTGIVFRPGLDGVPATQSSICDIDGQLGRLSYRGYPLEELAAESTFLETAYLLIWGELPTAAQLQAFEHEVQMHRRVSFRVRDMMKCFPATGHPMDALQSSAASLGLFYSRRAIDDPKYIYAAVVRLIAKIPTMVAAFQLIRKGQDPIQPRDDLAYSANFLYMLTEREPDPFAARIFDRCLILHAEHSLNASTFSARVTASTLTDPYAVVASAVGTLAGPLHGGANEDVLAMLEEIGSPDQAASYLDEAIANKRKVMGFGHREYKVKDPRAVILQALAEEMFERFGHDDLYDVARALEEAAETRLGPKGIYPNVDFYSGLVYRKLGIPRDLFTPVFAISRVAGWLAHWREQLGANRIFRPSQIYTGSEQRRWIPLESRLPAAGA

SEQ ID NO: 37046 - protein, 480 aa, Saccharophagus degradans 2-40
MSTHTVDDEVDSLEPDNNQKILSTKLSRALKTTGMAAKSGIRHLNYLKNKTLTSSANVEKKAQLKLDHEAEIGRILFSGLSQMRGTALKASQLLSLEADLLPEGIRKELAKSCYQVPPINRALIRKMFIQELGKEPSKVFDKFEPQACAAASLGQVHKASITLPETGEQQTVAVKIQYPGIGESIDSDLKMLSFILNSLSKTTSHVPNKHVLETTLDEIERCLKDEINYEQEAENTRWFAHNLNVAGVRIPKVYNAFSTQRVICTEFLEGLHVEEWLSTNPTQAQRNRAGQIIFNIFTHGAFELNALHADPHMGNYLFLANGDIGLIDFGCVKKLDKAFTENMGHLVSAILNKNQPQVFESYKQLRILSQDMEYDRYINHVYPILGPLQDWMSTPYAPTRKDINGNTLSGPTESNYYDFSQLPPPPTDMNRANHKTAMESLYSLTRDQLYFDRSYFGVYQLLRKMKAVVDTSNKWIKASK

SEQ ID NO: 37047 - protein, 181 aa, Escherichia coli K12
MLKLLKTIMRAGTATVKYPFAPLEVSPGFRGKPDLMPSQCIACGACACACPANALTIQTDDQQNSRTWQLYLGRCIYCGRCEEVCPTRAIQLTNNFELTVTNKADLYTRATFHLQRCSRCERPFAPQKTIALAAELLAQQQNAPQNREMLWAQASVCPECKQRATLINDDTDVLLVAKEQL

SEQ ID NO: 37048 - protein, 235 aa, Pseudomonas syringae pv. syringae B728a
MRTHPNETDTSCRTPCRQVFTGNHMQLKNPILGLCQQATFMLSAAKVDQCPDDEGFEVAFAGRSNAGKSSALNTLTHASLARTSKTPGRTQLLNFFGLDEDRRLVDLPGYGYAKVPIPLKLHWQRHLEAYLGSRESLKGLILMMDIRHPMTDFDVLMLDWAIASNMPMHILLTKADKLTYGAAKNTLLKVQAEIRKGWGDAVSIQLFSAPKRMGLEEAYTVLADWMELEDKAPAE

SEQ ID NO: 37049 - protein, 544 aa, Saccharomyces cerevisiae
MSEENLRPAYDDQVNEDVYKRGAQSKLTKARKADFDDEKDKKKDNDKHIDKRPKSGPRLDENGNPLPKEPRLPKRKVAVMVGYCGTGYHGMQYNPPNPTIESALFKAFVEAGAISKDNSNDLKKNGFMRAARTDKGVHAGGNLISLKMIIEDPDIKQKINEKLPEGIRVWDIERVNKAFDCRKMCSSRWYEYLLPTYSLIGPKPGSILYRDIEESKTELPGVLDEDLESKEFWEEFKKDANEKFSTEEIEAILAYVPPARDEFDINEELYQKVKKYKQLENAHRRRYRISAAKLAKFRASTSQYLGAHNFHNFTLGKDFKEPSAIRFMKDIKVSDPFVIGDAQTEWISIKIHGQSFMLHQIRKMVSMATLITRCGCPVERISQAYGQQKINIPKAPALGLLLEAPVFEGYNKRLEQFGYKAIDFSKYQDEVDKFKMKHIYDKIYKEEVDENVFNAFFSYIDSFNKVTGAQGEETADKSGPAVQKSIFEFLTAKGIPGLTDAPESNKKIKQRKRMEEEEAASKKAEISSTTQSNEPEVQPEAAAN

SEQ ID NO: 37050 - protein, 317 aa, Synechococcus sp. WH 5701
MPQIGSAGQALRGHAAEHQDAAVRASVSGRRQPLPPSQRKYKFGTTSFMLAIHVGAVFALLPRFWSWQAVVVLAALYWTTVLGVTLGLHRLLAHRSFVAPKWLERTLVLMGSLACQSGPIEWVGLHRHHHKYSDQPNDHHDAGRGLWWSHSDWMLHDIPAVRQMARFTGDLQRDPLYRWLDRWFLLLQVPLGAALWWYGERAGVPGGGLGLVLWGIPLRLAIVYHVTWLVNSATHAFGYRNFDSPDLSRNCWWVAVLSFGEGWHNNHHAHPASARHGLRWFEFDITWQHIKLLRALGLAKRIRVAHVGQPLPSATSS

SEQ ID NO: 37051 - protein, 104 aa, Coccidioides immitis RS
MADVEMTDAPTAPAKLKATTKSSKSGAAEASSEGKKRFEVKKWNAVALWAWDIVVDNCAICRNHIMDLCIECQANQGSSTAEESRFPFPLHLKMAEDETSLPTR

SEQ ID NO: 37052 - protein, 312 aa, Synechococcus sp. WH 5701
MTATVRRPSPPSARSLSRAEALHRPRRGEPTPSAPKGTRWATLGFMAVVHALAVVALLPRFWSVPAVASMLLLYWITGCLGVTLGYHRLLAHRALRVPQWLERFFATCGALSCQHGPIDWAGLHRHHHKFSDTEADHHNSHKGFWWSHMGWMFEEIPAMAAVPRLTGDLQRDPYYRWLNTNFLLLQIPVGLLLFWIGTATGAGGWALVLWGIPLRLVVLYHCTWLVNSATHCWGSVSHESGDESRNNPWVAALTFGEGWHNNHHAFPHSARHGFGARQFDLTWQHIRLLKALGLATQVRLPSAAGKATQAVI

SEQ ID NO: 37053 - protein, 303 aa, Streptomyces avermitilis MA-4680
MIVVAGEALIDLVPQGAGALAGLKPALGGGPYNTAVALGRLGSPTAFCSRTSRDAFGEALLDGLRTAGVDVSAVQRGAEPTTLAVATIDEHGSAAYSFYVDGTADRQFAAPDRLPGATRAVSFGTCSLVLEPGASAYEELLRSAAAQGLFTTLDPNIRAGLIPDPDAYRARFKSWLASVTLLKLSEDDATWLGGSPREWLASGPSAVVLTRGGDGLTVFTRDGAEHSVPGEPVDVVDTIGAGDTVNAALLHGLAARDALSPEGLAGLDAEGWTELLRFAARAAAITCSRAGAEPPYASELGAF

SEQ ID NO: 37054 - protein, 804 aa, Bacillus subtilis subsp. subtilis str. 168
MFVSYKWLEDYVDLKGMDPAVLAEKITRAGIEVEGIEYKGEGIKGVVIGHVLEREQHPNADKLNKCLVDIGAEAPVQIICGAPNVDKGQKVAVATVGAVLPGNFKIKKAKLRGEESNGMICSLQELGIESKLVAKEYAEGIFVFPNDAETGSDALAALQLDDAILELGLTPNRADAMNMLGVAYEVAAILDTEVKLPQTDYPAASEQASDYISVKIEDQEANPLYTAKIIKNVTIAPSPLWMQTKLMNAGIRPHNNVVDITNFVLLEYGQPLHAFDYDRFGSKEVVVRKAAENEMIVTLDDQERKLSADHLVITNGTKAQAVAGVMGGAESEVQEDTKTILLEAAYFNGQKVRKASKDLGLRSESSVRFEKGIDPARVRLAAERAAQLIHLYAGGEVLAGTVEEDHLTIEANNIHVSADKVSSVLGLTISKEELISIYKRLGFTVGEADDLLVVTVPSRRGDITIEEDLIEEAARLYGYDNIPSTLPETAGTTGGLTPYQAKRRKVRRFLEGAGLSQAITYSLTNEKKATAFAIEKSLNTVLALPMSEERSILRHSLVPNLLDSVSYNLARQTDSVALYEVGSVFLTKEEDTKPVETERVAGAVTGLWRKQLWQGEKKPVDFFVVKGIVEGLLDKLNVLDSIEFVQSERKQLHPGRTANILLNGSLIGFIGQVHPSLEKELDIKETYVFELDLHALLAAETAPLVYTAIPKYPSVTRDIALVTDKTVTSGQLESVIKEAGGKLLKEVTVFDVYEGEHMEEGKKSVAFSLQYVNPEQTLTEEEVTKAHSKVLKALEDTYQAVLRG

SEQ ID NO: 37055 - protein, 269 aa, Brassica napus
  misc_feature (252)..(252): Xaa can be any naturally occurring amino acid
MGDLYALDFDGVLCDSCGESSLSAVKAARVRWPGLFVGVDSALEEWIVDQMHIVRPVVETGYENLLLVRLLLETKMPSIRKSSVAEGLTVDGILESWGKIKPVIMEAWDEDDKDALIDLFGKVRDDWINNDLTTWIGANRFYPGVSDALKFASSKIYIVTTKQGRFAEALLREIAGVIIPPERIYALGSGPKVEVLKLLQNKPEHQGLKLHFVEDRLATLKNVIKEPELDKWNLYLSNWGYNTEKERAEAEXLSRIQVIELSTFTSNVK

SEQ ID NO: 37056 - protein, 313 aa, Agrobacterium tumefaciens str. C58
MRRTVMILCCGEALIDMLPRQTTLGEAGFAPYAGGAVFNTAIALGRLGVPSAFFTGLSDDMMGDILRETLRASKVDFSYCATLSRPTTIAFVKLVDGHATYAFYDENTAGRMITEAELPALGADCEALHFGAISLIPEPCGSTYEALMTREHETRVISLDPNIRPGFIQNKQSHMARIRRMAAMSDIVKFSDEDLAWFGLEGDEDTLARHWLHHGAKLVVVTRGAKGAVGYSANLKVEVASERVEVVDTVGAGDTFDAGILASLKMQGLLTKAQVASLSEEQIRKALALGAKAAAVTVSRAGANPPFAHEIGL

SEQ ID NO: 37057 - protein, 350 aa, Staphylococcus epidermidis ATCC 12228
MKAAVWYGQKDVRVEDREPKAIKDNEVQVKVSWAGICGTDLHEYLEGPIFISTDQPDPLLGQTAPVTLGHEFSGVIENVGKDVSRFKKGDRVVVNPTVSKREKPENVDLYDGYSFIGLGSDGAFAEFTNAPETNVYHLPDNVSAREGALVEPTAVAVQAVKEGELLFGDTVAVFGAGPIGLLTIVAAKAAGASKIFVFDLSEERLAKAKSVGATHVYNSGNVDPVQTVYEHTDNGVDVSFEVAGVGITLQQSIEVTRPRGTAVIVSIFGHPVEFNPLLQMNKGVKLTTTIAYTPTTFQQTIDLIANGSLNVKDVVTDQIELENIVESGFNQLVNDKSQAKILVRLNGDQK

SEQ ID NO: 37058 - protein, 480 aa, Arabidopsis thaliana
MQISSSSFITKFTNLHMVRSTSDHHQWRHNYNLKQLFIPNLSVSNSQHLPLNQSVAAIVFGGGSDSELYPLTKTRSKGAIPIAANYRLIDAVISNCINSGITKIYAITQFNSTSLNSHLSKAYSGFGLGKDRFVEVIAAYQSLEDQGWFQGTADAIRRCLWVFEEFPVTEFLVLPGHHLYKMDYKMLIEDHRRSRADITIVGLSSVTDHDFGFGFMEVDSTKAVTRFTIKGQQDLISVANRTATRSDGTSSCSVPSAGIYVIGREQMVKLLRECLIKSKDLASEIIPGAISEGMKVKAHMFDGYWEDVRSIGAYYRANMESIKRCRLDLKFYDRQCPLYTMPRCLPPSSMSVAVITNSIIGDGCILDKCVIRGSVVGMRTRIADEVIVEDSIIVGSDIYEMEEDVRRKGKEKKIEIRIGIGEKSRIRRAIVDKNARIGKNVMIINRDNVEEGNREAQGYVIREGIIIILRNAVIPNDSIL

SEQ ID NO: 37059 - protein, 541 aa, Agrobacterium tumefaciens str. C58
MQATIEKLKATASSTAATDLRAAFAADDQRFSRFSVKFDDLLMDYSKCAVNEEIVTLLEQLAREGGVEAKREEMFSGKAINFTEDRAVLHTALRNRSNTPVLVDDKDVMPDVNGVLAAMGKFADAIRSGSLKGATGKKITDVVNIGIGGSDLGPVMATLALAPFHDGPRAHFVSNIDGAHIADTLKLLDPETSLFIIASKTFTTIETMTNAATARRFIAEKLGEGAVKHHFAAVSTALDKVAAFGIESDRIFGFWDWVGGRYSIWSAIGLPLMIAIGPDNFGKFLDGAHAMDRHFREAPIRENLPMLLGLIGFYNRNVLDYPTRAILPYDQRLSRFPAYLQQLDMESNGKGVTIDGTPVEGQSGPVVWGEPGTNGQHAFYQLIHQGTSVIPAEFMIAANGFEPELRHQHQLLIANCLAQSEALMKGRTLAEAKAQLTSKGMEDSQADFIAPHRVFTGNRPSITFVYDKLTPFALGRLIALYEHRVFVEGVLFRINSFDQWGVELGKELATGLLPVVEGKESAAGHDSSTQGLVKALAGLAG

SEQ ID NO: 37060 - protein, 218 aa, Triticum aestivum
  misc_feature (146)..(146): Xaa can be any naturally occurring amino acid
  misc_feature (162)..(162): Xaa can be any naturally occurring amino acid
MEDERSTQSYQGGEAAEQVEVTDRGLLGNLLGKKKAEEDKEKQEELVTGMEKVSVEEPEVKKEEHEDGEKKETLFSKLHRSSSSSSSSSDEEKEEVIDDNGEVIKRKKKKGLKEKLQEKLPGHKDPEGEPVTGLPAPEAPGLCKPXGSDVAVQKIHGDVKTXEGAPSLPEGGQICLLWNKLREKLLRRAPSKPGGPLPPLSLFFCSFHHPLFPSRAPS

SEQ ID NO: 37061 - protein, 570 aa, Agrobacterium tumefaciens str. C58
MSELSLGHPENVSVAKRWLASYPPGVPSEIPASANASLIDLLEKSCKQFADRKAFSSMGKSLTYRELDADTRAVAAWLQSRGLEKGDRVAVMMPNILQNPVAVYGILRAGMVVVNVNPLYTPRELEHQLKDSGAKALFVLENFAHVAQQAVPKTAVRHVVVAAMGDLLGLKGHIVNLVVRKVKKLVPAHAIPGSISFKAMLKEGQGVSLKPVGLTAQDIAFLQYTGGTTGVSKGAVLTHANLLANKAQISLWLDAAFNGRKDRPEVLNFICALPLYHIFALTVNSLMGIALGGHNLLIANPRDIPGFVKELSHYQPHIFPGLTTLFNALMNNEEFRKLDLSSLIFVLGGGMAVQRPVAERWVSVVGCPITEGYGLSETSPVATVNRLDAAEFSGTIGLPISSTEIDIRDEDGNSLPTGEVGEICIRGPQVMAGYWQRPDETAKAITADGFFRSGDMGFMDERGYTKIVDRKKDMILVSGFNVYPNEVEEVAASHPGVLECAAIGVPDEHSGETVKLFVVKKDQSLTEAELKAFCAKNLTNYKRPKIIEFRTDLPKSNVGKILRRELRNLN

SEQ ID NO: 37062 - protein, 532 aa, Aspergillus nidulans FGSC A4
MLRRAILPLTRPSGLVSAPRLSALPVSHSRCYAKGSKPKTPYKLPESVKSSKPEQPAKPSQQEQYAAEQAEFETTSDPQANTANTTSQASSSPESSPSQSEQDAPQRPLPDLTQGIPSTLAAELEARSKKSGSGTLNLTEDPSRFEEDYSDDGRGDIPKGGYESSLDRKRARMAKLMYALFLLGSVGGMAYLGRNWDTVEEENAHPDVPSGWSFGLWYNRIKARMGDFTSYYKDPAFPKLLPDEDPNLRQPYTLVLSLEDLLVHSEWSREHGWRVAKRPGVDYFLRYLNQYYELVLFTSVPSMMADQVLRKLDPYRIIRWPLFREATRYKDGEYIKDLSYLNRDLSKVILIDTKEEHARLQPENAIILDKWNGNPKDKTLVALIPFLEYLAGMGVDDVRTVLKSFEGQSIPIEFAKREKAMRERFEKELAEEQKKRPRSGMGSLASALGLKSSARTLDGEQLPSAGLQEGKMLWDQIRERGQKNYELIEKEIRENGEKWLAEMAAEEEKLRQEQMESMKGSLTGFFGGGKKE

SEQ ID NO: 37063 - protein, 226 aa, Aspergillus oryzae
MLSAGERPQPAIGKNAAATRAQSSLSHSPAPMWSVQPKPEQVQHIWVVTGPAGCGKSTVGRGLQAALNVPFLEGDDFHSQKNKEKMGSGIPLTDADRWDWLISLRNAAIKALSPSEANNFHPPSGVVVACSALKQKYRDVMRVAAYGTPSVQIHFVYLKLDENALLQRVAARQAHYMKSTMVQSQLQDLEEPKGEWDALTIDAHVPQEQVMREVLEAVRDKLAEYQ

SEQ ID NO: 37064 - protein, 796 aa, Magnetospirillum magnetotacticum MS-1
MGIVVAWTAVTALHDRDIFMAQAEYRTQSLADLAAEQVLRTIEGADTALKAARTQLRHMGDWEKLSQDHKSWQILRDYGDAMSAVPILYMADAQGIIRLHGQSFPFRPISIVERDYFVAHRADPADIPLISAPITGLVTGNQVIIVSRRITNPDGSFGGVVGATLKADAFQAFFQTLGLGGGAVVNLQRPDGIILARQPFMEGAVGRKVDNSKAFPAIAEGKPRGTAVTDSPLDGLSRITAFQRINRYGLIVITAIPVETVLGEWRRQTIRMSSMVGVGILVLSALFVMLLRRYHTEVAARAELKNSEATLNRAQSVAHIGSWQVDLPSDHVRWSQETYRIFGITPGTPVTFTTVMAMVHPDDRAQVQDAISALLTGAPYDVEHRVITAGGEVKYVAAKALLTTAPTGEPQEILGTVQDITEKKQAEIAIREHQALLLEVQSVAKLGYYDYDIRTDLWRSSPILDTIFGITTDYIRTGQGWLELVAPAMRAEMGAYLLEIQAGQHDFDKVYPIIRPCDGEERWVAGLGKIERDAEGRPTRMVGTIKDITEQHRAEQSLRDKADELERSNTELEQFAYVASHDLREPLRMVSSYVDLLARRYNDKLDDDAREFIAFAKDGATRMDRLILELLEYSRIGRVTRPMLPVSLGGVVERALRALAPKIEECGAEFATPPEVLPTVLGDAEELMRLFQNLIGNAIKYRDPERKPVISIEAENTGKEWILTVIDNGIGIEPKYFERVFLIFQRLHRRGEYEGTGIGLAVCKKIVEHHGGRIWVESTPGQGSRFSVTLPPIGQV

SEQ ID NO: 37065 - protein, 375 aa, Magnetospirillum magnetotacticum MS-1
MTDTKINLIGLSRDQLIAEMAAIGEKPFRAKQLWHWMYNRGETDFAKMTSISKSMHGALAERYVVRRPQMTKELISADTTRKWLLKFDDGHEAETVYIPDADEDRGAVCISTQVGCTLTCRFCHTGTQLLVRNLTAAEIVGQFMVARDSYGEWPTPDDGGRQLSNIVVMGMGEPLYNFENVATALEIAMDGEGIGISKRRITLSTSGVVPMMKICGERLGVNLAVSLHAVTDEIRDRIMPINKKYPLKELMQACRDYPGASNARRITFEYIMLKGVNDSAADARALLKLIKGLPAKFNLIPFNPWPGSEFETPDIKTTKAFSDILQDAGYSAPIRMPRGRDILAACGQLRSESQREKASRAKARAAQGIIDEHHG

SEQ ID NO: 37066 - protein, 1501 aa, Saccharomyces cerevisiae
MSNIKSTQDSSHNAVARSSSASFAASEESFTGITHDKDEQSDTPADKLTKMLTGPARDTASQISATVSEMAPDVVSKEESFADALSRHTTRSGAFNMDSDSDDGFDAHAIFESFVRDADEQGIHIRKAGVTIEDVSAKGVDASALEGATFGNILCLPLTIFKGIKAKRHQKMRQIISNVNALAEAGEMILVLGRPGAGCSSFLKVTAGEIDQFAGGVSGEVAYDGIPQEEMMKRYKADVIYNGELDVHFPYLTVKQTLDFAIACKTPALRVNNVSKKEYIASRRDLYATIFGLRHTYNTKVGNDFVRGVSGGERKRVSIAEALAAKGSIYCWDNATRGLDASTALEYAKAIRIMTNLLKSTAFVTIYQASENIYETFDKVTVLYSGKQIYFGLIHEAKPYFAKMGYLCPPRQATAEFLTALTDPNGFHLIKPGYENKVPRTAEEFETYWLNSPEFAQMKKDIAAYKEKVNTEKTKEVYDESMAQEKSKYTRKKSYYTVSYWEQVKLCTQRGFQRIYGNKSYTVINVCSAIIQSFITGSLFYNTPSSTSGAFSRGGVLYFALLYYSLMGLANISFEHRPILQKHKGYSLYHPSAEAIGSTLASFPFRMIGLTCFFIILFFLSGLHRTAGSFFTIYLFLTMCSEAINGLFEMVSSVCDTLSQANSISGILMMSISMYSTYMIQLPSMHPWFKWISYVLPIRYAFESMLNAEFHGRHMDCANTLVPSGGDYDNLSDDYKVCAFVGSKPGQSYVLGDDYLKNQFQYVYKHTWRNFGILWCFLLGYVVLKVIFTEYKRPVKGGGDALIFKKGSKRFIAHADEESPDNVNDIDAKEQFSSESSGANDEVFDDLEAKGVFIWKDVCFTIPYEGGKRMLLDNVSGYCIPGTMTALMGESGAGKTTLLNTLAQRNVGIITGDMLVNGRPIDASFERRTGYVQQQDIHIAELTVRESLQFSARMRRPQHLPDSEKMDYVEKIIRVLGMEEYAEALVGEVGCGLNVEQRKKLSIGVELVAKPDLLLFLDEPTSGLDSQSSWAIIQLLRKLSKAGQSILCTIHQPSATLFEEFDRLLLLRKGGQTVYFGDIGKNSATILNYFERNGARKCDSSENPAEYILEAIGAGATASVKEDWHEKWLNSVEFEQTKEKVQDLINDLSKQETKSEVGDKPSKYATSYAYQFRYVLIRTSTSFWRSLNYIMSKMMLMLVGGLYIGFTFFNVGKSYVGLQNAMFAAFISIILSAPAMNQIQGRAIASRELFEVRESQSNMFHWSLVLITQYLSELPYHLFFSTIFFVSSYFPLRIFFEASRSAVYFLNYCIMFQLYYVGLGLMILYMSPNLPSANVILGLCLSFMLSFCGVTQPVSLMPGFWTFMWKASPYTYFVQNLVGIMLHKKPVVCKKKELNYFNPPNGSTCGEYMKPFLEKATGYIENPDATSDCAYCIYEVGDNYLTHISSKYSYLWRNFGIFWIYIFFNIIAMVCVYYLFHVRQSSFLSPVSILNKIKNIRKKKQ

SEQ ID NO: 37067 - protein, 354 aa, Ostreococcus tauri
MFGRFGAPRGFTASYRVYPVSFIDRPQVELGDKAIMPPSALERLTRMQIDEFPMTFEVENAKRGRKTHCGVLEFVADEGVVYLPYWMMQNLLLEEGDVVKFTYASPPKGTYVKLQPQTKDFLDISNPKAVLEMTLRNYTCLTVGDTFVIHYNNKKYYMDVVEAKPGDAIGVVDTDCEVDFAPPLDYVDPYGPDNTKFEDTNSGAINAPKKEEVAGDDAGASTSGAETSVEPKTKTFLAFAGGGRRLDGKSISEIAPVEVEIPTTSLRVTKEWQQLRQGGVLGGETSKEPEQPNPDGDIDRKRSGKVVFGGARAAAIARKKEKAAAAKKDDAPEKSDAKPTSSFEAFKGTGNKLR

SEQ ID NO: 37068 - protein, 184 aa, Zea mays
MALLRPHLHRFHSNALHQSAPHTKSTADAGGGLVVYPTYGRRRRHRCSAIAIDAPSSLAGVTPIRWGYTSVQGFREEMEDDIVIRSEALDSFSFAAVFDGHAGSSSVKFLREELYKGCVEALQVGSLLKGGDFGAIKGALVKAFESVDQSLLKWLETKGEEDESGSTATVMLIRNDVSYLHILG

SEQ ID NO: 37069 - protein, 564 aa, Ostreococcus tauri
MRHDEELRARFPDAALDDSTMVDDVSIALVRAAIKATTSGRGTVACAARRLETDADRALAAADEKDSARSSISADGSVSREAHELAMLTAAIARSGIRTKGDVSYRIVCASADSRGTLAQSSTAIEQCSMTVRDANCCVDVAGWTLCFFTATGWEGEGENDLEAALQDALDADKVFNQLGKRTRTVVHRRSRLKHEGSPTTSNGDGASRVALRRMNSAEAGESSELSEDDSFNGSRERETSSVERVGSPSLDDCTNIVSDINGRELNIGEKVSSGSFGALYRGTYSTRSDDGTLNRRVVALKYLKSVDNGGNFDARRDFFQEVRILRKINHENVIGYVGSVIEGQDLCLITEFAGNGNLIDYMAAKNRPFGTREVARITLGIARGMNFIHEGLKMMHRDLKASNVLLDDSLTPKICDFGLARVMAKNPGQMTAETGTYRWMAPEVIGHMQYDYSADVYSFAILFWEILTGGQVPFAELNPLQAAVAVVQRGMRPEIPRNCDPYLVEIMRKCWKTAPSARPTFRVLVAMFEAYLDVLPEREQAEEKKQRPFSKFFRWKQKKKSCN

SEQ ID NO: 37070 - protein, 309 aa, Salmonella enterica subsp. enterica serovar Typhi str. CT18
MTTKKADYIWFNGEMVRWEDAKVHVMSHALHYGTSVFEGIRCYDSHKGPVVFRHREHMQRLRDSAKIYRFPVSQSIDELMEACRDVIRKNNLTSAYIRPLVFVGDVGMGVNPPPGYTTDVIIAAFPWGAYLGAEALDQGIDAMVSSWNRAAPNTIPTAAKAGGNYLSSLLVGSEARRHGYQEGIALDVNGYISEGAGENLFEVKDGVLFTPPFTSSALPGITRDAIIKLAKELGIEVREQVLSRESLYLADEVFMSGTAAEITPVRSVDGIQVGEGRCGPVTKRIQQAFFGLFTGETEDKWGWLDPVNS

SEQ ID NO: 37071 - protein, 392 aa, Hyphomonas neptunium ATCC 15444
MDDRKFTLNFGPQHPAAHGVLRMILDLDGEIVTRVDSHIGLLHRGTEKLLEYKTYLQGMPYFDRLDYCAPMNQEHAWCLAIEKLLGVEVPRRASIIRVMYSEIGRIMSHLLNVGTGVMDVGALTPITWCFEEREKLCVFYERASGSRMHAAYFRPGGVHQDLPQRLIDDIATWCDQFPGKLDQIEGLVTENRIFKQRNVDIGVVDQRTILDWGFSGVMVRGSGLAWDLRRSQPYECYSELDFKVPVGRHGDNYDRYVCRMDEMRESVKIILQCIDLMAKDGPGPVLLAGSKLSPPRRADMKNSMEALIHHFKLYTEGFHVPEGECYAAVEAPKGEFGVYLVADGTNRPYRAKIRAPGYPHLQAMDYLCKGHQLADVSAVLGTLDIVFGEIDR

SEQ ID NO: 37072 - protein, 263 aa, Arabidopsis thaliana
MNSCQQKAMEKLLHGHGCANQLLIMDQTESDSSMEREDLAKSVLHCFSDALSILIDTNDHQDDQSNNSSPQDSSPVLESSRKPLHKRGRKTSMAESSDYHRHESSTPIYHDGFLWRKYGQKQIKESEYQRSYYKCAYTKDQNCEAKKQVQKIQHNPPLYSTTYFGQHICQLHQAYATFPIDTSDFEEHEGSHMIRFGHPNISFSSSTSNLRQHQNHQDRIKDEYMKPVIAEDWSPSQWMSSEVALAVEAFEFNPFWTSHDLSS

SEQ ID NO: 37073 - protein, 218 aa, Streptococcus pyogenes M1 GAS
MLMIKGIIFDMDGVLFDTEPFYLRRREDFFKTKGIPIDHLNSKDFIGGNLQELWKELLGKNRDDAIVKAITTDYDAYKQAHKPPYQKLLITEVNSCLEQLEKQGIKLAVASNSKRQDVLLALETTQIKDYFEIILAREDVSRGKPYPDIYNKAVQKLGLQKKQLLVVEDSQKGIAAAKAANLTVFAITDYRYGIDQSQADHKIDHLGQLCVKIGCFGS

SEQ ID NO: 37074 - protein, 548 aa, Hypocrea jecorina
MPIGNIYVIAGVSVVGGALFGFDISSVSAQLAEQSYLCYFNQDENPPTTVDGTCGGPRSLVQGGITASMAAGSWLGALISGPLSDRLGRKYSIMVGCIIWVIGSTLSCASQNIGMLIVARIINGLSVGIESAQVPVYIAEISPPSKRGRFIGMQQWAITWGILIMYYISYGCSFIGKQNPLEYNTASWRIPWGLQMIPAFFLFFMMMPLPESPRWLARKDRWEDCRAVLTLVHGKGDPNHPFVAYELQDIKDMCEFERRHADVTYLDLFKPNMLNRTFIGLFTQIWSQLTGMNVMMYYIANIFSMAGYSGNANLLASSIQYIINVLMTIPALLWVDKWGRRPTLLVGSVLMALWMYANAGILATYGEVVPGGIDHVAAQSMRVSGAPAKGLIACTYLFVASFAPTWGPVSWTYPPELFPLRLRGKGVALATSGNWAFNTALGLFTPVAFANIKWKSYLIFAIFNTVAFFHVFFVFPETAGKTLEETEAMFEDPNGIKYLGTPAWKTRVATSLTERAEHGDIEAKIGHDTEKPPVHTHEEEKASTPPPQ

SEQ ID NO: 37075 - protein, 366 aa, Bacillus caldotenax
MGNYRIAVLPGDGIGKEVTSGAVEVLKAVGIRFGHEFTFEYGLIGGAAIDEAGTPLPEETVRLCRESDAVLLGAVGGPKWDDNPPHLRPEKGLLAIRKQLDLYANLRPVVCYDSLVSRSPLKPDLVQGVDFVIVRELTGGIYFGQPSAVVENGEEKAVDTLLYKKEEIERIVRMAFELARGRRKKVTSVDKANVLSSSRLWREVAEEVANEFPDVTLEHMLVDMRMQLIRAPKQFDVIVTENMFGDILSDEASMLSGSLGMLPSASLSASGPSLYEPVHGSAPDIAGMNKANPIAAILSAAMMLRLSFGLTAEAGGRARVWQALALGSGSRLGQRRPHLSTNEMVEEIKAAVLDYTAIAQIMTVYA

SEQ ID NO: 37076 - protein, 166 aa, Zea mays
NSLGWAPPYGFHCVGQDMFSSLKSKAKQMATSFNMSNFANREDLLGQSKKADDMSRVVGLDNQGIVVLQRQIMKEQDEGLEKLEETVLSTKHIALAVNEELTLHTRLIDDLEDHVDVTNSRLQRVQKRLAILSKRTKGGCSCMCLLLSVVAIVILAVIVWLLVKYL

SEQ ID NO: 37077 - protein, 366 aa, Bacillus coagulans
MKMKLAVLPGDGIGPEVMDAAIRVLKTVLDNDGHEAVFENALIGGAAIDEAGTPLPEETLDICRRSDAILLGAVGGPKWDHNPASLRPEKGLLGLRKEMGLFANLRPVKAYATLLNASPLKRERVENVDLVIVRELTGGLYFGRPSERRGPGENEVVDTLAYTREEIERIIEKAFQLAQIRRKKLASVDKANVLESSRMWREIAEETAKKYPDVELSHMLVDSTSMQLIANPGQFDVIVTENMFGDILSDEASVITGSLGMLPSASLRSDRFGMYEPVHGSAPDIAGQGKANPLGTVLSAALMLRYSFGLEKEAAAIEKAVDDVLQDGYCTGDLQVANGKVVSTIELTDRLIEKLNNSAARPRIFQ

SEQ ID NO: 37078 - protein, 335 aa, Streptomyces avermitilis MA-4680
MTIRVGINGFGRIGRNYFRALLEQGADIEIVAVNDLGDTATTAHLLKYDTILGRLKAEVTHTADTITVDGKTIKVFSERNPADIPWGELNVDIVIESTGIFTKKADAEKHIAGGAKKVLISAPASDEDITIVLGVNEDKYDPAKHNVISNASCTTNCVAPMAKVLDENFGIVKGLMTTIHAYTNDQRILDFPHKDLRRARAAAENIIPTTTGAAKATALVLPQLKGKMDGISMRVPVPTGSATDLVVEVSREVTKDEVNAAFKKAAEGELQGYLSYTEDPIVSSDIVGDPSSCTFDSAMTMVMEGTSVKILGWYDNEWGYSNRLVDLTVFVGNQL

SEQ ID NO: 37079 - protein, 403 aa, Streptomyces avermitilis MA-4680
MKTIDELLAEGVDGKRVFVRADLNVPLADGLITDDGRIRAVLPTVKALAEAGAKVVVASHLGRPKGAPDPAFSLLPAAERLGELLGAPVAFAQDTVGPAAHDAVNGLQPGQVAVIENLRFNAGETSKDDAERGAFADRLAALADIYVGDGFGAVHRKHASVYDLPARLPHYAGYLIATEVNVLKKLTEDVKRPYVVALGGAKVSDKLAVIDQLLGKADRLLIGGGMAYTFLKAKGYEVGISLLQEDQIPTVKEYMERAEKNGVELVLPVDVLVSTEFPDLKTKAPANPTTVAADAIPADQEGLDIGPETRKLYASKLADAATVFWNGPMGVFEHPDYAEGTKAVAQALVDSQAFTVVGGGDSAAAVRILGFDETAFGHISTGGGASLEYLEGKTLPGLAALED

SEQ ID NO: 37080 - protein, 475 aa, Pseudomonas aeruginosa PAO1
MSKVVLASQLPNKRNASLAPGLKQRHVTMLSIAGVIGAGLFVGSGHAIAAAGPAALLAYLIAGTLVVLVMRMLGEMAVASPDTGSFSTYADRSIGRWAGFTIGWLYWWFWVLVIPLEAIAAAAILNAWFPAIDTWIFALAVTFLLTVTNLFSVARYGEFEFWFALLKVIAIIAFIVLGAVAIVGGLPEREVSGLSSLMASHGGFVPNGYGAVLGALLTTMFSFMGTEIVTIAAAESKDPAKQITRATNSVIWRIGLFYLVSIFIVISIVPWNDPLLIQVGSYQRALELLDIPHAKLIVDLVVLVAVASCLNSAIYTSSRMVFSLAKRGDAPSVLKLTNTAHVPRPAVLASTAVGFLTTIVNYFAPEKVFTFLLASSGAVALLVYLVIAVAQLRMRKQLQASGQPIEFRMWLYPWLTWAVILFIVAALSIMLIMPEHRHEVFATALLTIFTVCLGLLNARRKPRLGEDYAGKTARV

SEQ ID NO: 37081 - protein, 461 aa, Coccidioides immitis RS
MAVDLYLVSLAAWVLANATIAFRRWDGKRSDVKISDTVRNAANQTELNLKYTYFVVYILVVASDWLQGPYLYPLYKQTLQLPENIVAALFSTGFVSGALSATFVGSLADRYGRRKACLFFCVIYSLSCLLTVSPSSVYLLFLGRLLGGIGTTLLFTVFETWLVAEFHRLELEKEGAELNDLLGTMTILNTIVAVASGLLSELLVGWTESKRSPFLASIFCLGLAFFAILRKWGENYGDEKVLKGDSSATHLMDGISAVIKDGRVLTLGIASTIFEGTMYLFVVFWSPAIISAERAADTSVPQNPPFGLIFASFMAAMMFGSQVFAYLMRPSSSQLPLEQGNSPPPALVRSSCLLKVLLPVASSCLSWSVLCPTRTSTLWAFCLYEMTIGVYFPSMGVLKSVLVDDRHRASIYALFRVPLNIFVVAGLALTKEGEGYRNTVFLSCSALLLAAMGFAHLFLKH

SEQ ID NO: 37082 - protein, 91 aa, Synechococcus sp. WH 5701
MGATADLRMAVKKAGPVVTDQGNLVLDLKFAGGITDPAALEQAINNLPGVLENGLFVGLTDPVAGAVADERPLRSDHIGCDGTGEGHERFG

SEQ ID NO: 37083 - protein, 73 aa, Triticum aestivum
ICQVLDQRGVGELVKIATERGRKARPNLKVGICGEHGGEPSSVAFFAKAGLDYVSCSPFRVPIARLAAAQVLV

SEQ ID NO: 37084 - protein, 397 aa, Streptococcus pyogenes M1 GAS
MPKLSKRVLEMKESVTLAAGARAKALKAQGRDVLNLTLGEPDFFTPKHIQDKAIESIQNGTASFYTNASGLPELKAAIATYLKNQYGYHLSPDQIVAGTGAKFILYAFFMAVLNPGDQVLIPTPYWVSYSDQVKMAEGQPIFVQGLEENQFKVTVDQLERARTSKTKVVLINSPSNPTGMIYGAEELRAIGEWAVHNDILILADDIYGSLVYNGNQFVPISTLSEAIRRQTITVNGVAKSYAMTGWRVGFAAGEPEIISAMSKIIGQTTSNLTTVSQYAAIEAFCGSQSSLEEMRLAFEERLNITYPLLCQVPGFEVVKPQGAFYFFPNVKKAMEMTGFSDVTSFANAILEEVGLAVVSGAGFGAPENVRLSYATDIETLKEAVRRLHVFMESNEIN

SEQ ID NO: 37085 - protein, 172 aa, Triticum aestivum
VTFRPAVYKKAGTTRPEFPGYRRPTRPHGFHTKEPNPDVRRHEREGLPKAGTALFDGIEEGGIRASAYSSHEIDEHENERAMDGLQDRVSILKRISGVIFEEVEAHNRMLDILAPALDGGGGFLSGTVDKFKTVFETTSSRRMGTLVASFVPLFMLVYYLTRHKGPWVASSS

SEQ ID NO: 37086 - protein, 497 aa, Oryza sativa
  misc_feature (158)..(158): Xaa can be any naturally occurring amino acid
  misc_feature (167)..(167): Xaa can be any naturally occurring amino acid
MTSVQLETPHSGKYGQPTGLFINNEFVKGQEGKTFDVINPSDESVITQVHEATEKDVDIAVAAARKAFEGSWRQETPENRGKLLTNLANLFEKNIDLLAAVESLDNGKAISMAKVDISMCVGCLRYYGGWADKITGKVIDTTPDTFNYVKKEPIGVCXSDHSLELPXLLMWAWKIGPAIACGNTVVLKTAEQTPLGGLVAARLVKEAGFPPGVINVISGFGKVAGAALSSHMDVDKVAFTGSTVVGRTILKAAAASNLKKVTLELGGKSPNIVFEDADIDNAISWVNFGIFFNHGQCCCAGSRVYVQESIYDKFVQKSKERAQKNVVGDPFAADTFQGPQVSKVQFDRIMEYIQAGKDAGATIETGGKRKGDKGYFIEPTIFSNVTEDMKIVKEEIFGPVCSIAKFKTKEDAIKLGNASTYGLAAAVHTKNLNTAIEVSNALRAGTVWVNTYNTLHHQMPFGGYKESGIGRELGEDALANYTQTKTVSIRLGDALFG

SEQ ID NO: 37087 - protein, 131 aa, Glycine max
QFSCIFLLGLGLGDILKPDLIMPLMDMLPLEQRLAPYLPEGKWSPEEILELLQSPPFRQQVDSFTYVLRTGQIDLSQFGIDPSKYKFTVLSFLEALEDSVSKSVESEEARQDDQDLRSQSCNRHDPMDESQ

SEQ ID NO: 37088 - protein, 193 aa, Arabidopsis thaliana
MGGPGSSPCASCKLLRRRCAKDCILAPYFPPDDPHKFAIVHKVFGASNVSKMLQELPVHQRADAVNSLVFEANARVRDPVYGCVGAISYLQNQVSQLQMQLAVAQAEILCIQMQNEPTLQSHHQVLELDQDHKALLLNNNNINNCNTNNNNNNFGYAMSSGQFNSNFASPSSIMQMQMQMQMQDPLKQESLWT

SEQ ID NO: 37089 - protein, 443 aa, Burkholderia vietnamiensis G4
MPVRDFYPCASCEPPATAASGALSRQPAHVQREAPFPIHYFNLSTMSQVKRLTDLIAAGQLAGKRVFIRADLNVPQDDHGNITEDTRVRASVPAIRAALDAGAAVMVTSHLGRPTEGEFKPEDSLAPVAKRLAELLGRDVPLVSNWVENGVNVAPGQVVLLENCRVNKGEKKNSDELAQKMAKLCDIYVNDAFGTAHRAEATTHGIAKYAPVACAGPLLAAELDALGKALGNPARPLVAIVAGSKVSTKLTILKSLAGKVDQLIVGGGIANTFMLAAGLSIGKSLAEADLVAEAKAIIDEARERGASVPIPTDVVTAKEFSPTAAATVKQVADIEADDMILDIGPDTARALASQLEKAGTIVWNGPVGVFEFDQFGNGTKTLADAIAKSSAFSIAGGGDTLAAIAKYGIHDQVSYISTGGGAFLEFLEGKKLPAVEVLETRAA

SEQ ID NO: 37090 - protein, 221 aa, Helicobacter pylori 26695
MKAFLGALEFQENEYEELKELYESLKTKQKPHTLFISCVDSRVVPNLITGTKPGELYVICNMGNVNPPKTSYKESLSTIASIEYAIAHVGVQNLIICGHSDCGACGSVHLIHDETTKAKTPYIANWIQFLEPVKEELKNHPQFSNHFAKRSWLTERLNARLQLNNLLSYDFIQEKASKNELKIFGWHYIIETGRIYNYNFESHFFEPIGETIKQRKSHENF

SEQ ID NO: 37091 - protein, 158 aa, Triticum aestivum
RSAGDFGAGAFVGGVVGYGQGLITKKGFKGSLSNAGSAAKTFAVLSRAPGFIVCLLKKLRGKDDLVNSGIAGCCTGLALSFPGTPQALLQSCATFAAFSCIMEGLNKQQAAMAHTLRGNALTFAHEKGGVLPPFMLPPILDASDALASCCQTLVKPKH

SEQ ID NO: 37092 - protein, 258 aa, Streptomyces avermitilis MA-4680
MTSRMPLMAGNWKMNLNHLEAIAHVQKLAFALADKDYEACEVAVLPPYTDLRSVQTLVDGDKLKIKYGAQDVSAHDSGAYTGEISGSMLAKLKCTYVAVGHSERRQYHHETDEIVNAKVKASFRHGLIPILCVGEELEVREAGNHVTHTLTQVEGGLKDVPAEQAETIVIAYEPVWAIGTGKVCGADDAQEVCAAIRAKLAELYSQELADQVRIQYGGSVKSGNVAEIMAKPDIDGALVGGASLDADEFVKIARFRDQ

SEQ ID NO: 37093 - protein, 586 aa, Triticum aestivum
MDSTDQFDNSPLLDGDGSSQENTTEYTGDGSVCISGHPASRKHTGNWKASFLIIVCSFCCYLAYSSIGKNLVSYLTKVLHETNLDAARHVATWQGTSYLAPLVGAFVADSYLGKYRTALIACKIFIIGMMMLLLSAALQLISAGPHAWTVWVHLVSSQYTIFLIGLYMVGLGYGAQRPCVTSFGADQFDDTDYVEKTRKSSFFNWHYFAINAGSLIAGTVIVWVQEHEGWLWGFTISTLFVTLGVCIFFLGSIVYRFQKPRGSPLTRLCQVVIAATRNFDKVLPCDSSALYEFMGQGSAIEGRRKLEHTTGLGFFDKAAIVTLPDCESPGQHNKWKICTVTQVEELKILIRMFPIWSAMILFAAVQEQMSSTFVEQGMAMDKHIGSFEIPSASFQCVDTITVIVLVPIYERLIVPVIRKFTGRANGITSPQRIGIGLCFSMFSMVSAALVEGNRLQIAQAEGLVHRKVAVPMSIMWQGPQYFLLGVAEVFSNIGLTEAFYDESPDGMRSLCMAFSLVNMSAGNYLSSLILSLVPVFTARGGSPGWIPDNLNEGHLDRFYLMMAGLSFFNIVVFVFCAMRYKCKKAS

SEQ ID NO: 37094 - protein, 448 aa, Pseudomonas aeruginosa PAO1
MNQPLNVAPPVSSELNLRAHWMPFSANRNFQKDPRIIVAAEGSWLTDDKGRKVYDSLSGLWTCGAGHSRKEIQEAVARQLGTLDYSPGFQYGHPLSFQLAEKIAGLLPGELNHVFFTGSGSECADTSIKMARAYWRLKGQPQKTKLIGRARGYHGVNVAGTSLGGIGGNRKMFGQLMDVDHLPHTLQPGMAFTRGMAQTGGVELANELLKLIELHDASNIAAVIVEPMSGSAGVLVPPVGYLQRLREICDQHNILLIFDEVITAFGRLGTYSGAEYFGVTPDLMNVAKQVTNGAVPMGAVIASSEIYDTFMNQALPEHAVEFSHGYTYSAHPVACAAGLAALDILARDNLVQQSAELAPHFEKGLHGLQGAKNVIDIRNCGLAGAIQIAPRDGDPTVRPFEAGMKLWQQGFYVRFGGDTLQFGPTFNARPEELDRLFDAVGEALNGIA

SEQ ID NO: 37095 - protein, 409 aa, Oryza sativa
  misc_feature (197)..(197): Xaa can be any naturally occurring amino acid
  misc_feature (282)..(282): Xaa can be any naturally occurring amino acid
MPLLLRCSPAASPPLLPRRRSGSLLSAAPPGRRPLLPAAAGRVVLGCGLVTLDYLATVDAYPRPDDKIRSGELQVSGGGNAGNALTGAARLGLNTRLISKVANDEIGGTVLSELKEAGIDISHVIISDGGNTTFVYVIIDKQTKTRTCIITSGYPPMIPSDLRMSSLSAALQDVSLLYLDGYSDEMALAVAKQKCTXADQMKIPILVDAEPERTREELGGLLSLASYIVCNGKFPEKWTSVPSIPSALLEILLQYPRACFAVVTLGENGCMMLERGKDVPLXEIGENYETEPVDIENVAESLRLKVDKDDILPTCVSSKFMRLTARGSGNIFARLLIGTAESIPASELVDTTGCGDAFIGAVLHGLSTEMPPEKMLPFACQVAGIKCRAIGARSGLPWQSDPRLTKYLC

SEQ ID NO: 37096 - protein, 550 aa, Streptomyces avermitilis MA-4680
MNADSRTRLNQRPEWTALAKHREELAGTHLRDLFAADPGRGAGYTLEVGDLHVDYSKHLVTDETLRLLRELAAATDVFGLRDAMFRGEKINVTEDRAVLHTALRAPRDAVVEVDGENVVPAVHAVLDKMSTFAERVRTGEWTGHTGKPIKNIVNVGIGGSDLGPAMAYEVLRSFTDRSLTVRFVSNVDGADLHEAVRDLDPAETLFVIASKTFTTIETITNATSARDWLLTELKAGQEAVAKHFVALSTNAEKVSEFGIDTANMFEFWDWVGGRYSFDSAIGLSLMIAIGPERFREMLDGFRIVDEHFESAPAEDNVPLLLGLLGIWYGNFHDAQSHAVLPYSHYLSKFTAYLQQLDMESNGKSVQRDGNPVEWETGPVVWGTPGTNGQHAYYQLIHQGTKLIPADFIGFAEPVADLLPGLVAQHDLLMANFFAQTQALAFGKTPDEVRAEGVPEQLVPHKTFKGNHPTTTILAKELTPSVLGQLIALYEHKVFVQGAVWNIDSFDQWGVELGKVLAKRVEPALTEGADVPGLDESTKALVAKYRQLRGR

SEQ ID NO: 37097 - protein, 394 aa, Synechococcus sp. RS9916
MTQLETRTEPMVVNFGPHHPSMHGVLRLVVTLDGEDVVDCEPVIGYLHRGMEKIAENRTNVMFVPYVSRMDYAAGMFYEAIVVNAPERLADIPVPKRASYIRVLMLELNRIANHLLWLGPFLADVGAQTPFFYIFREREMIYDLWEAATGQRLINNNYFRIGGVAADLPYGWLEKCRDFCDWFGPKIDEYEKLISNNPIFRRRIEGLGAISRDEAINWSLSGPMLRASGVPWDLRKVDHYECYDDFDWNVAWEKEGDCFARYRVRIEEMRQSLKILRQACDMIPGGPTENLEARRMAEGKKSEFAGFDYQYVAKKVAPTFKIPNGELYTRLESGKGEIGVFIQGNNDVTPWRFKIRAADSNNLQILPHILKGHKVADIMAILGSIDVIMGSVDR

SEQ ID NO: 37098 - protein, 246 aa, Pseudomonas syringae pv. syringae B728a
MTDIGKQHSATSSSTSSHSDSADVALKHIVDGFVHFRKEVFPQQEELFKKLATAQSPRAMFITCADSRIVPELITQSSPGDLFVTRNVGNVVPPYGQMNGGVSTALEYAVVALGVQHIIVCGHSDCGAMRAVLNPDSLDKMPTVKAWLRHAEVARTVVEQNCSCSGELETMQVLTQENVISQLQHLRTHPSVAAKMASGQLFIHGWVYSIETSEILAYDAELDRFIPLDGTGPTPMASPKARFSAD

SEQ ID NO: 37099 - protein, 525 aa, Escherichia coli K12; identical to SEQ ID NO: 1491

SEQ ID NO: 37100 - protein, 272 aa, Staphylococcus epidermidis ATCC 12228
MERLENKIAVITGASTGIGQASAVALAIEGAHVLALDISDQLEETVQSINDNGGKATAYRVDISDDKQVKQFSEKIAQEFGHVDVIFNNAGVDNGAGRIHEYPVEVFDKIMAVDMRGTFLVTKFLLPLMMKQGGSIINTASFSGQAADLYRSGYNAAKGGVINFTKSIAIEYGRENIRANAIAPGTIETPLVDNLAGTSDEEAGQTFRENQKWVTPLGRLGTPDEVGKLVAFLASDDSSFITGETIRIDGGVMAYTWPGEMLSDESWKNSTK

SEQ ID NO: 37101 - protein, 702 aa, Rhodospirillum rubrum
MAGIYLFVVAAALAALGYGALTIKTIMAADAGTARMQEISGAVQEGASAFLNRQYKTIAVVGAVVFVILTALLGISVGFGFLIGAVCSGIAGYVGMYISVRANVRVAAGAQQGLARGLELAFQSGAVTGMLVAGLALLSVAFYYILLVGIGATGRALIDPLVALGFGASLISIFARLGGGIFTKCADVGADLVGKVEAGIPEDDPRNPAVIADNVGDNVGDCAGMAADLFETYAVTVVATMVLASIFFAGVPAMTSMMAYPLAIGGVCILASILGTKFVKLGPKNNIMGALYRGFLVSAGASFVGIILATAIVPGFGDIQGANGVLYSGFDLFLCAVIGLLVTGLLIWVTEYYTGTNFRPVRSVAKASTTGHGTNVIQGLAISMEATALPALIICAAIITTYQLSGLFGIAITVTSMLALAGMVVALDAYGPVTDNAGGIAEMANLPEDVRKTTDALDAVGNTTKAVTKGYAIGSSGLGALVLFAAYTEDLAFFKANVDAYPAFAGVDVNFSLSSPYVVVGLFIGGLLPYLFGSMGMTAVGRAAGSVVEEVRRQFREIPGIMEGTAKPEYGRCVDMLTKAAIKEMIIPSLLPVLAPIVLYFVILGIADKSAAFSALGAMLLGVIVTGLFVAISMTAGGGAWDNAKKYIEDGHYGGKGSEAHKAAVTGDTVGDPYKDTAGPAVNPMIKITNIVALLLLAVLAH

SEQ ID NO: 37102 - protein, 363 aa, Coccidioides immitis RS
MFQGGYYEDNDPMDGVFHPGLMRRAGHAARRFDEYYRCYPVAMMPGPEREAANHGGKVFMPASALDKLTRLHITYPMLFEVHNGAKQRMTHAGVLEFIAEEGKIYLPFWMMQTLLLEPGDLLQIKSTDLPLGRLIKLQAQSTSFLDISDPKAVLENAFRNFSCLTKGDVFTFSYNDQTYEMAVLETKPENPENAISVLETDLEVDFAPPLGYEEPKRPSGTSTPSSMTSAGLPLGGMLHPHGTMAQSINYAAIAPESTDAARGAKAVSSNFLHGGQRLNAKKGSKQPTPKASTPVSGVSTNAQPPAPVRRTNGPQPLRLPPGKLFFGYAIKPVQKSNENGQKEGEKHTSFLGAGQSLRGSKKK

SEQ ID NO: 37103 - protein, 1101 aa, Medicago truncatula
MEGFGMNSDLSRTGAVERDIEQAITALKKGACLLKYGRRGKPKFCPFRLSNDESVLIWFSGKEEKHLKLSHVSRIISGQRTPIFQRYPRPEKEYQSFSLIYNDRSLDLICKDKDEAEVWFSGLKALISRSHHRKWRTESRSDGIPSEANSPRTYTRRSSPLHSPFGSNESSQKDSGDHLRLHSPYESPPKNGLDKALDVVLYAVPQKSFFPLDSASASVHSISSGGSDSMHGHMKTMGMDAFRVSLSSAVSSSSQGSGHDDGDALGDVFIWGEGTGDGVVGGGNHRVGSGLGVKIDSLFPKALESAVVLDVQNIACGGRHAALVTKQGEIFSWGEESGGRLGHGVDSDVLHPKLIDALSNTNIELVACGEYHTCAVTLSGDLYTWGNGAYNYGLLGHGNQVSHWVPKRVNGPLEGIHVSYISCGPWHTAVVTSAGQLFTFGDGTFGALGHGDRKSVSLPREVESLKGLRTMRASCGVWHTAAVVEVMVGNSSSSNCSSGKLFTWGDGDKGRLGHGDKEAKLVPTCVALVEHNFCQVACGHSLTVALTTSGHVYAMGSPVYGQLGNPQADGKLPTRVEGKLLKSFVEEIACGAYHVAVLTLRNEVYTWGKGANGRLGHGDTDDRNNPTLVDALKDKHVKSIACGTNFTAAICLHKWVSGVDQSMCSGCRLPFNFKRKRHNCYNCGLVFCHSCSSKKSLKASMAPNPNKPYRVCDGCFNKLRKTLETDSSSHSSVSRRGSINQGSLELIDKDDKLDTRSRNQLARFSSMESFKQVESRSSKKNKKLEFNSSRVSPVPNGGSQRGALNISKSFNPVFGSSKKFFSASVPGSRIVSRATSPISRRPSPPRSTTPTPTLGGLTTPKIVVDDAKKTNDSLSQEVIKLRSQVESLTRKAQLQEIELERTSKQLKDAIAIAGEETAKCKAAKEVIKSLTAQLKDMAERLPVGTAKSVKSPSIASFGSNELSFAAIDRLNIQATSPEADLTGSNTQLLSNGSSTVSNRSTGQNKQSQSDSTNRNGSRTKDSESRSETEWVEQDEPGVYITLTSLPGGVIDLKRVRFSRKRFSEKQAENWWAENRVRVYEQYNVRMVDKSSVGVGSEDLAN

SEQ ID NO: 37104 - protein, 399 aa, Agrobacterium tumefaciens str. C58
MAEAAAPLFDTFARAPLRFERGEGVWLFTESGERYLDFAAGVAVNSLGHAHPHLVEAIKTQAEKVWHVSNLYEVPGQEKLAKRLTEATFADKVFFTNSGAEALECAIKTARRYHYSKGHPEKFRIITFEGAFHGRTLATIAAGGQQKYLEGFGPKVEGFDQVPFGDVDALKAAITAETAALLIEPIQGEGGIRAPAKEFLQLLRSLCDEHDLLLIFDEVQTGVGRTGKFFAYEQTGVAPDIMAVAKGIGGGFPLGACLATADAASGMTAGVHGTTYGGNPLAMAVGNAVLDVVLADGFLEKVRDVALVFRQGLASLKDRYPDVIEEIRGEGLLLGIKARVPSGELLQAMRAEHLLGVPAGDNVIRLLPPLVTTAEEAREGLARVEAAAASLTAKQAKIA

SEQ ID NO: 37105 - protein, 443 aa, Magnetospirillum magnetotacticum MS-1
MGLKTACIEKRGSLGGTCLNVGCIPSKALLAASHHYHAASHDLGAFGIKVSKVEIDVAGMMGHKDKVVSDNTKGIEFLFKKNKVTYIIGAGAITAPGQIEVTAKDGAKSTVAAKHIVIATGSEVTPLPGVEIDEEVIISSTGALALPKTPKHIVVIGGGVIGLELGTVWGRLGAKVTVVEFLDRILPFNDGEVSKTMQRLLAKQGMEFKLGTKVTAITRKGKTATITVEPAAGGAAEKIEADCVLVAIGRRPFTEGLGLDKVGVAIDKRGFVTIDGHFRTNVPGIYAIGDVVGGAMLAHKAEEEGVALAEILAGQHGHVNYEAIPAVVYTWPEVASVGKTEEQLKAEGIAYKAGKFPFTANGRARSMNEVDGFVKILACATTDKVLGAHIVGPNAGDLIAEVVLAMEFGAASEDIARTCHAHPGLGEAVKEACLAVDGRPLHT

SEQ ID NO: 37106 - protein, 394 aa, Agrobacterium tumefaciens str. C58
MSNKWRPATQLVHGGTLRSPYGETSEAIYLTQGFVYENSEAAEARFKGETDGFIYARYASPTNDMFEKRMCLLEGAEDARALASGMAAVTAAIMCQLRAGDHIVAARALFGSCRWVVETLAPKYGIECTLIDGRDLDNWEKAIQPNTKLFFLESPTNPTLEVVDIAGVAKLANQIGAKVVVDNVFATPLFQKPLELGAHIVVYSATKHIDGQGRCLGGVILSDKKWIEEELQDYFRHTGPAMSPFNAWTLLKGIETLPLRVKQQTENAAKIADFLADSGKVAKVIYPGRADHPQADIIARQMSGGSTLVAFELKGGKDAAFKLQNALEIVKISNNLGDAKSLITHPGTTTHKNLSDEARAELGISGGTLRLSCGIEDTDDLLEDLAKGLAAVSA

SEQ ID NO: 37107 - protein, 256 aa, Mesorhizobium loti MAFF303099
MTPGIRPLVAGNWKMNGTSASLNELRMIGNGFMSGLDAETEALVCVPATLLSHAAEILSRTPVHAGGEDCHTKESGAYTGCISAEMLKDAGASHVIVGHSECREQRGEDDATVQAKAAAAWRAGLVAIICIGETQQQREAGATLEVLSRQVAGSVPPSATPSNTVIAYEPVWAIGTGLTPTAADVAEAHAHIRERLSEKLGASAAKTRILYGGSVKPSNAVELLGVRNVDGALVGGASLKAADFLGIAEAYRSISG

SEQ ID NO: 37108 - protein, 233 aa, Triticum aestivum
  misc_feature (83)..(83): Xaa can be any naturally occurring amino acid
MEKAGHEHVIGIPVSSTAIGIEEPEFTSGDAKYSTSLRTGGKSGRRTGDKFARGIKEHVILGPKLYETVRGKLSLGARILQAXGGVEKVFQRWFSVEKGEKLLQASHCYLSTTAGPIAGMLFVSTEKVAFRSDRSLALTSPKGDTVRVPYKVAVPLRRVKAARPSENQHRPEQKYVQLVTDDGFEFWFMGFVSYQTSLQHLEQAIGAAGGGMKVQSSRGAGTGSGTRLRPTAA

SEQ ID NO: 37109 - protein, 143 aa, Magnetospirillum magnetotacticum MS-1
MSVESILKTKGSVVFTIRPEHSVADAAALLTNKKVGVAVVCDAKGKLQGVLSERDIVKGLAQYGKAALEMPVRNVMSSPVVTCTPGDSVKTIMGVMTERRIRHLPVLEKDELIGIVSIGDAVNFRLTEAQMEMNVLRDVAATR

SEQ ID NO: 37110 - protein, 492 aa, Zea mays
MTSLPERGESPVPPLDSLRQDSAVTVLAAAAVASSSAGSDRKEDSGSRQPKASILSGVFSPPFAIFEGQQQGSSSPACDARSTKSSSGSYGLSRILRRFVGSGSMWRLLGCGRVLTSSDVWFLGKCYKVSPEEEESGDSESDSGHAAFLEDFSSRIWITYRKGFDAISDSKLTSDVNWGCMVRSSQMLVAQALIFHHLGRSWRKPPEKPYNPDYIGVLHLFGDSEACAFSIHNLLQAGRNYGLAAGSWLGPYAMCRAWQTLIRTNREQADAVDGKENFPMALYVVSGDEDGERGGAPVVCIDVAAQLCSDFNKGPSTWSPILLLFPLVLGLDKINPRSIPLLKETFKFPQSLGILRGKPGTSTYIAGVHEDRALYLDPHEVQMSVDIALDNLEADTSSYHCSVVRALALEQIDPSLAIGFYCRDKDDFDGFFSRASELAEKANAVALVTVMQSIDPSNQMYKQDDGLGCSGSSMANDDDLDGSGEAEEWQIL

SEQ ID NO: 37111 - protein, 542 aa, Magnetospirillum magnetotacticum MS-1
MAAAKTIVTTPFSGQKPGTSGLRKKVKVFAQPHYLENFVQAVFDSIGEVTGKTLVVGGDGRYHNRTAIQTILKMAAANGFGKVMVGQGGILSTPAASCVIRKYQTFGGIILSASHNPGGPDEDFGIKYNIPAGGPAPESITEAIYARTEVITSYKITEAADVDLDSLGSRTLDGMEVQVFDPVADYAELMESLFDFGAIRAAFAGGLRMKFDAMHAVTGPYATEILERRLGAPKGTVMNGVPLEDFGHGHPDPNLVHAHDLVEALTGAGAPDFGAASDGDGDRNMILGRDFYVTPSDSLAVLAANATLCPGYAKGLKGIARSMPTSAAPDRVAAKLGIPSFETPTGWKFFGTLLDAGLATFCGEESFGTGSDHVREKDGLWAVLAWLNVLAVRKQSVADIVTAHWREYGRNVYSRHDYEGIDSAAAEGLMEHLRSLSLKGQKLGAYTVAFNDDFSYTDPVDGSVSKKQGIRVVFEDGSRVVFRLSGTGTEGATLRVYIERFEPDASKHHLDPQIALADLIKIARDLAEIEARTGRTEPTVIT

SEQ ID NO: 37112 - protein, 344 aa, Glycine max
MAGSNELNPNDSKMVVPLNMWVLISNFKLAYNLLRRPDGTFNRDLAEFLDRKVPANANPVDGVFSFDVIVDRETNLLTRIYRLAEGEERSVNILDLEKPVNSEVVPVIIFFHGGSFAHSSANSAIYDTLCRRLVGICKAVVVSVNYRRAPENRYPCAYDDGWTALKWVSSTSWLQSRKDKKVHIYMAGDSSGGNIVHHVALKAMESGIEVFGNILLNPLFGGQERTESEKRLDGRYFVGVKDRDWYWRAFLPEGEDRDHHACNPFGPKGKSLEGITFPKSLVVVAGLDLVQDWQLGYAKGLEKAGQEVKLLFLEQATVGFYLLPNNEHFSPVMDEIKYFVGSDC

SEQ ID NO: 37113 - protein, 579 aa, Kluyveromyces lactis NRRL Y-1140
MPENKFEVTEEYLDPQSMLELSMPGGASKLSVRQKLILKCRRAMRMRDTEKKGSSSTDPVQSQYSLSLSSAEDKKRGFFGSVQDVLRKYMRFVGPGLMVSVAYMDPGNYATDVSAGASNEFSLLCIVLVSNIIAIFLQSLCIKLGSVTGLDLSRACKKHLPKWLNLTIYVFAECAIIATDVAEVIGTAVALNILLRIPLPAGVVITCIDVLFVLIAYKPGSSSMRFVRMFEYAVALLVFGVVICFCVELAYIPKTPVGHIFRGFVPSKQMFEHNGMYTATSILGATVMPHSLFLGSGLVQPRLLEYDVDHGYYDLLAEEDEDNVIEETEDTHSAVKEKEDIEVIRERRYFNYQPTNSAIKYAMKYSIFELAITLFTFALFVNSAILIVAGATLYGSEEAVDADLYTIHSLLSKNLAPIAGTVFMLALLFSGQSAGIVCTIAGQIVCEGHLDWNFKPWKRRLITRGISIIPCLIISLTIGRSALSKALNASQVVLSILLPFLVAPLIFFTCKKSIMKVKVNNKDKLNAPTVIGEEEQPDEYIDMSNNWITTIIAFLVWIFISLLNVYTIVQLGISHGDIS

SEQ ID NO: 37114 - protein, 602 aa, Kluyveromyces lactis NRRL Y-1140
MSHDPNQQQPHGGSGQGHHQRQLTNHAQGQHIGKYQIIKTLGEGSFGKVKLAYHISTGQKVALKIINKKVLAKSDMQGRIEREISYLRLLRHPHIIKLYDVIKSKDEIIMVIEYAGNELFDYIVQRDKMPEQEARRFFQQIISAVDYCHRHKIVHRDLKPENLLLDEHLNVKIADFGLSNIMTDGNFLKTSCGSPNYAAPEVISGKLYAGPEVDVWSSGVILYVMLCRRLPFDDESIPVLFKNISNGVYTIPNFLSQGAASLIKKMLIVNPVNRITVHEIMQDEWFKVDLPDYLVPAESTHQENSESKTEDGGPSVPLELIDDSLVQTLSNTMGYDVDEIYEALESDEDHPSLNEIRDAYQLIKENRNLINDIKVNKQQSNDLDTFLSQSPPTFEQSLHAPPGSKNRHSHRHSKRTQQRTYQYHYGNGSQDGDSTIAILPSSLPQIHRANMVAQGSQAAAKISPLSVKKSKTRWHFGIRSRSYPLDVMGEIYIALKNLGAEWAKPSEEDLWTIRVRWRYNIDMPDDEMKNKQIPDLMKMVIQLFQIETNNYLVDFKFDGWESSNGVVYSSRNDDEMSTFSAYPFLHLATRLIMELAVNSQGS

SEQ ID NO: 37115 - protein, 695 aa, Streptomyces avermitilis MA-4680
MSTKPTTTDLEWTELDQRAVDTARVLAADAVQKVGNGHPGTAMSLAPAAYTLFQKVMRHDPADPDWVGRDRFVLSAGHSSLTLYTELYLAGFGLELDDLKSFRTWGSRTPGHPEYGHTPGVETTTGPLGQGVANAVGMAMASRYERGLFDPDAAPGTSPFDHFIYAIAGDGCLQEGISHEASSLAGHQKLGNLVLLWDDNHISIEGDTETAVSEDTVKRYEAYGWHVQRVAPKPDGDLDPHALYDAIQAAKAVTDKPSFIAMRSIIAWPAPHAQNTEAAHGSALGEDEVAATKRVLGFDPEKSFEVAEEVLAHTREALDRGREAKAEWEKGFAAWRTAQPERAAEYERIAATELPAGWEEKLPVFEVGKGIATRAASGKVLQALGAVIPELWGGSADLAGSNNTTIDKNSSFLPADNPLPEADPYGRTIHFGIREHSMAAEMNGIALHGNTRIYGGTFLVFSDYMRNAVRLSALMHLPVTYVWTHDSIGLGEDGPTHQPVEHLASLRAIPGLNVVRPADANETAIAWREILKRYTKVFGKGAPHGLALTRQGVPTYEPNEDAAKGGYVLFEAEGGAPEVILIGTGSEVHVAVEAREQLQAAGVPTRVVSMPSVEWFEEQDQGYRDSVLPPSVRARVAVEAGIGLTWHRFVGDAGRIVSLEHFGASADGKVLFREFGFTPENVADAARESIAAAQR

SEQ ID NO: 37116 - protein, 320 aa, Pseudomonas aeruginosa PAO1
MDRLPIIDIAPLYGADRGAWNDVARRIDQACREWGFFYIAGHPLPAARFEALLAAAREFFALPVEEKLKIDITRSRNHRGYGAIATEQLDPALPSDFKETFDMALHLPAEHPDVRAGKSFYGPNRHPDLPGWEALLEGHYADMLALARTVLRALAIALGIEEDFFDRRFEQPVSVFRLIHYPPASARQSADQPGAGAHTDYGCVTLLYQDAAGGLQVQNRQGEWIDAPPIDGTFVVNIGDMMARWSNDRYRSTPHRVISPRGVHRYSMPFFAEPHMDTEIRCLPGCFDADNPPKYPPTTCGDWLTSRFAQTYAYRRGETA

SEQ ID NO: 37117 - protein, 265 aa, Glycine max
  misc_feature (261)..(261): Xaa can be any naturally occurring amino acid
LRIIKPCNHVLSLSFPIRRDDGSWEVIEGYRAQHSQHRTPCKGGIRYSTDVSVDEVKALASLMTYKCAVVDVPFGGAKAGVKINPKNYTDNELEKITRRFTMELAKKGFIGPGIDVPAPDMSTGEREMSWIADTYASTIGHYDINAHACVTGKPISQGGIHGRISATGRGVFHGIENFINEASYMSILGMTPGFGDKTFVVQGFGNVGLHSMRYLHRFGAKCVGVGESDGSIWNPDGIDPKELEDFKLQHGSILGFPKPRXYEGS

SEQ ID NO: 37118 - protein, 337 aa, Thellungiella halophila
MSPVPERTKLHIAMAVFQTGYAGNHVIMRFALNLGVSKLIFPLYRNIIALSVLAPSAFFLEKKERPRMTTSLLIQFFLLGLVGITLNQGFYIFGLDNTSPTFASATENAVPAVSFLMAALLGIEKVELKRRDGVAKVVGTFVSVAGSLAITLYKGPTIYQPSLRSMDQPTNAGEAEEQNKNWTLGCVCLMGHCLCWSSWIVLQSPLLKRYPARYSFVSYSCLFAVFQIVGISAYFERDLESWKIKSGREMYALLYTGLVGSGMVFAIQIYVVERGGPLFVSAYLPLQTLLAALLATFALGEHLYLGGLIGAILIICGLYLVVMGKSGRRKLFANSNT

SEQ ID NO: 37119 - protein, 452 aa, Staphylococcus epidermidis ATCC 12228
MFNFLKPARHIKSLPSEKVDDTYKRLRFQVFLGIFIGYAGYYLLRKNFSLAMPSLIEQGFSKGELGIALSAVSIAYGFSKFVMGTVSDRSNARMFLTLGLVLTAIINLLLGFIPFFTSSITIMFIMLFLVGWFQGMGWPPSGRVLVHWFSVSERGSKTSIWNVAHNVGGGLMAPIATWGISMTALYNFGYLKGFEGVFIYPALLAIIIAILSYILIRDTPQSQGLPPIEQYKNDYATSTKQTIETELTTKEILFKYVLNNKWVWAIAFTNIFVYFVRYGVLDWAPTYLSEEKHFDLSASGWAYFLYEWAGIPGTLLCGYLSDKLFKGRRGPAGFFFMLGVTIFILIYWLNPPGHAWLDNLSLIGIGFLIYGPVMLIGLQALDYVPKKAAGTAAGLTGLFGYLFGAVMANIVLGFVVQHFGWHIGFVLLTVISILAMLCFILTWNKRGQEQID

SEQ ID NO: 37120 - protein, 397 aa, Pisum sativum
MALSRLSSSSSSSNGSNLFNPFSAAFTLNRPISSDTTATLTIETSLPFTAHNCDPPSRSVTTSPSELLSFFRTMALMRRMEIAADSLYKANLIRGFCHLYDGQEAVAVGMEAGTTKKDCIITAYRDHCTFLGRGGTLLRVYAELMGRRDGCSKGKGGSMHFYKKDSGFYGGHGIVGAQVPLGCGLAFGQKYLKDESVTFALYGDGAANQGQLFEALNISALWDLPAILVCENNHYGMGTATWRSAKSPAYFKRGDYVPGLKVDGMDALAVKQACKFAKEHALKNGPIILEMDTYRYHGHSMSDPGSTYRTRDEISGVRQERDPIERVRKLLLSHDIATEKELKDTEKEVRKEVDEAIAKAKDSPMPDPSDLFSNVYVKGYGVEAFGVDRKEVRVTLP

SEQ ID NO: 37121 - protein, 183 aa, Spiroplasma citri
MKFALFLATGFEEGEAIITTGVLRRGGIKLELISITKALEVVSSHDVTIKADKLIEDVKYEDYDGFILPGGRIGVDNLAKNEMLKDWLLKANNAQKTIAAVCAAPQILGHLGILDNKEATSYPGCTEGMDKAIYNNEIAAITDGHIITGASVGSTMNFALAIADRVLGAEKVMKLQNELVIRD

SEQ ID NO: 37122 - protein, 384 aa, Staphylococcus aureus subsp. aureus COL
MKLSLNSNSKYLRAPSIRQFSNRMNNLDDCVNLTIGQPDFPMPDVVKKAYIDAINNDKTSYSHNKGLLETREAISQYFKNRYHFSYDPEEIIVTNGASEAIDTTLRSIIEPGDEIIIPGPIYAGYIPLIEVLGGKPIYIDTTATQFKITPDALESHISPKTKAVLLNYPTNPTGVVLKRNEVLNIVNVLKKYPLFIISDEIYAENTFSGKHVSFAEFEDIRDQLILIGGLSKSHSATGIRIGFLLGPQYLIDKLTFMHAYNCICANVPAQIACITALNEGLEAPKYMNEAYVERRNYLVSELTKLGFEITAQPEGAFYIFPSIKHITDDDFEFCVDLLESTHLAIVPGSSFTEFGKGFVRISYAYEMDVLKEGMKRLAKYLNTK

SEQ ID NO: 37123 - protein, 513 aa, Bacillus halodurans C-125
MLEKDYSVFPLLYQAVQANPKKEALYDLNERITYEQLLERVNELAAIFIEMGVVKGDRIGVCLPNWNETVIIFFAAAKLGATVVPFNPNYREYEIAYIVANAAPKLLFVCEKVEENVGLAALVADQRQLISVRFKSPFAIPFEQLKRTNKSAIDVSIVPSHERYCILYTSGTTGLPKGVMITHSSVVQSGLALARSLKCTKDDVFIVPAPLFHIFGMACNLMAAVSCQAKVILQEKFKPDHTLALIEQEKVTIHQAVPTMFILELNHPDFSTFDLSSLRAGMVGAAPCPKETVQEIRKRMGFHLCISYGMTEVGAATITPYEDEDESSLDTVGKPMEGVEITIVNEDREPLPVGDIGEIAIRGFGNMIGYYKLPEQTNEVLGDNGWFYTGDLGSLDEEGYLRFIGRKKELIIRGGYNIYPQEIEAILSEHEKVQESAVIGLPDEVLGELVCAGIKLKQGAHSSEQELLAYLSKRIAHYKVPSKIVFVEELPVTASGKVQKSQLREQIIETIKS

SEQ ID NO: 37124 - protein, 266 aa, Gossypium hirsutum
LSIEEVEVAPPQKDEVRIKILFTSLCHTDVYFWDAKGQNPLFPRILGHEAGGIVESVGEGVTDLKPGDHVLPIFTGECKECPHCLSEESNMCDLLRINTDRVGMINDGKSRFSINGKPIYHFLGTSTFSEYTVVHVGQVAKINPHAPLDKVCVLSCGMSTGFGATVNVAKPKKGQSVAIFGLGAVGLAAAEGARVSGASRIIGIDLNPSRFEQAKKFGVTEFVNPKDYNKPVQEVIVEMTGGGVDRSVECTGSIQAMISAFECVHD

SEQ ID NO: 37125 - protein, 323 aa, Crocosphaera watsonii WH 8501
MISTTSFFTPVENDLHLLTDNLKRLVGARHPILGAAAEHLFDAGGKRIRPAIVLLVSRATMLDLEITSRHRRLAEITEMIHTASLVHDDVVDEAALRRNVPTVNSLFDNRIAVLAGDFLFAQSSWYLANLDNLQVVKLLSEVIRDFAEGEIFQGINRFDTSLTLEAYLDKSYYKTASLMANSSKSAAILSDASAEVIDSLYNYGKYLGLAFQIVDDILDFTSPTEVLGKPSGSDLISGNITAPALFAMEETPYLETLIQREFSEEGDIDKALSIISESQGIERSQELAAYHGQLALKQLACLKPSPYSQSLTDIVDYVLSRLY

SEQ ID NO: 37126 - protein, 266 aa, Gossypium herbaceum
LSIEEVEVAPPQKDEVRIKILFTSLCHTDVYFWDAKGQNPLFPRILGHEAGGIVESVGEGVTDLKPGDHVLPIFTGECKECPHCLSEESNMCDLLRINTDRVGMINDGKSRFSINGKPIYHFLGTSTFSEYTVVHVGQVAKINPHAPLDKVCVLSCGMSTGFGATVNVAKPKKGQSVAIFGLGAVGLAAAEGARVSGASRIIGIDLNPSRFEQAKKFGVTDFVNPKDYNKPVQEVIVEMTGGGVDRSVECTGSIQAMISAFECVHD

SEQ ID NO: 37127 - protein, 266 aa, Gossypium raimondii
LSIEEVEVAPPQKDEVRIKILFTSLCHTDVHFWDAKGQNPLFPRILGHEAGGIVESVREGVTDLKPGDHVLPIFTGECKECPHCLSEESNMCDLLRINTDRVGMINDGKSRFSINGKPIYHFLGTSTFSEYTVVHVGQVAKINPHAPLDKVCVLSCGMSTGFGATVNVAKPKKGQSVAIFGLGAVGLAAAEGARVSGASRIIGIDLNPSRFEQAKKFGVTESVNPKDYNKPVQEVVVEMTGGGVDRSVECTGSIQAMISAFECVHD

SEQ ID NO: 37128 - protein, 335 aa, Cyanidium caldarium
MLIFNDLRHFLPVVPRFVYKSLKKHPRKFGLTEIVLDNGRRAEGRWREKTENLTHKKITKKHLLRCIKKIGIFNEDNRAGIYQTLHRISCIKNRYGNIVGLTYRIGREFIGIGPIIRDLIESNQSTLLIGRPGIGKTSFIREISRILSNEIMKRVIIVDSANEISGEGCCPHISTGKARRMEVQSINSQHEVMIEAIENHTPEIIIIDEIGTEYESQAAISISQRGIRLIGSAHSSDLFNLAKNPTLCKLVGGIESVTLSDTQAILRKTKKTILERKGCSCFNATIEINKKRTVKVYTSVEQSIDAILEGRVNNSQIRSMKLNGEITISLNYQDE

SEQ ID NO: 37129 - protein, 266 aa, Gossypium robinsonii
  misc_feature (58)..(58): Xaa can be any naturally occurring amino acid
LSIEEVEVAPPQKDEVRIKILFTSLCHTDVYFWDAKGQNPLFPRILGHEAGGIVESVXKGVTDLKPGDHVLPIFTGECKECPHCLSEESNMCDLLRINTDRVGMINDGKSRFSINGKPIYHFLGTSTFSEYTVVHVGQVAKINPHAPLDKVCVLSCGMSTGFGATVNVAKPKKGQSVAIFGLGAVGLAAAEGARVSGASRIIGIDLNPSRFEQAKKFGVTEFVNPKDYNKPVQEVIVEMTGGGVDRSVECTGSIQAMISAFECVHD

SEQ ID NO: 37130 - protein, 1187 aa, Ostreococcus tauri
MRSRISFCDALRICSVAKNLSSVTALTYERTSMTSVPKPLKFLRPHLQTLKDVYEKMKDKENKFLLADIVSLLAMTNANVSGEVPESLKYRLLGSKEDIGNWGHEYVRNLAAEIGTEYHRRMEQDGEGASMNDLMDLVYEIVPFHMQHNAEPEAVDLLLEVERLDVLLNHVNDTNYARTCLYLFSCANYLPEPEDATVLKMAHSIFIKVGKMPDAMRVALKLCEQTIIEETFNACTDLGIKKQLCYMLARHGHPLKLDEGPCEVPEENLDTLQNIMSNSDLTKNYLTLARDLDVMEPKLPEDIYKSHLMDVRAPSGAAVDSARANLASTFVNAFVNAGFGQDKLLTSSEPADGSSSNVSWIFKNKDHGKTSAAASLGSILLWDVDGGLPQVDAYLYSEDPYIVAGGLLAVGLINTNVRNECDPAYGLLYESVTKENASVRIGAIMGLGLAYAGTQKEEVSELLTEVIHDDTAPLEVVAFAALSLGLVFCGTCHEDCVSTIVQTLMLRPEKDHENTFMHFLCLGLGLLFLQRQAEVEATLEVAKTLPPRISEYLQTVLDVCAYAGSGNVLKVQSLLAKCGEHPEFEEDDEWIADPQSVAVLGVALVAMGEELGSDMAVRAYDHLIQYGDAAVKKAVPLAFALLHASNPKLDITDLLGRLSHDSNEEVAQAACLALGVVGAGTNNARLASQLRQLSSYYYKEPSCLFLVRVAQGLVHMGKGLLTLSTSHSDKALHSNVALAGLIITAFAGLDMKHTILGKHHYMLYYLFVAAQPRMLMTVDEQGDPLQVSVRVGQAVDVVGQAGRPKTITGFQTHNTPVLLAVGDRAELASEKYIPLTPVLEGVVILKKNPGWVEDMEKHHTLPLSTMTVMQLMIQPFGIMNTLRWKFVIPMSATGALAATVVAPKSTGLYKFCESWTLLVASFMMFFSVVWFIILETESFSRIRVLFDSRPWRNTPDIMEDTSSSEEFKSKICCPFTGEDAHGTCPICHSIVSYAGYYHVILTQGDPPMLHTIIGDSILEHRLAMKASENVRKPKLGRIQLDTLINYRGNFLFGTVSPSCKGCYIKAWCWTVGYRMVWQSTILGFNTMLCSYLFGEEVKVFDLKSTLLCLSMFFSVSTVCMLLSILSTALVFIREHAFMQSDAVPKYVLQDLGTVPEKLISLMADPCAKFGSNPTKTYWNWLWAIKKA

SEQ ID NO: 37131 - protein, 497 aa, Ammi majus
MDVIIIVLSVMLAYVLVKHLLLSRDRGKNLPPGPFQLPIIGNLTNLGKLPHRSLAKLSQNYGPIMHLQLGRVTTIVISSSAIAQQVFQKKGRAFSRRFIPDSLCACDHSLYSFVWLPIGPQWRNLRKISNSNLFSANKLDANQHLRGRKVNELIAYVQKCSQTGDAVDIGRAAFRTSFNLLSNTVFSKDMVDPYQDSAQEFKDLAWNIMVEAGSPNLVDYFPVLKKMDPQGVKRRMTGYFQKVIKMLDGLINERLALKGSGTTVDKTDMLDELINISQVNPNEMDKILMEHLFVDIFVAGTDTTSNTVEWGMAEILRSTETMMKVKAELRHLVGKGVILEEGDIYRLPFLQCIVRETLRLHPPFPLLLPRQTEEETELNGYTIPKNSQVLVNAWAIGRDPVSWKNPSSFRPERFLDSEVDVKGQDFELIPFGAGIRICPGLPLVMRMVPVMLGSLINCFDWELEGGIPLNELDMEEKCGLSVAKLHPLRVLATSQVV

SEQ ID NO: 37132 - protein, 458 aa, Burkholderia vietnamiensis G4
MQSNTVHPCDEVLPTGKLVTLGLQHVLVMYAGAVAVPLIVGGALKLPKDQIAFLISADLFSCGIATLIQTLGLWIFGIRLPVIMGCTFAAVGPMIAIGTNPGLGMLDIFGSTIAAGIIGIVLAPTIGKLLRFFPPVVVGTVIAVIGLSLMEVGINWAAGGVGNPDYGSPVYLGLSLLVLTLILLINKYGRGFIANISVLLGIVAGFAIAFAIGRVNTDGVAHAPWVGFVMPFHFGIPHFDPLSIATMVTVMFVTFIESTGMFLAVGDMVDRPVDQERLVRGLRVDGLGTLIGGIFNSFPHTSFSQNVGLIGVTGVKSRYVCATGGVILVLLGLFPKMAQVVASVPPFVLGGAGIVMFGMVAANGIKVLSKVDFVNNTHNLFIVAVSVGMGLVPVVSPHFFSKLPPALAPILHSGILLASASAVLLNIVFNGVKGEKDARCEIRRAGHDFDGRPADVHH

SEQ ID NO: 37133 - protein, 530 aa, Ammi majus
MITCEMGIYLQMQDIILFSLVFFSTLILWRIFSTYVIRKKTCSGPPEPAGRWPLIGHLHLLGGSKILHHILGDMADEYGPIFSLNLGINKTVVITSWEVAKECFTTQDRVFATRPKSVVGQVVGYNSRVMIFQQYGAYWREMRKLAIIELLSNRRLDMLKHVRESEVNLFIKELYEQWSANGNGSKVVVEMMKRFGDLTTNIVVRTVAGKKYSGTGVHGNEESRQFQKAMAEFMHLGGLLMVSDALPLLGWIDTVKGCKGKMKKTAEEIDHILGSCLKEHQQKRTNISNNHSEDDFIYVMLSAMDGNQFPGIDTDTAIKGTCLSLILGGYDTTSATLMWALSLLLNNRHVLKKAQDEMDQYVGRDRQVKESDVKNLTYLQAIVKETLRLYPAAPLSVQHKAMADCTVAGFNIPAGTRLVVNLWKMHRDPKVWSDPLEFQPERFLQKHINVDIWGQNFELLPFGSGRRSCPGITFAMQVLHLTLAQLLHGFELGTVLDSSIDMTESSGITDPRATPLEVTLTPRLPPAVYQ

SEQ ID NO: 37134 - protein, 426 aa, Helicobacter pylori 26695
MSVTLVNNENNERYEFETIESTRGPKAVDFSKLFETTGFFSYDPGYSSTAGCQSKISYVNGKKGELYYRGHRIEDLVAKYKYVDVCKLLLTGELPKNQDESLEFELELRHRSFVHESLLNMFSAFPSNAHPMAKLSSGVSILSTLYSTHQNMHTEEDYQTMARRIVAKIPTLAAICYRNEVGAPIIYPDIARSYVENILFMLRGYPYSRLKHTTQGEVEITPLEVEAFDKILTLHADHSQNASSTTVRNVASTGVHPYAAISAGISALWGHLHGGANEKVLLQLEEIGDVKNVDKYIARVKDKNDNFKLMGFGHRVYKSYDPRAKILKGLKDELHQKGVKMDERLSEIAAKVEEIALKDEYFIERNLYPNVDFYSGTILRALKIPVRFFTPVFVIGRTVGWCAQLLEHVKSPQARITRPRQVYVGD

SEQ ID NO: 37135 - protein, 346 aa, Zea mays
MADELDELIGFLSDRNPQVRGAAADIVRGLTGGEDGLRALTARADSALPALLRLLASAGGSGSGEAAADSLVNLSQDAALAARLVALGAVDAAMDVVAKRGGEQPALARRLVMLLVNLTHVESGVAALLQVGDEKVQGLYVAKLVRSFCRSSSDSEEEDIFEYVASTLVNISKVEAGRRILLEPKRGLLKQIIRQFDSTNQLRKKGVAGTIRNCCFEADTQLLSLLSLAEYLWPALLLPVAGKKIYSEEDRSKMPLELSSALSHEREVVEDSEIRQQALEAIYMIVLQDGGRRSFWSVNGPRILQVGYEDEKDPKVMEAYELIGSLLVGKGEDVQDNKKEQGEKPQ

SEQ ID NO: 37136 - protein, 455 aa, Zea mays
YLHSNDTHVVAGALLGIGIVTCGVKSDCDPAFAILMEYIGKDDSNIRIGAILGLGIAYAGSQKEELKMHLSAVLGDSQSPLEVLVFSAIAMGLVFVGSCNEEIAQSIIFALMERSEAELAEPIIRLLPVALGLLYLGKQDSVEATAEVSKTFDEKIGKYCDVTLMSLAYAGTGNVLKVQKLLGICSQHLEKGETHQGPAVLGIALIAMAEELGAEMAVRSLERLLQYGEQNIRRAVPLALGILCISNPKVNVMDTLSRLSHDADADVSMAAIISLGLIGAGTNNARIAGMLRNLSSYYYKEAAHLFCVRIAQGLVHLGKGLLTLSPYHSDRFLLSPMALGGLVTVLHACLDMKSTILGKYHYILYIIVLAMQPRMLLTVDEDLKPLSVPVRVGQAVDVVGQAGRPKTITGFQTHSTPVLLAAGERAELATEKYIPLTPVLEGFVILKKNPEYHEE

SEQ ID NO: 37137 - protein, 449 aa, Pseudomonas syringae pv. syringae B728a
MFGFFRPARHQAPLPEEKVDSTYRRLRWQIFAGIFIGYAGYYLLRKNFSLAMPYLIDEGYTRGQLGVAMSAIAIAYGLSKFLMGIVSDRSNPRYFLPFGLLVSAGIMFIFGFAPWATSSVTIMFVLLFINGWAQGMGWPPSGRTMVHWWSQKERGGVVSVWNVAHNVGGGLIGPLFLLGMGWTNDWHAAFYVPAAVALLVAVFAFATMRDTPQSVGLPPIEHYKNDYPEGYDASHEEEFSAREIFVKYVLRNKFLWYIAMANVFVYLLRYGVLDWAPTYLKEAKHFTVDKTSWAYFLYEWAGIPGTLLCGWMSDKIFKGNRGLTGMVFMFLVTIATLVYWLNPEGNPTVDMIALVSIGFLIYGPVMLIGLQALELAPKKAAGTAAGFTGLFGYLGGSVAASAAMGYTVDHFGWDGGFVLLIGACILAMVFLAPTLRHKQVASTSRDTKG

SEQ ID NO: 37138 - protein, 433 aa, Mesorhizobium loti MAFF303099
MGGANQEATATLQFAGKTHEFKVRSGSVGPDVIDIASLYSTTGAFTYDPGFTSTASCESEITFIDGDAGILLHRGYPIDQLAEHGDFLEVCYLLLYGELPTKAQKDDFDYRVTRHTMVHEQMSRFFTGFRRDAHPMAVMCGVVGALSAFYHDSTDISDPYQRMVASMRLIAKMPTIAAMAYKYHIGQPFIYPKNDLGFAANFLHMCFAVPCEEYKINPVLARAMERIFILHADHEQNASTSTVRLAGSSGANPFACIAAGIACLWGPAHGGANEAALNMLGEIGHVDHIPEFIARAKDKNDPFRLMGFGHRVYKNYDPRAKIMQKTAHEVLGELGIKDDPLLDIAMELEKIALTDPYFIEKKLYPNVDFYSGITLKALGFPTTMFTVLFAVARTVGWIAQWKEMIEDPRQKIGRPRQLYTGAPERDYVPIAKR

SEQ ID NO: 37139 - protein, 359 aa, Pisum sativum
MLGVIRNKTIRPSFSAFRFFSSAKQMTVRDALNSALDVEMSADSKVFLMGEEVGEYQGAYKVTKGLLEKYGPERVLDTPITEAGFTGIGVGAAYYGLKPVVEFMTFNFSMQAIDHIINSAAKSNYMSAGQISVPIVFRGLNGDAAGVGAQHSHCYASWYGSCPGLKVLVPHSAEDARGLLKAAIRDPDPVVFLENELLYGESFPVSAEVLDSSFWLPIGKAKIEREGKDVTITAFSKMVGFALKAAEILEKEGISAEVINLRSIRPLDRPTINASVRKTNRLVTVEEGFPQHGVGAEICTSVIEESFGYLDATVERIGGADVPMPYAGNLERLVVPHVEDIVRAAKRACHRSVPLAAAA

SEQ ID NO: 37140 - protein, 340 aa, Bacillus subtilis subsp. subtilis str. 168
MKVKVAINGFGRIGRMVFRKAMLDDQIQVVAINASYSAETLAHLIKYDTIHGRYDKEVVAGEDSLIVNGKKVLLLNSRDPKQLPWREYDIDIVVEATGKFNAKDKAMGHIEAGAKKVILTAPGKNEDVTIVMGVNEDQFDAERHVIISNASCTTNCLAPVVKVLDEEFGIESGLMTTVHAYTNDQKNIDNPHKDLRRARACGESIIPTTTGAAKALSLVLPHLKGKLHGLALRVPVPNVSLVDLVVDLKTDVTAEEVNEAFKRAAKTSMYGVLDYSDEPLVSTDYNTNPHSAVIDGLTTMVMEDRKVKVLAWYDNEWGYSCRVVDLIRHVAARMKHPSAV

SEQ ID NO: 37141 - protein, 152 aa, Saccharomyces cerevisiae
MSFIKNLLFGGVKTSEDPTGLTGNGASNTNDSNKGSEPVVAGNFFPRTLSKFNGHDDEKIFIAIRGKVYDCTRGRQFYGPSGPYTNFAGHDASRGLALNSFDLDVIKDWDQPIDPLDDLTKEQIDALDEWQEHFENKYPCIGTLIPEPGVNV

SEQ ID NO: 37142 - protein, 106 aa, Triticum aestivum
  misc_feature (21)..(21): Xaa can be any naturally occurring amino acid
  misc_feature (45)..(45): Xaa can be any naturally occurring amino acid
VTEGTALPVGDEEPAARAQGXYFYDKKESYSGWFSFSLVFNSKAXRGTLNLMGADPMDAETRDFSVVGGTGDLFMARGVATIRTDATEGLFYFRLKMDIKLYECYV

SEQ ID NO: 37143 - protein, 485 aa, Bacillus halodurans C-125
MEAIYTRQFLAGEWIEGASTQTITNYNPYTGEKIHEIKGASLDDLDQAYRAAKNAQKEWEQTLPAQKQEVLEKAAALLAERKDEVIERLVNEAGSSIIKASIEWGATLQTIKVAATFPLRMEGKILPSNIPGKENRIYRSAKGVIGVISPFNFPLVLAMRSVAPALATGNAVVLKCSSDAPITSGLLIAELFEEAGLPKGVLNVVVGKAAEIGDAFVTHPIPKLISFTGSTEVGRHIAQLAARELKETALELGGNNVMIVLDDADIEKAAEKAAVGKFLHQGQICMALNRIIVDASIYDSFVEVFKEKVSQLQTGNPAEPATLIGPLINYKQIGRIQQLVKESVAQGAVKVLEGHVQGNLMSPTILSEVTNDMPVAKEEIFGPIAPIIKAKDEAEAIAIANDSPYGLSGSIFTGSLHRGVQVAKQIDTGMIHVNDQPVNEEAHISFGGEKDSGIGRFGGEWVLDKFTTVKWISIQEKERVYPFWG

SEQ ID NO: 37144 - protein, 261 aa, Bacillus subtilis subsp. subtilis str. 168
MLLKRRIGLLLSMVGVFMLLAGCSSVKEPITADSPHFWDKYVVYPLSELITYVAKLTGDNYGLSIILVTILIRLLILPLMIKQLRSSKAMQALQPEMQKLKEKYSSKDQKTQQKLQQETMALFQKHGVNPLAGCFPILIQMPILIGFYHAIMRTQAISEHSFLWFDLGEKDPYYILPIVAGVATFVQQKLMMAGNAQQNPQMAMMLWIMPIMIIVFAINFPAALSLYWVVGNLFMIAQTFLIKGPDIKKNPEPQKAGGKKK

SEQ ID NO: 37145 - protein, 142 aa, Brassica napus
  misc_feature (117)..(117): Xaa can be any naturally occurring amino acid
  misc_feature (130)..(130): Xaa can be any naturally occurring amino acid
DASEDEWGQFIIGYILPGKPIANLIFKIYGRISTVHALSFLADLKLGHYMKIPPRCMYTAQLVGTVVAGVVNLGVAWWMLESIQDICDIEGDHPNSPWTCPKYRVTFDASVIWGLIXPKRLFGARGMYRXLVWLFLIGAVLP

SEQ ID NO: 37146 - protein, 365 aa, Burkholderia vietnamiensis G4
MSTPAPHTAPSMKAAVWHGRNDIRVEEVPVPGHPPAGWVQIRVHWCGICGSDLHEYVAGPVFIPVDAPHPLTGLKGQCILGHEFSGEIAALGAGVTGFALGERVTADACQHCGTCWYCRHGMYNICENLAFTGLMNNGAFAEYVNVPAELLYKLPDNFPTEAGALIEPLAVGMYAVKKAGNIVGQTVVVVGAGTIGLCTIMCAKAAGAGRVIALEMSAARKQKALEVGATVVIDPKASDAIAEVKALTGGYGADVSFECIGHTATAKLAIDVIRKAGKSVMVGIFEEPTSFNFFDIVSTEKEVIGSLAYNGEFADVIRFIADGRIDVQPLITGRIALGDIVARGFEELVNHKDRNVKIIVQPVAA

SEQ ID NO: 37147 - protein, 557 aa, Oryza sativa (japonica cultivar-group)
HQRRNATHHDATMASHAVTDALLLPRSEGAVAGAVDFRGRPASRASTGRWSAAMFVLGVEIAERFAYHGVSANLISYLTGPLGESTAGAAAAINLWSGVATMLPLLVACVADAWLGRYRTIVLASLLFVVSMGMLTLSSALPAFHGDGGGCSYTSKSLSCAPSTAQVAIFYVSLYLVALAEAGHKPCAQAFGADQFDQNDAKESVSRSSFFNWWYFGMCSGTAMTTMVSSYIQDNIGWGLGFGIPCLVMAFALAMFLLGTRNYRYYVSTQSSPFARLARAFVALIRGSKDDALAVVDDDDGGDHREELRGVLRLFPIWATCIIYAVIFSQSSTFFTKQAATLDRRIGESFRVPPAALQTFISVTIIAFIPVYDRAFVPVARRFTRASSGITMLQRIGTGLVLALAAMVVAALVEARRLGVARDAGMVDDPKAALPMSLWWMVPQYVLFGLSDVFAMIGLQEFFYDQVPDALRSLGLAFFLSIFGVGHFFSSFIISAIDGATKKSGASWFANNLNRAHLDYFYWLLAGLCAVELVAFVFVSRVYVYKKRVPHNGCDVM

SEQ ID NO: 37148 - protein, 544 aa, Oryza sativa (japonica cultivar-group)
RSKLVSHLLDSGMADTVAGAVDYRGRPASRAATGGWKSSVFVMAMEIAERFAYKGVAANLITYLTGPLGQPMARAAASIDAWKGVSQMLPLPLACVADAWLGRYRAIVLASVIFVLSMGTLSMSSAFPVSRAGHVAVFYVALYMVALGEGAHKPCAQAFAADQFDEKDGGECAARSSFFNWWYFGMCAGTAVTTMVSSYVQDNVGWGLGFGIPCIVIVVSLAAFLLGTRSYRFYTARTASPVARVAKAFLTLIKSWRSNRRTNPASGGKGDGDGDAGDLVEEVKSVLRLLPIWASCIIYAIIFSQTSTFFTKQAATLDRRIGRSFNVPPAALQTFISVSIVVFIPVYDRLFVPLARRYTGRPSGITMLQRVGAGLALSLVAVVLSALVETRRLRVAAGAGMADAPKARLPMSLWWMVPQYVLVGVADVFAMIGLQEFFYDQVPDAVRSLGLALFLSIFGVGHLLSSLLISVIDGATARRAGGSWFANNLNRAHLDYFYWLLAGLCAVELVAFFLFSRVYTYKKKGNDADGNCDYRGVDDDGICV

SEQ ID NO: 37149 - protein, 337 aa, Triticum aestivum
MAPLGDTVASVASAAAPGLVVSFGEMLIDFVPDVAGVSLAESGGFVKAPGGAPANVACAISKLGGSSAFVGKFGDDEFGHMLVDILKQNGVNAEGCLFDQHARTALAFVTLKSNGEREFMFYRNPSADMLLTEAELNLDLIRRARIFHYGSISLITEPCRSAHVAAMRAAKSAGILCSYDPNVRLPLWPSAQAARDGIMSIWKEADFIKVSDEEVAFLTQGDAHDEKNVLSLWFEGLKLLVVTDGEKGCRYFTKDFKGSLPGYTVNTVDTTGAGDAFVGSLLLNVAKDDSIFYNEAKLREVLQFSNACGAICTTKKGAIPALPTTATALELISKGTN

SEQ ID NO: 37150 - protein, 320 aa, Bordetella pertussis Tohama I
MPSQLEALRRHTVVVADTGDFEAMRALRPTDATTNPSLILKAVQQEAYRPLLVQTARAHQGASPAEITDRLLVAFGRQILDIVPGRVSTEVDARLSFDTRATVERARGLIALYQAAGVPRERVLIKIASTWEGIQAARVLQAEGIRCNLTLLFCLPQAAACADAGVQLISPFVGRIYDWHKKNAGAEWVEDARRGANDPGVQSVSRIYRYYKRFGIETEIMGASFRNVDQILALAGCDLLTISPELLTRLAQTEGEVPAALSPQAGHDDADAVRLDGGEVAFRTQLNEDAMASEKLSEGIRLFVADARKLDALIESHGAA

SEQ ID NO: 37151 - protein, 307 aa, Zea mays
MAAALPLSPVSHQLCRRSNRFWYNALTPRFCSPVFSTTSPCLIGVKGIGSSSQLRPRHPLISSAASTDYLLHDVGATVAVLGGAYALVLLFESLTKRDVIPQRLSRKLVHILSGLLFVLSWPIFSASTEARYFAAFVPLVNGLRLVVNGLSVSPNSTLIQSVTREGRPEELLKGPLFYVLALLVAAVFFWRDSPTGMISLAMMCGGDGIADIMGRKYGSYKIPYNPRKSLAGSISMFIFGFFISIGLLYYYSSLGYLHMNWETTFTRVAIVSLVATLVESLPITDQIDDNVSVPLASILAAYLSFGY

SEQ ID NO: 37152 - protein, 372 aa, Bacillus subtilis subsp. subtilis str. 168
MTATRGLEGVVATTSSVSSIIDDTLTYVGYDIDDLTENASFEEIIYLLWHLRLPNKKELEELKQQLAKEAAVPQEIIEHFKSYSLENVHPMAALRTAISLLGLLDSEADTMNPEANYRKAIRLQAKVPGLVAAFSRIRKGLEPVEPREDYGIAENFLYTLNGEEPSPIEVEAFNKALILHADHELNASTFTARVCVATLSDIYSGITAAIGALKGPLHGGANEGVMKMLTEIGEVENAEPYIRAKLEKKEKIMGFGHRVYKHGDPRAKHLKEMSKRLTNLTGESKWYEMSIRIEDIVTSEKKLPPNVDFYSASVYHSLGIDHDLFTPIFAVSRMSGWLAHILEQYDNNRLIRPRADYTGPDKQKFVPIEERA

SEQ ID NO: 37153 - protein, 400 aa, Escherichia coli K12
MKEKTIIIVGGGQAAAMAAASLRQQGFTGELHLFSDERHLPYERPPLSKSMLLEDSPQLQQVLPANWWQENNVHLHSGVTIKTLGRDTRELVLTNGESWHWDQLFIATGAAARPLPLLDALGERCFTLRHAGDAARLREVLQPERSVVIIGAGTIGLELAASATQRRCKVTVIELAATVMGRNAPPPVQRYLLQRHQQAGVRILLNNAIEHVVDGEKVELTLQSGETLQADVVIYGIGISANEQLAREANLDTANGIVIDEACRTCDPAIFAGGDVAITRLDNGALHRCESWENANNQAQIAAAAMLGLPLPLLPPPWFWSDQYSDNLQFIGDMRGDDWLCRGNPETQKAIWFNLQNGVLIGAVTLNQGREIRPIRKWIQSGKTFDAKLLIDENIALKSL

SEQ ID NO: 37154 - protein, 370 aa, Coccidioides immitis RS
MASVYKSVSKKRKPSLKEDEHDEDVEMELEERLSDESSDGESDEQSVENHDTNGEINTNSNDRSNSSGYMPKTRVLMLTSRGVTHRHRHLLADLAALLPHTHKESKLDTKKKTTGYNFLLNSLADLHSCNVIFFLEARKRGQDLYLWLSRPPNGPTIKFSVTNLHTMGELGTGFAGNCLKGGRGVVVFDQSFGDEEVMKTGNEWRGLVREMLRGVFSVPKRGVKGMKPFIDRVIGVCWVDGKIWIRVFEIRETDGKTEKDGEEEAANKRRYRRGKDGLPNVSLVEIGPRFVLTPIVILEGSFGGPVIYENREYVSPSQVRREIRVKKAARYASRRAGQMDRTVKNAGLGLGAEGEANRKKDELDPHVLFA

SEQ ID NO: 37155 - protein, 479 aa, Staphylococcus epidermidis ATCC 12228
MEVFNMTNQLFINNEFIESQSKETMDVINPATGEAFDTITLATEEEVNDAIEKSQQAQLEWERVPQPTRAEHVKLLIPLLEKNRDEIAQLYVKEQGKTLTQAYGEIDKSISFIDYMTSLSMSDKGRVLQNSIANETIQIINKPIGVTAGIVPWNAPILVLMRKVIPAIVTGCSVVIKPSEETTLLTLRLAELFRASTIPAGLIQIVPGTGETVGTQLASHKDIQLISLTGSMRAGKSVYENAAQTVKKVNLELGGNAPVIVTSNADLDKAVNYIVTARINNAGQVCTCPERIFVHEDVHDDFLNKVTSKMKSLTVGDPFDENTDYGAIINQKQLDSIHEKVQDAIKNGATLMTGGHQLKRHGFFYAPTVLDNVRKDDNVFKDEIFGPVLAITTYRDFEQVIEDANDTNAGLSSYIFSENLTEVMTATERLKFGEVYANCEAEEVVNGYHAGWRESGLGGADGIHGFEEYYNTTVSYIRY

SEQ ID NO: 37156 - protein, 185 aa, Xanthomonas oryzae pv. oryzae KACC10331
MDEGKHVSTDTSQHASAPYKAVATRGEIAMSSPITLIEAITQALAWELEHDPAVLVLGEDVGVNGGVFRATAGLQQRFGSARVLDTPLDETTIAGLSVGLAAQGMKPVAEAQFDGFVYPMVDHLICHAARLRHRTRGRLHCPMVLRVPWGGGIRAPEHHSEANEAIFTNVPGLRVVLPSSPQRAS

SEQ ID NO: 37157 - protein, 610 aa, Triticum aestivum
  misc_feature (603)..(604): Xaa can be any naturally occurring amino acid
  misc_feature (607)..(607): Xaa can be any naturally occurring amino acid
MAQLQETYACSPATERGRGILLAGDAKTETIAYCSGRSVIFRRLDAPLDAWAYTEHAYPTTVARFSPNGEWVASADASGCVRVWGRNGDRALKAEFRPITGRVDDLRWSPDGMRIVVSGDGKGKSLVRAFMWDSGSTVGDFDGHSKRVLSCDFKPTRPFRIVTCGEDFLANYYEGPPFKFKHSIRDHTNFVNCIRYSPDGTKFITVSSDKKGLIYDGKTGDKIGELSSEGSHTGSIYAVSWSPDSKQVLTVSADKTAKVWDINEDASGTLNRTLVCTGIGGVDDMLVGCLWQNDNLVTISLGGTFNVFSATNPDKEPVSFAGHLKTVSALALFPQSNPRTMLSTSYDGVILKWIQGVGYGGRLIRKNNTQIKCFVATEEELITSGYDNKVFRIPVNGDQCGDAESADVGGQPNALNIALQQPEFALVTTDSAIVLLNKSNVTSTTKVSYTITSSAVSPDGTEAIIGAQDGKLRIYSISGDTVTEEAVLEKHRGPITTIHYSPDVSMFCSADSNREAVAWDRATREVKLKNMLFHTARINCLAWSPDSRFVATGSLDTCAIIYDVDKPAASRTTIKGAHLGGVHGISFADNDTLVTAGEDACIXXWKXTHQ

SEQ ID NO: 37158 - protein, 727 aa, Oryza sativa
  misc_feature (101)..(101): Xaa can be any naturally occurring amino acid
  misc_feature (134)..(134): Xaa can be any naturally occurring amino acid
  misc_feature (149)..(149): Xaa can be any naturally occurring amino acid
  misc_feature (174)..(174): Xaa can be any naturally occurring amino acid
  misc_feature (185)..(185): Xaa can be any naturally occurring amino acid
MPPRRAALLLLALAVYVPLGTASSTTIASYLLGLWSRAHRHSLPAPAPAPAPAPAPETHRPGIRHPVPRHHRKRPHVAPPLPPPSSSERQVAPYQLFPRIXELEIEDCSRETFLKQSQVGIMGAGSSLQDPEKXTTVTVDLVPLGQKFXRTSALLTSNRFLQKKVPINSSIFGXDYNVIYVHYPXGLPSLVPSVPGSLGPISSSQYPFSANVHNRRHQKINSKSVAIIALSAVVLVLMSFGICIIWKYKGFEKSRGTGRVSNSSATRKTGMRSSFSSMTSSTASFVSTIATCPPTVKTFSISELEKATENFSFNKIIGEGGYGRVYRGTIDDEVDVAVKLLTRKHQNRDREFIAEVEMLSRLHHRNLVKLIGICIERSTRCLVFELVPNGSAQAHLHGSDKIYGPLDFDTRMKIALGAARGLAYLHEDANPHVIHRDFKASNVLLENDFTPKVADFGLAKEASEGMDHISTQVMGTFGYVAPEYAMTGHLLVKSDVYSYGVVLLELLSGRKPVDMTQPPGSENLVTWARPLLTDRDGLQQLVDPSMPAASYGFEKLAKAAAIASMCVHVEASHRPFMGEVVQALKLIYNGNNDDTCTSGSFGGGGGEEYEDEEASSPWNNRSWSHDFAATPPPASRRLAFPRAPARPTTMDYSSDPADGAAGTSSASARRQRSTSSLVLDKIESLAAYDWSGPLRASRGRNFYRLRGSMSEHGGHPSEDCSMEGYWM

SEQ ID NO: 37159 - protein, 169 aa, Xanthomonas oryzae pv. oryzae KACC10331
MLAAIRDPDPVIYMEPKPIYRQYKEVVANDGQALPLDVCFVLRDGTDVTLVTWGAQVKEALEAADTLAGEGISAEVIDVATLRPLDFDTIAESVAKTGRCVIVQEAPRTAGFGAEIAARLAEQSMYDLVAPVERVTGYDTHIPLFRLEMKYLPSVERIVTAARRAVAAG

SEQ ID NO: 37160 - protein, 497 aa, Staphylococcus epidermidis ATCC 12228
MTNINVRNYIDESYGLFINNEFQASDSGETLTVSNPANGEDLAKVARAGKKDVDKAVQAAHDAFDSWSKISKEERADYLLEISRRIHEKTEHLATVESLQNGKPYRETSTIDVPQAANQFKYFASVLTTDEGSVNEIDQNTMSLVVNEPVGVVGAVVAWNFPILLASWKLGPALAAGNTVVIQPSSSTPLSLIELAKIFQEVLPKGVVNVLTGKGSESGDAIFHHEGVDKLSFTGSTDVGYGVAQAGAERIVPTTLELGGKSANIIFDDANLEQVIEGVQLGILFNQGEVCSAGSRLLVQSSIYDELLPKLKEAFENIKVGDPFDEDTKMSAQTGPEQLDKIESYIKIAEEDDKANILTGGHRITDNGLDKGYFFEPTIIEINDNKHQLAQEEIFGPVVVVEKFDDEQEAIEIANDSEYGLAGGIFTTDIHRALNVAKAMRTGRIWINTYNQIPAGAPFGGYKKSGIGREVYKDAIKNYQQVKNIFIDTSNQTKGLY

SEQ ID NO: 37161 - protein, 433 aa, Filobasidiella neoformans
MAALSDRQKDELHRAMLAYLHAAGMHNAYAALQHDAALADVDPRDRAVGLLEKKWTSVIRLQKKVIDLENRNAALLAELAAAARPAAPGPFLPRPPPRHTLASHRAPVTRLAFHPTWTLLASASEDATVKLWDWEAGDMERTLKGHTKAVMDVDFDPRGGLMATCSSDLTLKLWDTANQYTNVKTLHGHDHSVSSVRFMPDGETLVSASRDKTIRVWQVSSGYCIKTFSGHAEWVREAVPSEDGRWLVSASNDQTSRIWDFSTGETKMELRGHEHVVECAVFAPVNAYPAIRELAGLKPPAPRDTRAKSPGVYAATGSRDKTIKLWDALSGQCLRTLVGHDNWIRALVFHPSGKYLLSASDDKTIKVWDLANGRCTKTIEAHSHFVTSMTWGRAVGASGGIEKVNGDASSKEPRRINVLATGSVDQTIKVWTP

SEQ ID NO: 37162 - protein, 991 aa, Solanum pimpinellifolium
MMMVSRKVVSSLQFFTLFYLFTVAFASTEEATALLKWKATFTNQNNSFLASWTPSSNACKDWYGVVCFNGSVNTLTITNASVIGTLYAFPFSSLPFLENLDLSNNNISVTIPPEIGNLTNLVYLDLNTNQISGTIPPQIGSLAKLQIIRIFNNHLNGFIPEEIGYLRSLTKLSLGINFLSGSIPASLGNLNNLSSLYLYNNQLSGSIPEEIGYLRSLTKLSLGINFLSGSIRASLGDLNNLSSLYLYHNQLSGSIPEEIGYLRSLTKLSLGINFLSGSIPASLGNLNNLSRLDLYNNKLSGSIPEEIGYLRSLTYLDLGENALNGSIPASLGNLNNLFMLYLYNNQLSGSIPEEIGYLRSLTKLSLGNNFLSGSIPASLGKLNNFFSMHLFNNQLSGSIPEEIGYLRSLTYLDLSENALNGSIPASLGNLNNLFMLYLYNNQLSGSIPEEIGYLRSLTYLDLKENALNGSIPASLGNLNNLSRLYLYNNQLSGSIPEEIGYLSSLTNLYLGNNSLNGLIPASFGNMRNLQALFLNDNNLIGEIPSFVCNLTSLELLYMPRNNLKGKVPQCLGNISDLLVLSMSSNSFSGELPSSISNLTSLKILDFGRNNLEGAIPQCFGNISSLQVFDMQNNKLSGTLPTNFSIGCSLISLNLHGNELEDEIPWSLDNCKKLQVLDLGDNQLNDTFPMWLGTLPELRVLRLTSNKLHGPIRSSGAEIMFPDLRIIDLSRNAFSQDLPTSLFEHLKGMRTVDKTMEEPSYEIYYDSVVVVTKGLELEIVRILSLYTVIDLSSNKFEGHIPSVLGDLIAIRVLNVSHNALQGYIPSSLGSLSILESLDLSFNQLSGEIPQQLASLTFLEFLNLSHNYLQGCIPQGPQFRTFESNSYIGNDGLRGYPVSKGCGKDPVSEKNYTVSALEDQESNSEFFNDFWKAALMGYGSGLCIGISIIYILISTGNLRWLARIIEELEHKIIVQRRKKQRGQRNYRRRNNRF

SEQ ID NO: 37163 - protein, 401 aa, Chromobacterium violaceum ATCC 12472
MNPRLDQLHPYPFQRLAALLADAKPPASLPHISLAMGEPKHPAPQLVKDALCANLAGLSGYPATQGTPALRQACADWAERRYGVRLDPASEVLPVNGSREALFSLTQCLIDAGGAAKPVVVSPNPFYQIYEGAALLAGAEPHYLNCEAENRFQPDWDGVPDEVWRRAQLVIVCSPGNPTGAVMDLAAWDKLFALSDRYGFVIASDECYSEIYFDQPPLGGLSAARALGRGLERLVMLTSLSKRSNVPGMRSGFVAGDAAILKQFLLYRTYHGSAMSLTVQAASVAAWNDEAHVESNRAAYAAKFAAVLPLLQPVLEVERPEAGFYLWAKVPDGDDAAFARALFQQRHVTVLPGSYLARDAHGANPGRGYVRIALVAEQAECVAAAQRIVEFTQTQRAATPA

SEQ ID NO: 37164 - protein, 377 aa, Oryza sativa (indica cultivar-group)
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTQGIVLDSGDGVSHTVPIYEGYALPHAILRLDLAGRDLTDYLMKILTERGYSFTTTAEREIVRDMKEKLSYIALDYDQEMETAKTSSSVEKSYELPDGQVITIGAERFRCPEVLFQPSFIGMEAAGIHETTYNSIMKCDVDIRKDLYGNIVLSGGTTMFPGIADRMSKEDHCLAPSSMKIKVVAPPERKYSVWIGGSILASLSTFQQMWIAKAEYDESGPSIVHRKCF

SEQ ID NO: 37165 - protein, 814 aa, Solanum pimpinellifolium
MMMVSRKIVSSLQFFTLFYLFTVAFASTEEATALLKWKATFKNQNNSFLASWTPSSNACKDWYGVVCFNGRVNTLNITDASVIGTLYAFPFSSLPYLENLDLSNNNISGTIPPEIGNLTNLVYLDLNTNQISGTIPPQISSLAKLQIIRIFNNHLNGFIPEEIGYLRSLTKLSLGINFLSGSIPASLGNMTNLSFLFLYENQLSGSIPEEIGYLRSLTELDLSVNALNGSIPASLGNLNNLSSLYLYNNQLSDSIPEEIGYLSSLTELHLGNNSLNGSIPASLGNLNNLSSLYLYANQLSDSIPEEIGYLSSLTELHLGTNSLNGSIPASLGNLNKLSSLYLYNNQLSDSIPEEIGYLSSLTNLYLGTNSLNGLIPASFGNMRNLQALFLNDNNLIGEIPSFVCNLTSLELLYMPRNNLKGKVPQCLGNISDLQVLSMSSNSFSGELPSSISNLTSLQILDFGRNNLEGAIPQCFGNISSLQVFDMQNNKLSGTLPTNFSIGCSLISLNLHGNELADEIPRSLDNCKKLQVLDLGDNQLNDTFPMWLGTLPELRVLRLTSNKLHGPIRLSGAEIMFPDLRIIDLSRNAFLQDLPTSLFEHLKGMRTVDKTMEEPSYHRYYDDSVVVVTKGLELEIVRILSLYTVIDLSSNKFEGHIPSVLGDLIAIRILNVSHNALQGYIPSSLGSLSILESLDLSFNQLSGEIPQQLASLTFLEFLNLSHNYLQGCIPQGPQFCTFESNSYEGNDGLRGYPVSKGCGKDPVSETNYTVSALEDQESNSKFFNDFWKAALMGYGSGLCIGISIIYFLISTGNLR

SEQ ID NO: 37166 - protein, 848 aa, Solanum pimpinellifolium
MMMVSRKIVSSLQFFTLFYLFTVAFASTEEATALLKWKATFKNQNNSFLASWTPSSNACKDWYGVVCFNGRVNTLNITDASVIGTLYAFPFSSLPYLENLDLSNNNISGTIPPEIGNLTNLVYLNLNTNQISGTIPPQIGSLAKLQIIRIFNNHLNGFIPEEIGYLRSLTKLSLGINFLSGSIPASLGNMTNLSFLFLYENQLSGSIPEEIGYLSSLTELHLGNNSLNGSIPASLGNLNNLSFLFLYENQLSGSIPEEIGYLSSLTELDLSDNALNGSIPASLGNLNNLSSLYLYNNQLSDSIPEEIGYLSSLTELNLGNNSLNGSIPASLGNLNNLSSLYLYANQLSDSIPEEIGYLSSLTNLYLGNNSLNGLIPASFGNMRNLQALFLNDNNLIGEIPSYVCNLTSLELLYMSKNNLKGKVPQCLGNISDLRVLSMSSNSFSGDLPSSISNLTSLQILDFGRNNLEGAIPQCFGNISSLEVFDMQNNKLSGTLPTNFSIGCALISLNLHGNELADEIPRSLDNCKKLQVLDLGDNQLNDTFPVWLGTLPELRVLRLTSNKLHGPIRSSGAEIMFPDLRIIDLSRNAFSQDLPTSLFEHLKGMRTVDKTMEVPSYERYYDDSVVVVTKGLELEIVRILSLYTVIDLSSNKFEGHIPSVLGDLIAIRVLNVSHNALQGYIPSSLGSLSRVESLDLSFNQLSGEIPQQLASLTFLEFLNLSHNYLQGCIPQGPQFRTFESNSYEGNDGLRGYPVSKGCGKDPVSETNYTVSALEDQESNSKFFNDFWKAALMGYGSGLCIGISIIYFLISTGNLRWLARIIEELEHKIIMQRRKKQRGQRNYRRRNNRF

SEQ ID NO: 37167 - protein, 544 aa, Oryza sativa (japonica cultivar-group)
GYRTVAAMESGGLIAPSETCSSDGRGGGGGGWRAARFLIAVGFLERIGFNGVQGNLVMYLTGPMGMSTAAAAAGANAWGGTVLVLTLVGALAADSRLGRYRAIVAAGVLHLLSLGMLTISSVMQPNHPHPASCHDAAAACSPSPPPPPSLARLVFFHAALYLLALAQGFHNPCSEAFGADQFAASDPGARASRSSYFNWYQFFNSFGYGISNTALSYVEDSVSCTVGFAVCLATTAVYLPIFLLGTRAYRAEQPVDGALLARLAKTSSSAARAWTARVFRRKDTSCTERLLAREEVGEKGFLAKLLPIWVTSIVFAIVSAQEVTLFIKQGSTMDRRIGARGGLVVPPAALQSIVSVIFLTFVPVYDRALVPLARRFTGHPAGITTLQRVGVGMAMSCLAMAVAALVEAKRLRAASDAGLIDRPDATVPMGVWWLVPQYALVGLSKVFGIIGLDEFFYDQVPDDLRSVGLAMSLSVRGVGSYASGVLVSAIDCATRSGGESWFSDNLNRAHLDYFYWILAALAALEVAVFVYIAKRYVYKNKGEP

SEQ ID NO: 37168 - protein, 800 aa, Solanum pimpinellifolium
MMMVSRKIVSSLQFFTLFYLFTAAFASTEEATALLKWKATFKNQNNSFLASWTPSSNACKDWYGVVCFNGRVNTLNITNASVIGTLYAFPFSSLPFLENLNLSNNNISGTIPPEIGNLTNLVYLDLNTNQISGTIPPQIGSLAKLQIIRIFNNHLNGFIPEEIGYLRSLTKLSLGINFLSGSIPASLGNMTNLSFLFLYENQLSGSIPEEIGYLSSLTELHLGNNSLNGSIPASLGNLNKLSSLYLYNNQLSDSIPEEIGYLSSLTELHLGTNSLNGSIPASLGNLNKLSSLYLYNNQLSDSIPEEIGYLSSLTNLYLGTNSLNGLIPASFGNMRNLQALFLNDNNLIGEIPSFVCNLTSLELLYMPRNNLKGKVPQCLGNISDLQVLSMSSNSFSGELPSSISNLTSLQILDFGRNNLEGAIPQCFGNISSLQVFDMQNNKLSGTLPTNFSIGCSLISLNLHGNELADEIPRSLDNCKKLQVLDLGDNQLNDTFPMWLGTLPELRVLRLTSNKLHGPIRLSGAEIMFPDLRIIDLSRNAFLQDLPTSLFEHLKGMRTVDKTMEEPSYHRYYDDSVVVVTKGLELEIVRILSLYTVIDLSSNKFEGHIPSVLGDLIAIRILNVSHNALQGYIPSSLGSLSILESLDLSFSQLSGEIPQQLASLTFLEFLNLSHNYLQGCIPQGPQFCTFESNSYEGNDGLRGYPVSKGCGKDPVSETNYTVSALEDQESNSKFFNDFWKAALMGYGSGLCIGISIIYFLISTGNLRWLARIIEELEHKIIMQRRKKQRGQRNYRRRNNRF

SEQ ID NO: 37169 - protein, 216 aa, Brassica napus
  misc_feature (59)..(59): Xaa can be any naturally occurring amino acid
KSKDYYKKIGKAGKRGYLWFGPPGTGKSTMIAAMANFLEYDVYDLELTTVMDNTQLRRXEDGDDKEAIEKKMMKNEGDKKESKVTLSGLLNFIDGLWSACGGERIIVFTTNFVDKLDPALIRKGRMDKHIEMSYCGFEAFKVLAKNYLDVVESELFDEIKMLLEVEEIKMTPADVGENLLPKSEGEEGETCLRRLIEALKEEKEEAKRRVEEEVKP

SEQ ID NO: 37170 - protein, 463 aa, Mycoplasma genitalium G37
MATIQEIECDFLAKIAQKFTNAEIELINKAFYHAKTWHENQKRLSGEPFFIHPLRTALSLVEWNMDPITICAGLLHDIIEDTDQTEANIAMIFSKEIAELVTKVTKITNESKKQRHLKNKKENLNLKSFVNIAINSQQEINVMVLKLADRLDNIASIEFLPIEKQKVIAKETLELYAKIAGRIGMYPVKTKLADLSFKVLDLKNYDNTLSKINKQKVFYDNEWDNFKQQLKKILAQNQIEYQLESRIKGIYSTYKKLTVHEQNISKIHDLFAIRLITKSELDCYHILGLIHLNFLIDSKYFKDYIASPKQNLYQSIHTTVRLKGLNVEIQIRTQQMDNVSKFGLASHWIYKEQKEGLLAPALQLNYLVTKQKHSHDFLKRIFGTDIIKINVSASHEPNVIKQINVDSNNKLLDIAFENYPKQFAKLTKIEIDGVEINSFDTSVENEMLIEFYFGKNNNLKSKW

SEQ ID NO: 37171 - protein, 430 aa, Photobacterium sp. SKA34
MNIDATQETAQRYRYWRIHIMVSMYIGYAAFYLTRKNFSYAMPAIITDLGWDKADIGLMGTLFYLTYGCSKFISGIVSDRSNPRYFMGIGLIATGIINILFGLSSSIVALSILWILNAWFQGWGWPACSKLLTTWYSRSERGRWWSIWNTAHNVGGAMIPIIVGFTVLHFGWRYSFYIPGIIAVVIGLFLCWRLRDKPTSMGLPSIGHWRKDYLEIAHENTGMGLSQKQILFRYVLNNKYIWLLSLSYILVYIVRTAINDWGNLYLTEQYGYSLITANSALSLFEIGGFLGSLVAGWGSDKIFSGNRGPMILLFSIGIFLSVAALWLIPISSFVLQAVCLFTIGFFVFGPQMLIGMAAAECSHKNSVGAATGFVGLFAYMGAALAGYPLAIIMQHYHWMGFFVVVSVAAAAIGLLLLPFLKAQHGDAISV

SEQ ID NO: 37172 - protein, 471 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIEGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKVR

SEQ ID NO: 37173 - protein, 552 aa, Synechococcus sp. WH 7805
MTASASAKPTHTLVRLDAPFTDQKPGTSGLRKSSTQFEEPHYLESFIEASLRTLPGVQGGTLVLGGDGRYGNRRAIDVILRMGAAHGLSKVIVTTGGILSTPAASNLIRQRQAIGGIILSASHNPGGPDGDFGVKVNGANGGPTPASFTDAVYECTKTLEEYTIVEAAAIPLDAPGLHSIGAMQVEVIDGVDDFVALMQELFNFDQIRDLIRSDFPLAFDAMHAVTGPYATRLFEGLLGAPAGSVRNGVPLEDFGKGHPDPNLTYAHELAELLLEGDDYRFGAACDGDGDRNMILGQRCFVNPSDSLAVLTANATLAPAYASGLAGVARSMPTSAAVDVVAKELGIDCFETPTGWKFFGNLLDAGKITLCGEESFGTGSNHVREKDGLWAVLFWLQILAERRCSVAEIMAEHWKRFGRHYYSRHDYEAVASEAAHGLYDRLEAMLPNLVGQPFAGRTISEADNFSYTDPVDGSVTTGQGLRILLDDGSRVVVRLSGTGTKGATIRIYLESYVPNSGDLNQDPQVALAEMISAINDLAEIQSRTGMDRPTVIT

SEQ ID NO: 37174 - protein, 1080 aa, Bordetella pertussis Tohama I
MPKRTDLKSILIIGAGPIIIGQACEFDYSGAQACKALKAEGYRTILVNSNPATIMTDPETADVTYIEPITWQAVEKIIEREKPDALLPTMGGQTALNCALDLAHHGVLKKHNVELIGANEHAIEKAEDRQKFKQAMTDIGLESAKSGVAHSMDEAWEVQRRIAADIGTAGFPVVIRPSFTLGGSGGGIAYNAEEFEVICRRGLEASPTKELLIEESLLGWKEFEMEVVRDKADNCIIVCSIENLDPMGVHTGDSITVAPAQTLTDKEYQIMRNASIAVLREIGVDTGGSNVQFAVNPQNGRMIVIEMNPRVSRSSALASKATGFPIAKVAARLAVGYTLDELRNEITGGATPASFEPTIDYVVTKVPRFAFEKFPQADARLTTQMKSVGEVMAMGRTFQESFQKALRGLEVGVDGLNQKTTDREKLQIELGEPGPERIWYVGDAFAQGFTLDEVHGLTRIDPWFLAQIKEIVDIELALEQKTLADLDYATLWELKRRGFSDRRLAFLLDSSESEVRKLRHQLNVRPVYKRVDTCAAEFATNTAYMYSTYEEECESQPTDRKKIIVLGGGPNRIGQGIEFDYCCVHAALALREDGYETIMVNCNPETVSTDYDTSDRLYFEPLTLEDVLEIVHKENPVGMIVQYGGQTPLKLARALEANGVSIIGTSPESIDVAEDRERFQKLLNKLGLRQPPNRTARTEAEALAHASEIGYPLVVRPSYVLGGRAMEIVHEQQDLERYMREAVKVSNDSPVLLDRFLNDATEVDVDCLADGQTVFIGGVMEHIEQAGVHSGDSACSLPPYSLSAEVIAEIKRQTTMMAKALNVSGLMNVQFAIQGGDVYVLEVNPRASRTVPYVSKATGLQLAKIAARAMAGRTLADQGITREVVPPYFSVKEAVFPFVKFPGVDTILGPEMKSTGEVMGVGNSFGEAFVKSQLAAGVRLPDSGTVFISVRNQDKPRAVEVARGLHNLGFKLVATRGTAAEIEAAGIPVQVVNKVTEGRPHIVDMVKNGEVSLVINTVEERRNAIADSRTIRTQALANRITFFTTIAGARAAVEGMQFMRQGLGLQVYPLQELHAGLTAQ

SEQ ID NO: 37175 - protein, 1402 aa, Burkholderia vietnamiensis G4
MSATPVKSVCPYCGVGCGMVLHVEADEVVKVSGDSEHPTNFGRLCTKGSSAHVALRRSGRLDRAFVRRAREDDLVPLPARDAIAETARRLRAVLDAHGPDALSFYVSGQMSIEAQYLVNKLAKGFVGTNNIESNSRLCMASASTGYKQSLGADGPPGSYQDFDRANLFFVIGANMADCHPILFLRMMDRVKAGAKLIVVDPRRTGTADKADLFLQIRPGTDLALLNGLLHLLHANGRTDAAFIDAHTEGWDAMPAFLADYTPERVAEITGLAPDDLRTAAQWIGDAPEWTSCWTMGLNQSTHGVWNTNAICNLHLATGTICRPGSGPFSLTGQPNAMGGREMGYMGAGLPGQRSVASDDDRRFVENLWRVPAGTLRQETGSGTVDLFERMAAGDIKACWIICTNPVATVPNRQNVIAGLQAAELVIAQDAFLDTETNRYADILLPGALWAEGDGVMVNSERNLTLMRAAVAPPGDALPDWRIVAEVARAMGFGAAFDYASAADVFDEIVRFSNPATGYDLRGASHAALRDGPVQWPVAPGAARERHPIRYLNDGVSQTLRPAADGGAAPRIAFPTPSGRARFFARPHVAPAELPDDTFPIVLNTGRLQHQWHTMTKTGKVAMLNKLNPRPFVELHPDDARALGIAAKDSVEIRSARGRAVLPAVVTERVLRGNCFAPMHWNDVYGDELCINAVTNDAIDAESQQPELKYCAVALTRADTNAFAPADDDTARLDAAAADAAHAAAAADAQAAPVSLAASQESDMADLDTFAAALGVADLAPPPLSDAERLYVAGLVGGLRASAGRRDGGVPVLPAGAPLTPPVRYWLDGMLAGLFSRSAPAPATERAAPALPADAAAPGGVRIVRTRPKVTLLWASQTGNIESLTEDYATQLMNAGFEIRTACMSDYPVASLASAQYVLLMTSTFGDGDAPDNGSEFWDALQAAGAPRVEGMQFAVLAFGDRNYDQFCGHGRRLDARLAELGATRLCARVDCDVEFQRDADQWLERVVARIKEADAALHAVPSAGASASGLLPSKAHPAPSKLVANLRLNRPGAAKDTRYVSLSTEGANLEYEAGDALGVWPTNCPELVDELLAVTALKADTPVSVAGVGDVRLADALARHFDITRPHPDTLAFIASRSANGALKALLGDDRKADLKQWLWGQQLADVLHEFPVELSGMELVGILKRLQPRLYSIASSPSAHRGEIHLTVSAVRYHNGRRARKGVASTFLADRADDGRVPVFVQKSAHFRPPVNGDVPVVMVGPGTGVAPFRGFLHERQARGARGRNWLFFGEQHAQTDFYYGDELSAMRDSGFLTRLDLAFSRDQADKIYVQDRMREHGAELYSWLEDGAHFYVCGDAARMAKDVDTALKAVVAEHGGMSDEAANDYVARLAKARRYVRDVY

SEQ ID NO: 37176 - protein, 589 aa, Debaryomyces hansenii CBS767
MTRRFMKPLYSFMTKRLNSSATKPFYITSPIFYVNARPHLGHLYSMLLCDTRNRWEKLDPNKLSFFLTGTDEHGLKIQTAAEKLGMTPKDLTDQVSTNFKNLGQKVNIAYDRFIRTTDEDHVKTVQYFWSVMEEKGFLYQGSHSGWYAVSDETFYPATQIEEMVDPTTGEKKMISKETKNEVVYQEETNYFFRLSHFQDRLIAFLESNPDFIKPKSKYTELLRELTENKLTDLSVSRPSSRLTWGIEVPGDSSQKIYVWFDALLNYITACGFPEKFPIVNEKYQTEPSNMWPATHIIGKDIIRFHCIYWPIFLMAAGIDMPRQVVVHSHWLCDGFKMSKSLGNVVDPLETLDYYGEDALRFFLTEYSNIESDCNYNEQYFYLTRENLIGKYANLITRCGGNAFNILESVKSFQAGEFDNIDVLIRDHCLNNEKTNESKQIIALKNELSEILNNLYTSMDMSMSSFDQMRTIQKWWAPLEKANQLFQLGQPWLYTKSLKSDTVSDDDKEIHKLIQNYYVFMAAETSRICSILINPIIPNLSSKILDRLAVSPQNRTSHFTTIGSDLTYGEGANSKKHKIPIQRVPMRSSN

SEQ ID NO: 37177 - protein, 464 aa, Photobacterium sp. SKA34
MLKLLTQVRKPTLDLPLAVRKKMWLAPFLRSYLVVFVSYMVMYFIRKNFNIAQNDLISDYGMSMTQLGTIGLGFSITYGIGKTALNYWCDGKNSKNILPLGLLLSGLCMLGFGLVMGPSMGSFYMMIGLYALSGLFQSVGGSNSYSTISKWTSKKNRGTFLGMWNISHNIGGAGAAGIALFGANYFFDGNVAGMFIVPSIIAIVVALIGFTMGNDSPESYGLGTAEELFEEPISEEDKAVNENQMSKLEIFKTYVLYNKVIWLLCFANVFLYVVRIGIDQWSTVYGYEILGFDKETAISGFTMFETGALIGTCLWGFFSDLINGRRGLVACIALIGVIATLGFYQHADTIFAYRASLFALGFLVFGPQLLIGVAAVGFVPKQGIAVADGIKGTFAYLIGDSFAKLGLGMIADGTPIFGQTGWAGTFVALDTAAVICCVIMAIVAVLEERKIYREKREKQQLATN

SEQ ID NO: 37178 - protein, 202 aa, Rhodopirellula baltica SH 1
MTSSNSNSSREVSLERKTGETDIKLSVNLDGSGAGKRDSGIGFLDHMLDLLAKHALIDLTVEAKGDLHVDDHHTAEDIGIALGTAVDRALGDRAGVRRYGHFTLPMDECLVTSAVDMGGRYAFEYNAPIAASKIGTFDSELVEHFWQSFAVNAKCNLHVLLHHGSNGHHISECVFKATARAIRMAVESDPRSDAIPSTKGVL

SEQ ID NO: 37179 - protein, 700 aa, Oryza sativa
MIAAVTSLSHPSTASSAKFDGRRSEERRKKGLIVAAASSALTSIPLSLLAMSRNLESPVQTQMAVSALNRALSSEYPSKSRSEGRASGWKRIFVQTDTGCVLAVQLDRGDNAHTVKRKLQLALNVPTEESSLTFGDRVLKNDLSTIRNDSPLLLTKTFMHRSSSTPCLSPTGKDIQQQRDRGGPIELLVCPSRCSRTKQLVKDVARAIRNGVDPIPVNSGLGGAYYFRNSKGENAAIVKPNDEEPFAPNNPKGFTGKALGQPGLKRSVRVGETGFREVAAYLLDYDNSANVPPTVLVKISHPVFNVNECVSSANMKASKDYPGAVSKIASFQQFIPHDFDASDHGTSSFPVSAVHRIGILDIRIFNTDRHAGNLLVRKLTGPGKFGNQTELIPIDHGLCLPECLEDPYFEWIHWPQASIPFSDDELDYIANLDPMKDADMLRMELPMIHEACLRVLILSTIFLKEATSFGLCLAEIGEMMSREFTGMEDQPSELEVVCMEARRLAIEREESSPEIDSGDEDAIQFELDCEDDHEMLKAQPAYHFELKGGSSRNPLSKLDEAIEEEEDDIEEEESNAEKLGYPKAINKWLPNISKLSTSLNGVRLGDKIQCQLPAAPKIMDPVKIFEGNSNHSGSQVGNWRSANEQLPTSASFVKLADMGSETWALFLEKFQELLPEAFRSRKCGAAGQRARQRLGTSCQF

SEQ ID NO: 37180 - protein, 294 aa, Zea mays
MEQYEKVEKIGEGTYGVVYKALDKATNETIALKKIRLEQEDEGVPSTAIREISLLKEMNHGNIVRLHDVVHSEKRIYLVFEYLDLDLKKFMDSCPEFAKNPTLIKSYLYQILRGVAYCHSHRVLHRDLKPQNLLIDRRNNALKLADFGLARAFGIPVRTFTHEVVTLWYRAPEILLGARQYSTPVDVWSVGCIFAEMVNQKPLFPGDSEIDELFKIFRVLGTPNEQGWPGVSCLPDFKTAFPRWQAQDLATIVPNLEPAGLDLLSKMLRYEPSKRITARQALEHEYFKDLEMVQ

SEQ ID NO: 37181 - protein, 540 aa, Burkholderia pseudomallei K96243
MTLNSLPVWPALQAHYEEIRDAHLRDWFAPANDRAPTRAERFTFEGGGLAADFSKNRLTDATLALLVRLAREAGVEARRDAMFAGETVNPTEGRAALHTALRANAPDAPFQAQVAAERAKMARFADAVRSGAWTGYTGKRIRHVVNIGIGGSDLGPKMVVHALHHVATPDIATHFVSNVDGADLARVLERIDPEATLAIIVSKTFTTLETMTNARSLRDWFVANGCPEGALAKHFVGVSANPAEVVKFGIAEANVFEMWDWVGGRYSLWSAVGLSIMIAIGPERFDELLAGARDMDEHFRTAPLERNLPVLQGLVGIWYRNFFGAQSYLVAPYSEALHYLPSYLQQLEMESNGKSARIDGAFVDYPTSAVTWGEPGTNGQHAFFQMLHQGPTLVPIDFIAVLTPEHPLASHHPKLLANCFAQSEALMLGRTLDEARKIVGPAKPELAPHLTFPGNRPTTTLLVDALTPRTLGALIALYEHKVLVQAAVWNINPFDQWGVELGKILGKVVEADLTAAQVDPAKHDSSTSALIARARKALGE

SEQ ID NO: 37182 - protein, 315 aa, Streptomyces avermitilis MA-4680
MELHGRAAETDRMTTQGTAQGTAPFGRALCAMITPFTAAGTLDLDGARRLADRLVSEGCDGLVLSGTTGESPTTTDAEKSALVRAVREAVGDRASIVAGVGTADTRHTVELALEAEKAGADGLLVVTPYYSRPPQEAVEAHFRDIADASGLPLVLYDIPGRTGTRIEPATMIRLAEHPRIVAVKDCAYDLLGTQKVLARTELAYYTGCDEYVLALYASGGAGYVSTVANVAPGHFRSILDAFDAGDPALAARLQQRAVPLIESMMAAGLPGTVTSKALLGRLGLPSGPVRAPLRPAGRETADGLLALYEELVSVS

SEQ ID NO: 37183 - protein, 227 aa, Coccidioides immitis RS
MANDEYDFLFKGTSYTPRPAMSNPILRALVLIGDSGVGKSNLLSRFTRNEFNLDSKSTIGVEFATRSIQVDSKTIKSQIWDTAGQERYRAITSAYYRGAVGALLVYDISKHQTYENVTRWLKELRDHADSNIVIMLVGNKSDLRHLRAVPTEEAKQFASDNNLSFIETSALDASNVELAFQNILTEIFRIVSSKALDSGDSAQNPLSDRKVVEITKTQDPESKQGCC

SEQ ID NO: 37184 - protein, 319 aa, Bacillus subtilis subsp. subtilis str. 168
MKRIGVLTSGGDSPGMNAAVRAVVRKAIYHDVEVYGIYNGYAGLISGKIEKLELGSVGDIIHRGGTKLYTARCPEFKTVEGREKGIANLKKLGIEGLVVIGGDGSYMGAKKLTEHGFPCVGVPGTIDNDIPGTDFTIGFDTALNTVIDAIDKIRDTATSHERTYVIEVMGRHAGDIALWAGLAGGAESILIPEADYDMHEIIARLKRGHERGKKHSIIIVAEGVGSGVEFGKRIEEETNLETRVSVLGHIQRGGSPSAADRVLASRLGAYAVELLLEGKGGRCVGIQNNKLVDHDIIEILETKHTVEQNMYQLSKELSI

SEQ ID NO: 37185 - protein, 471 aa, Citrus maxima
MASLRSATALSRLRSRAGQQSNLSNSVRWLQMQSSADLDLHSQLKEMIPEQQERLKKVKSDLGKAQLGNITIDVVIGGMRGMTGLLWETSLLDPDEGIRFRGLSIPECQKLLPAAKPDGEPLPEGLLWLLLTGKVPSKEQVDGLSKELRDRATVPDYVYKAIDALPVSAHPMTQFASGVMALQVQSEFQEAYEKGIHKSKSWEPTSEDSLNLIARVPVVAAYVYQRIYKDGKIIPKDDSLDYGGNFSHMLGFDDPKMLELMRLYVTIHSDHEGGNVSAHTGHLVASALSDPYLSFLAALNGLAGPLHGLANQEVLLWIKSVVDECGENVTTEQLKDYVWKTLNSGKVVPGFGHGVLRKTDPRYTCQREFALKHLPDDPLFQLVSKLYEVVPPILTKLGKVKNPWPNVDAHSGVLLNHFGLAEARYYTVLFGVSRSLGICSQLIWDRALGLPLERPKSVTLDWIEKNCKKAA

SEQ ID NO: 37186 - protein, 196 aa, Triticum aestivum
  misc_feature (29)..(29): Xaa can be any naturally occurring amino acid
RVGYAIKTDKLDALYEKVKLKGVTKTLLXVKAAGMALAQHPVVNASCRDGKSFSYNSSINIAVAVAIEGGLLTPVLEDVDKSDIYLLAQKWRALLKKTRMKQLQPNEYSSGTFSLSNLGMFGVDRFDAILPPGQGAIMAVGASRPTVIADKDGFFSIKNEMLVNVTADHRIIYGADLAAFLQTFAKIVEDPESLTL

SEQ ID NO: 37187 - protein, 410 aa, Bacillus subtilis subsp. subtilis str. 168
MSLREEALHLHKVNQGKLESKSKVEVRNAKDLSLAYSPGVAEPCKDIHEDINKVYDYTMKGNMVAVVTDGTAVLGLGNIGPEAALPVMEGKAVLFKSFAGVDAFPIALNTNDVDKIVETVKLLEPTFGGVNLEDIAAPNCFIIEERLKKETNIPVFHDDQHGTAIVTVAGLVNALKLSGKSMSSIKVVANGAGAAGIAIIKLLHHYGVRDIVMCDSKGAIYEGRPNGMNDVKNEVAKFTNQDRKDGSLKDVIVDADVFIGVSVAGALTKEMVQSMAKDPIIFAMANPNPEIMPEDAREAGASVVGTGRSDFPNQVNNVLAFPGIFRGALDVRATHINEEMKIAAVEAIASLVSEDELSADYVIPAPFDKRVAPAVAKAVAKAAMETGVARITVDPEEVAEKTRKLTIIGE

SEQ ID NO: 37188 - protein, 362 aa, Kluyveromyces lactis NRRL Y-1140
MVVHNPNNWHWVDKNCIDWAKKYFQEKLVGLTTGESTDELYAEITKLSSLEGDCEVNQRKGKVISLFDLKLNVGIAGHVGENKLEGSITVPEVAFDSDPEDYQFDISIFKETSKLFEIKPVIREKLIPQLRDIFSNFGKQLLLTHGNDIQVSSDKVTSKFTKANQQSSFSTSGSTKEDANKDSATGNTSTANASSSTKAAVTSSETQQKNSGNAAKYNTTKVHLESSFQVPAIELYNTFIDKRRIEAWSRSPIQPEANTGDFSGSTLQLNDAFKLFGGNITMKFLSGEPGKKIVFQWRLNDWKQGHYSELSLEFHESQEYHETKLVVNWSGIPVGEEDRVRGNFEEYYIRSIKVTFGFGAIL

SEQ ID NO: 37189 - protein, 168 aa, Triticum aestivum
MKGGRKNLRRACEEGTAVTLAEGESIMQVVTLRGSNLIEVTDGEGVKSLALFPAKFQKSFWIKNGNFVVVDASGRDEALESGSKIACVVSRVLFHDQVRALEKSGQWPAIFKSTPNGWATGPQGTTSQAEEEHNSDEDDDDDMPPLEANTNRNRPFDVHSDTESDSDS

SEQ ID NO: 37190 - protein, 420 aa, Arabidopsis thaliana
GGLNHEKCRNLKLRVDDSEATKYFVCPKFVEREQCTESYSNFNTSRCSCGVLMNEVTQLDGRGGLASAGNGVEGGVFVRSDHTSFMITDDLKVEITSVRLTLNVLKDLGYVDCEKLDEKIHDVNLEEVPTLLECLSTSDNPLTDTFLKKKSSYSTKRIQKLPSPGLCEDREESTPDQTITLNVVKKEGNILFVECGDDFVDLLFTFLAIPLESAWGIAGDGIIIGCIGNLSKSFKDLSVDPGREAKCVLPHYYKCQKQLLDAVTTHKPPTFYLYVSSMASNHIREYRLSEDSSKPLVYFWDELMPMISIDPKSKGSTNTTDESTIPSGGFMKRGTKFMITDDLIITPLNSTSTIGLVKEKQIRLDDVEVQEIIIRKEEAIRLLQASLVTCSALSTGLLAIESASTSVPQSANLKKPKIET

SEQ ID NO: 37191 - protein, 476 aa, Zea mays
EILKARHRRASSATFIFFSPSWGKWHRSIKIPFTTTMMAASSSSSFNLSDHLVQDDLPWPASSSSSSQLPFAPSHPPHGAIIGGSQQWWQQPQMLNCADRHPSDELEVLLSAQGSHHHHPSSSVIHPQLSSLLMMQDLGFQWSSCGSFVDTSSSPMPPPLVNGQQHDGHNKIKEWDRPLTANNSSRSSCASTAMACRDVVLDGGGGGGLPAMAAVAADLDDGTVLPASVNVPRTTTTRQRPFPAAPPPLPGDAFEILASSRLCKTLLLSQASSSVLLHNGTTMPLLRSEHVPYGPPAPAHPQGPSIGNYKQCMQMGASCGGRAQHEAACQSMAAAAARPALPVVPSSKKPRVEQRSSTIVPSFKVRKEKLGDRIAALQQLVSPFGKTDTASVLMEAIGYIKFLQDQVETLSRPYLKSSRSKKPRPTPRGSSNASAGELEETRPDLRSRGLCLVPLSCTSYVTNENGVWVPPNFRAN

SEQ ID NO: 37192 - protein, 107 aa, Oryza sativa (japonica cultivar-group)
MSGVLAKFAIASAVMWTAPVAIVYGFYYQMIPGVSQLSSSTQTLASGFLAVISINLVIGFYICMAMKETPHQEPQPDPTFLANAKASIDQPTPSQVNDDSHGKGKVE

SEQ ID NO: 37193 - protein, 145 aa, Zea mays; identical to SEQ ID NO: 1333

SEQ ID NO: 37194 - protein, 307 aa, Petunia x hybrida
MDQYEKVEKIGEGTYGVVYKARDRVTNETIALKKIRLEQEDEGVPSTAIREISLLKEMQHANIVRLQDVVHTVKSDCILSFEYLDLDLKKHMDSSPEFSKDPRLVKMFLYQILRGIAYCHSHRVLHRVLHRDLKPQNLLIGRRTNALKLADFGLARAFGIPVRTFTHEVVTLWYRAPEILLGSRHYSTPVDVWSVGCIFAEMVTQRPLFPGDSEIDELFKIFRVMGTPNEDTWPGVTTLPDFKSALPKWPSKDLATIVPNLDGAGLDLLDKTVRLDPSKRITARNALEHEYFKDIGYVFRSKGSSRV

SEQ ID NO: 37195 - protein, 955 aa, Flaveria brownii
MSSLFVEGMLLKSANESCLPASVKQRRIGDLRRLNHHRQPAFVRGICRRKLSGVSRIELRTGGLTLPRAVLNPVSPPVTTTKKRVFTFGKGNSEGNKDMKSLLGGKGANLAEMASIGLSVPPGLTISTEACEEYQQNGKKLPPGLWDEILEGLQYVQKEMSASLGDPSKALLLSVRSGAAISMPGMMDTVLNLGLNDEVVDGLAGKSGARFAYDSYRRFLDMFGNVVMGIPHSLFDEKLEQMKAEKGIHLDTDLTAADLKDLVEQYKNVYVEAKGEKFPTDPKKQLELAVNAVFDSWDSPRANKYRSINQITGLKGTAVNIQCMVFGNMGNTSGTGVLFTRNPSTGEKKLYGEFLVNAQGEDVVAGIRTPEDLVTMETCMPEAYRELVENCVILERHYKDMMDIEFTVQENRLWMLQCRTGKRTGKGAVRIAVDMVNEGLIDTRTAIKRVETQHLDQLLHPQFENPSAYKSHVVATGLPASPGAAVGQVVFSAEDAETWHAQGKSAILVRTETSPEDVGGMHAAAGILTARGGMTSHAAVVARGWGKCCVSGCADIRVNDDMKVFTIGDRVIKEGDWLSLNGSTGEVILGKQLLAPPAMSNDLETFMSWADQARRLKVMANADTPNDALTARNNGAQGIGLCRTEHMFFASDERIKAVRKMIMAVTPEQRKAALDLLLPYQRSSFEGIFRAMDGLPVTIRLLDPPLHEFLPEGDLEHIVNELTADTGMSKDEIYSRIEKLSEVNPMLGFRGCRLGISYPELTEMQVRAIFQAAVSMNNQGVTVIPEIMVPLVGTPQELRHQIGVIRGVAANVFAEMGLTLEYKVGTMIEIPRAALIADEIAKEAEFFSFGTNDLTQMTFGYSRDDVGKFLPIYLSQGILQHDPFEVLDQKGVGQLIKMATEKGRAANPNLKVGICGEHGGEPSSVAFFDGVGLDYVSCSPFRVPIARLAAAQVVV

SEQ ID NO: 37196 - protein, 531 aa, Burkholderia pseudomallei K96243
MILPAASPLPRSLEPFDAPPIHASAPLLSVAELRDIETAAAAALPPHTLMERAGKSAAQWLAARLVSDPRPVWFAVGPGNNGGDALVAAAELRRLGFAADAWMPIEVKPDDARWALARARAANVPIDEAAPESFDGYGWLVDGLFGIGLARPLDGAFAAIAQRIAARARHTGRVLALDVPSGLDSDTGARVGGGTAVTATCTLSFIAAKPGLYTGDGRDLAGEIHVAPLDLGEPPAPAIRLNAPELFEARLPERAFASHKGTYGSLGIVGGDTGMCGAPILAARAALFAGAGKVHVGFVGTGAPPYDPPYPELMLHPADALPSASLTALAIGCGLGASERAARVLAALLPLDAPKLIDADALNLIATTPALAAALAARGRTGDAAVLTPHPLEAARLIATDAADVQRDRVAAARALCARFSAVVVLKGSGTVIAAPDGRLAINPTGNAALATGGTGDVLGGLIGAFLAQRMPRYEAALAGVYLHGLAAERLCAAGAGPAGLAAGELAPAVRALVNRLFYTRPAAPDEAPLY

SEQ ID NO: 37197 - protein, 371 aa, Picrorhiza kurrooa
MSLVNSITWSQTSSILNIQSNISKKLTPFSILPHPLTNNLPISLFPNPKSNISNSNTPLSAILTKDQKPQNPPTTPTFDFKSYMLQKADSVNKALDDSIPLTEPLKIQESMRYSLLAGGKRIRPMLCIAACELVGGDESTAMPAACAVEMVHTMSLMHDDLPCMDNDDLRRGKPTNHKVFTEDVAVLAGDAMLAFSFEHVASLTKGVCSERIVRVIYELAKCVGCEGLVAGQVVDICSEGMDEVGLEHLEFIHLNKTAALLEGSVVLGAILGGGSDEEVEKLRNFARCIGLLFQVVDDILDVTKSSKELGKTAGKDLVADKTTYPKLIGIEKSKEFAERLNREAKEHLAGFDQNKAAPLIALADYIAYRDN

SEQ ID NO: 37198 - protein, 74 aa, Glycine max
  misc_feature (15)..(16): Xaa can be any naturally occurring amino acid
  misc_feature (31)..(31): Xaa can be any naturally occurring amino acid
  misc_feature (39)..(39): Xaa can be any naturally occurring amino acid
  misc_feature (41)..(41): Xaa can be any naturally occurring amino acid
  misc_feature (45)..(45): Xaa can be any naturally occurring amino acid
  misc_feature (51)..(51): Xaa can be any naturally occurring amino acid
  misc_feature (62)..(62): Xaa can be any naturally occurring amino acid
  misc_feature (65)..(65): Xaa can be any naturally occurring amino acid
  misc_feature (73)..(73): Xaa can be any naturally occurring amino acid
MSGRGKGSKGLGKGXXKRHRKFLRDNIQGIXTKPAIRRXAXRGGXKRISGXIYEETRGVLKXFLXNVIRDAVXT

SEQ ID NO: 37199 - protein, 602 aa, Burkholderia vietnamiensis G4
MRGTGFPLVSGRSSGRACARPDGSALRVSSNENPIMSNQDTFTAESNESNASNEPAASVSRRGFLKLAGVSSLATAASGLGAARAAAATPDGTPEQVHLTWGNDPSSEVAISWASLAPAVNPRARIVADGEPARTVHGVQRIYTDGLNGETVFTYHARVHGLKPNTRYRYELTADNDSNAAQPFAATFATAPRGRAPFRFTSYGDLATPNGAWVLSSPQSRFAVQAVEQFQPLFHLLNGDLCYANLNPAHQPEVWRDFGNNNQSSAANRPWMPCPGNHEIEFNNGPQGLDSYLARYQLPENGTRFPGRWYSFRVSSVLFISLDADDVVYQDAAAFVAGPAPLVPAASTGHAPIEPGTSFYVRGYSNGEQTRWLEHTLRHAAHDDDIDWIVVQMHQDALSSSKTGNGSDKGIREAWLPLFDRYGVDLVLCGHDHDYERSYPVRGCNHRAGVDASTGEVVETLQPRPVGPADPDRTTFDTSAGTIHLILGGGGTSAPLDVYGENPATGYAQAKVFTKPNRPVPGTAPNTFVRKPADALEDAIWSARRDTGTGYGIAVFDHDPGKPGGHTTITMRYYHAPGADQHPSPQYELFETIELRKQRREH

SEQ ID NO: 37200 - protein, 164 aa, Euphorbia esula
MSADIEYRCFVGGLAWATTDQSLQEAFSPYGEILDSKIINDRETGRSRGFGFVTFNNEKSMRDAIQGMNSQELDGRNITVNEAQSRGSGGGGGGGGYSRGGGGGGYGGGGRREGGYGGGGGGYNSRSSGGGGGYGGGRDQGYGGGGGGSRYSRGGGESDGNWKN

SEQ ID NO: 37201 - protein, 285 aa, Zea mays
  misc_feature (110)..(110): Xaa can be any naturally occurring amino acid
  misc_feature (115)..(115): Xaa can be any naturally occurring amino acid
YLPSHCRCSRLRIAHYLRFWDIYVREKQLDRSIKKTGEALAPDRQCRTQPQGRRRSVPDEVARHHEHAVAAGQCCSVMVQSIAAPADAVWSLVRRFDQPQGYKRFTQSCXLVDGXGVEVGSVRELLVVSGLPAESSRERLEIRDDERRVISFRILGGDHRLANYRSVTTVHEAASEGGPLTMVVESYVVDVPPGNTVEETRIFVDTIVRCNLQSLEDTVIRQQAMAAPAAARRQPELTPSPSQLGLPVSSEASSAIYDVFFRRWYCIVSQIRRIGTVNCLKVLRQ

SEQ ID NO: 37202 - protein, 204 aa, Ostreococcus tauri
  misc_feature (1)..(2): Xaa can be any naturally occurring amino acid
XXLLLPRRTKGCDQSCRLAGWHWLVLDNGQEVRLQRNALTVVEAPESQDGDGEDADDGEGDGEDIENGEDGEEEEEDGDDDEDDDDDDDDDSKDNMKTRLRRPTRIPGNGPPSQAAAAAMKRLQERRRSARPNCMSNFERLTLTTLLKYKKMYGLEPNAETDSDKTALTHEIAKHFMSQKLDEQKVLQDFMCAVADTTQVRPVG

SEQ ID NO: 37203 - protein, 734 aa, Bacteroides fragilis NCTC 9343
MDSILFWLVPFASVLALCFALYFHKQMMKESEGTPQMIKIAAAVRRGAMSYLKQQYKIVGWVFLGLVILFSVMAYGFQVQNAWVPIAFLTGGFFSGLSGFLGMKTATYASARTANAARTSLNAGLRIAFRSGAVMGLVVVGLGLLDISFWYLLLNWAIPADVLTPTHKLCIITTTMLTFGMGASTQALFARVGGGIYTKAADVGADLVGKVEAGIPEDDPRNPATIADNVGDNVGDVAGMGADLYESYCGSILATAALGAAAFIHTDDTVMQFKAVIAPMLIAAIGIILSIIGIFSVRTKENATMKDLLGSLAWGTNLSSALIVAVTFFILWLLQLDNWMWISCAVVVGLVVGIVIGRSTEYYTSQSYRPTQKLSESGKTGPATVIISGIGLGMLSTAIPVVAVVIGIIASYLLASGFDFNNVGMGLYGIGIAAVGMLSTLGITLATDAYGPIADNAGGNAEMSSLGKEVRKRTDALDSLGNTTAATGKGFAIGSAALTGLALLASYIEEIRIGLTRLGNLVLTFPNGDTISTANATFVDFMNYYEVNLMNPKVLSGMFLGSMMAFLFCGLTMNAVGRAAGHMVDEVRRQFREMKGILTGETEPDYERCVAISTKGAQREMVVPSLIAIIAPILTGLIFGVPGVLGLLIGGLSSGFVLAIFMANAGGAWDNAKKYVEEGNFGGKGSEVHKATVVGDTVGDPFKDTSGPSLNILIKLMSMVAIVMAGLTVAWSLF

SEQ ID NO: 37204 - protein, 173 aa, Zea mays
MQRGDPLVVGRIIGDVVDPFVRRVPLRVAYAAREVSNGCELRPSAIADQPRVEVGGPDMRTFYTLVMVDPDAPSPSDPNLREYLHWLVTDIPATTGVSFGTEVVCYESPRPVLGIHRVVFLLFQQLGRQTVYAPGWRQNFSTRDFAELYNLGLPVAAVYFNCQRESGTGGRRM

SEQ ID NO: 37205 - protein, 963 aa, Bordetella pertussis Tohama I
MAQALPTMDRRTFLRRSGLGVGAGLAATQLSLVKRAEAAEGDGKVAIGNTKIEVRRTVCTHCSVGCAVDAVVENGVWVRQEPVFDSPINLGAHCAKGASVREHGHGEHRLRYPMKLVNGKYQRISWDTAYEEITAKLMQLRKESGPDSVYWIGSSKHNNEQSYLLRKFVSFWGSNNCDHQARICHSTTVAGVANTWGYGAMTNSYNDMQNSKVALYIGSNAAEAHPVSMLHMLHAKETGCKMIVVDPRFTRTAAKADQYVRIRSGTDIPFLFGLLYHIFKNGWEDQAYIDARVYGMDEVKADILAKWSPDKVEEACGVDEATMYSVAKTMHENRPGTLVWCMGQTQHSIGNAMVRASCIVQLALGNVGKSGGGANIFRGHDNVQGATDVGPNPDSLPGYYGLAEGSWKHFANTWGVDYEWIKDRYASPAMMTKPGITVSRWIDGVLENPDLIDQDTNLRAVFYWGHAPNSQTRGLEMKRAMDKLDLLVVVDPYPSATAAMAAMPGKAEDLNPNRAVYLLPAATQFETNGSCTASNRSLQWREKVIDPLWESRTDHMIMHQLAEKLGFGKELSKNYKMQKVKGMDEPVVEDILREINASVWAIGYTGQSPERLKAHMRNMHVFDVKTLRAKGGKDAETGYDLTGDYFGLPWPCWGNPSLKHPGTANLYDTSLHVMDGSGNFRANFGVERNGVNLLAADGSHSKGADLTTGYPEFDHVLLKKLGWWEDLTPEEQKAAEGKNWKTDPSGGIIRVTMKVHGCHPFGNARARAVVWNFPDAIPQHREPIYGTRPDLVAKYPTHNDLKTFWRLPTLYTSLQQKNVAEKLYEKFPIILTSGRLVEYEGGGEETRSNPWLAELQQESFVELNPKAAADRGIRNGDRVWVLTPTGARLNVQALVTERVGPDTAFMPFHFSGHWQGVDMLASYPEGAAPIVRGEAVNTGTTYGYDSVTMMQETKTTICNIEKA

SEQ ID NO: 37206 - protein, 546 aa, Burkholderia pseudomallei K96243
MGKPLLGQMMDMPLLVSSLIAHAARHAGDVEIVSRRVEGDIHRYTYRDCEARSKRLAQALTGLGVGVGERIGTLAWNGYRHVEAYYGISGMGAVCHTINPRLFPEQIAYIVNHAEDRYVLFDLTFAPLVDQLAPQCPNVKGWIAMTDDAHLPKGATPYLCYETLVGAQDGDYAWPLLDERQASSLCYTSGTTGHPKGALYSHRSTVLHAYGAALPDAMGLSSRDAALPVVPMFHVNAWGLPYTAALTGTKLVLPGKDLDGKSLYELIESERVTFSAGVPTVWLGLLGYMREAGVRFSTLERTVIGGSACPPSMLETFEDVYDVRVIHAWGMTELSPLGTLAKLNWAQSQRGIGEQRRLLEKQGRVIYGIDMRIVGEDGRELPWDGVAFGDLQVRGPWVIDRYFGIDASPLVDGWFPTGDVATIDADGFLQITDRSKDVIKSGGEWISSIDVENVAVAHPAVAEAACIACAHPKWTERPLLVVVKRAGMDVTRDELLAFYEGKVAKWWIPDDVAFVDALPHTATGKLQKLKLREQFRGHVLPTAVDA

SEQ ID NO: 37207 - protein, 312 aa, Leptospira interrogans serovar Lai str. 56601
MTFHHKEFHILSSSDKSKLYCQSWTKSNSNRLLIFHHGFGEHSGRYTNLIRYFSKSDINFYSFDMRGHGNSDGKRGHSDSFDLYVRDLADFVSEVLKREQKERFFLLGHSLGGAITLRYSQEGINQDNILGLILGSPALRVRMDFRKKLKKFAAGILSKISPSSVVDAELNLQYLSHDPEVIESYKQDPLVHGKVSLKMGTELLKIGPQLIKKANVLRCPVLILHGQEDGLVDVNGSTELYKNLIYRNKRIKIYPGFYHELMNEFPEHREIVLNDIQTFLETIQREKIDFESLKLQRKEVVSRKKRNPVSNP

SEQ ID NO: 37208 - protein, 329 aa, Streptomyces avermitilis MA-4680
MKAAVIESVGKAVVAEVPDPTPGPREVVVEVAACGLCGTDLHILQGEFAPKLPIVPGHEFAGEVVGLGTQVTEVSVGDRVAVDPSLYCYECRYCRTGHNNLCERWAAIGVTTAGGAARYAVAPVANCVKLPEHVRTQDAALIEPLSCAVRGYDVLRSRLGAHVLVYGSGTMGLMMLELAKRTGAASVDVVDVNPARLTTARQLGVSGSAANADELDRPQGWDVVVDATGNAAAIQDGLGRVAKAGTFLQFGVADYATRVTIDPYRIYNQEITITGSMAVLHSFERAAELFAGGVLDPDVFISDRIPLARYPQALEQFASGVGRKIVVVP

SEQ ID NO: 37209 - protein, 618 aa, Kineococcus radiotolerans SRS30216
MSNSVQMPALGESVTEGTVTRWLKAVGDTVEVDEPLLEVSTDKVDTEIPSPVAGTLLEILVPEDETADVGADLARIGDPSEQGGGSPAPQEQPAPAAPQDAPAPPSTEDTQAAPQAAQEPSPEEPPAAAAAPAPGGGEAVKMPALGESVTEGTVTRWLKAVGDSVEVDEPLLEVSTDKVDTEIPSPVAGTLLEILVGEDETADVGADLARIGDASAAPSPAPAAPAQEAPAAPQEESLADEVAERETARAQAESATQPSSTPSAEPASAPAQPVAPAPAPAAPAPQAPASTPAPAEVTGGGTYVTPLVRKLAKDLGVDLATVTGTGVGGRVRKQDVQEAADKAAEAARAAEAKAAEAAAPAPAAAAEKPAAKPAPAVEVSAKRGTTEKMSRLRKVIAQRMKESLQNSAQLTTVIEVDVTKIARLRARAKDGFLATEGAKLTFLPFFVKAAVEALKQHPSLNASIDGENIVYHGSENVSMAVDTPKGLITPVIKDAGDLNLGGLARKIADLAARTRASKITPDDLSGGTFTITNTGSIGALFDTPILNAPQVAILGTGAIVKRPVVLEVDGQETIAIRSMMYLALSYDHQIVDGADAARFLQTVKKRIEAGEFEGELGL

SEQ ID NO: 37210 - protein, 477 aa, Kineococcus radiotolerans SRS30216
MRGSRRSSRQHSRPQEHFVAGAAEQQYDVVILGGGSGGYACALRSAELGLKVALVEKDLLGGTCLHRGCIPTKALLHAAEVADSAKESETFGVRATFDSIDMAGVNKYKDGVIARLYKGLQGLVKSRKIDLVAGTGKLVAKNTVEVDGQRYTGKAVVLASGSYSRSLPGLEVGGRIMTSEQALALDSVPDRVVVLGGGVIGVEFASVWRSFGADVTIVEALPHLVPLEDEAASKALERAFRKRGIKFSLGVRFKGVEQTDSGVVVSLEDGKTFEADLMLVAVGRGPNTAGLGYEDQGITMDRGFVLTDERLRTNVEGVYAVGDIVPGLQLAHRGFAQGIFVAEDIAGLAPAPIDELGIPKVTYCEPEVASVGLTEAKAREKYGDVDVVEYNLGGNGKSQIIGTTGFVKLVRQKDGPVVGVHMVGSRMSEQVGEAQLIVNWEAYPDDVASLVHTHPTQNEAVGEAFLALAGKPLHSHA

SEQ ID NO: 37211 - protein, 355 aa, Escherichia coli W3110
MSQKYLFIDRDGTLISEPPSDFQVDRFDKLAFEPGVIPELLKLQKAGYKLVMITNQDGLGTQSFPQADFDGPHNLMMQIFTSQGVQFDEVLICPHLPADECDCRKPKVKLVERYLAEQAMDRANSYVIGDRATDIQLAENMGITGLRYDRETLNWPMIGEQLTRRDRYAHVVRNTKETQIDVQVWLDREGGSKINTGVGFFDHMLDQIATHGGFRMEINVKGDLYIDDHHTVEDTGLALGEALKIALGDKRGICRFGFVLPMDECLARCALDISGRPHLEYKAEFTYQRVGDLSTEMIEHFFRSLSYTMGVTLHLKTKGKNDHHRVESLFKAFGRTLRQAIRVEGDTLPSSKGVL

SEQ ID NO: 37212 - protein, 844 aa, Candida albicans SC5314
MSNNNFQESSNNTSSPSKRSTPMLFLDAENKTQEALTTFELLNACTYQNKYVGSANVTTTATTSTKTSNSTSTKSHQQQHRRKLEYMTCDCEEEWDSELQMNLACGPDSNCINRITCVECVNRNCLCGDDCQNQRFQNRQYSKVKVIQTELKGYGLIAEQDIEENQFIYEYIGEVIDEISFRQRMIEYDLRHLKHFYFMMLSNDSFIDATEKGSLGRFINHSCNPNAFVDKWHVGDRLRMGIFAKRKISRGEEITFDYNVDRYGAQSQPCYCGEPNCIKFMGGKTQTDAALLLPQMIAEALGVTPRQEKAWLKENKSIRNQQQNDESNINEEFVNSIEIEPIENQDGVTKVMSALMKTQHPLIIKKLIERIFLSNDQDDINVMFVRFHGYKTISTILQDLLVAKNSGKESETTDNNDIDNSTGDDDQDKDELIIKILKILVSWPAVTKNKIASANLEEVVKDIQTNNENSNNNDEINQLCTSLLDRWSKLEMAYRIPKQESVPTNNAAAAATTTATATGTTTSASPFERISSHTPEVGGTNTPSSTSQQQQQQNSRDAGLPENWRSAFDKNTGGYYYYNLVTKETTWERPLGSLPLGPKPPSGPGLKGRINKYNEIDLAKREELRIQKEKEMKFIEMQNRDRKLKELIEMSKKSMNNIGGSSGTTITAATINGLSDNGGNNNGNITGIYGDDKHSKHHHHHHDKHLKNGPRNTSTSSSSGNNVEKIWKRIFAKYIPNIIKKYESEIGRDNVKGCAKELVNILTQSEIKHGNSLPSSSSSNGYSMELSDKKLKKIKEYSHGYMDKFLIKFNNSKKHKSTMGSKGSDNHKRKHNGDGDNGVKRSKV

SEQ ID NO: 37213 - protein, 278 aa, Zea mays
  misc_feature (158)..(158): Xaa can be any naturally occurring amino acid
TLDPRVREGAQGSDAAAPGGEVEENMAAWLVAKNTLKIMPFKLPPVGPYDVRVRMKAVGICGSDVHYLREMRIAHFVVKEPMVIGHECAGVVEEVGAGVTHLSVGDRVALEPGVSCWRCRHCKGGRFNLCEDMKFFATPPVHGSLANQVVHPADLCFXLPDGVSLEEGALCEPLSVGVPACRRAGVGPDTGVLVVGARPLGPVVPAGWRGPFCAPCLVVPVVDDPRLALCPFSGPRSRLCGWRPLRGALWPRWNVSPLFWAPPLSRCLFCRRFPLLLS

SEQ ID NO: 37214 - protein, 458 aa, Carboxydothermus hydrogenoformans Z-2901
MIKFGTDGWRGIIAKDFTFASLEKVTLGLAAYLQEKYRAGAVVVGYDCRFLSEHFAETVAEILLKSGFDVYLPEKFVPTPYVAFAINKLKAIGGVMLTASHNPPEYNGFKFIPDYAGPALPDITDRLEQLINAGAVPSLKEKGKKLTLNLESAYVDHLKKLTGLNYGQGTVVVDPMYGAGQGYLEKVLTDFGYTVSTIRNYRDPLFGGSMPEPKQKELKPLVEAIKNKKADLGLALDGDADRFGIVEGERLFTANEVLILTYHYLIESGRGGDVARTVPTTHLLDKMARANGFNVIETPVGFKYIGKALREGAVLGGEESGGLSIAGHVPEKDGILADLLAVKIREFFKKPLTEVLEDVYTRYGRSYTRRDDYRTTPEQKEEILKRLSSLKLTEIAGEKVLRESRVDGMKWELASGSFVLVRASGTEPVFRIYGEAESEEKLDLLLNEIKMVVLGTVL

SEQ ID NO: 37215 - protein, 180 aa, Triticum aestivum
MARHHLLLFPPLLALAFSFVVAAPEGDAAAFIDGASHRYLRDQQEDQATSMSLDEVSAAVSVLLGFAPPAMLPAPSSAKLNKLLLPNPFDRPRSVFLMQLDGSHDYVDGFISDAGSIYKTKIDGAKSAAIELTDKDELIVIRSDESSGLDVLDNELANLEADVEFASSLISLLKTIERGI

SEQ ID NO: 37216 - protein, 148 aa, Oryza sativa
  misc_feature (95)..(95): Xaa can be any naturally occurring amino acid
MFAEENGLKGDPRLQAISQAIRVVPHFPIHGIMFQDITTLLLDHKAFKDTVDIFVDRYRDTHISVVAGIEARGFMFGPSIALGIGAKFVPLRKPXGSLPGEEIQKKKALKNGPDGWKWKVGAANPGNRPLTMENWVATGGTMSAGVKL

SEQ ID NO: 37217 - protein, 359 aa, Pseudomonas syringae pv. tomato str. DC3000
MVIDTAIISKAYDDLRAGFDFAKVYYAVKANPAVEVINLLKDKGSSFDIASIYELDKVLSCGVGPERMSYGNTIKKSKDIRYFYEKGVRLFATDSEADLRNIAKAAPGAKVYVRILTEGSTTADWPLSRKFGCQTDMAMDLLILARDLGLVPYGISFHVGSQQRDISVWDAAIAKVKVIFERLKEEDGIVLKLINMGGGFPANYITRTNSLETYAEEIIRFLKEDFGDDLPEIILEPGRSLISNAGILVSEVVLVARKSRTAVERWVYTDVGKFSGLIETMDEAIKFPIWTEKKGEMEEVVIAGPTCDSADIMYENYKYGLPLNLAIGDRMYWLSTGAYTTSYSAVEFNGFPPLKSFYL

SEQ ID NO: 37218 - protein, 504 aa, Bacteroides fragilis NCTC 9343
MSKKALLMILDGWGLGDHGKDDVIFNTATPYWDYLMETYPHSQLQASGENVGLPDGQMGNSEVGHLNIGAGRVVYQDLVKINLSCRDNSILKNPEIVSAFSYAKENGKNVHFMGLTSDGGVHSSLDHLFKLCDIAKEYNIENTFVHCFMDGRDTDPKSGKGFIEQLEAHCAKSAGKVASIIGRYYAMDRDKRWERVKEAYDLLVNGIGKKATDMVQAMQESYDEGVTDEFIKPIVNAGVDGTIKEGDVVIFFNYRNDRAKELTVVLTQQDMPEAGMHTIPGLQYYCMTPYDASFKGVHILFDKENVVNTLGEYLAANGKKQLHIAETEKYAHVTFFFNGGRETPYDNEDRILVPSPKVATYDLKPEMSAYEVKDKLVAAINENKYDFIVVNYANGDMVGHTGIYEAIEKAVVAVDACVKDTIEAAKAQGYEAIIIADHGNADHALNEDGTPNTAHSLNPVPCVYVTENKEAKVADGRLADVAPTILHILDMVQPAEMTGCNLIK

SEQ ID NO: 37219 - protein, 631 aa, Salmonella enterica subsp. enterica serovar Typhi str. CT18
MSTTTLTRREQRAKAQHFIDTLEGTAFPNSKRIYVTGSQHDIRVPMREIQLSPTLIGGSKDNPQFEENEAVPVYDTSGPYGDPEVAINVQQGLAKLRQPWIDARNDSEELDDRSSAYTRERLADDGLDDLRFTGLLTPKRAKAGKRVTQLHYARQGIVTPEMEFIAIRENMGRERIRSEVLRHQHPGMNFGARLPENITPEFVRDEVAAGRAIIPANINHPESEPMIIGRNFLVKVNANIGNSAVTSSIEEEVEKLVWSTRWGADTVMDLSTGRYIHETREWILRNSPVPIGTVPIYQALEKVNGIAEDLTWEAFRDTLLEQAEQGVDYFTIHAGVLLRYVPMTAKRLTGIVSRGGSIMAKWCLSHHKENFLFEHFREICEICSAYDVSLSLGDGLRPGSIQDANDEAQFSELHTLGELTNIAWEYDVQVMIEGPGHVPMHMIQRNMTEELESCHEAPFYTLGPLTTDIAPGYDHFTSGIGAAMIGWFGCAMLCYVTPKEHLGLPNKEDVKQGLITYKIAAHAADLAKGHPGAQIRDNAMSKARFEFRWEDQFNLALDPFTARAYHDETLPQESGKVAHFCSMCGPKFCSMKISQEVRDYAAAQAIEVGMADMSENFRAKGGEIYLKREEA

SEQ ID NO: 37220 - protein, 199 aa, Helicobacter pylori 26695
MVKIGVCGPVGSGKTALIEALTRHMSKDYDMAVITNDIYTKEDAEFMCKNSVMPRERIIGVETGGCPHTAIREDASMNLEAVEEMHGRFPNLELLLIESGGDNLSATFNPELADFTIFVIDVAEGDKIPRKGGPGITRSDLLVINKIDLAPYVGADLKVMERDSKKMRGEKPFIFTNIRAKEGLDDVIAWIKRNALLED

SEQ ID NO: 37221 - protein, 396 aa, Oryza sativa (japonica cultivar-group)
MATFSGTDRLRDLHAFDDTKAGVKGLVDAGVTTVPYFFRHHPDPLPVAAPSEAAAAIPLIDLAKADVDRGHVVSQVRSAAESAGLFQVVNHGVAGELMDAMLAAARRFNEQPAEAKAPYYTRDLGSKVRFFCNFDLFQSPAAQWRDTLYVEMVPDAPSPEEIPPPLRGVAEDFAAAVWRLGERVTELLSEALGLPPGYLAEHAGCMDGMSMVAQYYPPCPEPEKTMGTTRHSDPSFLTVLLQDESGGLQAVLPRPPEERWVDVPPVAGALVVNVGDLLQLVSNGRLRSMEHRVLPTAASAARARVAVACFFRLEYSASLTRPRSYGPIVDSGEGGARRAAAVYRSTTPRDFLAYFNGKGLDGRSALEHFRIPEAAAASSAVDVVSSSTTAAASIPR

SEQ ID NO: 37222 - protein, 94 aa, Triticum aestivum
  misc_feature (40)..(40): Xaa can be any naturally occurring amino acid
  misc_feature (65)..(65): Xaa can be any naturally occurring amino acid
EKHVGRSQSCVNYSRWSSPRKPSMIQTGTWRKQHTLIPCXRRTHSQSTSLPQRSHDYLSPTVSSXAMKKRNSMELQQPPKPRRIIVQSSPKWMF

SEQ ID NO: 37223 - protein, 332 aa, Burkholderia pseudomallei K96243
MSQVNRRVLLVSRPEREARVENFELVETPLAPLAVGEVRVRNHFLSIDPYMRGRMNAGRSYAEPQPLGEVMGGGTAGEVVESRNPAFAPGDRVIGAYGWQEYGTSTGKELRKVDTTRVPLSAYLGAAGMPGVTAWYGLNRIIRPRAGETLVVSAASGAVGSVVGQLAKLAGCRAVGIAGGADKCRYVVDTLGFDACVDYKAGRLADDLAAAAPDGVDGCFENVGGAVLDATLARMNPFGRIAMCGMIAAYDGAPAPLANPALILRERLLVQGFIVSEHFDVWPEALAQLASLVANRQLHYRETIAQGLERAPDALLGLLKGRNFGKQLVALV

SEQ ID NO: 37224 - protein, 358 aa, Bordetella pertussis Tohama I
MTHQIAVLPGDGIGPEIVEQAERVLKALDLPLELRQAPVGGAAFDQFEHPLPPATLELAQGSHAVLFGAVGDWKYDTLPREFRPEQAILGLRKALGLFANLRPAILYPELASASSLKPEIVSGLDILIIRELTGDIYFGTPRGVRTAADGAFAGEREGYDTMRYAESEVRRIARIGFESARKRNKKLCSVDKANVLETSQFWRDLVIEVSRDYLDVELSHMYVDNAAMQLVRNPRQFDVIVTGNLFGDILSDEAAMLTGSIGMLPSASLNAAGQGLYEPSHGSAPDIAGQGIANPLATILSAAMLLRYSLNLAPQADRVEAAVRKVLADGLRTADIHEAGTTKVSTSQMGDAVLKALG

SEQ ID NO: 37225 - protein, 331 aa, Burkholderia pseudomallei K96243
MRCCLPRRLPLTMPLNPKIAQVLDMIERAKRPDYHEQTPAQARAAYEKSAPILDVAPAPMFSVEDLRVPSRDGGAFGARLYLPVEPSLAEPLPVLVYYHGGGFTVGSVNTHDALCRMFARDAQCAVLSVDYRLAPEHKFPTAVDDAEDALVWLHAHASRFGIDSARLAVGGDSAGGTLATVCAVLARDRGIALALQLLIYPGTVGHQQTESHARLAKGYLLSADTIQWFFGHYVRDASDRDDWRFAPLDGTRGAPSFERVAPAWIATAQYDPLSDEGEAYADKLRAAGNRVTLVAYAGMIHEFFKMGGYVPEVRLAHADAVGALRAAFDGD

SEQ ID NO: 37226 - protein, 518 aa, Oryza sativa (japonica cultivar-group)
MGVTKAEAVAGDGGKVVDDIEALADLRKEPAWKRFLSHIGPGFMVCLAYLDPGNMETDLQAGANHKYELLWVILIGLIFALIIQSLSANLGVVTGRHLAELCKTEYPVWVKTCLWLLAELAVIASDIPEVIGTGFAFNLLFHIPVWTGVLIAGSSTLLLLGLQRYGVRKLEVVVALLVFVMAGCFFVEMSIVKPPVNEVLQGLFIPRLSGPGATGDSIALLGALVMPHNLFLHSALVLSRNTPASAKGMKDVCRFFLFESGIALFVALLVNIAIISVSGTVCNATNLSPEDAVKCSDLTLDSSSFLLRNVLGKSSATVYGVALLASGQSSTITGTYAGQYVMQGFLDIKMKQWLRNLMTRSIAIVPSLIVSIIGGSSGAGRLIVIASMILSFELPFALIPLLKFSSSSNKMGENKNSIYIVGFSWVLGFVIIGINIYFLSTKLVGWILHNALPTFANVLIGIVLFPLMLLYVVAVIYLTFRKDTVKFVSRRELQAGDDTEKAQVATCVADEHSKEPPV

SEQ ID NO: 37227 - protein, 283 aa, Burkholderia pseudomallei K96243
MCLIVFDWQPDTTHGPVLTLAANRDEFFRRTSAPLAWWSDAPHVLAGRDLEGGGTWLGVARDGRFAALTNYRAPFDIRAGAPTRGKLVSGFLTGENVAPLDYLANVAEKAVFYNGFTLLAGDVARGELAWYCNRPADAQPAPDAPVSVAPGVHGLSNARLDTPWPKLVGKRSALGALLTGDAAAPLDALIEMMRDTREAADDALPHTGIPLERERALSAAFIETPEYGSRGTTVLRVARDAEGRLRFDMKERCDDDGSHRIVRPGAFERAFTFDVDTGGHPRR

SEQ ID NO: 37228 - protein, 115 aa, Streptococcus pyogenes M1 GAS
MNPLIQSLTEGQLRSDIPNFRPGDTVRVHAKVVEGTRERIQIFEGVVISRKGQGISEMYTVRKISGGIGVERTFPIHTPRVDKIEVIRHGKVRRAKLYYLRALQGKAARIKEIRR

SEQ ID NO: 37229 - protein, 322 aa, Zea mays
MAPAGNGADDHELPLFHPSPCAHYYVQSPSAASHTLSHPASDSMALILSPFPNLHHDADARHSSDGRDHEHDHEEASRLTLSRYSSSRGSNSSFPVGDKKPGRRRHALSGRSSGRHDDGDDDADGEAQRSGAWRYVKLDPEAPCCCIAFQVAWRVAASAALALLVFVLGHQGRGTPRVSFRLGKVQRFALGKGLDGSGVETSFLNCNSSVDMAVENHSKGDGWSHDVGPRGTSTVRLFVAAQDKPMYAAGRGMQDLLESSHGLPLTVTVRARSRYRVVGSLVRLTYRHDSECVVLLRRTPDRSNGIRAAAGSRATTTCSALS

SEQ ID NO: 37230 - protein, 435 aa, Streptococcus pyogenes M1 GAS
MSIITDVYAREVLDSRGNPTLEVEVYTESGAFGRGMVPSGASTGEHEAVELRDGDKSRYLGLGTQKAVDNVNNIIAEAIIGYDVRDQQAIDRAMIALDGTPNKGKLGANAILGVSIAVARAAADYLEVPLYTYLGGFNTKVLPTPMMNIINGGSHSDAPIAFQEFMIMPVGAPTFKEGLRWGAEVFHALKKILKERGLVTAVGDEGGFAPKFEGTEDGVETILKAIEAAGYEAGENGIMIGFDCASSEFYDKERKVYDYTKFEGEGAAVRTSAEQVDYLEELVNKYPIITIEDGMDENDWDGWKVLTERLGKRVQLVGDDFFVTNTEYLARGIKENAANSILIKVNQIGTLTETFEAIEMAKEAGYTAVVSHRSGETEDSTIADIAVATNAGQIKTGSLSRTDRIAKYNQLLRIEDQLGEVAQYKGIKSFYNLKK

SEQ ID NO: 37231 - protein, 304 aa, Glycine max
MAATSTSLFSSNLHSLNSQPFSSSLSFFRNVHSTLSFPSSKPSRGVVAMAGSGKFFVGGNWKCNGTKDSIRKLVSDLNSATLESDVDVVVAPPFVYIDQVKNSITDRIEISAQNSWVGKGGAFTGEISVEQLKDLGCKWVILGHSERRHVIGENDEFIGKKAVYALSEGLGVIACIGELLQEREAGKTFDVCFQQLKAFADVVPSWDNIVIAYEPVWAIGTGKVATPEQAQEVHAAVRDWLKKNVSAEVSSKTRIIYGGSVNASNSAELAKQEDIDGFLVGGASLKGPEFATIINSVTSKKVVA

SEQ ID NO: 37232 - protein, 410 aa, Oryza sativa (japonica cultivar-group)
MAGGRPLESVLVAPGVKGKKVLAFKRDGLKKNEAVTGLIHDIVASSSARSAFHVLDLAKVVDLYAGWRRALPGVRPFYAVKCNPDTALLGALAALGAGFDCASRAEIEAVLALGVPPAAIVYANPCKPGAHVAFAAEAGVNVTTYDSEEEVAKVKRCHPSCELLLRIKAPDCGGVKVDLGLKYGANPDEVLPLLRAARRAGLGVAGVSFHVGSGASRAAVYRGAIEAARAAFDAAAGLGMPPMRVLNIGGGFVAGAAFGDAAAVINRALGRYFGDLLPTVELIGEPGRYFAETAFTLAARVIGKRRRGDVREYWIDDGVYGSLNCILLDSYVPRPRPLAGARPGEETHASTVFGPTCDSIDTVVTGYQLPEMSVDDWLVFDDMGAYTTAAGSSFNGFATSAINTYLAYSS

SEQ ID NO: 37233 - protein, 623 aa, Psychrobacter arcticus 273-4
MCGLLGLIDYTKTTSEDIFSEMLSCLVKRGPDSEGIDLFYDDSCSVLLGHRRLAIQDLSNHGHQPMKYDNLVTIYNGEVYNFKEIQQQLLEKGYFFESDSDTEVILKAFHCWGIKSVDKFRGMFAFAIYDINKREITIFRDRVGVKPLYYSQTEDSFIFSSELKPFISFPNFDKSIDFEAVSSYLQFGYIHAPKSIFSSAKKLLPGHYLKFDIASKKLSIDCYWDVTDYFEDKTNVTDITAITDELESIIIESFNLRMISDVPVGTFLSGGVDSSLVTAILQKYSDIPINTFTIGFEDKNYDESIYAKAIADHLGTNHTEYICKKEDALEIIKELPKIFDEPFADSSAIPTTLVSKLAKEKVSVILSGDGGDELFCGYSSYTLMEKRFASISKIPFKNSIKKLSDFIPFPLVLLNGINENLYTKFMKFRNLLEHDDIANAFKVSNSVFCKDEIDKIISQEYFFNEDSISHVSTLEKMMISDFKGYLPDDLLVKVDRSTMSVSLEGREPLLDHKIIEFAARMPISLKKNKSILKDILKRYVPEELFLRKKQGFGIPINSWLRNDLKYLLDQYLNEDIIKEYGVFDPKYVTDLLRLFHAGKNDDRKIWTLLMFQMWFSEHLATSK

SEQ ID NO: 37234 - protein, 586 aa, Debaryomyces hansenii CBS767
MLRAGYRTAVRSATKLTPRLGHEIRLISKQQVRWASQIAHPKVPPHIGNEGVKEFSFNHQKDWDLLRASITKFTDNGALKIPLVINGEKIYNSNEMTQVNPARHSQKLAEVSQAGEKEIQQAIEAAKQAKAKWGATPWTDRAAIFLKAADLISTKYRYDMLAATMLGQGKNVYQAEIDSVAELIDFFRYNVKYAEEMYGQQPVASAPGVWNRAEYRPLEGFVYAVTPFNFTAIAGNLVGAPALMGNTVVWKPSATAALSNYLLLNILEEAGLPKGVINFIPGEPNQVTDLVLNDKDFSALHFTGSTDVFKNLYVKISNNVAEDKYRDFPRIVGETGGKNFHLIHPSASLDHAVLSTIRGAFEFQGQKCSALSRLYVPKSIWPEFQERLVASMSNITVGNCTDPNTLQNFMGPVIHEQSFDKLAAAIDQAKADPELTVIQGGNYDKSKGFYIAPTLIETTNPNHEFLTKEFFGPIVTTYVYPDAEYESIMDKIDGSTKYGLTGAVFARDREAIRLAEEKLRYSAGNFYVNDKCTGAVVGQQWFGGARMSGTNDKAGSGNILNRFVSVRNIKENFYELTGFKYPSNYN

SEQ ID NO: 37235 - protein, 651 aa, Psychrobacter arcticus 273-4
MCGVNGFFNAHTTIPVQNVIAQMNAAIDHRGPDAGDAWLDENIGLVLGHQRLAIQDLSPAGAQPMHSACGRYVLAFNGEIYNHLQLREQLMIEGHAPAWRGHSDTETMLACFVAWGIEKTLQAMVGMFAIVLWDRQQKVLTLARDRMGEKPLYWGWQGQSLYFSSELKGLKAHPSFKTDINRDAITLLLRHNCIPAPYSIYQGIEKLRPGHWVQLPLSDIQQAKTAQSKAYWRFNDIVEAGLADPFTGSPEQAVDALESALMQSIGGQMQSDVPLGAFLSGGIDSSTVVALMQAQSSRPVKTFTIGFDDAGYNEATHAKAIAKHIGTEHTEMYMRPEDALAVIPKLSSIYCEPFSDSSQIPTFLVNQLAHQHVTVALSGDGGDELFGGYNRYLMAQQVWSKSRKLPRPMRQLAAVSLTALSPKSWDTLVNTLSPVIPKRLNLRTPGDKAHKLAGVLNIDSEQAFYQNLTSHWQDPAQLVIGAQEPATLISDSSCWPTTDSFQHAMMAMDAQTYMTDDILVKVDRAAMANSLETRVPMLDHRIAELAWRMPLDYKIRNGEGKWLLKQVLYRHVPRELIERPKMGFGIPLHDWLRGSLRDWAEALLDRNLLQQQGYFNPAPIRKIWNEHLSGVFNHQHQLWDILMFQAWLETQ

SEQ ID NO: 37236 - protein, 260 aa, Bacillus cereus E33L
MLKSYRAVLVSLSLLLVFVLSGCSNAAPIDAHSTGIWDHYFVYPISFMIQFVAHHIPGASFGIAIIIMTLVIRSAMIPLAVSQYRSQAKMKKMQPELQKLKQKYGDVSKDLEKQKQYQKEMSELMKSGGWNPLAGCWPLLIQMPIFSALYYAISRTEEIRTSTFLWVNLGHADPYHILPIIAALTTFIQMKVFQSNSTPGEQVQMLKMQQIMMPAMILFMGFAAPSGLVLYWITGNLFTMMQTIVLRKIMEREELQLQKA

SEQ ID NO: 37237 - protein, 158 aa, Zea mays
VSLSVARRGEADRYIQMEGLQRSSSTFRRSGSSGLVWDERFLTEGAEAKAAGEGGTDEAQPEMRRSRSTGGVGMMLRRGGDDKKQQQQKKKKQQGQKKDEERDPQVFRTKEVAPDVDPPSPRVSGCILCAIFGGSSSGPGAAARRGRAKPKRRQRSAV

SEQ ID NO: 37238 - protein, 241 aa, Triticum aestivum
MKCPSDSSAGRDPWAPPPASGGGGSSEPAKKRQRTSSSSQAEASSSSQPPPAPPGDAREVPDLGEDAMFEVLRRAEPRTLAAAACVSRGWRVLAQDERLWEAPCVREWTDLGFSEQLLRAIVPSFGGFRRLHAVSIQARRRFGVGCGNWHGVRTPGQGRRRGGCPWTDDEHRLFLLGLKTYGKGDWRKISRNFVRTRTPTQVASHAQKYFIRLSSGAARRSSIHDITTVHLTDDQPPAPSQ

SEQ ID NO: 37239 - protein, 236 aa, Cryptococcus neoformans var. neoformans JEC21
MPFHAEPLKPSEEIDMDLGHSVAAQKFKEIREVLEGNRYWARKVTSEEPEFMAEQVMGQAPNFLWIGCADSRVPEVTIMARKPGDVFVQRNVANQFKPEDDSSQALLNYAIMNVGVTHVMVVGHTGCGGCIAAFDQPIPTVENPGATPLVRYLEPIIRLKHSLPEGSDVNDLIKENVKMAVKNVVNSPEAWEKARKGEFREVFVHGWLYDLSTGNIVDLNVTQGPHPFVDDRVPRT

SEQ ID NO: 37240 - protein, 197 aa, Arabidopsis thaliana
MDSSSSMCKQAQPIVRKARKKKEREELERIKQAERKKRRIEKSIATSAAIRAELEKKKLRKLEEQRRLDEEGAAIAEAVALHVLLGEDCDDSYRNTLNQETGFKPWDYTTKINLFSGGINRFFPHQRCSSYAVHDNNRTRDSNWSSVSYEPFARGWDNNNNNMGISADLFDTQAVSSLQISENTDVDAIVFNGMFRR

SEQ ID NO: 37241 - protein, 151 aa, Lupinus luteus
LTESQAALVKSSWEEFNANIPKHTHRFFILVLEIAPAAKDLFSFLKGTSEVPQNNPELQAHAGKVFKLVYEAAIQLQVTGVVVTDATLKNLGSVHVSKGVADAHFPVVKEAILKTIKEVVGAKWSEELNSAWTIAYDELAIVIKKEMNDAA

SEQ ID NO: 37242 - protein, 609 aa, Wolbachia endosymbiont of Drosophila melanogaster
MNEFKSIRNIAIIAHVDHGKTTLLDNMLKQSGTFRENQEVQERVMDSGDQERERGITILAKCTSIMWGDEKINIIDTPGHADFGGEVERVLCMADGVLLLVDAAEGPMPQTKFVLSKALKANLKPIVIINKVDRPDSRIDEVLNEIYELFFNLDATNEQLDFPVLYASGRNGWCAKELSDERKDLSPLFSTVIDYIKPSVYNQNAPFAMLVTLLESDKFLGRILTGKVYQGIAKVNSDLKVLDLDGKVIERGRLTKLLSFSGLKRIPVEQAVAGDIIAIAGLEEASVSDTIAAPEVTTAVSSTPVDPPTMAITLSVNDSPFAGQEGTKLTSTAIKDRLYAEAETNVAITVTLAPSGEAFEVGGRGELQLGVLIENMRREGFELSVSRPRVLFKEEGGKKLEPIEEVVIDVDDEYSGIIMEKLSFRKGEVTDMRPSGNGRTRLTFLVPSRGLIGYQGEFLTDSRGTGIINRLFHSYAPHRGPISGRRNGVLISTDKGEAVAYAIFNLQDRGIMFIKPQDKVYCGMVVGQHSRDNDLEINVLKGKQLTNVRASGSDEAIKLTPPKIMTLEDMIAYIDDDELVEVTPKSIRLRKKFLDPNERKRAGRAKNKE

SEQ ID NO: 37243 - protein, 801 aa, Cryptococcus neoformans var. neoformans JEC21
MSVHIVHIVQTPTYQYIFEQVSHSCSCIYSPLCGPSLAQVTLSTHAVQPARGQPHPISSPLSSLDSSSLLPVSINNLSARRTDLPSITATSCSLGFPGMAHRTNTRSPSGLNRRPTDRCTSQSGSLQTASSPVQSTFGGRIYAAPEEDRGLIMRDRSERDRGENDWADEKGNSMGKTRGMDVGVTRPKRRLSSLPNLLVPPPLHRAMSSTSVSSPPQSPIGQPGHGSYHSLQQPFHNQKAHGSSTANNFPSYSRSNPPKLDDKVGMVGYATAMAAASREKEGPPSLWGIELKWISLITLALQNAFLTIIMHYSRISTAPNRTYSAAAAVLLNELLKGGISVFIALKRIDNEMTASPPPPVYSEKLDDKDFDKRSGQKLPSIIHPTRLQALSKAVFSPDCYKLSVPAILYVIQNNLQYVAASNLDVATFQVTYQMKILTTAFFSVLLLRKRLSRTKWASLILLAIGVGIVQIQSSSAPAASHHTHVTVSHERQLRSEIPVSDEPIMSPERVMHPVRGFVAVTLACMTSGLAGVYFEFILKSSSGSSAPDLWVRNTQLSLFSLVPALVPIIVNPSGPNGMGYFSKVMSCFDNFNGWAIGTVLTQTFGGLITALVIRYSDNIMKGFATSLSIIISFLASVALFSYPITLSFIVGASIVLFATYTYNSPAPPASSTRKEIAVPGSPISTSAPILGEPEKPSRASSVINLLGLGSNNGSRKPSVSDIKSYASSQLGLSSYPVSASVSAPGTPRTNMNDYAESGRSSPASFGAVQTSHGGSGAGFGRGNVGDKVRPILSLDIDRKHG

SEQ ID NO: 37244 - protein, 391 aa, Zea mays
  misc_feature (112)..(112): Xaa can be any naturally occurring amino acid
MSSPMATITASASPAMQQTSNKATTSATVASPAPVRYRPSLLVILSACLVLMGAGGPLLLRVYFVHGGERLFLSAMLQISGWPLLLPPICVSLYRSRSRSRSHGVASLLLPXRLAGAAAVLGAFYAISCFLYALGSQALPLSTSSLLLATQLAFTAVFAFLFVGLRFTPFSANAVVLLTIGPAVLGVGPGSGKPAGEASRTYWIGFCEAIAAAALAGLVLPLVEIATARYGRRTGPAARVPPPYATVMQMQAVMGAAGTLVCLLGMAIKSDFQAVPSEAATFGLGKTNYYLVLIWDAISWQLLNLGIVGLITCASSLLAGIMIAVLLPLSEVLAVIFLHEKFDGPKGIALVLSLWGFASYLYGEKAQKKMETQKNELQMVKKTVDLESATL

SEQ ID NO: 37245 - protein, 143 aa, Psychrobacter arcticus 273-4
MANERTLSIIKPDAVAGNNIGAIYDRFEKSGLKIVAAKMMQLDDEKAGGFYAEHAERPFYNDLKSFMMSGPVLVSVLEGENAIAKHREIMGATNPKDAAEGTIRADFASSIDENAVHGSDSAESAAREISYFFNEEEVCARTR

SEQ ID NO: 37246 - protein, 564 aa, Bordetella pertussis Tohama I
MARGYAIGRAVVMGAAALEVAHYRIAPEDAAAESQRLTEALAKAQADLLQMADTLPEDAPRELGAMLNVHRLLLGDPLLAEQALALIAERHYNAEWALTAQGQILGQQFEAMEDEYLRERGGDVRQVIERALHVLAGTSAMLPDGAQLDGNDPLVVVAHDISPADMLRLRGGRFAAFVTDLGGPTSHTAIVARSMGVPAVVALGNVRELVRDGDMLIVDGADGVVVLNPSARILAEYQARQRVYADERAELALLRDEPAVTLDGIDIVLHANIELPEEASLSLACGAHGIGLFRSEFLFMGRPDLPGEEEQYEAYASVVKVMAGRPVTIRTLDIGADKTLDDEATVATNPALGQRAIRYCLARPEMFATQLRAILRASAHGPVRVLIPMIAHMHEVHATYAALESARRELDARGQPYAARVEVGAMVEIPAIAIAIEPFVQALDFLSIGTNDLIQYTLAIDRGDHDVAGLYDPLHPAVLRLVANTINAGERAGKPVAVCGEMAGDARLTRLLLGLGLTEFSMHPQQLLDVKREVRRAHSNALRVKVAAALNRALPIDPDTLDAL

SEQ ID NO: 37247 - protein, 457 aa, Sulfitobacter sp. EE-36
MLRNDDQLATWDRENFFHPSTHLAQHARGESATRVITGASGVHIEDRDGNRMLDAFAGLYCVNAGYGRTEVADAIAEQAHQLAYYHSYVGHGTETSITLAKMIMDRAPAHMSKVYFGLSGSDANETNIKLVWYYNNILGRPQKKKIISRWRGYHGSGLMTGSLTGLSLFHDKFDLPMNPVIHTDAPYYYRRKDRTQTEAEFTAQCANALEALIQAEGPDTIAAFIGEPVLGTGGIVPPPAGYWDAIQEVLNRHDILLIADEVVTGFGRLGTMFGSEHYGLKPDLITIAKGLTSAYAPLSGSIVSDRMWKVLEQGTDENGPIGHGWTYSAHPICAAAGVANLKLIDDLNLVSNAAEVGGYLNASMKEALGDHPNVGDIRGEGLLCAVEYVADKADATPLDPAAKVGAAISAAMLERGVIARAMPQGDITGFAPPFCITRAEVDTVVAATADAVKTVLG

SEQ ID NO: 37248 - protein, 288 aa, Triticum aestivum
MITPRYLGDTIEYSSYASNALGALPYGRPAGGRTSDLVAAEVIWEDEGFNYIKESFDKGTLHLIGLLSDGGVHSRLDQVQLIVKGASERGAKRIRLHILTDGRDVLDGSSVGFVETIEKDLAQLREQGVDARIASGGGRMYVTMDRYENDWSVVKRGWDAQVLGEAPHKFQNALEAVKTLRAEPKANDQYLPPFVIVDESGKSVGPIVDGDAVVTFNFRADRMVMLAKALEFPDFDKFDPCRVPKLVRWMLHMMGVELQHYWSLFPTFFEKDSGESLGKGVPPFLQEQ

SEQ ID NO: 37249 - protein, 110 aa, Zea mays
LRPVLVLQGDLLQLKGGKGLCKGGANRHRKVLRDNIHGITKPAILMLALMGGVKRISVLIYEETRYVLKIFLENVILDTFTYTEHARRKTDTAMDVDYTLKLQCRTLYGF

SEQ ID NO: 37250 - protein, 194 aa, Lactobacillus johnsonii NCC 533
MKVVDAEFVISAVSEKQYPKDDLPEFALAGRSNVGKSSLINTIVNRRKLARTSQQPGKTQTLNFYKVNNELYLVDVPGYGYAKVSKKQRAAFGEMIQDYLETRADLKGLILLVDARHNPTADDINMFNYALYLDIPILVVATKMDKLKKMEASQIKQKIGKSLDLSQENVSFLPFSSVSKLNVDKFWDWVEDKM

SEQ ID NO: 37251 - protein, 492 aa, Zea mays
  misc_feature (193)..(193): Xaa can be any naturally occurring amino acid
MGSTAAASVLPVSAGSGENLVLILDYGSQYTHLITRRVRQLGVLSLCVSGTAPLASLEGLRPRAVILSGGPHSVHAPGAPAFPEGFLGFAAAAGAHVLGVCYGMQLLVQSLGGAVVSGERQEYGKMDVEVTAASSALYGQAETGKRQTVWMSHGDEVVRLPEGFEVVARSVQGAVAAIENRENRFYGLQYHPXGGVDSTVAATLVHKAIGDRLHCVFVDNGLLRYKEGERVMTTFESDLHLPVTCVDASEQFLSKLKGVEDPEKKRKIIGREFIAVFDDFAHKLEQKIGKRPEYLVQGTLYPDVIESCPPPGSGRTHSHTIKSHHNVGGLPKDMKLKLIEPLKLLFKDEVRKLGGILNVPDSFLKRHPFPGPGLAVRVLGDVTQGNALEVLRQVDEIFVQSIKDAGLYDKIWQAFAVFLPVQTVGVQGDQRTHSNAVVLRAITSEDGMTADWYYFEHAFLVDVVNKICNNVRGINRVCQDITSKPPATVEWE

SEQ ID NO: 37252 - protein, 416 aa, Arabidopsis thaliana
MIYTAIDNFYLTDEQLKASPSRKDGIDETTEISLRIYGCDLIQEGGILLKLPQAVMATGQVLFQRFYCKKSLAKFDVKIVAASCVWLASKLEENPKKARQVIIVFHRMECRRENLPLEHLDMYAKKFSELKVELSRTERHILKEMGFVCHVEHPHKFISNYLATLETPPELRQEAWNLANDSLRTTLCVRFRSEVVACGVVYAAARRFQVPLPENPPWWKAFDADKSSIDEVCRVLAHLYSLPKAQYISVCKDGKPFTFSSRSGNSQGQSATKDLLPGAGEAVDTKCTAGSANNDLKDGMVTTPHEKATDSKKSGTESNSQPIVGDSSYERSKVGDRERESDREKERGRERDRGRSHRGRDSDRDSDRERDKLKDRSHHRSRDRLKDSGGHSDKSRHHSSRDRDYRDSSKDRRRHH

SEQ ID NO: 37253 - protein, 399 aa, Zea mays
MLPSVMDYFSSCWGPRSGAGHRGKGSDAAGRQDGLLWYKDAGQLVTGEFSMAVVQANQLLEDQSQVESGSLSLADPGPQGTFVGVYDGHGGPETSRFINDHLFNHLRRFATEHKFMSADVIRKAFQATEEGFLSLVSKEWSLKPQIASVGSCCLVGVICAGTLYVANVGDSRAVLGRLVKATGEVVAMQLSSEHNACYEEVRQELQSSHPDDPHIVVLKHNVWRVKGLIQISRSIGDVYLKKPEYNREPLHSKFRLRETFQRPILSSEPQITEHRIQPNDQFVIFASDGLWEHLSNKEAVDLVQSSPRKGIARRLVKAAMQEAAKKREMRYSDLKKIDRGVRRHFHDDITVIVVFLDSDAMSKASWSKSPSVSLRGGGVALPGKSLAPFSAPAGLNSTY

SEQ ID NO: 37254 - protein, 430 aa, Burkholderia thailandensis E264
MSRDLPGTLAAWQKAYGDIVHLRIWPEHDVVVADPQLARALLVTHHDALIRWERGIRVLSQVHGHSVLTAEGEAWRTRRHALVPNFSPKAVQGFSPTIVKAATRAFAQWPREDADWHIESALTMLTMDVILQMVFSSTLGEDVRVAEQAIRVASAAANAEFYWPTSMPDWMPWKREKRQALRTLKDLIERHLQRRLKLACDAWPDDLLSCLLQSREDASALSLQNVRDECMTIFLAGHETTAATLVWWAWCMASNPEAQRVARDEVQRVLQGNAPVAETLPELGYLVQTIKETLRRYPVAPLLISRRATRAIQLGDWALPARTLFMIPAHLMHHDARWFPDPEAFRPERFAPDAPEVPRGAYIPFGAGPRVCLGQHLAMAEMTVIAAMLLQRFVLSAPDGSAPPHPVLNVTLRPAQPMHLAITQVDPRIA

SEQ ID NO: 37255 - protein, 993 aa, Debaryomyces hansenii CBS767
MPIPRNDIEGISFISLITNKNEEFEESANFYNKLGFRLTKNFSKITNNSESKPKLQIGISNDSLKELWLESFPLQNTDENGFIRPWQELLVYDGDGCEKLNSATTLKIRLSTLDDLSNTAKELNFFTTDLPKVKDILTKDLNTEFESPSDTVIKVVDPMGNTLNFSNFENPLSEKSFDSPEDYLKYKTEKLLSSLDRLEHKSVEDQPTEKTKKKKKKIAIMTSGGDAPGMNSAVRAVVRAGIYYGCDVFAIYEGYEGLVQGGDLMRKMEWADVRSYLSLGGTAIGTARCAKFRERPGRLQGAHNMVENGIDALIVCGGDGSLTGADLFRSEWPSLVEELVSNGTFTTKEVEPYRHLTMVGLVGSIDNDMASTDSTIGAYSALERITEMVDYIDATASSHSRAFIVEVMGRHCGWLGLMSGLATGADFIFIPERPPKAGQWQNELKDVCSRHRQKGKRNTTVIIAEGAIDDDLNPITPDEVQKVLVALGLDTRITTLGHVQRGGTAVAYDRLLATLQGVDAVKAVLELTPDDPSPMIGSLENKIVRKPLIEAVKLTKSVATAIENKDFDKAMSLRDSSFEDAYHHFLSSSIYDDGLKILPEAERLNIGVVHVGASSSGLNAATRAAALYCMSKGHKLFAIQNGFSGLINEGEIKELSWLDVEGWHNKGGSEIGTNRSLPSEDFGNVAYYFQKFKLQGLIIIGGFESFSALNELDEKKQEYPIFNIPMVVIPATVSNNVPGTEYSLGGDTCMNQLLKYCDAVKQSASSSRRRVFVVEVQGGYSGFVASYCGLITGSLATYTPESKIDLKTIQEDIDLLYEVFEDDRGEYNNGKMIIRNEQASSVYTTDLIADIIKESAGGRFETRTAVPGHVQQGFTPTSMDRVNACRFAVKSCQYIEDWNTKLGGLILDMDATKTNRRSRSNVKNSIEHILEEKNGSAVVLGIQGAQIKFNSVEALFAKDANIPLRKGRVVHWTEMIEVADMLSGRLLLREKKQ

SEQ ID NO: 37256 - protein, 433 aa, Burkholderia thailandensis E264
MTPSDVKATLSFSDNSPSVELPIYKGTMGPDVIDIRKLYGQTGKFTYDPGFMSTASCNSAITYIDGDKGELLYRGYPIDNLAQNADFLESCYLLLKGELPNAAQKKEFVATVTKHTMVHEQMQFFFRGFRRDAHPMAILVAAVGALSAFYHDSLDINDPRHREVSAIRMIAKLPTLVAMAYKYSIGQPFVYPRNDLSYSANFMRMMFANPCEEYKVNDVLVRALDRILILHADHEQNASTSTVRLAGSSGANPFACIAAGIACLWGPAHGGANEAALNMLEQIGTPDNIPEFIKQVKDKNSGVKLMGFGHRVYKNYDPRAKLMRETCYEVLNELGLHDDPLFKLAMQLEKIALEDEYFVSRKLYPNVDFYSGIVQRALGIPTSMFTCIFAMARTVGWIAQWNEMIADPEQKIGRPRQLFIGETPRAAKPIDQR

SEQ ID NO: 37257 - protein, 121 aa, Triticum aestivum
MSKKGTGGEESVVVSAQTRKAKRGPPRKRNPCPGIRCVAGRIYDPKNGKTCHQCRQKTTDFMVACRQPRKKGLCPIHFCHKCLSNRYGEDAKDKAKEAGWTCPKCRRICNCSLLQKDERRD

SEQ ID NO: 37258 - protein, 392 aa, Saccharomyces cerevisiae
AITDFDSSNKSYYGENTLYLLSFQGVNGTLGGNSVRVSLTTGPVHDFTWSPTSRQFGVIAGYMPATISFFDLRGNVVHSLPQQAKNTMLFSPSGHYILIAGFGNLQGSVEILDRLDKFKCVSKFDATNTSVCKWSPGGEFIMTATTSPRLRVDNGVKIWHVSGSLVFVKEFKELLKVDWRSPCNYKTLENKDEAFFENHIINNWEPLPDSTTSSLDPKISNKSELQIHSSVQEYISQHPSREASSNGNGSKAKAGGAYKPPHARRTGGGRIVPGVPPGAAKKTIPGLVPGMSANKDANTKNRRRRANKKSSETSPDSTPAPSAPASTNAPTNNKETSPEEKKIRSLLKKLRAIETLKERQAVGDKLEDTQVLKIQTEEKVLKDLEKLGWKDE

SEQ ID NO: 37259 - protein, 651 aa, Triticum aestivum
  misc_feature (311)..(311): Xaa can be any naturally occurring amino acid
  misc_feature (319)..(319): Xaa can be any naturally occurring amino acid
MRMARPALKTLTTGPPEAKGEFIRLCSSGRLKDALHHPFRDVLWSDPTLFAHVFRACRAIPLLHQLHAFAATCGAAADRFTTNNLMLAYADLGDLPTACSLFERIPSRNVMSWNILIGGYIKNGDLGSARKLFDEMPTRNVATWNAMVAGLTNAGLDEDSLGFFLAMRREGLHPDEFGLGSVFRCCAGLSDLVSGRQVHAYVVRCGMDIDMCVGNSLAHMYMWSGWLAEGEAVLKALPSLTVVSFNTTIAGRTQNGDSEGALEYLSMMRGIGLAADVVTFVSIITCCSDLAALAQGQQVHAQVIKAGVDKXVIPVITCXLVHMYSRCGCLGDSERVYSGYCGLDLFLLSAMISACGFHGQGHKAVELFKQMMNAGARPNEVTFLALLYACSHSGLKDEGLEFFELMTKTYGLQPSVKHYTCIVDLLGRSGCLDEAEALILSMPVRADGVIWKTLLSACKTQKNFDMAEQIAERVIEFDPRDSAPYVLLSNIRATSRRWGDVSELRKNMREKNVRKEPGVSWVELKGQVHQFCTGDKSHPRQGEIDEYLEEMMAKIRQCGYAPDMSMVFHDMEDEEKEVSLTHHSKKLAIAFAFLSLPEGVPIRIMKNLRVCDDCHVAIKLMSQVTGRDIVVRDVSRFHHFRDGKCSCGDYW

SEQ ID NO: 37260 - protein, 414 aa, Rhodococcus sp. RHA1
MTDSARELDLVVYGATGFVGKLLADYLAQHAPEGVRIALAGRTAAKLEAVRSSLGPRAAEWPVIVANSDDAASLAALAARTRVVATTVGPYAKYGHALASVCAEAGTDYVDLTGEVLFVRESIDANHERARETGARIVHSCGFDSIPSDLGVHVLHEKVQEDGAGELTDTTLVVTSVRGGVSGGTIDSLRTQVDVSKKDPALRRLAASPYSMSPDRSKEPDLGKQSDMSVVKGEDIAPGLKGWKAPFFMGPYNTRVVRRSNALRDWAYGRKFKYREVMNVGSSPITPVIAGAVAAGLGGMIVGMALPPTRYVLDRVLPSPGDGPSEEAQRKGHFTMDVYTTTSTGARYTSRVKAKGDPGYSATAVMLGESALSLALGGDALPDATGVLTPATALGDVLVTRLRDAGFEISARKL

SEQ ID NO: 37261 - protein, 1066 aa, Xanthomonas oryzae pv. oryzae KACC10331
MNAQLDPLASTSVARPLLAPELPAAPGALRAAITAAWLKDETEHVRELLDQARLPAAEQAKVQAIAADLVTRVRARAQDQGAIEAFMRQYDLGSEEGVLLMCVAEALLRIPDQDTADKLIRDKLGDADWKKHMGGSDSLLVNASTWGLMLTGQLVQLNDLTRADVPGAFKRLIGRVGEPVIRLAVRQAMKIMGHQFVMGRTIGEALSRSRKGDNAHYRYSFDMLGEGALTMKDAQRYLQAYRDAIHAIGRSGNFVGTDVFAAPSISIKLSALYPRYEHAKRARVMEELVPGVLELAQLAKSYGIGYTVDAEEADRLELSLDIIEATFSDSSLDGWEGYGLAVQAYQKRTPYTIDFLADLARRVGRRIPVRLVKGAYWDAEIKRAQIEGHPGYPVFTRKQNTDVSYLACARRMFAHNDALYPMFATHNAQTIAAVRAIAAGKTYEHQKLHGMGDDLYAEVIPADRLGLPCRVYAPVGSHEDLLPYLVRRLLENGANSSFVNRITDEDVAIEDLIRDPVEAVSSFTSIPHPKIPLPADLLRSQNQNRKNSMGANLANDNDLRQLAEQLNAAIKPWKATPLVPGALISTPSQPVLNPADRRETVGQWHPADPDTVQTSLASAAAAQPGWNRTPAASRATILEHAADLLEARMPEFMAICVKEAGKTLPDAVAEVREAVDFLRYYAGQARAQFGAPERLPGPTGESNELQLHGRGVFVCISPWNFPLAIFLGQVAAALAAGNTVIAKPAEQTNLIGFAAVKLLHEAGVPEAAVQFLPGDGATVGAALTNDPRVAGVAFTGSTETARIINRTLAARDAAIGVLIAETGGQNAFIADSSSLPEAVVKDAIASAFISAGQRCSAARVLFVQDDIADKVMTMLAGAMGELKIGDPSLLSTDVGPVIDADALKILDDHAARMDREARLIGSTTLATTTAHGSFFAARAYELTSLAQLQREIFGPVLHVIRWKADQLDAVIEQINATGYGLTLGVHSRIDETIERITSRVAVGNVYVNRNQIGAVVGVQPFGGQGLSGTGPKAGGPHYLLRFATEKVVTVNTTAAGGNASLLTLGD

SEQ ID NO: 37262 - protein, 127 aa, Spiroplasma citri
MELIHTVQAPQAVGPYSQAIKLANGFLYISGQLGLNPTTMLLVDNISDQTRQVLANINAILTAAKYTKDNVIKTTILLSDINDFVVVNEIYESFFKEHKPARSTFAVKDLPKAALIEIEVIAFKENS

SEQ ID NO: 37263 - protein, 296 aa, Zea mays
  misc_feature (69)..(69): Xaa can be any naturally occurring amino acid
  misc_feature (171)..(171): Xaa can be any naturally occurring amino acid
  misc_feature (217)..(217): Xaa can be any naturally occurring amino acid
  misc_feature (221)..(221): Xaa can be any naturally occurring amino acid
  misc_feature (247)..(247): Xaa can be any naturally occurring amino acid
PLPSAKRTPKPSRLGKETIDIDANGDTDSEETKAVKKRYWSDEEEVRLASAWLNCSNEPIHGNDKKGEXFWKEITEYFNKHAPSDHQRDDNQLKIHYSRLKTLTSNFNWCWIAVSKMHTSGYSDDQLMNEAQKMYANANNGKPFTLVHWWKTLRNEPKFYAHISKMDKEKXRAVPLTIVKTVISYPPQRPIGRDAAKAQKNGKHKAEEVLHGIVLLXDNIXKLLKVQQERKEEREKVATFQLEITRXQPKAAQEQKEAKFLELYNSLLQHTSQLSEQVRINQEKTMQKMELKLFGD

SEQ ID NO: 37264 - protein, 379 aa, Triticum aestivum
  misc_feature (106)..(106): Xaa can be any naturally occurring amino acid
  misc_feature (108)..(108): Xaa can be any naturally occurring amino acid
  misc_feature (119)..(119): Xaa can be any naturally occurring amino acid
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCXSXESNLCDLLRIXVDRGVMIGDGQSRFTISGKPIFHFVGTSTFSEYTVIHVGCLAKINPSAPLDKVCVLSCGISTGLGATLNVAKPKKGSTVAIFGLGAVGLAAMEGAKMAGASRIIGVDLNPAKYEQAKKFGCTDFVNPMDHTKPLQEVLVEMTNGGVDRAVECTGHVDAMISAFECVHDGWGVAVLVGVPHKEAVFKTHPMNFLNERTLKGTFFGNYKPRTDLPEVVEMYMRKELDVEKFITHSVPFSQINTAFDLMLKGEGLRCVMRMDE

SEQ ID NO: 37265 - protein, 196 aa, Zea mays
MADHADDLHAEQTEGFKVGEKKTIDEYQKLDQNDESLQKWKASLGLGQGKDISDPNDPRKCIILSLGLEVEGRDDIIIDLRAPGALEELEKKPFTIKEGASFRMKAQFKVQHEILAGLKYLQKVNRMGVSAKLQEMMGSYGPNTEEKPFYEKKFEPETAPSGMLGRGHYTALSKFVDDDNQVHLQFKWSFDIKKDW

SEQ ID NO: 37266 - protein, 131 aa, Aggregatibacter actinomycetemcomitans
SFCERVISGEWKGYTGKAITDVINIGIGGSDLGPYMVTEALRPYKNHLTMHFVSNVDGTHIAETLQKVNPETTLVLVASKTFTTQETMTNANSARDWFLATAKEEKHVAKHFAALSTNAKEVEKFGIDTDN

SEQ ID NO: 37267 - protein, 197 aa, Wolbachia endosymbiont of Drosophila melanogaster
MAKQITSNCNFIFGASDIKSLPNESAPEIAFAGRSNVGKSSLINLLINSKKAARVSSKPGCTRQINFYSMYDDKFRLVDLPGYGYSHAGKEEIIQYLNLIEYYLIQRENLRRVFVLIDSKVGLKEIDKDFIYWLIYNNINFNIVLTKIDKVSQKSLGAVIEDIQKWINNENVSIHQMSIRVKHKITKVRDEFFKFTR

SEQ ID NO: 37268 - protein, 427 aa, Pseudomonas syringae pv. tomato str. DC3000 [sequence omitted]

SEQ ID NO: 37269 - protein, 535 aa, Bifidobacterium longum NCC2705
MFSPRKIPMNVRGISMANGPVLVVDFGAQYAQLIARRVREAGVYSELVPHSMPVDEILAKDPKAIILSGGPASVFEPGAPTIDTKVFESGVPVLGICYGFQVMAYELGGKVDKAALGEYGKTSATIDDAAGILADSPAEQTTWMSHGVAVEQAPAGFEVLAHTEGAPVAAMADESRKLYGVQWHPEVKHSPLGQKLIENFLHRCAALPNDWDASSIIEDQVKKIREQVGDAEVICGLSGGVDSAVAAALVHKAIGDQLTCVFVDHGLLRKGEVEQVKHDFVAATGIRLITVDAADDFLDALAGVSEPERKRKIIGEKFIRTFEKAQRQVLEEAGARGKEVKFLVQGTLYPDVVESGGGDGAANIKSHHNVGGLPKDIKFQLIEPLRTLFKDEVRAIGTELGLPDEIVWRQPFPGPGLGIRIIGEITKERLDLLREADAIAREELSKAGLDRDIWQCPVVLLADVHSVGVQGDERTYGSPIVLRPVSSEDAMTADWSRVPYDVLATISTRITNECRQINRVVLDCTSKPPATIEWE

SEQ ID NO: 37270 - protein, 472 aa, Magnetospirillum magnetotacticum MS-1
MTMSDDVKKVLELIKENDVKYVDFRFTDPRGKWQHTAQHVSTVDADMLNEGIMFDGSSIAGWKSINESDMILKPDASSAVMDPFAAQSQLIINCDIVEPATGQLYDRDPRSIAKRAEAYVKSSGVGDATYFGPEAEFFVFDDVKYELGMNKGYYELRSEDGVEAQGRDFAEGNLGHRPGVKGGYFPVPPVDGHVDMRAEMLTVMGEMGLPIEKHHHEVASSQHELGIKFGSLVQAADWIQIYKYVVHNVAASYGKTATFMPKPIYGDNGSGMHVHQSIWKAGKPLFAGSGYADLSDTALYYIGGIIKHAKAINAFTNPLTNSYKRLIPGFEAPVLLAYSARNRSASCRIPYSASPKGKRVEVRFPDPGANPYLAFSAMLMAGLDGIANKIHPGDPMDKNLYDLPPEELKLVPTVCGSLREALESLRANSDFLCKGDVFSKEFIESYIDLKYEEVYRFEHTPHPVEFQMYYSV

SEQ ID NO: 37271 - protein, 552 aa, Psychrobacter arcticus 273-4
MTNTQQQSESIDDNQAQLSKQQNSDNNKKVPRVLMILDGFGHREDDKDNAIAAADMPNLDKIYEQYPHGLISASGEDVGLPDGQFGNSEVGHMNLGAGRVLYQDSTRISSEVASRDFYKNEALVNAVKAANTLGGNVHIMGLLSDGGVHSNQDHIEAMCHSALVHGAKNVFVHCFLDGRDTPPKSADKYINRLRDHIIKLNAHYESGRVQIASIIGRYYAMDRDNRWDRVQKAYELITEGKADRLSTRADGAVQAAYKARETDEFINPTVVIGRDEVPYTVDDNDALIFMNFRADRARELAQAFVLPDHEFSGFARNKQPKLAAFVMLTKYSDVLADNPKTSIAYYPTSLTNTLGEYLQSKGKTQLRIAETEKYAHVTFFFSGGREDEYKGETRILVPSPDVATYDLQPEMSAPEVTDKLVEAIESGQYDVLVVNYANGDMVGHTGIFDAAVQAVEALDVCVGRVAAAVHAAGGDMLITADHGNCEQMQDYESGQVHTQHTTEHVPLIYVGEKKVQVRSGGKLSDVAPTILALMDIEAPKEMTGENLLVAAE

SEQ ID NO: 37272 - protein, 272 aa, Xanthomonas campestris pv. campestris str. ATCC 33913
MLEVSSHNVWTALAVTLAAGLATGLGSLMVVFAKKPNPRLLAFGLAFAGGAMVFVSLSEILNKSIASFSNAYNDKLGFTYGTLTFLGGMLLIMVIDRLVPNPHQSLSTDDPQFRDDNRAYIRRVGLLTAVAITAHNFPEGLATFFATLESPAVGMPLAFAIAIHNIPEGIAIAVPVYFATRNKFYAFGASLLSGLAEPIGAGIGYLLLSSVLSEAVFGAVFGVIAGVMVFLALDELLPAAKRYAQGHETVYGLVSGMGTLAISLVLFRYAAP

SEQ ID NO: 37273 - protein, 495 aa, Leptospira interrogans serovar Lai str. 56601
MEPVQKLQIPYKSIRLSDGTEYQSYHTEGALSGKQPADYKNGIPAFRKEWIQKRFNHSNHSQMYFAKKGIITEEMRYAAFRENMEPEFVRSEIACGRAILPSNRNHPELEPMIIGKNFLVKINANIGNSTFSSSIEEEVEKLHWAIKWGADTVMDLSTGKNIHETREWILRNSPVPIGTVPIYQALEKVKGKTENLNIQIFLETLEEQAEQGVDYFTIHAGVLLRYIPLTTNRITGIVSRGGSILAKWCQAHHKENFLYTHFDEILKVMKKYGVSISLGDGLRPGSIADANDKAQFSELETLGELTQLAWKEDIQVMIEGPGHVPMNLIKENVDLQTKICQEAPFYTLGPIVTDIAPGYDHITSAIGAAMIGWYGTAMLCYVTPKEHLGLPNKEDVKQGVIAYKIAAHAADLAKGHPGAIDRDNLLSKARFEFRWEDQFSLSLDPETAKTFHDEMLPQDRMKTAHFCSMCGPHFCSMNLTQELRKFAQEKEIQES

SEQ ID NO: 37274 - protein, 482 aa, Arabidopsis thaliana
MDRVSNLPDGVRGHILSFLPAKHIALTSVLSKSWLNLWKLIPILDIDDSEFLHPEEGKAERLEIRQSFVDFVDRVLALQDDSPIDRFSLKCITGIHPDHVNRWICNVLQRGVSDLDLFIDFSYEDTQEDEDMLPQEMFVSKTLVKLKIRNDRCVDWWCGKGGTSLPMLKSLYIDSDLILWGKMKRFLSSFPVLEELRMASMEWKESHETVSSASLRKLSILGTGCEDYVNPKSISFDTPSLLYLNYSDLVAEDYPLVNMGKLLEARINLIVKDDQIKRVREPNNDLLQDDAGNVVLQFGNVVKLMNGIQNIQILYLTADTLEVLSLCCESMPVFNNLKTLGIKSEEGRGWQAVPALLRNCPHLEYLIIEGLLHNVTDKCGDACDCISREDKGRSLASCPVKKVEIQGFRGTMREINMIGHFLRSFKCLKEMGIFPEEEGPTNFENPGAFEYVEKILKLYNEISNCDVYFLVWGYMRRKWTTQ

SEQ ID NO: 37275 - protein, 126 aa, Desulfitobacterium hafniense Y51
MKEIFTSKAAAAAGPYSQAIEALGFIFTSGQLPINPVSGEIDQNDIVWQANQVFSNVKAILEEAGAGFENVVKSTIFLKDMNDFATVNKLYGELFAKPFPARSCFQVGKLPKDAMIEMEVIALKTK

SEQ ID NO: 37276 - protein, 131 aa, Aggregatibacter aphrophilus
TFCARVISGEWKGYTGKAITDVINIGIGGSDLGPYMVTEALRPYKNHLTMHFVSNVDGTHIAETLKKVNPETTLVLVASKTFTTQETMTNALSARDWFLAAAKDSAHVAKHFAALSTNAKAVAEFGIDTDN

SEQ ID NO: 37277 - protein, 96 aa, Zea mays
METTEPLQDIMCEFRAGKMSHEGTRVVPDTRKGLVRVGRGEEGLVHFQWLDRGQNIVEDDQIIFPDEAVFEKVTESPGRVYILKFKQDSRKFFFWM

SEQ ID NO: 37278 - protein, 212 aa, Triticum aestivum
YELWCLARASGIRYCVLFCDTEVDHCREWNTKRQEKGEPTYDNNIFDDLVSRFEKPDRRNRWDSPLFELFPSRDGVMESSPVIAEAVSYLTKKVDSKTRDVKVLQPTISTQTARTTEANSLYEMDKATQEVINAIVEAQSCGLGLPVNKISLGPDLPTICLQRSVGLPELRSLRRTFIKLAGQYSLSGPPPPADADSATRMFVDYLNREISS

SEQ ID NO: 37279 - protein, 208 aa, Triticum aestivum
  misc_feature (188)..(188): Xaa can be any naturally occurring amino acid
MGSTPGSSYDCSFKVLLIGDSAVGKSSLLVSFVSAAPTDDDISPTIGVDFKIKFLTVGDKKLKLTIWDTAGQERFRTITSSYYRGAHGIILVYDVTKRQSFTNLADVWAKEIELHSTNKECVKMLVGNKVDKDEDRMVTTEEGLAFAQQCGCLFLESSAKTRENVEKCFEELALKILEVPSLSEEGSXSVVKRNSLKQKHEKSGGCCQ

SEQ ID NO: 37280 - protein, 224 aa, Zea mays
  misc_feature (216)..(216): Xaa can be any naturally occurring amino acid
MRFTASPVVELPVSGAVLTFEQDNDSFEVGTSVWPSSLVLVKFVERCIRDPALPFADVLRFPGTRAVELGSGCGPAGLGLSRLGLTDLVLTDIAAVLPALRRNLRRNRVHLARAPRLAQLHWNCPAHLATLATPRRFDLVVAADVVYVQESVPHLIAAMDALADAERGVVLLGYQIRSPEAHQVFWETVPAVFPVIEKVAREHLDPGYAYEESDVXILRRSPRQ

SEQ ID NO: 37281 - protein, 350 aa, Arabidopsis thaliana
MKKWLITGAVVIVLIGLGAWAIVSITPPPPKRCGTPGGPPITAPRIRLSDGRYLAYEEHGVSRQNATFKIVFIHAFSTFRRDAVIANRVRPGFLEKNGIYVVSYDRPGYGESDPHSSRNEKTLAHDVEQLADQLQLGSKFYVVGYSMGGQAVWGVLKYIPHRLAGATLLCPVTNSWWPSFPDSLTWELWNKQSKSERFSMLITHHTPWLLYWWNNQKLFSTTAVMQSSPNMFSPQDLALLPKLAARVSYKNQTTQQGTHESLDRDLIVGFGKWSFDPMKIENPFPKGEGSVHMWQGDDDRLVPIQLQRIIAQKLTWIKYHEIPGAGHIFPMADGMAETILKELLPIPQSS

SEQ ID NO: 37282 - protein, 459 aa, Zea mays
  misc_feature (54)..(54): Xaa can be any naturally occurring amino acid
  misc_feature (162)..(162): Xaa can be any naturally occurring amino acid
  misc_feature (178)..(178): Xaa can be any naturally occurring amino acid
  misc_feature (199)..(199): Xaa can be any naturally occurring amino acid
MATHAALAASRIPAGARLHSRAAASSRHGVQRLDFADFSGLRPGSCSVSAAARXASFSDVLGAQLVAKVRMRFMDDATGENAVRAPAEAKLKVAINGFGRIGRNFLRCWHGREDSPIDVVVVNDSGGVRNASHLLKYDSMLGTFKADVKIVDDTTISVDGKXPSRVVSSRDPLKLPWXELGIDIVIEGTGVFVDGPGAXGKHIQAGAKKVIITAPAKGADIPTYVVGVNEGDYDHSVADIISNASCTTNCLAPFVKILDEEFGIVKGTMTTTHSYTGDQRLLDASHRDLRRARAAALNIVPTSTGAAKAVALVLPQLKGKLNGIALRVPTPNVSVVDLVINTVKTGITADDVNAAFRKAAAGPLQGILDVCDVPLVSVDFRCSDVSCTIDASLSMVMGDDMVKVVAWYDNEWGYSQRVVDLAHLVAAKWPGAAAAGSGDPLEDFCKDNPETDECKVYEA

SEQ ID NO: 37283 - protein, 513 aa, Oryza sativa (indica cultivar-group)
MDNAYIIAILSVAILFLLHYYLLGRGNGGAARLPPGPPAVPILGHLHLVKKPMHATMSRLAERYGPVFSLRLGSRRAVVVSSPGCARECFTEHDVTFANRPRFESQLLVSFNGAALATASYGAHWRNLRRIVAVQLLSAHRVGLMSGLIAGEVRAMVRRMYRAAAASPAGAARIQLKRRLFEVSLSVLMETIAHTKATRPETDPDTDMSVEAQEFKQVVDEIIPHIGAANLWDYLPALRWFDVFGVRRKILAAVSRRDAFLRRLIDAERRRLDDGDEGEKKSMIAVLLTLQKTEPEVYTDNMITALTANLFGAGTETTSTTSEWAMSLLLNHPDTLKKAQAEIDASVGNSRLITADDVTRLGYLQCIVRETLRLYPAAPMLLPHESSADCKVGGYNIPRGSMLLINAYAIHRDPAVWEEPEKFMPERFEDGGCDGNLLMPFGMGRRRCPGETLALRTVGLVLGTLIQCFDWERVDGVEVDMTEGGGLTIPKVVPLEAMCRPRDAMGGVLRELV

SEQ ID NO: 37284 - protein, 377 aa, Zea mays
MPATAGRVRMPANNRVHSSAALQTHGIWQSAIGYDPYAPENDKQQPGRPSSSVSANAAAAAANDANAAASAAAASGSGSGDGNAYTSFQGLLALARITGSNSDETRGACKKCGRVGHLTFQCRNFLSVKDLDLDDADAQAAAQAAAQAKFDEIKKKAAAGGDADDASDDVEEDEDSDSSDSDIDPELEKIIAQRERARNGARWPRKEKKSSSHHHRNSSSKRKSKHTRSRSDDSEEDEGRRGRDRKKMSGRSKKHERSDEASSDDTDSDRQRHRKSRKDRKSRKDRKRRSHRRSDDTLDEKDVSGGEERRHQRHQRSHHWRDASDCDNGDSDSAHDKKQSSRRRRHCQSENSGLDEDERHDHRGAKRSRKNRDHKRS

SEQ ID NO: 37285 - protein, 231 aa, Triticum aestivum
MDPAAAAARRQADKWMSVAEKLLMAKDLEGCKEFSSQAIAADPRTPGAEDLYAAADVLLASQRRRLPSGQPDPYAVLGLDPAKPASRLPDVVHSKFRRLSLLLNRSHPDRPCSVYVAEAARLVADAWAFLSNAGLKSALDAELDAAAAPRPPMQQPAVERRPHPSPPPQQSPVWAAPQPRPHPQRIPVRPAPQPTPPLQPSSLRAATQTPPPSQSRSLRAATRNRRPPRPV

SEQ ID NO: 37286 - protein, 400 aa, Psychrobacter arcticus 273-4
MNFLRMSELSLTNKVVLIREDLNVPIKEGKVASDARLQASLPTIKMALEKGAAVIVCSHLGRPTEGSSEAIYSLAPVADYLSDKLSAPVTLNNDYLAQGVAIKAGEVVLLENVRFNEGEKKNNAALAQKYADLCDVFVMDAFGTAHRAQASTEGVTQAMHQAGKTACAGPLLAAELDALSLALETPAQPMLAIVGGSKVSTKLEVLHSLAELCSQIIVGGGIANTFLAAQGHSVGASLYEADLVDTAREIMGKTEILLPEYVVVANKNDIDFADFTGSLQKAVATIKSVDNIGDNDMILDIAPDSAIKLAAAITNAKTILWNGPVGVFEVDAFGQGTQIVAEAVKNSQGFSIAGGGDTLAAIDKYQVADGVSYMSTGGGAFLEFVEGKVLPAVAALQINE

SEQ ID NO: 37287 - protein, 277 aa, Aspergillus oryzae
MATQTYTQIELLSANGTVLRRVSTAPPRLPTNDEIPIIDLAPIDGTLDERKALTSRIKAASENTGFFYIRNHRIPEELIQTSLSQAKTFFDQPLSEKMKIDSSASNVSSGYHGVGSTQSDLSIFALALGEREDYFDDVTSHPGADALYIHYPGIPDVAADSDIDVGIGSHTDIQCFTLLWQDNSGGLQVLSAQDEWLDARPIEGTLVVNIGDFLQRLSNNKFKSTVHRVYNRQPDSRYSMPFFFGFNPEAVCKVVPSCVDDEHPPLYEPISCGEVCS

SEQ ID NO: 37288 - protein, 232 aa, Leptospira interrogans serovar Lai str. 56601
MKTEPTQLQKPNLTIHRIFETLSVVAFILLSIYFGYQLTLLFLDYFIVHSYLAWAIPLVVLLSWLGADFLSGLVHFLGDSVGSENTPIFGPAFIFPFRDHHVDPKGITRHDFIETNGNNCLVSLPILVYYVFFWESAGAFSYLLASFWFFLLLGIFATNQIHKWAHQDSPAVFIKILQKYKLILGPKHHGVHHTAPHDTYFCITTGWLNPILKYLKFYEILRWILRIPPAVR

SEQ ID NO: 37289 - protein, 203 aa, Bifidobacterium pseudolongum
DVVYNHVYTVVDHYFNQTAPGSSFRYDANGYRTSGSGYGNDVASERAMACQSIVDSVRYWATEFNVDGFRFDLMGLIDQPTMDQVCAELDAIDPSLIVVGEGWGTIDASGNLETAQPGASNVEGAAVFDDSLSDAIKGSVFSDEDTGFVAGMVEKDTLIVTDVFGCDNRREGIDETGRCDSGTANTNYGGADQVVQYVEIHDN

SEQ ID NO: 37290 - protein, 352 aa, Rhodococcus sp. RHA1
MTFFESLARKLDRTGVDPTVWHAPPPPPPTGVLAPNGMLDDAHRWTLPAGEGPEDVAVDHDGRVVTGGNDGRIWRFDGHGHATELANTHGRPLGVEILDDGRFLICDAERGVLRVDDQGRVDVLADAAAGRPLVACNNSAVGRDGIVYFTDSSAHFTIADHRYDLLEHRGTGRLLRLDPRTGETDLLAEGLQFANGVGLASDESFVLVAETGSYQISRVDLTGPSQGAASVWAANLPGIPDNMTSQTRDGLFWVALYSPRMRLLDLLAPYPTLRIVAANLPEAVQPNPEHAGWVIALDHRGEIVHSLRGGKGSYSPVTGVREHDGWLYLGSLTADAVARVPAPPRPDVARGE

SEQ ID NO: 37291 - protein, 887 aa, Chromobacterium violaceum ATCC 12472
MAATFPDDIDPLETQEWTEALESVLDNEGAERAHFLLEKMVERTRRRGAHLPFDATTAYQNTIPVGKEAKSPGNHEMEHRIRSINRWNAAAMVLRAGKKDLELGGHIASFQSSATLYDVGFNHFWRAQNENQDGDLIYFQGHIAPGVYARAFMEGRLTAEQMDNFRQEVDGQGLSSYPHPWLMKDFWQFPTVSMGLGPLMAIYQARFLKYLESRGLAKTMGRKVWCFCGDGEMDEPESLGAIAMAAREGLDNLVFVINCNLQRLDGPVRGNGKIIQELEGDFRGSGWNVLKVIWGSRWDPLLAMDTKGLLKKRMDECVDGDYQTFKSKDGGYVREHFFGKYPELREMVANMSDEEIWNLNRGGHDPHKVYAAYHEATHNANGRPTVILAKTIKGYGMGASGEAKNIAHQAKKMDLDSLRNFRDRFGIPVSDEDLPKVPYYLPAEDSPEMKYMRERRAALGGYLPARKPVNHPLAVPELSAFDAQLQSSGDREFSTTMAFVRMLGTIMKDKNIGKRVVPIVPDESRTFGMEGMFRQYGIWSTQGQNYVPQDHDQLMFYKESKDGQILQEGINEPGAMADWIAAATSYANSSQPMIPFYIYYSMFGFQRIGDLAWAAGDMRARGFLLGGTAGRTTLNGEGLQHEDGHSHIQAGLIPNCISYDPTFAYELAVIVQDGMRRMYAEQEDVFYYLTLMNENYVHPAMPAGAEEGILKGMYLLQDGGDAKVKVQLMGSGTILREVMAAADLLKADFGIGADIWSVTSFNQLRRDGMEAERHNLLNPTAEARSSYVEQQLAGRNGPVIAATDYIRNYADQIRAYVPGRYVVLGTDGFGRSDSRANLRSFFEVDRYHVALAALSALARDGKIDGAKVAEAIAKYGIKTDKLPSWKV

SEQ ID NO: 37292 - protein, 554 aa, Chromobacterium violaceum ATCC 12472
MSNLIELKVPDIGGHSNVDIIEVFIAPGQTVSVDDSLITLETDKATMEVPAEAAGVIKEVKAVVGGKISEGDVIAILEVGAAASAPAPAAAAPAPAAAPAAAPAPAAAAPAAAPAAPAASGRSEIRVPDIGGHNGVDVIEVTVKVGDEIAVDDSLITLETDKATMEVPATAAGKVVEVKIKVGDKVSEGDLIVVVEGAVAAASAPAAAAPAPAAAPAAPAPVAAAPAAAPAVAPVAAAVSAAIDEIAFSKAHAGPSVRRLARELGVDLGKVKGNGRKGRITEDDVKAFVKGVMQNPAALAPAAAPAGSGAGLDLLPWPKVDFAKFGPIETKPLSRIQKISGANLSRNWVMIPHVTFNDECDITELEDFRKTVGKEWEKSGLKISPLAFIIKAAAEALKAFPTFNSSLDGDNLVLKQYYHIGFAADTPNGLVVPVIKDADKKGLRQIAQELTDLSKLAREGKLKPTDMQGATFTISSLGGIGGTSFTPIVNAPEVAILGVCKSQIKPVWNGKEFAPRLMCPLSLSFDHRVIDGAAAARFTVHLGKLLSDVRRLIL

SEQ ID NO: 37293 - protein, 599 aa, Chromobacterium violaceum ATCC 12472
MSNLIELKVPDIGGHNNVDVIEVFVKPGDVIEKEASLITLETDKATMEVPAEAAGTVKEVRVTVGSKVSEGDLVVILEAAGAAAAAPAEVKPVETTGVASATTQAGFAPQAAPVAASHSGGADIECDVMVLGGGPGGYSAAFRAADLGLKVVIVERYATLGGVCLNVGCIPSKALLHNAAVIDEVSHLAANGIKFGKPEVDIDMLRGYKEKVIAKLTGGLGGMAKARKVEIVRGNGHFIDPHHIEVSLTTGKGREESGEKKIVKFKNAIIAAGSRVVKLPFIPNDPRVVDSTGALELKGVADRMLIIGGGIIGLEMGTVYSTLGARLDVVEMLDGLMQGADRDLVKVWQKWNAHRFDNIMLNTKTVAVEPKEDGVWVTFEGEQAPKEPQRYDLVLYATGRAPNGKLIGAENAGIAVTDRGFIQVDKQQRTNVPHIFAIGDIVGQPMLAHKGVHEGHVAAENCAGMKSYFDARVIPGVAYTDPEVAWVGVTEDEAKKQGLKIEKGVFPWAASGRAIANGRDEGFTKLIFDAESHQIIGGGIVGPHAGDMIGEVCLAIEMGCDATDIGKTIHPHPTMGESIGMAAEVAHGTCTDLPPQRKK

SEQ ID NO: 37294 - protein, 337 aa, Coccidioides posadasii
MVVKVGINGFGRIGRIVFRNAVEHPEVEIVAVNDPFIETHYAAYMLKYDSTHGRFKGDVKFSENGLDVDGKHVRFYQERDPANIPWAETGADYVIESTGVFTTTEKASAHLKGGAKKVIISAPSADAPMFVMGVNNETYKSDIKVLSNASCTTNCLAPLAKVVNDNFGLVEGLMTTVHSYTATQKTVDGPSSKDWRGGRTAAQNIIPSSTGAAKAVGKVIPSLNGKLTGMSMRVPTSNVSVVDLTCRTDKSVTYDQIKEAMKKASANELKGIMSYSEDALVSSDLNGDPHSCIFDATAGIALNDHFIKLVAWYDNEWGYSRRVIDLIAYIAGVDAGK

SEQ ID NO: 37295 - protein, 336 aa, Rhizomucor miehei
MTVKAGINGFGRIGRIVLRASLLNPEVEVVAINDPFIDLEYMVYMFKYDSTHGRFKGTVEAKDGKLVVNGKPISVYAERDPCCIPGRIGAEYIVESTGVFTTKEKAGAHLTGGAKKVIISAPSADAPMFVVGVNLESYSSDMQVISNASCTTNCLAPLAKVIDDEFGIVEGLMTTVHATTATQKTVDGPSGKDWRAGRGAGANIIPASTGAAKAVGKVIPHLNGKLTGMAFRVPNPDVSVVDLTVRLEKSASYEDIKAAIKKASEGSLKGILGYTEDEVVSTDFIGDSHSSIFDAKAGISLNPNFVKLISWYDNEYGYSTRVVDLLVHIAKVDGRL

SEQ ID NO: 37296 - protein, 131 aa, Aggregatibacter segnis
SFCERVISGEWKGYTGKAITDVINIGIGGSDLGPYMVTEALRPYKNHLTMHFVSNVDGTHIAETLKKVNPETTLILVASKTFTTQETMTNALSARDWFLAAAKDPAHVAKHFAALSTNAKAVTEFGIDTNN

SEQ ID NO: 37297 - protein, 337 aa, Omphalotus olearius
MVVKVGINGFGRIGRLVIRNALEAQGVEVVAVNDPFIPLDYMVYMFKFDSVHGRYKGTVEAKDGKLIIAGKPIAVFGERDPASIPWGASGADYVVESTGVFTTIDKASAHLKGGAKKVIISAPSADAPMYVCGVNLDAYDPRRPSISNASCTTNCLAPLAKVIHDKFGIVEGLMSTIHATTATQKTVDGPSNKDWRGGRSVNNNIIPSSTGAAKAVGKVIPSLNGKLTGLSFRVPTLDVSVVDLVVRLEKEATYDEIKAAVKEAVAGPLKGILDYTEDALVSTDFTGNTHSSIFDASAGIALNKNFVKLIAWYDNEWGYSRRVVDLITFVAQKDGNA

SEQ ID NO: 37298 - protein, 131 aa, Aggregatibacter segnis
SFCERVISGEWKGYTDKAITDVINIGIGGSDLGPYMVTEALRPYKNHLTMHFVSNVDGTHIAETLKKVNPETTLILVASKTFTTQETMTNALSARDWFLAAAKDPAHVAKHFAALSTNAKAVAEFGIDTNN

SEQ ID NO: 37299 - protein, 338 aa, Paracoccidioides brasiliensis
MVVKVGINGFGRIGRIVFRNAVEHDDVEIVAVNDPFIETKYAAYMLKYDSTHGQFKGDIQHSSSNNLTVNNKTIHFYQERDPANIPWGKHGVDYVVESTGVFTTTEKAKAHLSGGAKKVIISAPSADAPMFVMGVNEKSYRPDISVLSNASCTTNCLAPLAKVIHDNFGIAEGLMTTIHSYTATQKTVDGPSHKDWRGGRTAAQNIIPSSTGAAKAVGKVIPALNGKLTGMAMRVPTANVSVVDLTCRTEKPVTYDQIKAAVKAASEGELKGILGYSEDALVSTDLNGDPRSSIFDASAGIALNDRFVKLISWYDNEWGYSRRVLDLIAYIAKVDAGK

SEQ ID NO: 37300 - protein, 131 aa, Aggregatibacter segnis
SFCERVISGEWKGYTGKAITDVINIGIGGSDLGPYMVTEALRPYKNHLTMHFVSNVDGTHIAETLKKVNPETTLILVASKTFTTQETMTNALSARDWFLAAAKDPAHVAKHFAALSTNAKAVADFGIDTNN

SEQ ID NO: 37301 - protein, 173 aa, Glycine max
MANQGAKKRKEENARHMARLRQIIIACNVIYVLLRMLVFHSSFTWKHWIGLIVTSLAYVIPYQQLAKMATPAYAEDGELLDGGFDMSTGGVCGYLHDVIYITCFVQVMSIVSGKFWYTYLVIPAFGAYQSFGFIKGFLPGGSEESFEDEKTRKKREKMEKKASRPKFAKTRTR

SEQ ID NO: 37302 - protein, 510 aa, Solanum lycopersicum
MALTLSFSLPLPSLHQKIPSKYSTFRPIIVSLSDKSTIEITQPIKLSTRTIPGDYGLPGIGPWKDRLDYFYNQGKNDFFESRIAKYKSTIFRTNMPPGPFITSNPKVIVLLDGKSFPVLFDASKVEKKDLFTGTFVPSTELTGGYRILSYLDPSEPNHEKLKKLMFFLLSSRRDHVIPEFHETYTELFETLDKEMEEKGTVGFNSGSDQAAFNFLARSLFGVNPVETKLGTDGPALIGKWILLQLHPVITLGLPKFLDDVLLHTFRLPPILVKKDYQRLYDFFYTNSANLFIEAEKLGISKDEACHNLLFATCFNSFGGMKIFFPNMLKSIAKAGVEIHTRLANEIRSEVKSAGGKITMSAMEKMPLMKSVVYEALRVDPPVASQYGRAKQDLKIESHDAVFEVKKGEILFGYQPFATKDPKIFDRPGEFVADRFVGEEGEKLLKHVLWSNGPETESPTVGNKQCAGKDFVVMVSRLFVTEFFLRYGTLNVDVGTSALGSSITITSLKKA

SEQ ID NO: 37303 - protein, 131 aa, Aggregatibacter segnis
LFCERVISGEWKGYTGKAITDVINIGIGGSDLGPYMVTEALRPYKNHLTMHFVSNVDGTHIAETLKKVNPETTLILVASKTFTTQETMTNALSARDWFLAAAKDPAHVAKHFAALSTNAKAVAEFGIDTNN

SEQ ID NO: 37304 - protein, 476 aa, Solanum lycopersicum
MNSAPLSTPAPVTLPVRSIPGSYGLPLVGPIADRLDYFWFQKPENFFTKRMEKHKSTVFRTNVPPCFPFFGSVNPNVVAVLDVKSFSHLFDMEIVEKANVLVGDFMPSVVYTGDMRVCAYLDTSEPKHAQIKNFSQDILKRGSKTWVPTLLKELDTMFTTFEADLSKSNTASLLPALQKFLFNFFSLTILGADSSVSPEIANSGYIFLDSWLAIQLAPTVSIGVLQPLEEILVHSFAYPFFLVKGNYEKLVQFVKNEAKEVLSRAQTEFQLTEQEAIHNLLFILGFNAFGGFSIFLPTLLGNLGDEKNADMQEKLRKEVRDKVGVNPENLSFESVKEMELVQSFVYETLRLSPPVPSQYARARKDFKLSSHDSVYEIKKGELLCGYQPLVMKDPKVFDEPEKFVLERFTKEKGKELLNYLFWSNGPQTGRPTESNKQCAAKDMVTLTASLIVAYIFQKYDSVSFSSGSLTSVKKAS

SEQ ID NO: 37305 - protein, 131 aa, Pasteurella pneumotropica
DFCQCVISGEWKGYTGKAITDVVNIGIGGSDLGPYMVTEALRPYKNHLTMHFVSNVDGTHIAETLKKVNPETTLFLVASKTFTTQETMTNAESARDWLLASAKDKSAVAKHFAALSTNGKAVAEFGIDTNN

SEQ ID NO: 37306 - protein, 349 aa, Mycobacterium bovis AF2122/97
MDVLSAVLLALLLIGANAFFVGAEFALISARRDRLEALAEQGKATAVTVIRAGEQLPAMLTGAQLGVTVSSILLGRVGEPAVVKLLQLSFGLSGVPPALLHTLSLAVALAIVVALHVLLGEMVPKNIALAGPERTAMLLVPPYLVYVRLARPFIAFYNNCANAILRLVGVQPKDELDIAVSTAELSEMIAESLSEGLLDHEEHTRLTRALRIRTRLVADVAVPLVNIRAVQVSAVGSGPTIGGVEQALAQTGYSRFPVVDRGGRFIGYLHIKDVLTLGDNPQTVIDLAVVRPLPRVPQSLPLADALSRMRRINSHLALVTADNGSVVGMVALEDVVEDLVGTMRDGTHR

SEQ ID NO: 37307 - protein, 713 aa, Bifidobacterium longum NCC2705
MQIRPGSMYPLGASYDGAGVNFALYSQVAQKVELCLFDEHDVETRIEMTERNSYVWHNYIPGLHPGQRYGYRVYGPYDPVHGLRCNPNKLLLDPYAKAIEGNIDGDESLFSYWFKSPDDNSAMNDLDSAAHTMKSAVINPYFDWGNDQHPYISYHDSVIYEAHVRGMTNLNMDVPPDIRGTYAGLAYPSVIEYLKKLGITAIELMPIHQFVNDSFLQEKGLSNYWGYNTIGFFAPHNAYSSSGERGEQVNEFKSMVKAYHRAGMEVILDVVYNHTAEGNHMGPTLSFKGIDNASYYRLVEGDQQHYFDTTGTGNSLLMRSPHALQLITDSLRYWVTEMHVDGFRFDLAATLARQFQEVDKLSAFFDIVEQDPIISRVKLIAEPWDLGSGGYQVGGFPSSWSEWNGRYRDTVRDFWRSQPSTLPEFASRLMGSSDLYQVNGRRPVASVNFITAHDGFTMNDLVSYNEKHNEANGEGNRDGESNNRSWNCGVEGPTNIPDVNDLRQRQMRNMFATLLFSQGIPMICGGDEVARTQQGNNNAYCQDNEISWTNWHLDKGRKELLAFVSKLIHLRLDHPVLHRRRFFTGREPGDDSNTIPQVEWFDHTGSIMDMDDWQNTHAFSMMIYLNGSDIPEVDWYGNRMVDNDFILIFNAHYEPIMFTLPDERYGRKWQLVVDTHNPNEPALSYEAGFMITAQSRSFLMLMSAKKPKKPMGL

SEQ ID NO: 37308 - protein, 1408 aa, Arabidopsis thaliana
MGTETVVHDQARWAMAAMERRLAVAKAQLLQQQQQKNEKDKKGTSDVDVSMKESHQADSLPTPSKTSIKKVDPKDDDSVAYTKLSHPVDENLLATNVKFSSAKGTIVDKVLHNLLRSGDSAQKYLQGTKSVKLDNYILLDNFVQSRSSASGSKKASQKDSKRSKSRMSMKRLKKSGALHIPKDLQKFDLFKPMHGMWESYMMKLIKVTGKIQLSLTLLSADLHGAFMFGNPSFFHKSVVLGYDLLSLTHFPKLNFSQPILLVTVAECKIASFTGVQGIMVRETSETFGIITRDDKFRVVPKKLSVFIIQLDCWKITLHGDKRSPDKKKRMNPSQQHLPKLCPKRLFLFFTPFLLFSLYYILTTIKTITISSQDRHHPPQLHVPSISHYYSLPETSENRSSPPPLLLPPPPSSSSSLSSYFPLCPKNFTNYLPCHDPSTARQYSIERHYRRERHCPDIAQEKFRCLVPKPTGYKTPFPWPESRKYAWFRNVPFKRLAELKKTQNWVRLEGDRFVFPGGGTSFPGGVKDYVDVILSVLPLASGSIRTVLDIGCGVASFGAFLLNYKILTMSIAPRDIHEAQVQFALERGLPAMLGVLSTYKLPYPSSSLCFELLASSTLLLILKERTFYPDGLYLMEVDRVLRPEGYWVLSGPPVASRVKFKNQKRDSKELQNQMEKLNDVFRRLCWEKIAESYPVVIWRKPSNHLQCRKRLKALKFPGLCSSSDPDAAWYKEMEPCITPLPDVNDTNKTVLKNWPERLNHVPRMKTGSIQGTTIAGFKADTNLWQRRVLYYDTKFKFLSNGKYRNVIDMNAGLGGFAAALIKYPMWVMNVVPFDLKPNTLGVVYDRGLIGTYMNWCEALSTYPRTYDLIHANGVFSLYLDKCDIVDILLEMQRILRPEGAVIIRDRFDVLVKMEALSSLTFKGSLPEAIFEAKGKKKLFVVYISGEDEESDKLNRLTWTDASGSLHQFLDPYSSVPCIAAIGFSGTQVWRTEGFITAEDLASSLEKAWLGLHIQETTASIFSAALASQNSETPVSSASSVVLPPGSVPLDAAVASPSTASSVQPSETNLFLKQGKESAEPSNLCDTTKNQPAPSVDGTKANVEHEATETPLRVQAEKEPIRPTAPGTNDNTSRVRSSVDRKRKQGTVINEEDSGVGVSGRDINLTKSVDTKETMKPKDEGGEEEDGEKSKKASDVHLNIRLPDGSSLQEKFSVTSILRMVKDYVNSNQTIGLGAYDLAVPYPRKVYTDQDLDKSLSELRLFDRQALVVVPRKRATVYQRGTSYSESNNNTDPNSGGYFAYVRRVLSYANPFSYFGGGTANASSSVPERQTRPNTEVRNNLGQVGTSFQDPSEGRSNVRNRRPTTSRIGSNIHTLNHNEDEAPFGDGNAFWNGNSTQYGGGSGGDSNDRR

SEQ ID NO: 37309 - protein, 377 aa, Pseudoalteromonas tunicata D2
MENQFIKSKAAIAWGPNQPLSIEEVDVMYPKAGEVLVKIIATGVCHTDAFTLSGQDPEGVFPAIMGHEGAGIVHAIGEGVTSVAIGDHVIPLYTPECGECKFCTSGKTNLCQKIRATQGKGLMPDGTTRFYKDGQPIFHYMGTSTFSEYTVLPEISLAKVNKTAPLEEICLLGCGVTTGMGAVMNTAKVKAGDTVAIFGLGGIGLSAIIGAQMAGASQIIGVDINPSKFELAKKLGATLCINPKDYDKPIQEVIVELTDGGVDFSFECIGNVDVMRSALECCHKGWGESVIIGVAGAGQEISTRPFQLVTGRVWRGSAFGGVKGRSELPHIVERYLAGEFKLDDFITHTMALEQINEAFDLMHSGESIRSVIHFDHK

SEQ ID NO: 37310 - protein, 117 aa, Glycine max
  misc_feature (16)..(16): Xaa can be any naturally occurring amino acid
  misc_feature (31)..(31): Xaa can be any naturally occurring amino acid
  misc_feature (51)..(51): Xaa can be any naturally occurring amino acid
  misc_feature (66)..(66): Xaa can be any naturally occurring amino acid
  misc_feature (73)..(73): Xaa can be any naturally occurring amino acid
  misc_feature (81)..(81): Xaa can be any naturally occurring amino acid
  misc_feature (90)..(90): Xaa can be any naturally occurring amino acid
  misc_feature (95)..(95): Xaa can be any naturally occurring amino acid
  misc_feature (112)..(112): Xaa can be any naturally occurring amino acid
MASSSDSWMKEYNEAXLKLADDITGMISERXSFPASGPETQRHASAIRRKXTILGTRLDSLQSLLXKVPAKTXKEMNPRKXMLLNLKTKXNQMAXTLNISNFANKDNLFGPXINPMP

SEQ ID NO: 37311 - protein, 566 aa, Aspergillus oryzae
MYALNQTAKSVWLPLTQLSGTSKYDIVSRLVCTILIIRSVLTVYQNVTCYGVAGTLTNALEYCRRWISLETRAAPRKFKRVDKDIEAISNSMVQKLARHGADVRRNLSLPKEGWDIEKVEAELNELHNLDHTRWEDGRVSGAVYHGGNELLEMQTRAIGKFSVSNPIHPDVFPGVRKMEAEIVAMILAAFHGPEDGAGVTTSGGTESIIMACLAAREKAAAERGVTNPEMIIPSTAHAAFFKAAQYFKIKLHLVSCPAPEYKASVTEIRRLINRNTVLLVASAPNYPHGIVDDIPEISRLATENDIPLHVDCCLGSLVIAFLQKSGFPSPYDNSGGFDFRQPGVTSISVDTHKYGFAPKGSSVLLYRNRSYRNYQYFLFPDWSGGAYASPSMAGSRPGSLIAGTWATLVRMGESGYISSCRQIVGAAKKFEAAILTNPILKPHIEIIGYPMVSVIAFTSKNDEIETYDIADAMDARGWHLNALQSPPAIHCAFTIPTAEAVDGLISDLIDVISEILLQIQEQKQKGEHIVRQRGKSAALYGVGGSIADRTMVNQFAEGFLDTLYKA

SEQ ID NO: 37312 - protein, 621 aa, Oryza sativa (japonica cultivar-group)
TISVSPPITKHPGRIMETVMQDSAGIRHLRKLSAAGLTHVHLLPSFHFASVDDNKSNWKFVDEAQLAKLPPGSDEQQAAIVSIQQEDPYNWGYDPVLWGVPKGSYASNPDGPSRIIEYRQMVQALNRIGLRVVMDVVYNHLDSSGPFGVSSVLDKIVPGYYLRRNVNGQIENSAAMNNTASEHFMVDRLIVDDLLNWAINYKVDGFRFDLMGHIMKSTMIRAKSAIRSLTRDVHGVDGSKIYLYGEGWDFGEVAQNKRGINASQINMSGTGIGSFNDRIRDSVNGGNPFGNPLQQGFSTGLFLEPNGYYQGNEADTRRELATYADHIQIGLAGNLKDYVLRTHTGEAKKGSDIYTFDGSPVGYTSSPVETINYVSAHDNETLFDIVSIKTPIGLSIDEKCRINHLASSMIALSQGIPFFHAGDEILRSKSLDRDSYNSGDWFNKLDFTYETNNWGVGLPPRDKNEENWHLIKPRLENPSFRPLKNHILSVFDNFVDILKIRYSSPLFRLSTASDIEQRVRFHNTGPSMVPGVIVMSIKDAQNEKCKMAQLDKNFSYVVTIFNVCPHEVSIEIHDLASLGLELHPIQVNSSDALVRQSAYEASKGRFTVPRRTTAVFVQPRC

SEQ ID NO: 37313 - protein, 346 aa, Oryza sativa (japonica cultivar-group)
MAAATVSNKRVILKRYVTGLLSEDDMEVVTVEAPPLDVPTGSKGVVVKNLYVSCDPYMRNRMTHHELPSYIPDFVPGEVLENFGVMKVISSGHLDFKAGDLVWGMTGWEEYTVINNPESLFKINHPELPLSYYTGILGMPGLTAYAGFFDVPKPKKGEYVFISGASGAVGQVVGQLAKITGCYVIGSAGYDEKVNLLKSKFGFDDAFNYKKEQDLEAALRRYFPEGIDIYYENVGGKMLDAVLPNMSLGGRIVACGMISQYNLEQPEGVRNLYYIVTKRLRMEGFHVFDYYDRYYRFEEEMAGYLKEEKVSYVEDVVEGLDTAPAALIRLFTGRSVGKQLVAVARE

SEQ ID NO: 37314 - protein, 374 aa, Yarrowia lipolytica CLIB122
MFGGTAQWGATPFRNRTQKFQDYYRCYPIAMMPGKDRESANYGGKIFLPPSALSKLSMLHISYPMLFQLKSEENDNVTYGGVLEFIAEEGRVYLPQWIIETLDVGPGSLLEISSCDLPLGKFVKFEPQSVDFLDISDPRAVLERSFQNFSTLTVGDVFKFSYNDKTYGMKVLEVKPDLEDKHSVCCVETDIEVDFAPPVGYVDPSTQSDSNYGRAIKTPGTSGSSTPAPMAAAGTMAQSIGYSKLAQQTIKSASKNTFSGGGQKLSGKAVKPEEEASLDEHFKELVGLGSTDTDANPQPLRLPFGQLFFGFPLVPVKPSEDEETQTEEQQQQPHFSGTGQSLRESRKRKERNSSAGAAGGTPKKPTSPEMVVID

SEQ ID NO: 37315 - protein, 528 aa, Borrelia garinii PBi
MKYALIRKLLFVLRTYMMNVRAILVLDFGSQYSQLIARRIREIGVYTKVIPYYTPLKEIKNMNIAGIILSGGPASVYAKDAPTLNMEIFNLKIPVLGICYGMQLIVKLFGGLVSKDYKQEYGSSEIFLKNEKSLLFSELPNKFQIIMSHGDSIEKIPNNFKQLAFTKNCIASISNEDQKIYGLQFHPEVTHSEFGDQILKNFVFKICQSQTNWSLESNVETIVEKIKLKVGSKKVILGLSGGTDSLVCALLIKKAIKENLICVFVNTGLLRKNEDKKILELKHQYDLNIKYIDASEKFLNYLKNISDPEEKRKIIGKEFVNVFEKITLEDQNIEYLAQGTIYSDVIESKSKNNASSKIKSHHNVGGLPDKMRLKLLEPLNEFFKDEIIQIGINLGIKKEALYRHPFPGPGLAIRIIGEVTQEKINILQEAENILTEELFTNDLYYEIRQAFVVLLPVKSVGVMGDQRTYEYTAVIRCVNTQDFMTAEWTELPYNFLRKVSSRIINEVRGINRVCYDISSKPPSTIEWE

SEQ ID NO: 37316 - protein, 435 aa, Blastopirellula marina DSM 3645
MKGDTHRVVIIGGGFGGLFAARSLKSSPVHVKLVDRRNFHLFQPLLYQVATGGLSPANIATPLRRILVRQRNTEVVMADVADFDPANRKVILHDGEVEYDSLIVAAGAETGYFGNCEWAKTAPGLKSIEDATEIRRKILSAFELAERTTDKTEQTELMTFVIVGGGPTGVELAGALAEISRQTMKNDFRNINPADARIILVDAGERVLSPFPPELSENARMSLTKLGVEVNNHHRVKLVEEGSVTVTHEDQETTIRAKTIIWAAGVQASPLGRKLAERTGAKTDRGGRVIVEPDCTLADYPEIFVIGDMACYPHQGEHPLPGVAPVAMQQGKYAAKTIVDRIQNKPTQPFRYSDPGSLATIGRSKAVAVLGKWKFTGFIAWVLWLVVHLMQLIQFENRLLVLMQWSWAYSTFNHSARLITGEDYRREELDDILGS

SEQ ID NO: 37317 - protein, 345 aa, Glycine max
  misc_feature (316)..(316): Xaa can be any naturally occurring amino acid
MSSQRADLACRIFPEPDASEIDHFDRLPDSLLLLVFNKIGDVKALGRCCVVSRRFHSLVPQVENVVVRVDCVISDDDSSSSAAASDKSRGPFWNLLRLVFGGIVKPIQTLGQFLGPKRPSSSSVTSPSSTTSSSPLAVGTDDDSDAGVTHHSPTQVLKNFNEIRLLRIELPSGELGIEDGVLLKWRADFGSTLDNCVILGASSVFHPKDNLTDPIPTTNCNANDDNGSIPDSFYTNGGLKLRVVWTISSLIAASARHYLLQPIISEHATLDNLVLTDADGQGVLYMNREQLEELRVKPLSASSASKRTLVPALNMXLVYAAHLELQLGFGFKGAHPGWKPIFLIK

SEQ ID NO: 37318 - protein, 547 aa, Brassica juncea
HELLHGLALVFLLAASSCKADEEITCEENTPFTCGNTDILSSKNFGKDFIFGVASSAYQIEGGRGRGVNIWDGFSHRYPEKSGSDLMNGDTTCESYTRWQKDVDIMGELNATGYRFSFAWSRIIPKGKVSRGVNQGGLDYYHQLIDALLEKNITPFVTLFHWDLPQTLQDEYEGFLDRQIIQDFKDYADLCFNEFGGKVKHWITINQLYTVPTRGYASGTDAPGRCSYMVDTKHRCYGGNSSTEPYIVAHNQLLAHAAVVDLYRTKYKFQNGKIGPVMITRWFLPFDESDPACVEAAERMNQFFHGWYMEPLTKGRYPDIMRQIVGSRLPNFTEEEAALVAGSYDFLGLNYYVTQYAQPQPNPYPSETHTAMMDPGVKLTYNNSRGELLGPLFAEDKVNGNSYYYPKGMYYVMDFFKTNYSNPLIYITENGISSPGTENRCEAIADYKRIDYLCSHLCFLRKVIREKGVNVRGYFAWALGDNYEFCKGFTVRFGLSYVNWDDLDDRNLKESGKWYQRFINGTVKNHANQDFLRSSLSSQSQKKRLAC

SEQ ID NO: 37319 - protein, 131 aa, Pasteurella aerogenes
AFCERVISGEWKGYTGKAITDVINIGIGGSDLGPYMVTEALRPYKNHLTMHFVSNVDGTHIAETLKKVNPETTLILVASKTFTTQETMTNAHSAREWFLASAKDEAHVAKHFAALSTNAKEVEKFGIDTAN

SEQ ID NO: 37320 - protein, 234 aa, Ralstonia solanacearum GMI1000
MSLLHQARFFTTVNHLRDLPATAVPEVAFAGRSNAGKSTAINVLCNQKRLAFSSKTPGRTQHINYFSVMPAKALDPLGFLVDLPGYGYAQVPGEAKSHWEHLLGDYIQTRSQLAGLVIMMDARRPFTDLDCQMVEWFLPTGKPIHVLLTKADKLTNNDASRALMSARKVLAGYQAQIEGEVSLTVQLFSSLKRRGIEEAQRTVAGWLCLPEAMPPSPDAEPAKKTPSPDAQRGE

SEQ ID NO: 37321 - protein, 482 aa, Salmonella enterica subsp. enterica serovar Paratyphi A str.
MQLNDSTLFRQQAFIDGDWRDARGGDVIPVSNPANGKPLGNVPKMGAEETRDAINAANRALPAWRALTAKERANILRRWFNLMMEHQDDLARLMTLEQGKPLAEAKGEISYAASFIEWFAEEGKRIYGDTIPGHQTDKRLLVIKQPIGVTAAITPWNFPSAMITRKAGPALAAGCTMVLKPASQTPFSALALAELAQRAGIPAGVFNVVTGSAGDIGGELTSNPLVRKLSFTGSTEIGRQLMEQCAKDIKKVSLELGGNAPFIVFDDADLDKAVEGALASKFRNAGQTCVCANRLYVQDGVYDRFAEKLNQAVNKLAVGDGLQADVAIGPLIDEKAVAKVQEHIADALEKGARVITGGEAHKLGGNFFQPTILVDVPDNAKVAKEETFGPLAPLFRFSDEADVIRQANDTEFGLAAYFYARDLSRVFRVGEALEYGIVGINTGIISNEVAPFGGIKASGLGREGSKYGIEDYLEIKYMCIGL

SEQ ID NO: 37322 - protein, 1839 aa, Lachancea kluyveri
MSSPTDAERVNMRREKHPQIEETFEEHVHNAMPKFKKHYALGITTHTNDEDDDPRDHRQRGIHNPNFIHSPNDPRPPLSQPIKPRFSVHGTASNASVFSHGDIAPVRKTSRAGSLFKRLAGKKSTTSLLGTEHQQRQQQQSSNSLVPAAGLRRKMSTFIHGGSGSQSNESRGTRSSIFFPSTSNSRRGSATSTMTSGSRSSHPPDTPPITSQQQEQQYDQQRQQRPETREQEQKPPTLSDMPIVSRSPSFFMLDTDLNNLSDITNIISATPKNTESDEVRSTGANKTLKYPKPPLSSHKSTSASDLSHHKAQWTAPESWDIEEDANKLLATKRKAKHHHHYHHPQHPRPPHRKHYSNFSKPIEDKAVVEKEQEPPEKCPQPISTDSNDAQGLEIAKPIDESSGIQHSASTQSVSSFSSGATGASGATGKQIGGDQETESTISTVGEDEEVTNLRSIDSEQTDDTSFSKFDEEYDKAEYQLEKYYNDFSDVDLNRRYAIRIFNIDDTFTTLSCTPNTTLQDMMPQLKRKFNVGQGSYQVSLKVGKLSKILRPTAKPILIQRRLLLLNGYLKSDPLHIMGIEDLSFIFSFVFHPVATSHLNYEQEQRLSRGDFVHVDLRNMDLTTPPIILYQHTSDIESLDVSNNANIFLPLDFIESAIKLSSLRMVNIRASKFPANVTDAYKLVSLDLERNFIKKVPDSIFKLNNLTIVNLQCNNLERLPPGFSKLKNLQLLDISSNKFVNYPEVINSCTNLLQIDLSYNKIHSLPVSINQLVKLAKMNLFNNRLTSVGDLSQMKNLRTLNLRCNRVTSIECHAPNLQNLFLTDNRISTFDDDLTRLRTLELQQNPITSMVCGGNYMANMTSLSLNKAKLSSFSAELLSKLPRLEKLELNENNLTQLPPEINKLTRLIYLSVARNKLESIPDEISDLRSLKSLDLHSNNLRMLMNNLEDLELTSLNVSSNLLTGFHGSPAKFFASPSPKLAKSLLFLSVADNNLTDSIWPLVNTFQNLKTLNLSYNNFVEISDLKLQNLTELYLSGNNFTSLPGEAVQHLRSLKVLMLNGNKLLSLPAELSQLSRLSVLDVGSNQLKYNISNYHYDWNWRNNKDLKYLNFSGNKRFEIKSALDPEGKNDLSDLGILKQLRVLGLMDVTLKTSKVPDESVSIRLRTTASMINGMRYGVADTLGQSDSVCSRDVTFERFRGREDECLICLYDGKNENASSGHKISKIIRDIYDKILIRLLEKYGEESDGIKRALRYSFLQLNKEINGMLVSVEDGNTDSGLTSADLLSGSSATVVYLKGKKIYTANIGDTMAVLSKNNGDFVTLTKLHVPAEREEYERIRTSGGYVNNQKLDGVSEVSRAVGFFDLLPHIHASPDISETVLSYSDEMLIIATHKLWEYLDYETVCDISRENKSQPMSAAEKMKDYAISYGCSDNITILCVSLDKSVNQQSQFTLNREDLISRKNTFEDTVLRRLQPEIAPPTGNVAIVFTDIKNSTFLWELFPDAMRAAIKTHNDIMRRQLRIYGGYEVKTEGDAFMVAFPTPTSALVWCLSVQLKLLEAEWPEEITSIQDGCLITDNSGTKVYLGLSVRMGVHWGCPVPEIDLVTQRMDYLGPVVNKAARVSGVADGGQITLSSDFCSEFKKIMKFHKRVVENQEPLKEVYGEDFIGEVLEREIHMLENVGWVFKDLGEQKLKGLETKEFITIAYPKTLASRHDLATKNQNSSVLNDDLLFQLRTISNKLENILSSINGGLIESETPGNSSIYMTFDKNTKDAVITKSTESDWISFLDHLVTRVESTVAILQLRQKLQGGLELYTSSDSTMHKSVFELLDEILKIQTDQKQ

SEQ ID NO: 37323 - protein, 524 aa, Cryptococcus neoformans var. neoformans JEC21
MRRTITLRHLLPLGIRSKHIMPTHAKLNVPSLGEVEVPVGLFINNEWVESTSRETFSTVNPATGQKLLDFAHAKKEDIDKAVIAARKAFKTTWGNNVLAAERGVLLNKLADLMERDSDKLAALESINSGKGIRIAREADVADSVACIRYYAGLADKIHGQTVSSFGKEKFVYTLHQPIGVCGQIIPWNYPIMMWAWKIAPALAAGCTVVMKPSELTPLSALALCDLVKEAGIPAGVINTVPGHGATAGDAISRHMDIDKVAFTGSVSTGRRISIAAAESNLKKVTLELGGKSPVIVFDSADVEEAADWAALAIWFNSGQDCCAGSRLYVQEGIFDKFLAAMKKRAEACAIGQPHDEKTSFGPLISEGQRDKVLNYIVSGKEQGARVVTGGQKWPESNDGYWIEPTILADTTPDMTIVKEEIFGPVVVAAPFKTEEEVLEVANDTSYGLAAAVFTNDTRQATRVSAALDAGTVWINQYALLHPGVPFGGFKQSGIGRELGTYGLEAYMQIKAVHNNLTQTSPWPV

SEQ ID NO: 37324 - protein, 589 aa, Legionella pneumophila str. Lens
MNQEISNFSTFNFSSALNKALEDMKFITPSPIQAQTIPLILQGRDAIALAQTGTGKTAAFALPILQNLSPEISTTQALILAPTRELAIQVAEQFELLSKYQRNVTIAVLCGGQEYGRQLKQLRSGAQVVVGTPGRILDHIDKGTLLLNNLKTFILDEADEMLRMGFIEDVETILEKLPEKKQMALFSATMPYRIRQIANTYLNDPASIEIRMETATVKSIEQRFLFASVHQKPDALIRVLEVEDYQGVIVFVRTKSSTEEVAELLQQHGLRAMAIHGDITQSLRERIIAQFKQGAIDILVATDVAARGLDVERVTHVINYDMPHDNETYVHRIGRTGRAGRSGVTILFVTPKESRLISSIERHTRQRIEKVQVPNDHMIQMARQQRFMSNITTRLNHEHVYSYKRIVEEYIKDHDVSAVDVAAALALLLHKDMPWRKELNMPKAASAFKEDRARAGEKGLDLRGRFKEDRKNSFADRKGARGSKKDFAKDFSNERKKFNDGRKAVNQESVAQDLFRIDVGKIHGVKPGNIVGAIANEAGLQSRYITGLKIHEDHSTVRLPKGMPKEVMKDLTKAWVCGRQLNLTLIGSA

SEQ ID NO: 37325 - protein, 757 aa, Burkholderia thailandensis E264
MREFDYLLVGGGIASVTAARTLRGENAPASIAILCGEPVLPYQRPPLSQEFLMGAAQPASIALHDAAFYASQRIDVVLGARAEHLDLAKRIVRASNGGAFRYRKLLIATGASAKVPALPGIGLDGVHVLHTVAQAQALKDATAHARRATVLGGGFLGVEIAATLRALGLQVTLIERAPDVMPTLRAPALASRFEALCKARGIDVLTSREVRRVLGAQRVEAVETSDGGTHPCDLFVAAVGVTPNCGWLDGSGLALGDGIEVDAFLQTADPDVFAAGDVAHFDDPIFGVRRRIEHWDNAVRQGRIVARNMLGYRLPYRDVSIFYGSVFGLSYNLLGYPVGATETIERGSFDDASYTLLYLADDVLRAAFTIDRPAVEIAAMNDAVRLHVNVAEQKSKLSDPNFALDKLPVQTILILQGGGALGAFECGAIKALEQHGVRPDVISAVSIGAFNGAIVASHPKGASKALEAFWRELSISLPLPHGSQWHQAWLSSYVLSCGVPNFLKPQWSQLGFGADQLRAKWTSFFDASSIEKLIARYVDFDSLGMSPTRLLIGAVDVETGEPRIFDSYVDRLSPAHVLASGSLPPGMPWTVVDGRPYWDGGVVSNSPLDLVIARCGQIGGRVFIVDLFSGSKTLPTNIVEVMLRREEIAYMDRVRNDLRLEEYASDFRDLVDGILAHVDAPTANEIRQQPLYIRLMGNRAALDIARITLNRDGRLSFIEDYDFSSDAIAQLQTQGYDAALAALANDRALRRRGRRAA

SEQ ID NO: 37326 - protein, 452 aa, Leifsonia xyli subsp. xyli str. CTCB07
MRESQFLLPDVGEGLTEAEIVSWKVAPGDSVAVNQVIVEIETAKSLVELPSPFEGTVGELLVVEGQTVEVGTPIFTVNGGEADHGVTEPAGEAEQAAVDAAASVTHESEEPKAGAVIVGYGSAGHGTSRRRVTHPGAAARPAAFPPAESAAEPGRAPSTPVPPSGGGPVIAKPPIRKLAKDLGVDLSTVTATGAIGEVTREDVLREGTQASVFRNIQTPEWPDDREERILVKGVRKAIANAMVTSAFSAPHVSVFVDVDATRTMEFVKRLKSAPDFVGVKVSPLLIMAKAIVWAVRRNPTVNSTWTDEEIIVRHYVNLGIAAATPRGLIVPNVKEAQGMSLLELAGALEELTLTAREGKTQPADMANGTITITNIGVFGMDTGTPILNPGEVGIVALGTIKQKPWVVDGEVRPRFVTTLGGSFDHRVVDGDVASRFLADVASIIEEPALLLD

SEQ ID NO: 37327 - protein, 337 aa, Leifsonia xyli subsp. xyli str. CTCB07
MERAPALAEPEPRVQSLPMVKALNAGLRQALVADPKVLILGEDVGPLGGVFRVTEGLQSEFGASRVVDTPLAEAGIVGTAIGLAMRGYRPVVEIQFNGFVFPGFDQITTQLAKMANRHSGAVSMPVVIRIPHGGHIGAVEHHQEAPEAYFAHTAGLRIVAPSTPHDAYWMIQEAIASDDPVIFFEPMSRYWPKGEVDTLENPLPLHASRIVRSGTDATIVAWAGMVPVALRAAEIAAEEGRSLEVVDLRSLAPIDYAPVLRSVQKTGRLVVAQEAPGIVSVGSEVAAVVGEKAFYSLEAPVLRVAGFDTPFPPAKLESLYLPDADRILEVVDRSLAY

SEQ ID NO: 37328 - protein, 432 aa, Arabidopsis thaliana
MTVRSKIREIFMPALSSTMTEGKIVSWIKTEGEKLAKGESVVVVESDKADMDVETFYDGYLAAIVVGEGETAPVGAAIGLLAETEAEIEEAKSKAASKSSSSVAEAVVPSPPPVTSSPAPAIAQPAPVTAVSDGPRKTVATPYAKKLAKQHKVDIESVAGTGPFGRITASDVETAAGIAPSKSSIAPPPPPPPPVTAKATTTNLPPLLPDSSIVPFTAMQSAVSKNMIESLSVPTFRVGYPVNTDALDALYEKVKPKGVTMTALLAKAAGMALAQHPVVNASCKDGKSFSYNSSINIAVAVAINGGLITPVLQDADKLDLYLLSQKWKELVGKARSKQLQPHEYNSGTFTLSNLGMFGVDRFDAILPPGQGAIMAVGASKPTVVADKDGFFSVKNTMLVNVTADHRIVYGADLAAFLQTFAKIIENPDSLTL

SEQ ID NO: 37329 - protein, 463 aa, Mycobacterium bovis AF2122/97
MSPQQEPTAQPPRRHRVVIIGSGFGGLNAAKKLKRADVDIKLIARTTHHLFQPLLYQVATGIISEGEIAPPTRVVLRKQRNVQVLLGNVTHIDLAGQCVVSELLGHTYQTPYDSLIVAAGAGQSYFGNDHFAEFAPGMKSIDDALELRGRILSAFEQAERSSDPERRAKLLTFTVVGAGPTGVEMAGQIAELAEHTLKGAFRHIDSTKARVILLDAAPAVLPPMGAKLGQRAAARLQKLGVEIQLGAMVTDVDRNGITVKDSDGTVRRIESACKVWSAGVSASWLGRDLAEQSRVELDRAGRVQVLPDLSIPGYPNVFVVGDMAAVEGVPGVAQGAIQGAKYVASTIKAELAGANPAEREPFQYFDKGSMATVSRFSAVAKIGPVEFSGFIAWLIWLVLHLAYLIGFKTKITTLLSWTVTFLSTRRGQLTITDQQAFARTRLEQLAELAAEAQGSAASAKVAS

SEQ ID NO: 37330 - protein, 393 aa, Gibberella zeae PH-1
MSQNTFNVAVVGLGALGSGAAYHAAIKGASVIGFEQYEFGNVYGSSHDTSRIVRTSYGSPDYVALARAAYKDWAELERRSGLQMLTITGGVAFFPKTTTPESEMNDFEKTMTVGDFARSLDVSGIPYELLGPEEVMKRWPAFNVPEGVQTIYTADSGIVHASKSVAAMQYQARANGAVLKEKTRVDAVIPNKNGKGVTLETSKGHFHADKVILACDAWINKLLAPLGAEIPLTVMQEQVTYYKPADLEPFDETKFPVWIWAGDRYYYGFPMYGEPAIKAGRDTSNNFMTPENRTFVPSEDLFNELTSFMGNLIPERGEPLRTVTCQYAITPDRQFIISPLKNHPDIIIGLGGGHAFKFSPAIGRVLAELAIDGSTKEDISNFGIPRSAADSKL

SEQ ID NO: 37331 - protein, 480 aa, Thermococcus kodakarensis KOD1
MRIEDVYIWDINAKWLGISPVQLMENAGAGVARTIEERFGKGLKVAVFSGTGNNGGDGFVATRHLSFENDVTLFLVGDEAKIRSEEAKHNWEILKKLDFVKIRILKDSSYIKSLDLSEFDVIVDALLGAGTKGEPREPIRSAIEKINEYSGKAKIVSVDLPSGYPSDIRVKCDFAVTFQWDKEEYGGFERVIVKIGYPKELYHLVGPGDAKFALRKKGEHKGQNGKLLVIGGSEDYFGAPYLAAKAASYLVDLVYLAMPEYSARRINDPNVILRPFERRNFRKEDVEDVLAIADGVDAVVIGPGIGQRAETKEFVVEFLRWCEKPVVIDADALKAVAEDLDVLKGKNFVLTPHAGEFRILFGEKPEGSLEEKAKLVVEKAKGVGGTVLLKGAYDIISDGKGWKYNKTGNRGMTTGGTGDVLAGLVGALLALGNSPLRAASAGAFLNGLAGDMVKEEMGENFTALDVAEKVPQAVKWVLEF

SEQ ID NO: 37332 - protein, 500 aa, Ophiopogon japonicus
MAFPIPARQLFIDGEWREPLLKNRIPIINPSTEEIIGDIPAATAEDVEVAVVAARKAFKRNKGRDWAATSGAHRAKYLRAIAAKITEKKDHFVKLETLDSGKPRDEAVLDIDDVATCFEYFAGQAEALDAKQKAPVTLPMERFKSHVLRQPIGVVGLISPWNYPLLMATWKIAPALAAGCTAVLKPSELASVTCLEFGEVCNEVGLPPGVLNILTGLGPDAGAPIVSHPDIDKVAFTGSSATGSKIMASAAQLVKPVTLELGGKSPVIMSEDIDIETAVEWTLFGVFWTNGQICSATSRLLVHESIAAEFVDRMVKWTKNIKISDPFEEGCRLGPVISKGQYDKIMKFISTAKSEGATILCGGSRPEHLKKGYYIEPTIITDITTSMQIWKEEVFGPVICVKTFKTEDEAIELANDTEYGLAGAVFSKDLERCERVTKALEVGAVWVNCSQPCFVHAPWGGVKRSGFGRELGEWGIENYLNIKQVTSDISDEPWGWYKSP

SEQ ID NO: 37333 - protein, 500 aa, Oryza sativa (japonica cultivar-group)
MELLLLYAPCVILLVSSLYLLRLFSDARRNLPPGPRPLPLVGNLLELGAKPHRSLARLAERHGPLMTLRLGAVTTIVASSPDAARDILQRHDAAFSTRPVPDIVRACGHDRFAMPWLPPSSPQWRALRKVCSAELFAPRRLDAQQRLRREKARRLVSHVARMAREGAAVDVRRVVFTTLLNMLSCTLFSADLADLDEGRAGSAGELADTVAEFAGTVGVPNVVDYFPAVAAFDPQRLRRWLSRVFTRLFAEFDEQIERRMRERDAGEPPKNDFLDVLLDYRTTEDGRQFDRQTLRSRFTDLFSAGSDTSAVTVEWAMAQLLQSPSSMMKAREELTRVIGSKPEIDESDIDSLEYLQAVVKETFRLHPPAPLLLSHRAETDTEIGGYTVPKGATVMVNIWAIGRDSKVWFEPDKFIPERFLQKEVDFRGRDFELIPFGSGRRICPGLPLAVRMVHLMLASLLHRFEWRLLPEVERNGVNMEEKFGIVMTLATPLQAIATPI

SEQ ID NO: 37334 - protein, 427 aa, Salmonella enterica subsp. enterica serovar Paratyphi A str.
MNTNNALMQRRHNAVPRGVGQIHPIFAERAENCRVWDVEGREYLDFAGGIAVLNTGHLHPGIVSAVEAQLKKLTHTCFQVLAYEPYLALCERMNQKVPGDFAKKTLLVTTGSEAVENAVKIARAATKRSGAIAFSGAYHGRTHYTLSLTGKVHPYSAGMGLMPGHVYRALYPCPLHNISDDDAIASIERIFKNDAAPEDIAAIIIEPVQGEGGFYAASPAFMQRLRALCDQHGIMLIADEVQSGAGRTGTLFAMEQMGVAADITTFAKSIAGGFPLAGVTGRADVMDAIAPGGLGGTYAGNPIACAAALAVLDIFEQENLLQKANTLGNTLRDGLMEIAETHREIGDVRGLGAMIAIELFENGDPGKPNATLTADIVARAREKGLILLSCGPYYNILRILVPLTIEASQIQQGLKIIAQCFDEAKQA

SEQ ID NO: 37335 - protein, 2095 aa, Arabidopsis thaliana
  misc_feature (1099)..(1099): Xaa can be any naturally occurring amino acid
MFAVENGLQGDPRLKAISDAIRVIPHFPKTGIMFQDITTLLLDPVAFKHVVDIFVDRYKHMNISLVAGVEARGFIFGPPIALAIGAKFVPLRKPGKLPGRVISEEYELEYGRDCLEMSVEAVKSEERALIIDDLVATGGTLSASINLLERAGAEVVECACVVGLPKFKGQCKLKGKPLYVLVEPNQAMSAVYCGTKRSYFDDNSSPPSSKRFRCFSPSNSPIWSSPPSSSLDQLHSAFPHIELTAFVDLKLRICLRYLSSSSSSPPVLVKALEDNGSDFNAAMKSLYSFASSEEKKAEELAAGGAATQETDAVCGGNPPTSGDDWVELLVREVLQSSGTDDAKVRAARVLEALEKMLSARAREEAGNKFQEEKVAVQQQVETLVKDNTVLKRAVAIQHERQKALEDANHQLGLLKQLVPQYQEKLRNLEVNNYALRMQLQQVEHGNSMPARFNPDPKTLLESSSSSLNNARCQASPRPLGSLRSSFDSILSLMAALASPSLIPSSLCFAAAADGPRSLSSNFSAFSDGGSNFRYHKSFLSLSSSSSSSTPYRNRRGRSLVVFATSGDYYATLGVSKSANNKEIKAAYRRLARQYHPDVNKEPGATEKFKEISAAYEVLSDEQKRALYDQYGEAGVKSTVGGASGPYTLSLTFTSSYISNQSNPFDLFETFFGASMGGFPGMDQADFGRTRRSRVTKGEDLRYDITLELSEAIFGSEKEFDLTHLETCEACAGTGAKAGSKMRICSTCGGRGQVMRTEQTPFGMFSQVSICPNCGGDGEVISENCRKCSGEGRVRIKKSIKVKIPPGVSAGSILRVAGEGDSGPRGGPPGDLYVYLDVEDVRGIERDGINLLSTLSISYLDAILGAVVKVKTVEGDTELQIPPGTQPGDVLVLAKKGVPKLNRPSIRGDHLFTVKVSVPNQISAGERELLEELASLKDTSSNRSRTRAKPQQPSTLSTAPSGSENKKDEVKEENEEPEQENYLWNNIKEFAGSPEFSSPIRQLSPPGSYGHGLFFPAKDMDTNSLMLIDNNGSFEIDDQSHVHVDASHTLEPVTLPTKRRRKKSDVWNHFTVETVSPGSAKACCNHCRKSFAYINGQKLXAGTSHLKRHIQLGICPMNRDDSSTLAQIVTPTTTTDPPKKRHRSSASYTPLDQDRCYNQMAKMIIMHDYPLHMVEHSGFTGFVQALCPQFTMASFNTIHADCVNMYLSEKHKLSNFITDIPGRVNLTVDLWTSNQSLGYAFVTGHFIDRDWKLTHRLLNVAVVPSPDSDFALNQPIAACLSDWNLERRLSSITVGQSVVNKTSIENLRCCLSARNQNVLNGQLLLGNCYARLLSSMAQDLLGAEDFKTPIKKVRDSVKYVKTKDSCQERFDELKKQLQTPSTKDLLIDNQTKWDTSYDMLLAACEHKEVFSCLGNCDLDYKILTSPEEWRKIEILCSSLKILFDAANVLTGSTRLTANDLFHEMTKLQLDLGNSATSEDQDVSNLANTLKDKFDEYWRECFLLMAVAVVMDPRFKMKLIEFSFSKAYGEDADKWIRSVDDAVHELYHDYAEQSHSLLDAYVVHGNDGFSETDMSQVHFHHEYHNSNGLSHDQIFEQPEDGNPLNEKPLEGLSGEGQPTGTESVGGNTTQGVEQEGHLGDAGTQENNIVEGQLEESKPMDGLTQKPLLTEENLQSNGEPTTAQESRLTDETMEETHANQSAEEMAHETQLVEEFPCESQPSENVPLQSQSGEGNVPETLPMEEIVEDTQPVEEVMQEETSQVSRPVEEIPLENQQVDDKDITHDVQPVEEMLEDTQPVEGVDHEAQELEVHDDIQSVEEVGHEIQPEGELLEDTQPVEEGAQEAQLVEENHDDVQLVEEAGHETHAVEGILEDTQPVEEVAQEARPVEQIPENSQNPQEYSREGESVQEEQQSEQHPQSHAMPHEEEAQHDSQSHAMPQEEATFTISQEGHHVDVLLQEGHHLEASSQEFPLITIGDGFSDFELYISEVGSHQQMKSELDQYLEESLIPRSQDFEVLGWWSLNRTKYPTLSKMAADVLSVPFCTVSPDSVFDTEVKKMDNYRSSLRHVTLEALFCAKDWFKHSSSNSTSENNLKMES

SEQ ID NO: 37336 - protein, 743 aa, Oryza sativa (japonica cultivar-group)
MAAHSVAAAHATIAARAGAAAPAPAPPERLGFRLSALAGRGLRSPLPPRRGAPSASASRRRHNNRVRAAAVETLEGQAATGALLEKSVNTIRFLAIDAVEKANSGHPGLPMGCAPMGHILYDEVMRYNPKNPYWFNRDRFILSAGHGCMLQYALLHLAGYDAVLEEDLKQFRQWGSKTPGHPENFETPGVEVTTGPLGQGIANAVGLALAEKHLAARFNKPDSEIVDHYTYCILGDGCQMEGISNEACSLAGHWGLGKLIAFYDDNHISIDGDTEIAFTEDVSARFEALGWHTIWVKNGNDGYDEIRAAIKEAKAVTDKPTLIKVTTTIGFGSPNKANSYSVHGSALGTKEVEATRENLGWPYEPFFVPEDVKSHWSRHVPQGAAFEADWNAKFAEYEKKYPEDAATLKSIVSGELPAGWADALPKYTPESPADATRNLSQQCLNALAKVVPGLLGGSADLASSNMTLLKMFGDFQKDTPEERNVRFGVREHGMGAICNGIALHSPGLIPYCATFFVFTDYMRAAMRISALCEAGVIYVMTHDSIGLGEDGPTHQPIEHLVSFRAMPNILMLRPADGNETAGAYKIAVLNRKRPSVLALSRQKLAQLPGTSIEGVEKGGYIVSDNSTGNKPDFIVMSTGSELEIVAKAADELRKEGKTVRVVSFVCWELFDEQSAEYKESVLPEAVTARVSLEAGSTLGWQKYVGSKGKAIGIDKFGASAPAGKIYQEYGITAENVIATAKSL

SEQ ID NO: 37337 - protein, 423 aa, Oryza sativa (japonica cultivar-group)
MASRRQWGAGAGAVDVPAQERKGEAAKIARRPKTTTVVAQQPPRIRRALADVSNLVNGRAALPVVNRQKAAAAAADKCRKPIKQRNENNKAAKPEVIVISSDSEKHKKNPAQRAASRRAPIQTLTSILTKCSRASDGVISPKKELIYDIDASDSHNELAVVDYVEDIYRFYRNTENTYRPLCTYMVSQTEINERMRAILTDWLIEVHYRLMLMPETLYLTVYIIDQYLSLENVPRKELQLVGVSAMLIACKYEETWAPLVKDFLVISDNSFSRQQVLSTEKSILNKLQWNLTVPTMYMFILRYLKAALGDEELEHMTFFYAELALVQYSMLFFAPSVIAAAAVYAARCTLGLSPLWSDLLEYHTGLAEPQLLECARRLVSLHAAAPESRQKVVYKKYASPKLGAVSLHSPAKKLLPPPSPVAA

SEQ ID NO: 37338 - protein, 434 aa, Oryza sativa (japonica cultivar-group)
MEYGAATRGALLAATLLAGARRSRLPLSPPPSPPSIQIQNRLYSMSSLPLKARGVRRCEASLASDYTKASEVADFDWENLGFGIGADRLHIQNRLYSMSSLPLKARGVRRCEASLASDYTKASEVADFDWENLGFGIVQTDYMYITKCGQDGNFSEGEMIPFGPIALNPSSGENALRMRTGAERMCMPAPSVEQFVDAVKQTVLANKRWVPPTGKGSLYIRPLLMGSGAVLGLAPAPEYTFIIFVSPVGNYFKEGLAPINLIVEDKFHRATPGGTGSVKTIGNYASVLMAQKIAKEKGYSDVLYLDAVHKKYLEEVSSCNIFVVKGNVISTPAVKGTILPGITRKSIIDVALSKGFQVEERLVSVDELLEADEVFCTGTAVVVSPVGSITYQGKRVEYAGNKGVGVVSQQLYTSLTSLQMGQAEDWLGWTVQLS

SEQ ID NO: 37339 - protein, 474 aa, Clostridium acetobutylicum ATCC 824
MNNFGEDFIFGGATAAYQAEGATKEDGKGPCIWDEYLKKEGRFTGDTASDFYHKYKEDLKFSRKFGVNGIRISIAWSRVIPDGKGEVNPKGLKFYSDLIDECIKNNVEPFVTLHHFDTPLTLFKDGDWLNRNNIDYFVRFAKVCFEALGDRVKKWITFNEAWAVAQNGYIIGNFPPSIKYDIPKAAQSMHNMMVAHAKVVELYKSMNLDGEIGIVHTLEGKYPITDSKEDKEAAYLDYMISNKFMLDACFKGEYPKETEKTINEIMSKNGGELKIYDGDLEVLKKASSKIDFLGMNYYSSHFLKAYEGESRIHHNGTGEKGTSIFALKGIGERVNNPEVPTTDWDWPIYPKGLHDMLVRIKNEYPNYKKIYVTENGMGYKDDFKDGKIDDTPRIDYINKHLEAILKAKNEGVVVKGYFVWSLMDVLSWSNGYNKRYGLFYVDFKTQNRYAKKSAYWFKRISYEKKLIDFSDIEY

SEQ ID NO: 37340 - protein, 221 aa, Oryza sativa (japonica cultivar-group)
MMMETELCSSRVLSPPRYESGDEELSVLPRHTKVIVTGNNRTKSVLVGLQGVVKKAVGLGGWHWLVLKNGVEVKLQRNALSVLEPPTGNEDDDDIDGNNSFCSSSDMGDKDMDYSSIEYHKPTKPRVRHTRPWSSCIKSSNRGNFHPSTKLRTRVNLTKLGTPTLWRYWKHFNLVSMNPNPSKEQLFHGVQQHFQSQQLDELQVILGFIQAAKRLKTLYRS

SEQ ID NO: 37341 - protein, 234 aa, Brassica napus
  misc_feature (220)..(220): Xaa can be any naturally occurring amino acid
MVSYPATTETISLAQEANSSEAIQILYQVLEDPSSSPEALRIKEQAITNLCDRLTEEKRGEDLRTLLTKLRPFFSLIPKAKTAKIVRGIIDAVAKIPGTTDLQITLCKEMVEWTRAEKRTFLRQRVEARLAALLMENKEYVEALALLSTLVKEVRRLDDKLLLVDIDLLESKLHFSLRNLPKAKAALTAARTAANAIYVPPAQQGTIDLQSGILHAEEKXDYKTGYSYFFEAFE

SEQ ID NO: 37342 - protein, 484 aa, Burkholderia thailandensis E264
MTPPPLRDHPAYRRETLRWCGQRAARARTLDVFDPYSGRRVGTVPLATVDDVRRAFDYAGAYRPTLSRYERSQILERAAARLVACAEEASTLISLESGLSKQDSRYEIGRVADVFKFASIEALRDDAQSYSCDLTPHGTSRRVFSQRQPLDGVIVAITPFNHPMNQVAHKIAPAIATNNRVIVKPSEKVPLSALYLADVLYEAGLPEPMLQVLTGDPREIADELLTHPSAALITFTGGVAIGKSIAAKAGYRRIVLELGGNDPLIVLDDADLERAATLAAQGSYKNSGQRCTAVKRILVQKRVAPRFTELLVEHTRAWTYGDPFDPTNRMGTVIDEAAAALFEARVDEAVARGARLLTGNARRGALYAPTVLDRVDASMTLVREETFGPVSPIIAFDTIDDAIRISNGTAFGLSSGVCTDRADAIVRFVNELNVGTVNVWEVPGYRLELTPFGGIKDSGLGYKEGVQEAMKSFTNLKTFSLPWA

SEQ ID NO: 37343 - protein, 540 aa, Acidovorax sp. JS42
MPNLSSSTTTVGPRPGVRPSGLLRAVRITTVFAGFLLWVVWHRGLMRCDTHSVADRFAQTLQRLGTTFVKLGQHLSLRSDLLTDEAQRALARLQTHVAPFPAEQAVHEIEAALGGRISDHFARFDMTPLAAASVAQIHLAALSDGREVVVKVRRPGAAEQAETDMRILRNVARMLEILVPSLRRWSLVAVVDEIAGNFRLEMNLEREARSVRRFSDAWRGSADIEIPDVIDGLCAPTVMVQVFSTGTPPENLPTEARESTARRLVDSYVTQIFRDGLFHGDPHPGNIFMMSDGRVCLHDFGIVGRVDRRMRRALAAFALAFVEQDTDWVVDAWLDLGLVVERADRALFLPIVQQLLADCAERPLSEWSLSEAMSQLVAAGRSSNVRLPRDLLVLTRTMLLLEGTVRGLSPQFSIFDSISRQAASGVLDQKPDAPTSKRLTYELGNAASDLPALLARRLHGALGSGRLFELRIVPDARLESGIERASRRVAVALVTLGLYIASSLLMQHGVGPRWGDMPVLALAGYALAIRYTFSLARGRH

SEQ ID NO: 37344 - protein, 127 aa, Arabidopsis thaliana
MASPTSSTRPNQENQEPQFQDFFPTMAGKLGGEGLIEEICKGFELLMDKDKGVITFESLRRNASTVLGLGDLTDDDVRYMINEGDFDRDGALNQMEFCVLMFRLSPELMEASRCVVTEVIEEEFYRH

SEQ ID NO: 37345 - protein, 377 aa, Picea rubens
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDALMKILTERGYSFTTTAEREIVRDVKEKLAYVALDYEQELETAKSSSSIDKSYELPDGQVITIGAERFRCPEVLFQPSLIGMEAAGIHETTYNSIMKCDVDIRKDLYGNIVLSGGSTMFPGIADRMSKEITALAPSSMKIKVVAPPERKYSVWIGGSILASLSTFQQMWIAKAEYDESGPSIVHRKCF

SEQ ID NO: 37346 - protein, 367 aa, Malus x domestica
MGKGGQSCNGVVRDAKPVEQENMAVWLVDVNTIKILPFKLPAIGPNDVRIRIKAVVICGSDVHYLKTMKCADFEVKEPMVIGHECAGIVDTVGSEVKHLVPGDRVGEPGISCARCQQCKGGRYNLCPDMKFFATPPVHGSLANQIVHPADLCFKLPENVSLEEGAMCEPLSVGVHACRRANVGPETSVLIIGAGPIGLVSVLAARAFGAPRIVIVDMDDKRLAMAKSLGADEAVKVSTKMEDLDDRVAEIKKAMISEVDVTFDCVGFNKTMSTGLNATRPGGKVCLVGMGHGVMTVPLTPAAAREVDVVGVFRYQNTWPLCLEFLRSGKIDVKPLITHRFGFTEKEVEEAFATSARGGNAIKVMFKL

SEQ ID NO: 37347 - protein, 272 aa, Arabidopsis thaliana
MAPTRILTRDEELGVISDDDDSPSGKRSKLDRFPLSRWELAVSLGVFLVFSSGLCCIYMTMPAAEFGKLKLPRSLADLRLLKDNLANYANEYPAQFVLGYCATYIFMQTFMIPGTIFMSLLAGALFGVFKGVVLVVFNATAGATSCFFLSKLIGRPLITWLWPDKLRFFQAEISKRRDKLLNYMLFLRITPTLPNLFINLASPIVDVPFHVFFLATLIGLIPAAYITVRAGLAIGDLKSVKDLYDFKTLSVLFLIGFISILPTILKRKKIVE

SEQ ID NO: 37348 - protein, 175 aa, Triticum aestivum
  misc_feature (12)..(12): Xaa can be any naturally occurring amino acid
  misc_feature (63)..(63): Xaa can be any naturally occurring amino acid
FEKKGILQRNGXRFPHVLEQILSCAQGEKLLPQIGVTDGAAAGNNRTIAVLGTSLSSWYSDQXQKKKNRKHNMKALAEIYLLSMSDVLITSGFSTFGYVAQGLAGLTPWIMYRPENHVVPEPPCGRAMSIEPCFHQAPYFDCRAKRDADLGKVVPYVRHCEDVSWGLKIVNETRL

SEQ ID NO: 37349 - protein, 278 aa, Brassica napus
MAETLKEDSITIREVWNDNLLEEFALIREIVDKFTYVAMDTEFPGVVLKPVETFKHNNDLNYRTLKENVDLLKLIQVGLTFSDEDGNLPTCGADDKFCVWQFNFREFNIGEDIYASESIELLRQCGIDFKKNLERGIDVARFGELMMSSGIVLNDSISWVTFHGGYDFGYLVKLLTCKELPIKQADFFKLLYVYFPTVYDIKHLMTFCNGLFGGLNRLAELMGVERVGVCHQAGSDSLLTLGSFRKLKERYFPGSTERYTGVLYGLGVEDGGGTNVAN

SEQ ID NO: 37350 - protein, 512 aa, Ulva fasciata
MRSIMITTSAIKFAGARGSRAQGTHGLRCSRAIQARAYESTTEYDYDMFTLGGGSGGVRASRMSSGFGAKVACAELPFGYISSESAGGLGGTCVLRGCVPKKLVMYCSEYAEHVKDAEGFGWEIGESKLHWDKFMEKKRKELQRLNGVYGNIMGNAGVEIIEGRATIKDKHTVVVNGKEYTSKYICIAVGGTPHMLGVPGVEHCINSDGILELDSVPKRLAIIGAGYIGVEFGGMFNNLGSDVQFFIRSDKVLKGFDEEVRDHIMTEYDRRGIKINTGCSPKQVKKNDDGTLDMTYSSPDGDVTGTFDQILMATGRTPNTANLGLEAAGVETNKQGFVVVDEFSKTSVDNIFAVGDITDRMALTPVALMEGMCLAKTLFNDQPIAPDHKNIPTAVFSQPHIGTIGYGEEEAVEKFGDVDVYSSSYRPMRNTISGNESRGFMKILVDASTDKVVGIHIVGPEAGEMMQGFGVAVKMGATKADLDSCVGIHPTAAEELVTMRTTSRQWRGKKQI

SEQ ID NO: 37351 - protein, 434 aa, Pseudoalteromonas tunicata D2
MSNKRPTIVIVGGGAGGLALATQLGHKLGKKQLADIILIDKNRSHIWKPLLHEVATGSLDADLDGVVYSAHAAKHHYRFVLGTLFSLNNTAKTVSLAALYDDDNHLILPERTLSYDKLVLAVGSVSNDFNTPGVKQHCYFLDSNQQAERFQHALLDNFTRIHHTEEANKALKIAIVGAGATGVELSAELYHVTELLKVYGLTNMTANKLHISLIEAGPRILPALSERIANSARRELNKIGVHVLENTQVKAASETGFVTQHPEPIEADIMVWAAGVKAPDFIKDLNVFELTRNNQIKVNPFLQSTVDQTIYVIGDCCAFIQADGSQVPPRAQSAHQMAQCVKLNLIAEFEQYPLTEFNYQDHGSLVNLSRFSTVGSLMGNLTKNSFFIEGKIARMMYISLYRMHQRAIHGVWRTMALWLSEKMLRIVRPKMKLH

SEQ ID NO: 37352 - protein, 335 aa, Ehrlichia ruminantium str. Welgevonden
MKIGINGLGRIGRCLIRCIYENNSIYKDSLELSALNGSTSPEIHAHLIQYDSVHGKFPHDVTYGKDYIAINNKEIPLSIEKEPNNIPWEKHNVDIVLECTGKFNKKPLAKGHINSKVKKVVVSAPMEDPDVTIVYGVNNEILKKEHQVISAGSCTTNCIAPILKIMNDTIGIKNGFITTIHSYTNDQNLVDNNHKDLRRARASAMSMIPTTTGATKTINSIIPELKGKLNGTAIRVPTPNVSMIDLVFNSIKSTNSTEINNIIKELSQNSQVINITDKKLVSIDFCHSIYSAIVDAEETYVTDNNLCRIAAWYDNEWAFAMRMLDIVCLLSQHIN

SEQ ID NO: 37353 - protein, 474 aa, Oryza sativa
  misc_feature (319)..(319): Xaa can be any naturally occurring amino acid
MTSLPGRGVSPSSSDPLCEGNAAPSSSSSSGQDLKQLKNSILSCVFSSPFSIFEAHQDSSANRSLKPHSGSYAWSRFLRRIACTGSMWRFLGASKALTSSDVWFLGKCYKLSSEELSNSSDCESGNAAFLEDFSSRIWITYRKGFDAISDSKYTSDVNWGCMVRSSQMLVAQALIFHHLGRSWRKPSQKPGSPEYIGILHMFGDSEACAFSIHNLLQAGKSYGLAAGSWVGPYAMCRAWQTLVCTNREHHEAVDGNGNFPMALYVVSGDEDGERGGAPVVCIDVSAQLCCDFNKNQSTWSPILLLGPLVLGLDKLYPRXSPSLKETFTFPQSLGILGGKPGTSTYVAGVQDDRAPYLDPHEVQLAVDIAADNLEAGTSSYHCSTVRDLALDLIDPSLAIGFYCRDKDDFDDFCSRASELVDKANGAPLFTVVQSVQPSKQMYNEESSSGDGMDSINVEGLDGSGETGEEEWQIL

SEQ ID NO: 37354 - protein, 902 aa, Burkholderia thailandensis E264
MRARGTVQRRAQGARGGAARARARRERLHALTNGFTNQQRASIMKIVVIGHGMVGHKLLECIAAGAQGALVAPQVAVICEEPRPAYDRVHLSEFFAGKSADDLSLVEPGFFERHPNFRLLLNTKAVAIDRGARTVALSTGETLAYDKLVLATGSTPFVPSVPGRERAGCFVYRTIEDLEAMQACGARAKSGVVVGGGLLGLECAKALRDMGLAAHVVEFAPRLMAVQVDEGGGRMLREKIEALGVQVHTGKNTLEIVDGETGAHRMAFADGTHLDTDMIVFSAGIRPRDEVARACGLEIGPRGGVAIDSHCRTSDADIYAIGECAAWNGQTFGLVAPGYDMARVVAQRLAGGDGAFTGADLSTKLKLMGVDVASIGDAHGKTPGCRTYQFADERRGVYKKLVVSGCGKELLGAVMVGDAADYGTLLQMMLNRIELPAAPEFLILPPADGAAKPALGVDALPDAAQICSCNNVTKAQLCEAVAGGATSIGALKGCTGAGTSCGGCVPLVTQVMKAEMKKQGLAVNNHLCEHFPYSRQELYHLVRVERIKTFGALLGKHGRGLGCDVCKPAVAGILASCWNEFVLKKEHAALQDSNDYYLANIQRDGTYSVVPRMPGGEVTPEGLIAVGQVARKYGLYTKITGGQRVDLFGARVEQLPLIWEALIAAGFESGHAYGKSVRTVKSCVGSTWCRYGVGDSVGLAIELENRYKGLRAPHKLKFGVSGCTRECAEAQGKDIGVIATEKGWNLYVCGNGGMKPRHAELLAADLDRATLIRYVDRFLMFYIRTADRLQRTSVWRDNLEGGLDYLIDVVVHDRLGLAAELEVEMQHVVDTYECEWKRAVTDSATRRRFRHFVNSDAPDSTIAFVEARGQIRPATPDERDAAGPHGVRAVREDEAQTETETA

SEQ ID NO: 37355 - protein, 83 aa, Glycine max
  misc_feature (6)..(6): Xaa can be any naturally occurring amino acid
  misc_feature (15)..(15): Xaa can be any naturally occurring amino acid
  misc_feature (17)..(17): Xaa can be any naturally occurring amino acid
  misc_feature (34)..(34): Xaa can be any naturally occurring amino acid
  misc_feature (44)..(44): Xaa can be any naturally occurring amino acid
  misc_feature (55)..(55): Xaa can be any naturally occurring amino acid
AIGMRXQAYLYDGYXVXIGTIEAFYNANLGITFXPVPDFFWGDXSFFFYTQPLYXPTSKRRDADVTDSVIGEGCVIKNCKIHQ

SEQ ID NO: 37356 - protein, 246 aa, Leptospira interrogans serovar Copenhageni str. Fiocruz L1-130
MKEFITKHRDKFQKISAISGAGISAESGIPTFRGSEGLWKNFRAEDLATPQAFSKNPKLVWEWYLWRRNIIETKRPNPGHFALVELERIHPDFFLITQNVDGLHSQAGSKKLTEIHGNIFINRCISCGQESKETISENTTPLPPQCQNCNSFLRPGVVWFGESYDDFKLNFSIQRMKHTDLLLVLGTSGSVSMPVYLAQIAKDSGALLVEINPERSSFSSSVDLFLQGKTGEVLPELIREILDNPS

SEQ ID NO: 37357 - protein, 461 aa, Oryza sativa (indica cultivar-group)
MPEQSIPKEAAYQIINDELMLDGNPRLNLASFVTTWMEPECDKLIQASVNKNYVDMDEYPVTTELQNRCVNMIAHLFNAPLGDSETAVGVGTVGSSEAIMLAGLAFKRRWQNKMKAAGKPCDKPNIVTGANVQVCWEKFARYFEVELKEVKLSDGYYVMDPAKAVDMVDENTICVAAILGSTLNGEFEDVKLLNDLLTKKNAETGWDTPIHVDAASGGFIAPFLYPELEWDFRLPLVKSINVSGHKYGLVYAGIGWCIWRSKEDLPEELIFHINYLGADQPTFTLNFSKGSSQVIAQYYQLIRLGFEGYKNIMENCQENAMVLKQGLEKTGRFNIVSKDNGVPLVAFSLKDSARHNEFEISDFLRRFGWIVPAYTMPPDAQHVTVLRVVIREDFSRTLAERLVLDVEKVLHELDALPARVVANGGDAAAASASEREMEKQREVISLWKRAVLAKKKTNGVC

SEQ ID NO: 37358 - protein, 335 aa, Xanthomonas campestris pv. campestris str. ATCC 33913
MTAPSKPVLVADIGGTNARFALADIDASVPLLDDTCREFAVVEFGSLGEAARYYLDQIGVQATKGVFAVAGRVDGDEARITNHPWVISRSRTATMLGFSTLHLINDFAAQAMAISLLRPQDVVQVGGASWRPAPIELPRNYGVIGPGTGLGVGGLIIRNGRCFPLETEGGHVSFPPGTPEEIRVLEILSEQFGRVSNERLICGPGLVNIHRALSEIAGIDPGPLEPKDITARAAAGDPRASRTIDLFCAIFGAIAGDMVLMQGAWDGVFLTGGLVPKVLDSLQHSGFRQRFEHKGRFSAIMSRVPSLAVMHPHAGLLGAAAYAVDAERALPGEQR

SEQ ID NO: 37359 - protein, 546 aa, Aspergillus oryzae
MDLMLALITLSLVEGFLLQRTVFVDLTFRTVTLSSVGVNLVLLTIWNTLIYPYFVTPLRHLPTISGNLNNARIVFDDPRGRLPLEWMKTVPNEGLIHFRDIVNRSYLLATNHQALLDIMSTNTYDFEKPWRARDFLARIIGFGLILSEGSAHKKQRRALTPSFNVKNIRALYSLMWEKTGLLMDELEKQIKQNPMDGTNAQSGEGKIEMSVWASRLTLDIIGPAAMGRDFRSLHNPENKVADSFLAILEPTKEKMAFLAVNFALPQWFARRIPWRLNKVINDETGFLRDLCRDIVHEKRASITATKATAKELEADILGTMMLGGDFTDDELIDQMLTFLAAGHETTASAFTWACYLLTLYPDVQERLRTEIRERIPSGNHPITWSDLETLPLLNGVCQEVLRLYPTVPMTIREAVRDSVVAGKHIPKGTRILLCPYAINRSPEFWGNDGEEFRPERWIDTDKNGQLVTNNTGGASTNFAQITFLHGQRSCIGKDFARAELRCAVAGVVGRFRFEMQNPKQKIHIAGAVTTKPVEGMHLRMSRVDDW

SEQ ID NO: 37360 - protein, 265 aa, Bacillus licheniformis ATCC 14580
MLKRRILLLFSMIGVIVLLAGCTEINQPITAESEGFWNTYIVYPLSQLITYVANLTNENFGLAIIIVTILIRLLILPLMIKQTKSSKAMQALQPEMQKLREKYSSKDQKTQQKLQQETMALMQKHGVNPLAGCFPILIQMPILIGFYHAIMRTREIAEHSFLWFDLGERDPYFILPILAGVFTFIQQKLMMAGTAQQNPQMAMMLWLMPIMIVVFAISFPAALSLYWVVGNLFMIAQTFFIKGPDLKAERQEAAAGGKKSGGKKK

SEQ ID NO: 37361 - protein, 445 aa, Blastopirellula marina DSM 3645
MTTQLLQARAGNITPEMEFVAKRENISAELVRDEVATGRLVIPANKVHLAGRLEPMGIGLATTCKINANIGNSAVTSDSESELTKLHTAVHFGADTVMDLSTGKDIDSIRKKIIDSSPVPIGTVPIYQMLEELGGTIEDMRPQHFLDMVEHQAKQGVDYMTVHCGIKLEHLHLSTHRVTGIVSRGGSLIAKWMMAHRKQNPLLTHFDDLCAIMREYDVTWSLGDGMRPGSIADASDEAQFAELDVLGECTMRGRELGTQVMVEGPGHIPLDQIQMNMERQQEICDGAPFYVLGPLVTDIAPGYDHITSAIGAAMAGWHGAAMLCYVTPKEHLGLPENEDVKQGVIAYKISAHAADVARKRPGAQDRDDALSRARFGFDWNEQFRLSLDPETAKAYHDQTLPQDTFKSAHFCSMCGPKYCSMKITEEIRVMAAEQGGLIQLAETPE

SEQ ID NO: 37362 - protein, 459 aa, Bacillus cereus G9241
MSKLVVIGGGPAGYVAAITAAQNGKDVTLIDEADLGGTCLNVGCMPTKSLLESAEVHDIVRKANHYGITLNNGSISIDWKQIQARKSQIVTQLVQGIQYLMKKNKIQVIQGKAKFETDHRVRVTNGNKEDIVDGDQFIIAAGSEPTALPFAPFDGKWILNSSHAMSLENIPKSLLIVGGGVIGCEFASIYSRLGTKVTIVEMAPQLLPGEDEDIAHILRGKLENDGVEIFTGAALKGLNNYKKQASFEYEGSIQEVNPEFVLVSVGRKPRVQQLDLEKAGIQYSNKGISVNEHMQTNVSHIYAAGDVIGGIQLAHVAFHEGTTAALHASGEDVKVNYHAVPRCIYTAPEIASVGLTEKDAREQYGDIQIGEFPFTANGKALIIGEQTGKVKVIVEPKYQEIVGISIIGPHATELIGQGTVMIHTEVTADIMRDYIAAHPTLSEAIHEALLQAVGHAVHA

SEQ ID NO: 37363 - protein, 399 aa, Bacillus cereus G9241
MAVEVVMPKLGMAMKEGIITSWNIKAGDHVSKGELIASINSEKIETEIEAPADGTVLDIAVSEDEGVPPGTVICYIGKSNEKVEVYESTNVVEEKTSNPEPKKVPHPDPYVIDLTKQRVKISPVAKKIAKTENLDIKSLLGTGPGGRITKVDVLKALEERVAVPEVLEQEESKVIPVTGMRKAIANRMHASLQNSAQLTLTMKVDVTDLVALHKEIADVVQKRYDNKLTITDFVSRAVVLALGEQKEMNSAYINDTIHQFEHVHLGMAVALEKGLVVPAIRFANNLSLVELSKQIKNVAQKAREGSLSSDDMQGTTFTISNLGSFGIEYFTPVLNTPETGILGVGAIEHVPVYKGKKIKKGSMLPLSLTFDHRVLDGAPAAAFLRTIKRYLEEPVTILL

SEQ ID NO: 37364 - protein, 344 aa, Bacillus cereus G9241
MTRTVSMSTAINEAMKISMRRDENVILIGEDVAGGAQVDHLQDDEAWGGVLGVTKGLVQEFGRNRILDTPISEAGYMGAAMAAAATGLRPIAELMFNDFIGSCLDQVLNQGAKFRYMFGGKAKVPVTVRTMHGAGFSAAAQHSQSLYALFTSIPGIKVVVPSTPYDAKGLLLAAIEDDDPVIFFEDKTLYNMKGEVPEGYYTIPLGKADIKREGSDVTIVAIGKQVHTALAAAKQLSKKGLEVEVIDPRSLSPLDEDTILASIEKTNRLIVIDEANPRCSIATDIAAIVADKGFDLLDAPIKRITAPHTPVPFSPPLEKLYLPTPEKVIETVSEMIGDQSLLHV

SEQ ID NO: 37365 - protein, 332 aa, Bacillus cereus G9241
MLKTTESKGNEITKEQARWMYEKMLEIRKFEDKVHELFAQGVLPGFVHLYAGEEAVAVGVCAHLTDSDSITSTHRGHGHCIAKGCDLNGMMAELFGKATGLCKGKGGSMHIADLDKGMLGANGIVGGGFPLACGSALTAKYKGTKDVSVCFFGDGANNEGTFHEGVNLAAIWKLPVIFIAENNGYGEATTFEYASSCDSIADRAKAYNIPGVQVDGKDLLAVYKAAEEAVERARNGDGPTIIECMTYRNYGHFEGEAQTYKTSEEKEEHLNEKDAIVNFRKHLIHEALLTESEIVDMEKAVDEAVQRSIEFSENSPYPGDEELLKDVYVSYK

SEQ ID NO: 37366 - protein, 545 aa, Oryza sativa (japonica cultivar-group)
MASHAVTDALLLPRSEGAVAGAVDFRGRPASRASTGRWSAAMFVLGVEIAERFAYHGVSANLISYLTGPLGESTAGAAAAINLWSGVATMLPLLVACVADAWLGRYRTIVLASLLFVVSMGMLTLSSALPAFHGDGGGCSYTSKSLSCAPSTAQVAIFYVSLYLVALAEAGHKPCAQAFGADQFDQNDAKESVSRSSFFNWWYFGMCSGTAMTTMVSSYIQDNIGWGLGFGIPCLVMAFALAMFLLGTRNYRYYVSTQSSPFARLARAFVALIRGSKDDALAVVDDDDGGDHREELRGVLRLFPIWATCIIYAVIFSQSSTFFTKQAATLDRRIGESFRVPPAALQTFISVTIIAFIPVYDRAFVPVARRFTRASSGITMLQRIGTGLVLALAAMVVAALVEARRLGVARDAGMVDDPKAALPMSLWWMVPQYVLFGLSDVFAMIGLQEFFYDQVPDALRSLGLAFFLSIFGVGHFFSSFIISAIDGATKKSGASWFANNLNRAHLDYFYWLLAGLCAVELVAFVFVSRVYVYKKRVPHNGCDVM

SEQ ID NO: 37367 - protein, 532 aa, Oryza sativa (japonica cultivar-group)
MADTVAGAVDYRGRPASRAATGGWKSSVFVMAMEIAERFAYKGVAANLITYLTGPLGQPMARAAASIDAWKGVSQMLPLPLACVADAWLGRYRAIVLASVIFVLSMGTLSMSSAFPVSRAGHVAVFYVALYMVALGEGAHKPCAQAFAADQFDEKDGGECAARSSFFNWWYFGMCAGTAVTTMVSSYVQDNVGWGLGFGIPCIVIVVSLAAFLLGTRSYRFYTARTASPVARVAKAFLTLIKSWRSNRRTNPASGGKGDGDGDAGDLVEEVKSVLRLLPIWASCIIYAIIFSQTSTFFTKQAATLDRRIGRSFNVPPAALQTFISVSIVVFIPVYDRLFVPLARRYTGRPSGITMLQRVGAGLALSLVAVVLSALVETRRLRVAAGAGMADAPKARLPMSLWWMVPQYVLVGVADVFAMIGLQEFFYDQVPDAVRSLGLALFLSIFGVGHLLSSLLISVIDGATARRAGGSWFANNLNRAHLDYFYWLLAGLCAVELVAFFLFSRVYTYKKKGNDADGNCDYRGVDDDGICV

SEQ ID NO: 37368 - protein, 342 aa, Glycine max
MADVTTYLRHHRDPDPDPDDDDQTLIPFPYWDLDFDFDPEFPTNTFSFTDRENQINFVMDLFHQRVEQSQLTDPLSNDAVFGVIDGIDLGFPAADDFFIGRRFSVGSDESDGGHSHSHAGIDDGVLGFCAHSDEDYNENDDVASIPLCWDALQLEDNNNNYDDFEWEEVIDERDVLSMLDDTVSVNLGIEAEAAAAAAEEEEAESEASILEWQVLLNSNNLEGPNSEPYFGDNEDFVYTADYEMMLGQFNDDAFNGKPPASASVVRNLPSVVVTEADVVCAVCKDEFGVGEGVKVLPCSHRYHEDCIVPWLGIRNTCPVCRYEFPTDDADYERRKAQRSVVM

SEQ ID NO: 37369 - protein, 566 aa, Aspergillus nidulans FGSC A4
MFSGSSSPPKDKSDTIPRSGPINTPSLSIQTEGTVGSQAKSPPPTSFFGRRASEEQSPGGDKKRRSSTVSKAASFFANAKNSLSLSSPRTESALSSSLPESSLHRYGNMDPALNVPQGSLNNSAGESSPTPRSSFRVGVTEDRNKKCRRTMEDTHAYLYNFLGNPVPSAQNDDSDQSSHPSDASPKTGELTPIVETDNGYFAIFDGHAGTFAAQWCGKKLHLILEDVMRKNINAPVPELLDQTFTSVDQQLEKLPVKNSGCTAVVALLRWEDRIPTPSSVTGSSAIGPAAVAATKAGADSKADDTPTQEAAATPVPAIPPKLREKAIRQRVLYTANVGDARVILCRNGKALRLSYDHKGSDENEGRRIANAGGLILNNRVNGVLAVTRALGDAYIKDLVTGHPYTTETVIQPDLDEFIILACDGLWDVCSDQEAVDLIRNVSDAQEASKILVDHALARFSTDNLSCMVIRLYADRHREVASQAVDLAGWESRSSRGLSETDKIVEGARKSMANTGIADESETLKKVHDEAEECTPEEVPESILSASPNAPAATLNQPNKPGSSDST

SEQ ID NO: 37370 - protein, 815 aa, Clostridium acetobutylicum ATCC 824
MKAIIMAGGQGKRLRPLTCNLPKPMMPIMQKPVLQYIIELLKKHGINEIGITLHYLPDEVMDYFGDGKELGVNIHYFIEQSPLGTAGSVRNAESFLDETFVVISGDALTDVNLTNILQYHKEKNAMVTIVLKKVTIPLEYGVAITDTEGRISNFIEKPGWGEIFSDKANTGIYVMEPGIFEFYNKDKKFDFSEELFPELLKSGKEIFGYVVNDYWRDIGNIEQFMKCNFDILNGYVDVDVDIDASQHQKGVWIGKNTIVSDNVKVIPPVYIGDNSEIRYGAEIGPFAVIGRNNIISEMATIKRSIIFENCYIGSGAELRGSVVSNNVQVGGGVSTFEESAIGTGSLVGEKSVVKAGVKIWPDKVIGSKTIIKTNVVWGENRCKVLFGKEGISGEINVELTPEFVSKLASAFASNLRMNSKVVVCSDYNLAAEMLKYSFVSGLISMGIEVYSAKEMTIPMLRFSTAYFKADAAVYIYCKGSNKEKVNILFIDKDGIMISRSMEKKIANSFLREDFRRTRANNFKRLRDFGECMGYYEDYIKENLCIQEIRNSGLKVAVSMENKLIKNEVKSIFSDLKIQYSIYDNYADLEGLKKEVIEKKMDFGVCISENCDKAIIIDENANIISTQMYESIKALILISVYKFKTIVAPVNSSKALKYIAKRYNCKYVKSKISERYILNEYILNEKDKNIKEVLFSYLSSTDALNIVINIINILARGKIKLSELMERIPNYILREKEIACSWDNKGKIMRSLIEENISKSIELIEGIKVNYEDAWVLIIPDSDEPICKIYAESNDEEKTDKIINEFESEIELFMKN

SEQ ID NO: 37371 - protein, 432 aa, Bifidobacterium longum NCC2705 [sequence omitted]

SEQ ID NO: 37372 - protein, 97 aa, Atropa belladonna
AIDEYDYLPYFYSRSFDLSWQFYGDNVGETVLFGDADPNSTTHKFGTYWIKDGKIVGAFLESGSPEENKAIAKVAKVQPVASLDQLAQEGIGFASKI

SEQ ID NO: 37373 - protein, 382 aa, Ehrlichia ruminantium str. Welgevonden
MSKSDYYDLLGLSKNATPEEIKKAYRKMALKYHPDKNPGDKAAEEKFKELSEAYDVLIDKDKRAAYDRYGHSAFSDGSGRGGFDFNSGFSTDFSDIFNDLFGGGFRGGRSSSKRQDGGTVGSDLRLDIEITLEDSFNGTKVPINYVTHVKCSSCSGSGSEGSVKSVQCNTCHGAGNIRTQQGFFTIERTCHVCNGEGEIIKNKCKKCSGSGRVRDEVNLLVTVPKGIESGDKIRLNGKGEAGYRGAQSGDLYVYPNIKKHKFFTRNGADLYCNVPIKMILATLGGHIEMPSIDGTWTKVKVPEGSQNGDKLRLKEKGMPVINSSRRGDMYIQITVETPINLTKQQKELLKKFDEEPNTVECNPQSTGFFQKVKSFWNDIRSS

SEQ ID NO: 37374 - protein, 1455 aa, Aspergillus oryzae
MPAHLHAHPPGSTSLAANHEAESPSDSVSSPRVFLSHDDEDAIAEIRRTLTEISHHNSKQGYPEPHSSFDKFLEAELQAGRKKSNLGVCFQSLSTWGDGEEHTDVKTLGTALWRTLTFQDVYEWTIQPWLSRKEPQSGRPLIRDFSGAVRSGEIMLVLGRPGAGCSTFLRTIAGHHSSFLGVTGSLDYSGLSLEEVKKHYRGQVAYVPEDDVHFPTLTVQQTLEFALQSKTPQRYQDRIPRYLEIYGRVFGMSHTMNTLVGNEYIRGVSGGERKRISIIESLATDSSVSCWDNSTRGLDASSALDYARSLRIMTDTCGKATLMTLYQASDAIYDLVDKVLLIDEGRMLYQGPAREAKRYFEDLGYECAEMQTISDFLTSITVPERRRFRLGWEHRAPKGPIELEEAFRKSSAYQKVQYDVQHYEDQRLGGKSVRCSQIDSDDGSLEDFKKAIQTDKSRFVSPKSPYTISVFRQVVLCAKRQLWQIRGHMSPLYIKIISSVVYGLLVGSMFYNQPQTTAGMYSRGGVIFYSSILLAWLQMSELEEAMQGRDILSRQKKFAFVRPSAVCLARVITDFLIAAVITFLYLIVVYFLSGLKSDAGAFWIDFLFIYLCTICLTAQFRLFAAASSNFEVALRYCGVSVLFCIVFGGYVLSVDRMIKDVPWVGWIAYTTPALYTYEAMMAAEFHNANFTCSPESIVPSGANYTNIAYQTCGYAGSQIGTTVVNGDDYLAAQYGFSFGHVWRNFGILCLFTVVYIVCTCWLSEIMEWEPDSAGPIEYKKSRRNSRRSHRQGLDEESNPVHRDVTMPDSANNFERSGQAITGSMSTFTWDNLELFVQVGKETRKLLNGVSGYCKPGTLTALVGASGAGKSTLLTALTQRPNSGKLTGTMYVDGHAVDESFNRQIGYCQQMDIHDESSTVREALEFSALLRQNPGVPDKEKLAYVNTVIETLDLIELQNALIGSLDIEKKKRVTIGVELCARPELLLFLDEPTSGLDSQGASSIVALLRRLADQGLAILCTIHQANQQQFEDFDRVLALSPGGSTYYFGEVGESGCSIFEYFSKNGHKPENVTNAADYLIEVVVGGMKKDTTHQVNWADVWNRSAEADMVKKDICDIRSKGAEAGVSQHAKEISQPPLYRQVGLLTQRTLRQYWRSPEYPYSRLYASFLHALINGLTYLQIGNSSTDLQSKAFSCFLVLMLVPEFINAISMRFIMNRDIWKAREGPSGVYGWVAFCTAQIVSEIPYAIISAVVFYVLYYFIVGLPLGFAAGYSFLMFFLFFLFATSWGQWIAALSADSMVAATLMPFFIIMCELFNGILQPHENMPVFWKYTMYYATPFTYWIGGVLTAVLRGMPVICDSSELTMFESPPNMTCAEYAGPWLAEHGVGYLSNPDDTSKCGYCKYSYGDDYLSGIGLDSSKIWPYFGIFLAFVISNYSMVYVLVYVRSVMKPFWGRK

SEQ ID NO: 37375 - protein, 455 aa, Prochlorococcus marinus str. MIT 9313
MMSSSPYEPGRDPLSPNCNLAPITTELDAQSRLIVGGCQLSELAECYGTPLYVLDEATLRAACQSYRGALQRHYPGPSLPIYASKANSSLMMSSLVASEGFGLDVVSAGELLTALKGGVPGDCIVLHGNNKSDQELLLAYRNGVTIVADNQHDLDRLSQLVPVGADPAKLMLRFTPGIECHTHEYIRTGHLDSKFGFDPDQLESVLNQLLGCRWARLTGLHAHIGSQIFELEPHQDLADVMAGALQLARRLGHPVMDLNVGGGLGVRYVSSDDPPSIDNWVKVVAEAVNQACRSRNLDLPRLMCEPGRSLVAAAGVTLYRVGSRKTIPGLRTYLSVDGGMSDNPRPITYQSLYTACLADRPLASPDETITLVGKHCESGDVLLKDLALPYASSGDVLVVFATGAYNVSMSSNYNRIPRPAAVLVHSGHSELVQRREQPEDLLRYDVMPERFLALG

SEQ ID NO: 37376 - protein, 448 aa, Oryza sativa (japonica cultivar-group)
MVMPMPTEGSEPLLPRKQRDGGDDGAASSHDHFDGASFSGAVFNLSTTIVGAGIMALPATMKVLGLVPGLILVMLAAVLTDASIELLVRFSRAVGATSYGEAMGDAFGAFGRGLLQLCVVVNNVGVMVVYMIIIGDVLSGKSSSGGVHHHGVIEGWFGPNRWNGRFSILVIVTLGVFTPLTCFKRVDSLKYTSALSVALAVVFVVITAGITTIKLMRGQIPMPKLFPDVHDWSSTWRLFTAAPVLVTAYICHYNVHPIHNELKDHSQIRPIVRASLLLCLAVYTTTSFFGFLLFGEATLDDVLANFDSDLGIPYSLVLDDAVRVSYVLHLMLVFPIVFHALRFNMDGLLFPSARPLSSDNRRFGAITAALLTVIFLAANFVPNIWDAFQFTGATAAVAIAYIFPAGMALRDRHGIATKGDKYLAVFMIVLALVANGVAVYSDACLGTF

SEQ ID NO: 37377 - protein, 418 aa, Pseudomonas aeruginosa UCBPP-PA14
MAVPADASPLRKLALFVGPGLLVSVGYMDPGNWATAIEAGSRFGYALLFVVVLASFSGMLLQSLCSRLGIATGRDLAQLSRERYRPGVARGQWLLAELSIVATDLAEVLGAALAFHLLLGVSITTGVVLTAFDTLIVLALQGANFRRLEAIVLGLIATIGACFFVELVLIGPYWPDVAAGLRPSWDTLSSQEPLYLAIGILGATVMPHNLYLHSSVVQTRVSGDDAASKRSAIRFSRLDTIGSLSLALLVNAAILILAAAAFHGSGHTEVVEIQDAYHLLDPLVGGALASFLFGFALLAAGQSSTFTGTIAGQVVMEGFLRAKIPCWQRRLITRGLALVPALIGVLWLGEGAVGKLLVLSQVVLSLQLPFALWPLIRFSSDRNLMGEFVNPRWVSALAWSLFGLISAANLTLLYFWFG

SEQ ID NO: 37378 - protein, 246 aa, Triticum aestivum
  misc_feature (136)..(136): Xaa can be any naturally occurring amino acid
  misc_feature (154)..(154): Xaa can be any naturally occurring amino acid
  misc_feature (160)..(160): Xaa can be any naturally occurring amino acid
  misc_feature (178)..(178): Xaa can be any naturally occurring amino acid
  misc_feature (195)..(195): Xaa can be any naturally occurring amino acid
  misc_feature (221)..(221): Xaa can be any naturally occurring amino acid
MCGILAVLGCADDTQGKRVRVLELSRRLKHRGPDWSGMHQVGDCYLSHQRLAIIDPASGDQPLYNEDKSIVVTVNGEIYNHEKLRAQLSSHTFRTGSDCEVIAHLYEEHGENFIDMLDGVFSFVLLDTRDTVLVPXAGSTPLWIAVEAKPLYIXWGIDGXSVGISSEMKGLNDDCGHXEIFPPGHLFSQEGGKVXRFDPPPWVLESSSLRGLYNPFSPRKXFQKGLSQRGLMRDLPCGVLPSGGAC

SEQ ID NO: 37379 - protein, 408 aa, Oryza sativa
MQAVLMAPGVKDKKVLAFKRGKGKDADAGVTALIRDIVAGGARSAFHVFDLAKVVDLHRGWRRALPDVRPCYAVKCNPDGAMLAALAALGAGFDCASRAEIEAVLALGVRPATIVYANPCKPEAHLEYAAEVGVNLTTYDSEEEVAKVRRCHPRCELLLRIKAPDSGDAKVDLGLKYGANPDEVLPLLRAAQREGVAVAGVSFHVGSGASRADVYRGAIEAAREAFDAAAALGMPPMRVLDIGGGFMAGRTFDEAAAVINRALERHFGDLPCVEVIGEPGRYFAETAFTLAARVIGKRTRGELREYWIDDGLYGSLNCILMDHYVPRPRPLAAAAAGEDTTAATTHASTVFGPTCDSLDTVVTGYQLPEMSVGDWLVFDDMGAYTTAAGSNFNGFATSAIKIHLAYSS

SEQ ID NO: 37380 - protein, 537 aa, Oryza sativa (japonica cultivar-group)
MESGGLIAPSETCSSDGRGGGGGGWRAARFLIAVGFLERIGFNGVQGNLVMYLTGPMGMSTAAAAAGANAWGGTVLVLTLVGALAADSRLGRYRAIVAAGVLHLLSLGMLTISSVMQPNHPHPASCHDAAAACSPSPPPPPSLARLVFFHAALYLLALAQGFHNPCSEAFGADQFAASDPGARASRSSYFNWYQFFNSFGYGISNTALSYVEDSVSCTVGFAVCLATTAVYLPIFLLGTRAYRAEQPVDGALLARLAKTSSSAARAWTARVFRRKDTSCTERLLAREEVGEKGFLAKLLPIWVTSIVFAIVSAQEVTLFIKQGSTMDRRIGARGGLVVPPAALQSIVSVIFLTFVPVYDRALVPLARRFTGHPAGITTLQRVGVGMAMSCLAMAVAALVEAKRLRAASDAGLIDRPDATVPMGVWWLVPQYALVGLSKVFGIIGLDEFFYDQVPDDLRSVGLAMSLSVRGVGSYASGVLVSAIDCATRSGGESWFSDNLNRAHLDYFYWILAALAALEVAVFVYIAKRYVYKNKGEP

SEQ ID NO: 37381 - protein, 184 aa, Triticum aestivum
QAIYLHSTPWAPTVMASWATSVAPFQGLKSTAALPVSRRSNGASLASVSNGGRIRCMQVCPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEDSPNP

SEQ ID NO: 37382 - protein, 120 aa, Actinobacillus pleuropneumoniae serovar 1 str. 4074
MEIILPNQSKGHYSPAIKSNGMLYISGQLPFNADGKIVGDIAAQTKQALANLAQVLAAAELSRNDVVQCRVYIPDVAYWDTVNQVYADFFGSHKPARTVVPCGNLHYNALIEIDAVAEFA

SEQ ID NO: 37383 - protein, 153 aa, Oryza sativa (japonica cultivar-group)
MNIRTTITRLASCMIASGCDDGSFSIRDLRLIKDDSLVAHFEYHKHPITSVEWSPHEPSTLAVSSADHQLTIWDLSLEKDAEEEAEFRARMREQADAPEDLPPQLLFVHQGQKDLKELHWHPQIPSMIISTAADGFNMLMPSNIDTTIREADA

SEQ ID NO: 37384 - protein, 496 aa, Medicago truncatula
MSGSGIFAEIIDGDVFNYYADGKWNKSSSGKFVPIINPTTRKIHFKVQACTQEEVNKAIESAKIAQKLWAKTPLWKRAELLHKAAAILKEHKAPIAECLVKEIAKPAKDAVTEVVRSGDLVSYCAEEGVRILGEGKFLVSDSFPGNERTKYCLTSKIPLGVVLAIPPFNYPVNLAVSKIGPAIIAGNSIVLKPPTQGAVAALHMVHCFHLAGFPKGLISCVTGKGSEIGDFLTMHPGVNCISFTGGDTGIAISKKSAMVPLQMELGGKDACIVLEDADLDLVAANIVKGGFSYSGQRCTAVKVALVMESVAETLVKKIKDKVAKLTVGPPEDDCDITPVITESSANFIEGLVMDAKKKGATFCQEYRREGNLIWPLLLDNVRSDMRISWEEPFGPVLPVIRINSVEEGIRHCNASNFGLQGCVFTKDINKAMLISDAMETGTVQINSAPARGPDHFPFQGLKDSGIGSQGITNSINMMTKIKTTVINLPTPSYTMG

SEQ ID NO: 37385 - protein, 335 aa, Brassica napus
VPADTVEAGDICAVCGIDDIQIGETIADKAHGKPLPTIKVEEPTVKMSFSVNTSPFSGRPGRPVTSRNLRDRLNRELERNLAMKVEDGETADTFIISGRGTLHITILIENMRREGYEFMVGPPKVINKRVNDKLLEPYEVATVEVPENHMGPVVELLGKRRGQMFDMQGVGSEGTVFLRYKIPTRGLLGLRNAILTASRGTAILNTVFDSYGPWAGDISTRDLGSLVAFEDGTSTSYALASAQERGQMFVGAGVDVYKGQIVGIHQRPGDLGLNICKKKAATNIRSNKDVTVVLDTPLTYSLDDCIEYIEEDELVEVTPLSIRMCKNPKMAKKGR

SEQ ID NO: 37386 - protein, 574 aa, Oryza sativa (japonica cultivar-group)
MVLPETAAEGKALTDAWDYKGRPAGRAATGGWGCAAMILGAELFERMTTLGIAVNLVPYMTGTMHLGNAAAANTVTNFIGTSFMLCLLGGFVADTYLGRYLTIAIFEAVQATGVMILTISTAAPGLRPPACGDPKGASAECVAADGTQLGVLYLGLYLTALGTGGLKSSVSGFGSDQFDESDVDGERKKMMRFFNWTTSDARWGYGICAAGILAGLAVFLSGTRRYRFKKLVGSPLTQVAAVTAAAWSKRSLPLPSDPDMLYDVDDAAAAGHDVKGKQRMPHSKECRFLDHAAIIDRSAAESPATASKWRLCTRTDVEEVKQVVRMLPIWATTIMFWTIHAQMTTFAVAQAELMDRRLAGGFLIPAGSLTVFLIASILLTVPFYDRLVVPVARRATANPHGLTPLQRVFVGLSLSIAGMAVAAAVERHRATASASAAAAAPTVFLLMPQFLLVGAGEAFTYMGQLDFFLRECPKGMKTMSTGLFLSTCAIGFFFSTLLVTIVHKVTGHGARGGGWLADNLDDGRLDYFYWLLAVISAINLVLFTVAARGYVYKEKRLADAGIELADEETIAVGH

SEQ ID NO: 37387 - protein, 644 aa, Clostridium acetobutylicum ATCC 824
MSEKKKFYITTPIYYPSAKLHIGNTYTTVASDALVRFKRLQGYDAFMLTGTDEHGQKIQRIAEDKGITPKAYVDEIVAGIKDLWKMMNISYDKFIRTTDEEHVKAVQKIVKKFYDNGDIYKSAYEGWYCTPCESFWTETQLVDGKCPDCGRPVEKTKEEAYFFKMSKYADRLIKYIEDHPDFIQPESRKNEMLNNFLKPGLQDLCISRSSFDWGIPITFDEKHVIYVWIDALSNYITALGYGSDNDELYNKFWPADLHLVGKDIIRFHTIYWPIMLMALDLPLPKQVFGHGWLLVDGGKMSKSKGNVVDPVVLINEFGTDPVRYYLLHEIPFGSDGLFNNEIFIKKINSDLANDLGNLVSRTAAMIEKYFDGSIQPPVDKEEIDNELIDMAISLPEKLDEDIKKLKIPEALDHIWDLIKRANKYIDETTPWVLAKDENKKARLGTVLYNLVESLRFVATTLTPFLPETGEKIKTQLNIELDTWESLSAFDGTRAGTKVSKGEVIFPRIDVDKKIEELNKLKEEQLKATRKMQPLKPEISIDDVDKLDLRVVKVLECEPVKKSKKLLKLKVELGGEERQVLSGISQFYKPEDLIGKKVVLVANLKPAKLMGQLSQGMILAVATDDDSKLYTLDIPEDIPTGSIVR

SEQ ID NO: 37388 - protein, 228 aa, Aspergillus nidulans FGSC A4
MNIVEWAFGKRMTPAERLRKHQRALDRTQRELDRERTKLENQEKKLIQDIKKSAKNGQIGACKIQAKDLAISLRIQTVRSNEQMMQSMKGATMLLGSMNRQMNLPALQRIAMEFERENDIMDQRQEMMDDAIDEATGIEGEEEEGEDIVKEVLDEIGVDLSQAVRILLLVYVDMDRTNASLKQLGETPSGIQKESVSEGRVAQAIGAGGAGGASDDDDLQARLDSLRR

SEQ ID NO: 37389 - protein, 208 aa, Linum usitatissimum
WILKYIAVGNEVLYWKDRNVIAYTLPAMKTVHHALQLANLTDIKVTTPHALSFLAASEPPSTGVFKKFDGEILEPILDFHRRTKTPFMVNPYPFFGYRDEVKDYAVFRPSKGLYDKHTGINYTNMFDEQMDAVYSSMKKLGKGYEEDVEIVIGETGWPSAGDPNQPGISLENALSYNGNVVKHVNSGKGTPLMPNRTFETYLSALLVP

SEQ ID NO: 37390 - protein, 295 aa, Hevea brasiliensis subsp. brasiliensis
EQCGRQAGGALCPGGLCCSQYGWCANTPEYCGSGCQSQCDGGVGGEGGCVDLGSIISRSTFEEMLKHRNNAACPAKGFYTYDAFISAAKAFPAFGTTGDVDTCKREIAAFFGQTSHATTGGWPTAPDGPYAWGYCHKEELNQASSYCSPSPAYPCAPGKKYYGRGPIQLSWNYNYGQCGQALGLDLLNNPDLVATDRVISFKAAIWFWMTPQFPKPSCHDVITGQWSPTGHDISAGRAPGYGVITNIINGGLECGSGWDARVEDRIGFYKRYCDMFGVGYGSNLDCYNQTPFGLG

SEQ ID NO: 37391 - protein, 140 aa, Rhodospirillum rubrum ATCC 11170
MAIERTLSIIKPDATRRNLTGAINARFEEAGLRIVGQKRLRLTTAQAEGFYEVHKERSFFGSLVEFMTSGPVVVQVLEGENAVLKNREVMGATNPANAAEHTIRKDFAESIEANSVHGSDSAENAAHEIAYFFAQTEIVA

SEQ ID NO: 37392 - protein, 220 aa, Bacillus cereus G9241
MNLKQLAGEYAAYFVNDGMKIGLGTGSTVYWTIQKLGERVKEGLSFQAVPTSKETEALAHQLNIPLISLNDVQSLDLTIDGADEIDSNLQLIKGGGGALLREKIVASSSKELLIIVDESKLVTHLGTFPLPVEIIPFSWKQTERKIQSLGCQTTLRLKNNEIFITDNNNMIVDCIFPNHIATPSALHKRLKMITGVVETGLFVNMTSKAIIGTKNGIKEL

SEQ ID NO: 37393 - protein, 331 aa, Oryza sativa (japonica cultivar-group)
MAKKRKRSSDAAAAVEKPDEFAPQRPERTLFGFKEKPADDEEAEAEAASEGEEDAAAAAAAAPFRNKEKVLVTCSRRINYRYRHLMQNVVSLLPHAKKDSKVESKQSKGNALNELLELRNCSSCLFFECRKQKDLYLWMVKSPGGPSVKFLVNAVHTMEELKLTGNHLKGSRPLITFSTNFDEQPHWQLVKEMLTQIFATPKDHRKAKPFHDHVFVFSIVDDHVWFRNYQISVPHNEIDKVDKGGLDKMTLVEVGPRFCLNPIKIFGGSFGGPTLYENPFYVSPNQIRALEKRKKAGKYAKKVKAKVRRKMHEMENTLEPDEFAELWKGED

SEQ ID NO: 37394 - protein, 345 aa, Actinobacillus pleuropneumoniae serovar 1 str. 4074
MALKDLDWANLGFSYIKTDYRFIAHWKDGKWDEGQLTTDNTLHIHEGSTALHYGQQCFEGLKAYRCKDGSINLFRPEENAKRMQGTARRLLMAEVPTELFVRACKEVVKANQDWLGPYGSGATLYLRPFLIGVGDNIGVKAAPEYIFSVFCCPVGAYFKGGLAPSNFITTDYDRAAPVGTGGVKVGGNYAASLLPHELAVQQGTATRKFADAIYLDPKTHTKIEEVGAANFFGITKDNKFITPASESILPSITKYSLLHIAKERLGMETIEGDVYIDQLDQFAEAGACGTAAVITPVGGIQHKDNFHVFYSETEVGPVTKRLYAELTGIQFGDVEAPEGWIVKVE

SEQ ID NO: 37395 - protein, 1148 aa, Oryza sativa (indica cultivar-group)
MTTRRGGRGFMACDHKRQFLKAGVGNVLRASIVLHANALTTPIMIGTSCRVGRMGVFDKRATQKFLIRVKQEIGNLIDHFLQQQQQEEEEVLVPRQELPNGTQPMEAVVVPSEPAATVENQQIEDPPISRFTWTIENLSRVSTKKLYSEIFVVGGYKWRILIFPRGNNVEYLSMYLDVADSAVLPYGWTRYAQFSLSVVNQMHNKFTIRKETQHQFSARESDWGFTSFMPLGDLYNPSRGYLVNDTCIVEAEVAVCKVVDYWSYDSKKETGYVGLKNQVDSACQAVYHMPTTENDMPSGSIPLALQSLFYKLQYNDSSVSTKELTKSFGWDMHDSFMQHDVQELNRVLSEKLEDKMKKGILLWQVIVLSHHGHYVQTCPFDLIGVHSNADLQLDVKGCQDVYASFDKYVEVERLEGDNKYHAEQYGLQDAKKGVLFIDFPPVLQLQLKRFEYDFMRDTMVKINDRYEFPIQLDLDRDDGKYLSPDADRNVRNLYTLHSVLVHSGGVHGGHYYAFIRPTLSDQWFKFDDERVTKEDAKRALEEQYGGEEELPQTNPGLNNTPFKFTKYSNAYMLVYIRESDKDKIICNVDEKDIAEHLRIRLEKDREEKERRKKEKAEAHLYTIIKVARDDDLTTQIGKDIYFDLVDHDKVPSFRIQKQMPFTQFKEEVAKEFGIPTQFQRFWLWAKRQNHTYRPNRPLTPQEETHTVGQLKEAANKAHNAELKLFLEVELGLDLKPLPLPDKTREDILLFFKLYDPEKEQLRYVGRLFVKASGKPQDILPKLRKMAGFSQDEEIELYELEDGDIVCFQKSPKPDTADQYRYPDVPSFLVYIRNRQVVHFRSLEKPKEDDFCLEMSKAFTYDEVVEKVAQKLGVDDPTKIRLTSHNCYSQQPKPQPIKYRGVERLLDMLIHYNQTSDILYYEVLDIPLPELQALKTLKVTYHHGTKDEVSVHSIRLPKNSTVGDVLNDIKSKVELSHPNAELRLLEVFYHKIYKIFAPNEKIENINDQYWTLRAEEVPEEEKNLGPFDRLIHVYHFTKDTQNQTQVQNFGEPFFMVIREDETLSSIKERIQKKLKVPDEDFSKWKFAYISLGRPDYFEDSDTVASRFQRNMYGAWEQYLGLEHPDTAPRKTHNANQNRHSFERPVKIYN

SEQ ID NO: 37396 - protein, 120 aa, Haemophilus ducreyi 35000HP
MSNTPYEETIFSKIIRKEIPANIVYQDDLVTAFRDIAPQAPTHILIVPNKLIPTINHIKTEDEMILGRLFTVAAQIAEQEGIAADGYRLIMNCNKHGGQEVFHIHMHLVGGKPLGKMLSE

SEQ ID NO: 37397 - protein, 455 aa, Desulfitobacterium hafniense Y51
MENTDLKNFEESMLDGLSELTIKKGPINPELYHKYEVKRGLRDLDGRGVLVGLTEIGEVHSYIIDEGEMVPVPGRLIYRGYDITDLARGFMEDNRFGFEETAYLLLFGRLPNRQELIDFHNLLDIYQKLPDNFARDMILNVPSKDIMNGMARSVLGFYCYDTNPDDTSIRNVLKQCIRLIAAFPALAVYCYQAYTHYHGNKSLVIHSPQPELSLAENILYMLRPNHKYTELEARLLDLALVLHAEHGGGNNSSFVTHVVTSTGTDTYSAVAAALGSLRGPKHGGANHKVIQMFQDIKEKISDWQDEDELSAYLDKILLKDAFDRSGLIYGIGHAVYSISDPRAVVLKHYASKLAAEKGLDNEFNLYAKVEELAPKVIAKHTKIYKGVSANVDFYSGFVYQMLNLPLEMFTPIFALSRIAGWSAHRIEEIVNGGKIIRPAYKSVVPRQKYVPLNKR

SEQ ID NO: 37398 - protein, 365 aa, Rhodococcus sp. RHA1
MSGATANISDTRIGVLLGDGIGHEIVPATQRVVSAAVVAAGGGAVDWVELPLGLGAIESHGTPIPDSTLSALDALDAWILGPHDSAAYPEPFRGRLTPGGVVRKRFDLFANIRPARSLEGVASTVPDMDLVIVRENTEGLYADRNMFAGSGEFMPTPDVALAVGVVTRKACERIAHTAFALARTRGRHVTIVHKANVLSMTTGLFRDVCREVGQRDYPDVRIDDEHVDAMTAHLVRRGRDFDVVVTENMFGDILSDLTGELSGSLGTAPSINSSETKVMAQAAHGAAPDIAGHNRANPTALMLSAAMMLEWLGDRRADRNLGGAAHRIRDAVRATIASGVATADLGGLASTSEFTETVLARTLRR

SEQ ID NO: 37399 - protein, 249 aa, Aspergillus nidulans FGSC A4
MPRKFFVGGNFKMNGNAESTTSIIKNLNSANLDKSVEVVVSPPALYLLQAREVANKEIGVAAQNVFDKPNGAFTGEISVQQLREANIDWTILGHSERRVILKETDEFIARKTKAAIEGGLQVIFCIGETLEEREANKTIDVVTRQLNAAAKELSKEQWAKVVIAYEPVWAIGTGKVATTEQAQEVHSAIRKWLKDAISAEAAENTRIIYGGSVSEKNCKDLAKEADIDGFLVGGASLKPAFVDIVNARL

SEQ ID NO: 37400 - protein, 117 aa, Citrus limon
HNVGALVVVKPGEQKSAAGIITERDYLRKIIVQGRSSKSTKVGDIMTEENQLITASPDTKVLRAMQLMIDKRIRHIPVIDDKGMIGMVSIGDVVRAVVSEHREELNRLNALYKEVTR

SEQ ID NO: 37401 - protein, 821 aa, Azospirillum brasilense
MSTHTNPPTPRERLVVVGNGMAGIRTLEELLAKAPDRYDITVFGAEPHPNYNRIMLSPVLAGEKTFEQIVLNGRDWYEANGIRLLTGDRVEVIDRANCTVTAISGLTVPYDKLLIATGSTPVIIPVPGSTLTGVVGFRDLADVDTMLEAAARGGRAVVIGGGLLGLEAANGLKVKGMDVTVLHLMDTLMERQLDRSAGALLRHELERRGITVLTGADTAEIVGSEKVSAVRLKNGQELPADLVVMAVGIRPNTTLGKAAGLACGRGIQVDDAMTTSDPAILSVGECVEHRGQTYGLVAPLFEMAKVAAARLAGSAEAAYTGSVTSTKLKVTGVDVFSAGDFTGGKDCEDIVFRDAARGVYKRVVVKENRILGAVLYGDTKDGGWYFQMLKDGTEVAPVRDTLIFGQSFGGEGAANPKAAVAALPDSAEICGCNGVCKGTIVTAITEKGLSSLDEVRAHTKASASCGSCTGQVEQLLALTLGDGYAGEAKAKPMCKCTDRTHDEVRRAITALDLKTIPDVMQRLEWRTPDGCHHCRPALNYYLLCEWPGEYKDDSRSRYINERVHANIQKDGTYSVVPRMWGGLTSAKELRAIADVVDKFAIPTVKVTGGQRIDLFGVKKEDLPAVWADLNAAGMVSGHAYAKGLRTVKTCVGSEWCRFGTQDSTGLGVKLERMTWGTWTPHKVKLAVSGCPRNCAEATIKDLGVVCVDSGYELHVGGNGGMHVRACDLLVKVETEAEVLEYTGAYMQLYREEARYLERTAPWVERVGLDHIRRRLVDDAEGRAALNARFLFSQSFSQDDPWAERANGSVDRHEFAPLAQVG

SEQ ID NO: 37402 - protein, 409 aa, Schizosaccharomyces pombe
MFSVIGRGIKFSSKSHYSVSCFLIATQGAKIRQIHTHNTFFKNFSFAKLGRNQRTSSLIKIHNSSTSFPKSRSEKVVYTPSLPLSSSVLASFSFLPHNILQNGLNTLHIWSGLPWWASIAACAVAMRIAVFPIMLKMMKTSAKLAIINPKVAEHMSVLSKAKAEGNSELMMQATTQIQNLYKVNNVNPLNLLSAPVFQGILFISFFYALKTMAGVPVEGFTDGGFWWVNDLSQPDPLHIFPVANGLLMLLNIELGSETGSNKVAMSPSMKKFFRFLCLASPLFTMNFPMAIFMYWFPSNVFSVFQGAFLRSSTIRHKLGLPEVPSAMPVPNAQNESFVKSFTDIVHGVQVKGKYPQASEILDATRFLKTDTNNEQKPTNNSTITKATTLSDNSQNDKSSSVTKPTEKKD

SEQ ID NO: 37403 - protein, 885 aa, Azospirillum brasilense
METVRTTCPYCGVGCGVLASVSSDGTVGVAGDPDHPANRGKLCSKGTNLPDTLGLAERLLHPQVDGRRVAWDEAIAEVAKRLSDTIAKHGPDSVAFYVSGQLLTEDYYAVNKLAKGFLGTANIDTNSRLCMASSVAGHKRGFGADAVPVTYDDLDEADLVLLVGSNLAWCHPILNQRLLAAKHTRGTRIVVLDPRRTAAVDGADRHLPIRPGTDALLFNGLLVYLADNHLADNGLIDARFVAEHTAGLAEALEAARADAPSPAHVAACCGLPLAEVEAFYAEVATVRRTVTVYSQGVNQSSQGTDTVNAILNVHFLTGRIGAPGMGPFSVTGQPNAMGGREVGGLANQLAAHMGFEPESVDRLRRFWNAPRVADKPGLKAVDLFRAVEQGTVRAVWVMATNPAVSMPDAARVRRALAKCETVIVSDCVADTDTARLSHIRLPAAGWSEKDGTVTNSDRTISRQRAFRPLAGEARPDWWIVTQVARAMGFAAAFSFETPADVFREHAALSAFENGGTRAFDIGGLAGLSDAEFETLAPAPWPRRAGEGPTRRLFADGRFFTEDGRARFVPVASRPLPRSVEPGSLMLNTGRLRDQWHTMTRTGLSPRLSAHAPEPCLDLHPQDAAARGLTDGALVSLSTPVGTALARLRVTEAQRVGEAFLPMHWTDRFTASCVVGRLVDDLAVDPVSGQPDLKRMPVTLTPYPAAWTGFLIAREPVEPAHGGYWSRRAVPGGHLIELASEDALPAPETLAFGFAGATVDYSDAARGVLRRAWVTHDRLEACLFLSTSGALPSRGWLVELLSAEALDGAARRALLSGRSPVPTADEGRTVWSCFGVGVNRLIAAIQSQGLTTVQEVGAALRAGTNCGSCIPELKEILADAQRSHVA

SEQ ID NO: 37404 - protein, 395 aa, Ehrlichia ruminantium str. Welgevonden
MLESHDFTFANMKKIQDFSCRGKTILLRVDLNVPVDDNKVVLDDTRIVRLTTTVKYLLSNNAKIVMISHYGSPKSYDREFSLKFLVEYLNKIFATNVLFVDGVIGSYVEQAVQSVPLGSVLLLENLRFYVEEEKNDLNFAKQLALLADVYVNDAFSCMHRKHASIDAVARLLPSFIGFNFQEELKYLSYVVSNSDKPVGVIVGGAKISTKIHMLRNLTQKVNFLILGGAIANNFLLSQGLKIGNSLCEKLDEDPFVDVINFAKKYGCEIIVPEDYLVTKDLVSNEAVVKNNQELAPDDIILDIGPHTINIITSIIGKCRTVLWNGPMGMFEKEPFSHGTFSIARLLAEFTKAGKLKSIVGGGDSICAIKLSGLLSEDFTYISTGGGALLHFLSLA

SEQ ID NO: 37405 - protein, 286 aa, Oryza sativa (indica cultivar-group)
MASSMAKNSSPFKVVLGSSSPARREILADMGYEFTVMCADIDERAIRREKPEELVKALAEAKAEAIKLKLHGEDSAQERDQPTILITSDQVMVSKGMIRERPKGQEEAREFIKGYSGDKAFAVNYVLVTNLSNGASKGGWDIPEIYFHHIPEDFIQSVVKEGHMTCVAGGLKLTHPSVLPFIKQLVSNSFETTTIASITTLRTANLYWTVSLQRLNNNNIESIALILRFLPMLHRSAQWIAFEDSRGSSLRGLFKKFLEPNDLHLECHLQLARRALLNGPYDALVL

SEQ ID NO: 37406 - protein, 144 aa, Plantago major
VGLESQTIKHMVEDECADSIIPLPNVTGKILSKVIEYCKRHVDAAAYSAAAKSDDKLASTATTDDDLKSFDTDFVKVDQSTLFDLILAANYLNIKPLLDLTCQTVADMIKGKTPEEIRKTFNIKNDFTPEEEEEVRRENQWAFE

SEQ ID NO: 37407 - protein, 186 aa, Plantago major
QIISLYLSIHHHLKRNDVVFRRKQEDHPPQLRWQRYSKWTNQVAVESQTIKHMIEDDCADNVIPLPNVTGKILSKVIEYCKRHVDAAAANTAAKAEDKLASTAPTDDDLKAFDTDFVKVDQATLFDLILAANYLNIKSLLDLTCQTVADMIKGKTPEEIRKTFNIKNDFTPEEEEEVRRENQWAFE

SEQ ID NO: 37408 - protein, 166 aa, Arabidopsis thaliana
  misc_feature (96)..(96): Xaa can be any naturally occurring amino acid
  misc_feature (105)..(105): Xaa can be any naturally occurring amino acid
  misc_feature (122)..(122): Xaa can be any naturally occurring amino acid
  misc_feature (127)..(127): Xaa can be any naturally occurring amino acid
  misc_feature (135)..(135): Xaa can be any naturally occurring amino acid
  misc_feature (138)..(138): Xaa can be any naturally occurring amino acid
  misc_feature (147)..(147): Xaa can be any naturally occurring amino acid
  misc_feature (153)..(153): Xaa can be any naturally occurring amino acid
  misc_feature (161)..(162): Xaa can be any naturally occurring amino acid
MASSMLSSAAVVTSPAQATMVAPFTGLKSSAAFPVTRKTNKDITSIASNGGRVSCMKVWPPIGKKKFETLSYLPDLSDVELAKEVDYLLRNKWIPXCVEFELEHXGLCTREQRETLPGYYDXGTWPXLELPFFRXEPXSVKVFKEVXRFKKGXPRGALIRXXRFGK

SEQ ID NO: 37409 - protein, 292 aa, Bacillus cereus G9241
MIDFGTIATAMVTPFDINGNIDFAKTTKLVNYLIDNGTTAIVVGGTTGESPTLTSEEKVALYRHVVSVVDKRVPVIAGTGSNNTHASIDLTKKATEVGVDAIMLVAPYYNKPSQEGMYQHFKAIAESTPLPVMLYNVPGRSIVQISVDTVVRLSEIENIVAIKDAGGDVLTMTEIIEKTADDFAVYSGDDGLTLPAMAVGAKGIVSVASHVIGNEMQEMIAAFQAGEFKKAQKLHQLLVRVTDSLFMAPSPTPVKTALQMVGLDVGSVRLPLLPLTEEERVTLQSVMQSIPR

SEQ ID NO: 37410 - protein, 330 aa, Yarrowia lipolytica CLIB122
MTVRDALNTALREEMDRNDNVFIMGEEVGQYNGAYKVTKGLLDKFGEKRVVDTPITEMGFAGVCVGAALAGLTPVCEFMTWNFAMQAIDQIINSGAKTYYMSGGTQQCNVTFRGPNGAAAGVAAQHSQDFTGWYGQIPGLKVVSPYSSEDAKGLLKAAIRDPNVTVFLENEIMYGESFPMSEEAMSPDFVLPLGKAKIEREGKDITLVGHSRNVETALKAADLLKKHHNVDAEVINLRTVKPLDTETIFNSIKKTNRLVSVEAGFPAFGMGSELCGVVNDSWAWDYLDAPIQRVTGAEVPTPYAIELENFAFPTPEIVVKAAKDALYIEE

SEQ ID NO: 37411 - protein, 91 aa, Plantago major
DDKLASTATTDDDLKSFDSDFVKVDQSTLFDLILAANYLNIKPLLDLTCQTVAEMIKGKTPEEIRKTFNIKNDFTAEEEEEVRRENQWAFE

SEQ ID NO: 37412 - protein, 178 aa, Glycine max
  misc_feature (143)..(143): Xaa can be any naturally occurring amino acid
  misc_feature (147)..(147): Xaa can be any naturally occurring amino acid
MERGANNKKLSPLSSEQFISLTTPLVFLEKEAEASSTGVSQERVIEDAEKDEFQVDDCPIEQVRLTVPITDDPTQPALTFRTWVLGLASCVFLAFVNQFFGYRTNPLKISSVSAQIITLPLGKLMAATLSTKPIRVPFTKWSXSLNXGPFSLKEHVLITIFATSGSSGVYAISIITIV

SEQ ID NO: 37413 - protein, 422 aa, Desulfitobacterium hafniense Y51
MNYIIIGNSAAGLFAAEGLRKVDSQGKITVLTADHYPPYSRCLTTYYLAGDIREEQLFLRTTEELARLNLNTHYRVRVTGLDPEGQRVSTASGEVFDYDRCLIATGASAVSLDIAGAALPEVFTLRHLENAKAIQKFIKKGRKAVIIGGGLVSLKSAYALRKQGMEVHVIVSSGYILSQMLNSSAAERLEEHLKDHGIHISLNSDVAAIKGKEHVEAVELKCGRIIDTNLVIIGKGVQPNVEPFLNSGLKINHGILVNEYLETNLPHVYAAGDVAETWDFLRECPRINAVWPNATEQGRVAALNMAGRKTIYKGSMGMNSVDFFGLRIISGGVITPLAHKKDIENALPWKVTEGQESWSKPLAKASTYQSLIWKGNYLKGYVLIGYPERAGLLTAMIRTQEPLAPEVQRNIEAGNRKIVKLK

SEQ ID NO: 37414 - protein, 75 aa, Malus x domestica
ACVDVLGGLIHIGIGSSAKDACCPVLQGLVDLDAAICLCTTIKAKLLNINLIIPIVLQVLIDCGKTPPSGFQCPA

SEQ ID NO: 37415 - protein, 483 aa, Pseudomonas syringae pv. phaseolicola 1448A
MTTTDEKGGVFETDLPARLDRLPWGRFHTLLVVALGITWLLDGLEVTLAGSVAGALKASPALNLTNSDVGLAGAAYIAGAVLGALFFGWLADRLGRRKLFFITLLLYVGATAATAFSFSVWSFMLFRFLTGMGIGGEYTAINSTIQEFTPARYRGWVDLTINGTFWLGAALGAIGSIVLLDPQWVGAELGWRLCFGIGAVLGLLVLLMRLWLPESPRWLLIHGQATQAKKIVEQIEADLQRQGHVLSPVQGKPLRLHVRDHTPLGEVARTLLVTFRQRSLVGLTLLTAQAFFYNAIFFTYALVLTDFYGVPSERVGWYVLPLALGNFCGPLLLGRLFDVVGRRVMISLTYGVSGVLLAISGYMFKQGLLDVTQQAIAWMVIFFFASAAASSAYLTVAETFPLEIRALAIAVFYAFGTGLGGMIGPTLFGELIETGERSNVLIGYLIGAGLMMFAALVQSIWGAAAERKSLEEVARPLSQAGER

SEQ ID NO: 37416 - protein, 436 aa, Clostridium acetobutylicum ATCC 824
MDYTTQMDAAKKNVTTKEMEVVAEKEQMEISELKMLMAEGKIVIPANKNHKSLSAEGVGQGLKTKINVNLGISKDCQNVDMEMKKVEIAIAMKAEAIMDLSSFGKTEEFRKKLINMSKAMIGTVPIYDAIGFYDKELKDITAEEMIGVVEKQAKEGVDFMTIHAGINRETAETFKRNKRAMNIVSRGGSLLYAWMELNNKENPFYEYYDKILDICEKYDVTISLGDACRPGCIDDSTDASQITELIKLGELTKRAWDRNVQVMVEGPGHMALNEIQSNMIIEKKLCHGAPFYVLGPIVTDIAPGYDHITSAIGGAVAAASGADFLCYVTPAEHLRLPNIEDMKEGIVASKIAAHAADIAKNVKGARDWDNKMAEARQKLDWKAMFDLSIDPEKAIRYRKESTPEDPDTCTMCGKMCSVRNMNKVMAGKDVNILRED

SEQ ID NO: 37417 - protein, 352 aa, Pseudomonas aeruginosa UCBPP-PA14
MASHWMIYGANGYTGRLVAEQAQREGLTPLLGGRNPAALHALGSQLGLECRVFDLGDPQACREALDQVKVVAHCAGPFSATSTPMIAACRAAGTHYVDITGEIAVFEQAHAGDAEAREAGIVVCPGVGFDVIPTDCLAACLKEALPDAQRLALGFDTGSGLSTGTAKTSVEGLKLGGKIRENGRLRDVPLGYKRRDIDFGRGLRHAVTIPWGDVATAYYSTGIPDIEVYLPAPPLLALSMRLIDPLRPLLGRQRVQDWLKGQVDKRISGPDQAARERLRTWVWGEARNARGERRTARLETANVYDLTLHGVLLAVRHLLDYQGPGGYFTPSRLLGARCVESLPGSGRITVIG

SEQ ID NO: 37418 - protein, 538 aa, Acidobacteria bacterium Ellin345
MPTPKPLVLIILDGWGYAPPSNANAISLARKPNYDKLLTDFPNTLIHTSGRYVGLPPGQMGNSEVGHLNIGAGRVVYMDITKIDLAIENKSLFKNQTLLDAMKHAANGRQLHFFGLLSDGGVHSHQNHLYALLRMAKENGVERVFVHPFMDGRDTLPTNGVKYVDQLQQKMREYGIGKIASISGRYYAMDRDKKWDREKLASDAMLHGRGEGGRYKDPVQGIKESYNKGVTDEFIIPFVCVDDNDQPIGVIRDGDACINFNFRADRARQITRVLARNSGITKDGGRELDAADTLDATIPRDTIPKDLHYTCMTQYDPKFTLPIVIPPDTLTHILANEMAAMNMRNLRVAETEKYAHVTYFFNGGIEKPYPGEERELVQSPKVATYDLKPEMSANGIADVIEHAVEKGAFDVIVVNFANADMVGHSGKIPPTITAVETVDSCLGRVYNVVRKKGGAMLITADHGNAEQMIDPETGGPQTAHTTNPVPFIFVAEDAKKRFSLRPDGALQDISPTMMGILGIPQPKEMTGHDLRVDLTVKK

SEQ ID NO: 37419 - protein, 390 aa, Corynebacterium diphtheriae NCTC 13129
MAAKNEWAEKDYYADLGVSSSATEAEIKKAYRKLARENHPDSHPGDAAAEERFKKVAEAYDVVGDETKRKEYDEFRSMIASGGFGGAGFPGGFRTQEGFDFDLGDIFGSGAGRGHAPQGGFGDIFGGIFNRGGGARNAARPTRGSDVETEITLEFREAAKGTTIPLQLTGDAPCHTCHGSGSRSGAPTTCTECNGTGFTSENKGAFGFSAPCTQCGGTGKMISDPCPDCSGTGTQRRTRSITVRIPAGVVDGQKVRLAGQGEAGPNGLPAGDLYVTVHVKNDRVFTRSGDDLEVTVPVSYAELALGDTISVPTLDLPVRVRIPSGTPNGRVLRVRGKGVPKRGGSAGDLLVKVEVTVPSSLDAASASALRAYVQAERDAGFDPRAGWAGK

SEQ ID NO: 37420 - protein, 178 aa, Prochlorococcus marinus str. MIT 9313
MRCRLPLTALALSAGLLLSSGSALAQTAASSNDKVLAQAGGGFNVAAVQALLNQGDAAVSAGNLTEARNDYDNARDAAKQLLSFYRDLSGAFRGLDARIPREMDAKGRKAMGLLAQANLRLAALFRQQNQPEVAVPVLVEVVRVMSPSRPEGQKAYQSLLELGFVETPYAGAKLTAPN

SEQ ID NO: 37421 - protein, 107 aa, Prochlorococcus marinus str. MIT 9313
MDPTTKTRIEALIQSSPIMVFMKGTKLMPQCGFSNNCVQILNSLGMSFETFDVLSDMEIRQGIKDYSNWPTIPQVYVKGEFIGGSDILIEMYNAGELAEKLEIALNS

SEQ ID NO: 37422 - protein, 336 aa, Oryza sativa (japonica cultivar-group)
MGNCASFTPKWGLSDLHCKGMVPIDEDETHEGIKTIRIQKACEFTTSSVLCVCIITWNMNGKMSVEDVTKLVSSNRKFDLLVFGLQEVPKCDVAQVLQETMAETHILLCQKTMQSLQMFLFGAKSSEKYIRELKVDKHAVGGCGGIIGRKKGAVAMYINFSGIRMVFVSCHLAAHENKVEKRNSECQHISHSLFSKNDIQYTKSADITVWLGDLNYRLQGISSIPARKLIEENRQSKLRGKDQLLQEAEKGEVFNGYCEGTLLFKPTYKYNIGSSNYDTSYKIRVPSWTDRILFKVDHTSGLDAVLNSYEALDCIRSSDHKPVRAHLCLKVHGDSA

SEQ ID NO: 37423 - protein, 399 aa, Zea mays
MNGSSGSQGHHVSGEKKQVCHVSRPILNNGPKHRPLTPMRRCRGVACVVIILSTAFLLVVYLAPITTFAVRLFSVHYSRKATSFLFGMWLSLWPFLFEKINKTKVVFSGENVPPKRRVLLFANHRTEVDWMYLWDLALRKGHLGYIKYILKSSLMKLPIFSWAFHIFEFIPVERKWEIDEAIIQNKLSKFKNPRDPIWLAVFPEGTDYTEKKCIMSQEYASEHGLPMLEHVLLPKTKGFICCLQELRSSLDAVYDVTIAYKHRLPDFLDNVYGVDPSEVHIHVRMVQLHHIPTTEDKITEWMVERFRQKDQLLADFFMKGHFPDEGTEGDLSTPKCLANFLTVVCLTAICLYLTLFSFVWFKVYVVASCAYLSFVTYYSILPPQLIGSPEGDVKAKKVV

SEQ ID NO: 37424 - protein, 180 aa, Plantago major
MAQYGAGRQTDEYGNPIQGHGMGTGTGMGGDQYGATGGLGGTGGGTHGGQQHMTGGQQYGATGMTGTGTHGTHGGAGTDYGTAGGVTTAGHRRSGSSSSSSSEDDGMGGRRKKGLKDKIKDKLPGHHGDQTQQTTGAGYGTGTGAGYGTGTGAGYGGEGHEKKGMVDKIKDKIPGMGGNR

SEQ ID NO: 37425 - protein, 331 aa, Shewanella sp. MR-7
MISNQIHLASRPTGMPTQTNFKLVEVTLPALKTGEVLVKNTWMSVDPYMRGRMIDKDSYIPPYQINEVMDGGAIGEVIESLNPQFPVGAKVSHISGWRSAFISDGSDLTLLPAVNIPEQYFLGIIGMPGLTAWVGLMKVAKLKPTDTVFVSAASGAVGMVVCQIAKLNGCKVIASVGSDEKAELVKSLGVDAVINYKNVTDLTQALRDAAPEGIDVYFENVGGAHLEAALDVMNDYGRIPVCGMIAYYNAQTPVPGPSNLLAINTKKLTMQGFIVMDYWDQYSEFVGQMAQWLQEGKMKSEETVYQGLEQAPDAFIGLFEGKNKGKMLVKL

SEQ ID NO: 37426 - protein, 607 aa, Agrobacterium tumefaciens str. C58
MNIVAKTIPLVVTTGPHAASTKIHKPGILHPHIRVPMREIAVHPTAGEPPVTVYDSSGPYTDPSHPVLIENGLPRLRHDWVVARGDVEAYEGRHVKPEDNGFATGERLTPEFSVRHQPLKATAGKAVTQLAYARAGIITPEMEFIAIRENLGREAAKEKPTRDGESFGAHIPDYVTAEFVRQEVASGRAIIPANINHPELEPMIIGRNFLVKINANIGNSAVTSSMAEEVEKMVWAIRWGADTVMDLSTGRNIHNIREWIIRNSPVPIGTVPLYQALEKVNGIAEDLNWEVFRDTLIEQAEQGVDYFTIHAGVRLHYIPLTVNRVTGIVSRGGSIMAKWCLHHHKESFLYEHFEEICDICRAYDVSFSLGDGLRPGSIADANDAAQFAELETLGELTQIAWARDCQVMIEGPGHVPMHKIKENMDKQLKTCGEAPFYTLGPLTTDIAPGYDHITSGIGAAMIGWFGTAMLCYVTPKEHLGLPDRNDVKVGVITYKIAAHAADLAKGHPAAQVRDDALSRARFEFRWEDQFNLSLDPDTARSFHDETLPKEAHKVAHFCSMCGPKFCSMRISHDIRAEAQKEGLEAMAARFKEGGELYMPLPTPASAE

SEQ ID NO: 37427 - protein, 234 aa, Brassica napus
FLTLFCFSHFLTLSFSSHFLTLSFSYLLLAHVLEMDSNPFTQTSNFVGLLYSQQNISFGNYEDNVDLSSSQLPSQGVDDVGERRERRKWTRTDDVVLISSWLNTSKDPVVGNEQRSGAFWKRIAAYFAASPKLAGCEKIEASHCKQRWHRINDLVCKFCGSYEAATREKSSGCNENDVLKRAHEIFYINHMRKFTLEHAWKELSNDQKWCEVSTAKNDGKKRKCEDNEDSPSLQ

SEQ ID NO: 37428 - protein, 357 aa, Oryza sativa (japonica cultivar-group)
MAEARTIGSISVPNVQELAGTCNGIDEEIPERYIRPEVSSDEVIKNNHGDMSIPIIDLDKLISPQSSQEECVKLISACQYWGFFQLINHGVPDEVIANLKNDLVEFFSQPLDAKKEYSQLPNNLEGYGQAFVVSDNQKLDWADMLYLQVCPTDSRDLRFWPNYPASFRHSIDAYSSETENIGLCLLQFMAKAVGVEPKSLLSVFEGQARGLRMNYYPPCLKADKVLGLSPHTDPGGLTLLLQVNDVQGLQINKDGKWFSVNALNGALIVNIGDTLEILSNGKFRSVEHRAVVHPSRERISAALFYYPCQDMVISPLPDFVKDGKVKYKTISYQDLLTEYFTAELDGRNRLKKMKLEP

SEQ ID NO: 37429 - protein, 360 aa, Oryza sativa (japonica cultivar-group)
MVGGFDKLKVEFIDQDESVQVVADTIRSSGEIPERYARPEMEADPVIIDTDGYNLPVIDMSRLINPEFSEEEIAKLGSACEDWGFFQLVNHGVDGELLQRIKDDITEFFRLPLQEKMSVAIPPNGLQGFGHHFVFSKEQKLDWVDLLFLTKRPVEDRTTEFWPTKPPTFRDSLDKYSLEIANVSAKLFKFMAINLGVDEEALLAAFKPEQPQSVRINHYPPCSQANKVLGLSPHTDGVGMTLLLQVNDVQGLQIRKDGRWFAVKNLPGALVVNVGDVLEILTNGKYKSIEHRAVINPDKERITLAAFQSVPLSSTVGPLQELLMKGEARYKTVDGAEFTKGYFAAKLEGRRYLESLKLGV

SEQ ID NO: 37430 - protein, 119 aa, Triticum aestivum
MSKAAAAAAAAASLPPPPPEVAHLVEQLQRHHLAPDASLLSSSAHSDLLQAVYAEAMAMVEEYQHATAAGSAGAAKKLNCSPEVYESLEHHLAVAEAAQRLRLPLLSQDGEVHEEEIES

SEQ ID NO: 37431 - protein, 428 aa, Pseudoalteromonas tunicata D2
MADNKATVHIDGLDPIELPIYSGTAGQDVIDVRTLGAHGYFTYDPGFMSTGSCESSITYIDGAKGILLHRGYPIDELAQNSHYLELCYLLLEGELPTEEQMTLFAREITTNTMMHEKIASFFQGFRVDAHPMAMLCGVVGALSSFYHDDIDINDPAQRKTSAIKLVAKLPTIAAMAYKYTIGQPFVYPRNDLTYAENFLHMMFSVPAEEYKVSPVLAKAMDRIFMLHADHEQNASTSTVRLAGSSGANPYACIAAGIASLWGPAHGGANEACLNMLEEIGSVDRIDEYVGKAKDKNDPFRLMGFGHRVYKNFDPRATVMRQTCHEVLAELNIQDPLLDVAMRLEQIALEDPYFVEKKLYPNVDFYSGIILKAIGIPTNMFTVIFAMARTVGWISHWDEMLSQPGHKIGRPRQLYTGYTKREFVKTEQR

SEQ ID NO: 37432 - protein, 151 aa, Oryza sativa (japonica cultivar-group)
MASSQGLKKNYRCDRSLQQFYTGGPFAVGSSPGGGEGEVEGGEAEAEAFLACACGGEVRLVSAADASAIGEPIEGENEAVTALALSPDSRLLFTAGHSRLIRVWDLASRTCTRSWKWWDCNTFPPTLSSYRVDPNDVPQSISECNVTHIND

SEQ ID NO: 37433 - protein, 184 aa, Triticum aestivum
AYLGDSIEQVCTKKQAGTGPEFPGYRRPTQPEKLKLTIWDTAGQERFRTITSSYYRGAQGIILVYDVAKRESFTNLGDVWTKEIDSNSSNKDCIKMLVGNKVDKDDERTVTREEGLAFAQESGCLFLESSAKTRENVENCFEELVLKILEVPSLLEEGSSSVVKRNILKKQQESHAKYGGRCCQ

SEQ ID NO: 37434 - protein, 194 aa, Saccharomyces cerevisiae
MVTSNVVLVSGEGERFTVDKKIAERSLLLKNYLNDMHDSNLQNNSDSDSDSDSETNHKSKDNNNGDDDDEDDDEIVMPVPNVRSSVLQKVIEWAEHHRDSNFPDEDDDDSRKSAPVDSWDREFLKVDQEMLYEIILAANYLNIKPLLDAGCKVVAEMIRGRSPEEIRRTFNIVNDFTPEEEAAIRRENEWAEDR

SEQ ID NO: 37435 - protein, 688 aa, Yarrowia lipolytica CLIB122
MRFSTSVVAVLTSALAINGVLAIPQVKNPVPQNILEPVQFRVAFAGAEAGKSAAVSWNTYGELSGAPTLRYGLDPDNLSKSASGESNTYATSTTWNHHVVLEGLEPGTVYYYRVEGADVSKTFHFKTALAPGTNKEFTFAAAIDLGVMGEYGLSTWVGEGAEGPLKPGEKNTIDSLLDDFDEYEFLLHPGDIAYSDYWLKEEIQGYLPNTTLEEGIYVYEALLNTYYQQMEGLTAYKQYMVSPGNHEANCNNGGTSDKKNNITYTADMCFEGQTNFTGLRNHFRMPAEESGGVGPMWYSFDYGLVHFVSINTETDFEDAPSSTGMRSGEFGYPGQQLDWLRADLANVDREKTPWVVVSGHRPWYIDAKKKNVCKDCQNAFEDILVDGNVDLVIMGHVHLYERNHPVAHGKVDPNGLNNPSAPWYIVNGAAGHYDGIDFAAGLDEEWIAYTMDGHYGWSSFTVHNCSHLTHEFVFSENNTRLDRQTLFKDRKCKLPIDGGSSVSISPSTSSIPGVESGSGFNGTVTKTESDKKSSVVGTATVSKPKPADETKTVIKPETSTVTETDCEKCHSETNGSLLESAAETAQTEKEQSKAATVVETVHETAVASTKPIVSISSLSPVATAPIASVGPSSVASASESESAAVFQPSTGSAGSTPALANVATLARISPMVMGVALVAVPAFAMQFV

SEQ ID NO: 37436 - protein, 170 aa, Prochlorococcus marinus str. MIT 9313
MIVSDSSPSAWLGLLDNAVLAWGLAACGLAQLSKLIVELIFYRRWRPAVLLETGGMPSSHSALVTGTAAGVGWEMGFDHSGFALAATVAFVVMYDASGIRRAAGFTAARVNLLPVETWPTPPEKQLKESLGHTRFEVLVGSLIGPAVALPGLVFVGSPLHLSQLLGMTLG

SEQ ID NO: 37437 - protein, 457 aa, Escherichia coli
MMEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGGWLLFSGNGGPQATVSNLWDQGGFLPHAFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAAVLVIMLMTRGMAISVYLIPVWLIVLGIGYLFKEKTAKAVKAH

SEQ ID NO: 37438 - protein, 528 aa, Kluyveromyces lactis NRRL Y-1140
MSLDTESFETAEKAIEVVTKEMVSLTNYSAIGSLTSQLSQNDTKSGGIEQKKLPLKPILLCLATSFAGFIFGWDVGTIGGITNMVSFQNFFGTNFDSSSNTHYFPKLLIGLIVSIFNISCALGGLFLVKIADINGRKPGIYAAITIYSLGTLIGWTCGSSWWYFFFARFISGLGVGATAVMIPMFIAESAPINIRGAMVVLYQLMITLGILLGNVINYCCRSTLHETDNATWKIPVGLGNVWAAIVALGVHFMPESPVFLTKRLGSALKAKAAFAHMNNLDVDDPIVDSHIRKMMESADAEVSTHNDMKNSRFEFILGQPRLGFRLFIGIMVMAFQQLSGANYFFYYGTTLFNSVGIEDPYLTSILLSSVNFISTFFGIYLVEKLGRKACLILGSAGMFTCMSVYASVGSFALNKSPQNSGAIMVTFTCVYIMFFACTSGPVSFVVISELFPSRTKAISMAVCTSINWLCNFFISLCTPYVTDKIGFKFGFVFAGCLFVSFWFFTFLLKETKNKTPEQVDALYSIDKQ

SEQ ID NO: 37439 - protein, 228 aa, Plantago major
VQLYELLMGVEEIVGDDNHHTPLLSSSSTSAPYAHTLEQQPHKKGTIWTALAHIITAVIGSGVLSLAWSMSRLGWVAGPLTMLTFAAVSLTSAILLCNCYKSSDLNNGLRNNGSYLDAIQNILGKKSAWAGGIIVRLYFIKLGIVYTITSGISIRAIHRSNCYHFEGHTASCNYGTTFYMLIFGIVQVVASQIPDFTNTKWLSVIAAIMSFMYSGIGSVLGVAKVIEN

SEQ ID NO: 37440 - protein, 689 aa, Arabidopsis thaliana
MVANNNTSSNRRKRIITEGDIATLLLRYDMETILRMLQEISYCSETKMDWNALVKKTTTGITNAREYQLLWRHLSYRHPLLPVEDDALPLDDDSDMECELEASPAVSHEASVEAIAHVKVMAASYVLSESDILDDSTVEAPLTINIPYALPEGSQEPSESPWSSRGMNINFPVCLQKVTSTEGMNGNGSAGISMAFRRKRKRWSAEEDEELFAAVKRCGEGNWAHIVKGDFRGERTASQLSQSCSLYYNLFMHHYLYSVDDEWWILPSLFRVVGGGGSLQTKWALIRKRCHTSTSVSQCGLQGTEAKLAVNHALSLALGNRPPSNKLAIGTSSRRSFPANSSIYVITEDALVWLPLACLNQKLAYLFNCGLMPTTSSCTITETEANGGSSSQGQQQSKPIVQALPRAGTSLPAAKSRVVKKTTASSTSRSDLMVTANSVAAAACMGDVLTAASGRKVEPGKTDAPRVPKTKPVKHASTVCMPQPSGSLSMPKVEPGTSVAASIRSLANGKLKPVMASSSSNKPPLIAPRSEGSSMLSASAPLASLSRIVSNQRVFAGSVPATEIVTCKPDGGQKGQARGNEASSSAAIQPHQITSRNLEISQGKQATQAQSPNLLPRKVPVVRTAVHCATNQKLMDKPSDQTVVPIRGAGSQSKAKGEVNSKVGPVIKVSSVCGKPLEVATVAGTGQGV

SEQ ID NO: 37441 - protein, 138 aa, Haemophilus ducreyi 35000HP
MLQQTLCLIKPDATQRNLIGKIISYLENAGLKIKAIKKLQLTQAQAEKFYLEHQDKPFFASLVGFMISAPIVAIVLEGENAIAHYRELMGATNPEQREAGTIRALYAISNQENSVHGSDSETSAKREIDYFFSKEEIC

SEQ ID NO: 37442 - protein, 234 aa, Triticum aestivum
KRVPLLAAHGRQGPDTGWTRGAPAGGPTAASAPSAKGGGSPPKGGAPPAPGGGHPPQGTLGGGPVGSGIPLSKGEEHPVVGLAIGGAEGVNPNFNLVKGRGGPLFPKEMVEPASGKFVLVVDETKLVTALGGSALPIPVEVVQFCWKHNQVRLQGLFNEEGCEANLRLNEDGNPYVTDNSKYIVDSHFKTPIRDALGAGKAPPPPEGVFEHGLFLNMATSVIIAGSDGVSVKTK

SEQ ID NO: 37443 - protein, 229 aa, Plantago major
LVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPILLTEAPLNPKANREKMTQIMFETFNTPAMYVAIQAVLSLYASGRTTGIVLDSGDGVSHTVPIYEGYALPHAILRLDLAGRDLTDSLMKILTERGYSFTTSAEREIVRDIKEKLAYIALDYEQELETSKTSSAV

SEQ ID NO: 37444 - protein, 503 aa, Glycine max
MAISIPSRQLFIDGEWKVPLLNNRFPIINPATEDIIGHIPAATKEDVDLAVDAAKRAFSHNKGKDWSSAPGSVRARYLRAIASKITEKKDELGKLEAIDCGKPLDEALADLDDVIGCFNYYAELAEGLDAKQNAPVSLPMETFKSYVLKEPIGVVALITPWNYPLLMATWKVAPALAAGCTAILKPSELASVTCLELAEICREVGLPPGVLNIVTGLGNEAGAPLSSHPDVDKISFTGSSATGSRIMTAAAQLTKPVSLELGGKSPIIVFEDVDLDKTAEWTIFGCFFTNGQICSATSRLIVHESIATEFVNRLVQWAKNIKISDPFEEGCRLGPIVSEGQYKKVLNCISTAKSEGATILIGGSRPEHLKKGYFVEPTIITDVTTSMQIWREEVFGPVLCVKTFSTEEEAIELANDTHYGLGSAVMSKDLERCERISKAIQAGIVWINCAQPSFIQAPWGGVKRSGFGRELGEWGLENYLSVKQVTKYISDEPWGWYQSPSKL

SEQ ID NO: 37445 - protein, 424 aa, Zea mays
MENLRSQNCHQGVAMEGVKFAPEKANTNRRALSDIKNIIGGPHQHLAVSKRALSEKPAAAAAANAKDQAGFVGHRPVTRKFAATLATQPTVALLDPIGSERLKRNADTAFHTPADMESTKMTDDSPLPMVSEMDEMMSPELKEIEMEDIEEAAPDIDSGDAGNSLAVADYVDEIYRFYRKTEGASCVPTNYMSSQTDINEKMRGILIDWLIEVHYKLELLEETLFLTVNIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIELSLVEYEMLQFCPSMLAAAAIYTAQCTINGFKSWNKCCELHTRYSEEHLMVCSRMMVELHQRAAHGKLTGVHRKYNTSRYSYAAKSEPATFLLDA

SEQ ID NO: 37446 - protein, 285 aa, Triticum aestivum
  misc_feature (184)..(184): Xaa can be any naturally occurring amino acid
  misc_feature (207)..(207): Xaa can be any naturally occurring amino acid
  misc_feature (227)..(227): Xaa can be any naturally occurring amino acid
MPAMYALTPRCTLPPHRRAPPPCRAASPTPAALARADPDELRSTWPQRAWTLAGSAAVLSSLSASASLAADSGSYAEPLAVALAAYTVADLATGVYHWLVDNYGDASTPLVGAQIAVFQGHHRHPSSITRREPCNNLHALARAVALALPAVEAAGAVAHAPGAEHAFVGTFAACVVLSHQVRAXAHEKHRQLPAGVQALDACGVLVXRAQDAAHHLQPYRTNYCILXGLWNGVLDRHKGFEALGNCRLRSGTAVRPGPLGPHPLPLGWGGTPRVRHPRPLVPDRL

SEQ ID NO: 37447 - protein, 325 aa, Ehrlichia ruminantium str. Welgevonden
MANDFYTTLTELKSLIQQDLDEMEHLILYQDNKNITLITEIIQHLIKSGGKRIRPIIFFIICKMLNYNKNDKVYIAAAIEFIHNATLLHDDVIDESELRRGEKTSNFLWGNKASILVGDFLLAVSFQWLIQCKNLTILSILSKTSNTIIIGEVEQMVASYNINISQEKYIDIISAKTASLFEATCESAANLAEVNNEKIHALKQFGYNLGISFQILDDILDYTASETQFGKKLGNDLLTGKITLPIIIAYQNANHQEKKFWTQLSTNPDINKAMFYIKSHSAIEQALNIASTYIDKAKSSLNIFANSDYKQILDKLLNSILYRNF

SEQ ID NO: 37448 - protein, 470 aa, Ehrlichia ruminantium str. Welgevonden
MFLSAEDTLNYIKKNTINFVDLRFTDSTSRWHHITRNAETINTYVLSSGVNFDSSSIPGWQSVEKSDMILLPDVSTAFVDPFTAQPTLVIICNVINPYDKSEYPKDPRYTAHKASQYMLSTGIADKCYFGPEVEFFVFDNATFYNGMYHSYFKIESSEHISQFQKREHINNSHCPKIKGGYMPTPPVDSLHDLRSEILTMLKEVGITPLIHHHEVAASQCEVGFQHDELIRSADNVQKCKYIIHGVASSYGKTATFMPKPVIGDNGSGMHCHQSLWKDNINIFVNSDGSMSEICLYYIGGIIKYGKAINAFTNPSTNSYKRLVPNFEAPTWLTYSYENRSSAIRIPYVPNTDLNAKRIEVRFPDPLANPYLCFSAQLMAGLYGIKNKIHPGPSIDKNLYTLDKKELQSFISVANSLEESLDALDNNREFLLEGDVFTNDQIDTYIKLKSSEVRDLHLHPHPIEFINYYSS

SEQ ID NO: 37449 - protein, 458 aa, Aspergillus nidulans FGSC A4
MSTKLDKSLDEILVNRQPRNRRRTARRKAANAAAPVGGVQKITKGAKPAGKAVQNGHPAPTESKIMVSGLPADVNEANIKEYFSKSAGPVKRVMLTYNQNGTSRGIASIVFREPDTAAKAAKELNGLLVDGRPMKIEVVVDASHAPTVPAPKPLSDRVAQSKPQPKPATNAKNANAARSGRGGRGRGRGGKARGNRPKPKTAEELDAEMVDYFNASNENGASAEVNAAAGSAPQQPAAGEDLGMAEISVIPKKPSATWWHSEYRVDFARGQDTLFVAALQVNASFKYGVGLCVNGVFKDLNDLHIASARRATVTYPSAAQDCLCYLTDVMEEAPLSQPNSSPYMDAVGRCLFPPHFHLRVSHPNQNSSQVQVEDTMEKNQDGRAKDKNHHTGKDTEQFCCNDKFEVEDEGDEDEPAAQDAKTQFTHAITLVIASSYTLTVPWPSRVLLLPLKGGKSMF

SEQ ID NO: 37450 - protein, 174 aa, Glycine max
  misc_feature (9)..(9): Xaa can be any naturally occurring amino acid
  misc_feature (82)..(82): Xaa can be any naturally occurring amino acid
  misc_feature (90)..(90): Xaa can be any naturally occurring amino acid
LYVSCAQTXLLDSKEYLAPVITPFEAMIAFNRGSQWTGAYVMEFRDLINLPQMGVGNQEEEEARFSFLKGGYVEDFENQDHXIINFFYHXACISSENVEEERETLALVNATEKALQLRNNSNVLMKGSARSGAEFLANRSYQGLNMSSENTSPEPYLIGRRGRASGYEDEKNKQ

SEQ ID NO: 37451 - protein, 363 aa, Corynebacterium diphtheriae NCTC 13129
MKAARYYDQKDIRIEEISEQPLLPGTARIKVAWCGICGTDLHEFLEGPLFVPEHHHPHPVSGEDSPVTLGHEMSGVITEVAEDVTDLAVGDHVVVEPYLIHDDVDTSEANPFYHLSRDMNFIGLAGGGGGLSENIVVKRRWIHKISPDLPLDEAALIEPLSVGYHAVERAGFASEEAAKGKVALVGGAGPIGLLTASVLKAFGATVVISELSPLRRKKALDSGAADYALNPAEVDVVEEIAKLTDGKGADVAFECTSVQVVLDTLMDAVRPGAVIVVVSIWSKRSNFDIHKLVMKEIDLRGTIAYSHAHPNTIKLVESGKINLKPFITGKIALQDIVDKGFDTLINHNETAVKILVSPSGVGL

SEQ ID NO: 37452 - protein, 120 aa, Campylobacter jejuni subsp. jejuni NCTC 11168
MSNYPKAIGPYSAYREVNGLLFISGQLPINPASGEIESSDIKEQTKQSLKNIGAILEENGISYDKVIKTTCFLADINDFVAFNEIYAEFFKAPYPARSAFAVKDLPKKAKVEIEIIAQKG

SEQ ID NO: 37453 - protein, 406 aa, Ehrlichia ruminantium str. Welgevonden
MFIEVLMPALSPTMTSGIIRKWYKSEGEEIKSGDIIADIETDKAVMEFEYTDEDGIMGKIIVAEGTKNVLVNQLIALIVTDKLDLKEVDAYVSSSTASKTEKASVVLQGEEEIKNDVVTISEPKRIKISPLAKKIASDFAIDINSIQGTGPYGRIVKADVLDAASKKENNVEIIPTSNGENTFIEVSSMRKVIAERLVYSKQMIPHFYVSVDCKVDDLLKVRLEINAENFGTKITINDFIIKAVSMSIKKFPEINVSWDDNDKIIAFANVDISVAVSIDDGLITPIIRNADKKSLLEISNEVKMLASKAKTGKLKPEEFQGGGFTISNLGMFGIKEFNAIINPPQSCIMAVGCSDKRAIIVDDQICISNVMTVTLSVDHRVIDGVLAAKFLNCFKSYIEKPYLMLI

SEQ ID NO: 37454 - protein, 248 aa, Thiobacillus denitrificans ATCC 25259
MTGFKDHFSSGSEGYAAYRPDYPATLFAWLSSLCAERRLAWDCATGSGQAARGLAAHFPRVVASDASAEQVRHATPHPGVDYRVATAEASGLAERSVDLVTVAQAAHWFDLPRFYAEVARVLKPAGVAALWGYGRIVLPGAMDAPLRYFYAETVGPYWPAERALIDDAYRGLDFPFVEIPPPAFAIEVAWTLPRLIDYLSTWSAVKRFQTARGRDPLPALNAELAPLWGDANAAMTLRWPLFLRVGRV

SEQ ID NO: 37455 - protein, 463 aa, Frankia sp. EAN1pec
MRNSITVARLVRHVEARRLRGQDDAGRRRPRVVVVGSGYAGLGVLRHLEARLPAGAAELVLVSPTDHLLYTSLLPQVAAGDIEPRHLAVSVRGALRRTVPHLGHATAVDATRREITVVGMTGEPSTLAWDRLVLAPGALTRTFDIPGLAEHGLGMKNLAEAVYLRDHVLRQLEYADASDSDAERRARCTFVVVGAGYTGTELAAQMRRFTVEALGQFPRLDAAQIRWLLLDLAPRVLPELDERLGAGAAKVLRERGVEVRLETSVTEVRADAVTLTDGAVIPSHTLVWCAGVTPNPLMSRLGAETVKGRLVVDENFQVPGLDGVFALGDAAAVPDVTKGGAPAGQTAQHAVRQGGAAGRNVAASLGYGRMRPYRHRDLGFVVDLGGADAVANPLGLPLSGPLAAAVTRGYHLLALGAAANRAYVGADWLLGAVARPRVVQLGFLPPPNATIAQVEQTELYGAP

SEQ ID NO: 37456 - protein, 226 aa, Plantago major
KMAPENKIVDQVSGWLTLYEDGSVDRSWTGPPEVKFMTDHVPPHNHFIDEVATEDITTSDGLKLRIYTPEKQENDDEKLPIILHFHGGGFCISEADWYMYYVIYARLARAAKAVVVSPYLRRAPEHRLPAACDDGFAALLWLQSIAKGESNHPWLHDHADFSRVFLIGDSSGGNVVHQVAARAGDTPLNPLKVAGAIPIHPGFCRAERSKSELEKPETPFLTLDMA

SEQ ID NO: 37457 - protein, 458 aa, Listeria innocua Clip11262
MAQTSTIQNDTKAAEEYAARVFETIKQRNPGETEFHQAVEEFLNSVIPALAKEPKYEAHGILEQLTEPERLISFRVPWVDDAGTVQVNRGYRVQFNSAIGPYKGGLRFHPSVTGSIVKFLGFEQIFKNSLTGLPIGGGKGGSDFNPKGKSDAEVMRFCQSFMTELQKHIGPDTDVPAGDIGVGGREIGYLFGQYKRLRGAYDAGTLTGKGLSYGGSLARTEATGYGLVYFTVEMLEAAGESIRGKKIVVSGSGNVAIYAIEKAHELGAKVVACSDSAGFVYDKEGIKVETVKQLKEVERKRISEYVTLHPSAEYYAGGDVWSVPCDIALPCATQNEINADQARALVKNGVIAVAEGANMPSTLEAVDIYHENKVLFGPAKAANAGGVAVSALEMAQNSTRMSWTFQTVDEHLQNIMKDIYKNSSNAASEYGAPGNLVVGSNIAGFLKVADTMIAHGII

SEQ ID NO: 37458 - protein, 538 aa, Saccharomyces cerevisiae
MSSVAENIIQHATHNSTLHQLAKDQPSVGVTTAFSILDTLKSMSYLKIFATLICILLVWDQVAYQIKKGSIAGPKFKFWPIIGPFLESLDPKFEEYKAKWASGPLSCVSIFHKFVVIASTRDLARKILQSSKFVKPCVVDVAVKILRPCNWVFLDGKAHTDYRKSLNGLFTKQALAQYLPSLEQIMDKYMDKFVRLSKENNYEPQVFFHEMREILCALSLNSFCGNYITEDQVRKIADDYYLVTAALELVNFPIIIPYTKTWYGKKTADMAMKIFENCAQMAKDHTAAGGKPVCVMDAWCKLMHDAKNSNDDDSRIYHREFTNKEISEAVFTFLFASQDASSSLACWLFQIVADRPDVLAKIREEQLAVRNNDMSTELNLDLIEKMKYTNMVIKETLRYRPPVLMVPYVVKKNFPVSPNYTAPKGAMLIPTLYPALHDPEVYENPDEFIPERWVEGSKASEAKKNWLVFGCGPHVCLGQTYVMITFAALLGKFALYTDFHHTVTPLSEKIKVFATIFPKDDLLLTFKKRDPITGEVFE

SEQ ID NO: 37459 - protein, 103 aa, Listeria innocua Clip11262
MLSDLYEEIKLRKTQPKEGSYTNYLFEKGLDKILKKVGEETTEVVIAAKNNNEELISEITDLTYHLLVLLAEKDIPLEDIKQELQSREGKLSKTSDRKEINDL

SEQ ID NO: 37460 - protein, 558 aa, Oryza sativa
  misc_feature (303)..(303): Xaa can be any naturally occurring amino acid
MDKLGANPANSCALTPLGFLERAATVFGDCPSVVYHDTVFTWSQTHRRCLRLASALVSSLGISRGDVVSVLLPNVPAMYEMHFAVPMSGAVLNSINTRLDARTVSVLLRHSGSKLIFVDPALLPVLRDALRLLPAGHTAPRVVLVEDPHEKEFPPAPAAALTYERLVEKGDPEFAWVRPASEWDPMILNYTSGTTSAPKGVVHCHRGIFLITVDSLVDWAVPPRPTYLWTLPMFHANGWSFPWGMAVVGGTNVCLRRVDAAEVFDTIARRGVNHLCGAPVVLNMLANAPEGVRKPLPGKVRIXTAGAPPPAAVLYRTEAIGFEVSHGYGLTETAGLVLWCAWKGEWDKLPASERARLKARQGVRTPGMAEVDVVDGETGRSVPRDGSTMGEIVLRGGCITLGYLNDEAATKAAIRDNGWFYTGDVGVMHPDGYVEIRDRSKDVIISGGENISSVEVESVLYGHPAVNEAAVVARPDEFWGETPCAFVSLKQGGGAVTAADVVAWSRERMPRYMVPKTVIFRDELPKTSTGKIQKYVLRNIAKEMGPTTGTNTKRNSKM

SEQ ID NO: 37461 - protein, 974 aa, Zea mays
  misc_feature (135)..(135): Xaa can be any naturally occurring amino acid
MTPLLLLRLLCLVPLVTAACAEAKLPADFTTLLAAKFSLADPGSALDAWDSRLSPSPCRWPHILCSNRSVSDAPAVASLLLSNLSLAGAFPSSLCSLRSLVHLDLCFNCLTGPLLPCLAALAALTHLGLGGGELXGQGPGAYGARGRYLATLSLAGNNLYGAFPGFLFNITTLHELLLAYNPFAPSPLPEDVSGPTQLSQLWLAGCGLIGEIPPSIGSLSSLVNLDLSTNNLTGEIPSSIRRMDNVMQIELYSNRLTGSVPEGLGALKKLRFFDASMNRLSGEIPADVFLAPRLESLHLYQNELSGRMPATLGQAPALADLRLFTNRLVGELPPEFGKNCPLEFLDLSDNRISGLIPAALCNAGKLEQLLILNNELIGPIPAELGQCRTLTRVRLPNNRLSGPVPQGLWSLPHLYLLELAGNMLSGTVDPTIAMAKNLSQLLISDNLFTGALPAQIGTLPALFELSAANNMFSGMLPASLADVSTLGRLDLRNNSLSGNLPQGVRRWQKLTQLDLAHNHLTGTIPPELGELPVLNSLDLSNNELTGDVPVQLENLKLSLFNLSNNRLSGILPPLFSGSMYRDSFVGNPALCRGTCPSGRQSRTGRRGLVGPVATILTVASAILLLGVACFFYTYHRSHNGGHPAEPGGGDGGGKPRWVMTSFHKVGFDEDDIVGCLDEDNVVGMGAAGKVYKAVLRRGGEDVAVAVKKLWSGGGKATGSTAKESFDVEVATLGKIRHRNIVKLWCCFHSGDCRLLVYEYMANGSLGDLLHGGKGGLLDWPARHRIMVDAAEGLAYLHHDCGPPIVHRDVKSNNILLDAQLGAKVADFGVARVIGDGPAAVTAIAGSCGYIAPEYSYTLRVTEKSDVYSFGVVMLELVTGKKPVGAELGDKDLVRWVHTGIEKDGVDSVLDPRLAGESSRDDMVRALHVALLCTSSLPINRPSMRIVVKLLLEAAPRARPLESKPKAAEEKPLDV

SEQ ID NO: 37462 - protein, 105 aa, Listeria innocua Clip11262
MNTVDFSKGLVPTIILDDQNGEVLMLAYMNQESYQKTLETGYTWFFSRSRNELWNKGETSGNTQKVKQIWTDCDNDTLLIRVIQTGPACHTGKKSCFFNLIKEDF

SEQ ID NO: 37463 - protein, 235 aa, Ashbya gossypii ATCC 10895
MSSVLYTHPPRPEKIPASATSQKMSEFINEDPKILDEAQLPQRAEDAQDWSGLALSKPAQERQKQLLQLTVRDTQLVRDVALLDTLLTQAAPPLSYSSDSDSDEADPVDPQEIYDLIAHISDPEHPLTLGQLAVVNLPDIEVRDSGDPHEIAEVVVRITPTITHCSLATLIGLGIRVRLERSLTPRFRITVLLKKGSHQSENQVNKQLNDKERVAAACENEQLVEVVSKMLSTCK

SEQ ID NO: 37464 - protein, 376 aa, Dunaliella viridis
MATSMAKSAFTGNMAGLKNFQRVQPARGAVKMEVVAQKKVRVAINGFGRIGRNFLRCWEGRKDSLLDVVCVNDSGGVKQASHLLKYDTTLGKFDADVKAVDDKTISVNGKNIAVVSSRDPTQLPWKAMDIDLVIEGTGVFVDTPGAGKHIQAGAKKVLITAPAKGNDIPTFVVGVNCDGYNHSYPIISNASCTTNCLAPFVKVLHEKFRIVKGTMTTTHSYTGDQRLLDASHRDLRRARAAALNIVPTTTGAAKAVALVLPDLKGKLNGVALRVPTPNVSIVDLVVQVEKKTFAEEVNNAFREAAAGPMSNVLAVADEPLVSADFKGMDQSTAIDSALTMVMGDDMVKVVAWYDNEWGYSQRVVDLAELTAQRWAA

SEQ ID NO: 37465 - protein, 108 aa, Triticum aestivum
YCNKHVQAKPADAADAGAAAPDAAAPPAEDLKNWDAEFVKVDQATLFDLILAANFLNIKGLLDLTCQTVADMIKGKTPEEIRKTFNIKNDFTPEEEEEIRRENQWAFE

SEQ ID NO: 37466 - protein, 362 aa, Eustoma grandiflorum
MGIPVVPRVESLARSGTQEIPKEYVRTKEELTSIADVFAEEKNDEGPQVPMIDIKDIESEDISVRERCRDVLNKAAMEWGVMHLVNHGISSDLIRRVKSAGQAFFDLPVEEKEKYANDQASGNVQGYGSKLANNASGQLEWEDYFFHCIFPEEKRDMTIWPKTPEDYIPSTNEYAKQLRALASKILAVLSLGLGLEPGRLEKEVGGLEELILQRKINYYPKCPQPELALGVEAHTDISALTFILHNMVPGLQLFYEGKWITAKCVPNSIIMHVGDTIEILSNGKYKSILHRGLVNKEKVRISWAVFCEPPKEKIVLKPLPETVSESEPARFPPRTFAEHIKHKLFRKSEETNEDNNLPKGSS

SEQ ID NO: 37467 - protein, 153 aa, Nicotiana benthamiana
MKMIVLRSSDGETFEVEESVALESQTIKHMIEDDCADTSIPLPNVTSKILAKVIEYCKRHVDAASKTEDKAVEDDLKAFDADFVKVDQSTLFDLILAANYLNIKRLLDLTCQTVADMIKGKTPEEIRKTFNIKNDFTPEEEEEVRRENAWAFE

SEQ ID NO: 37468 - protein, 523 aa, Roseovarius nubinhibens ISM
MIQDTHDRLLIIDFGSQVTQLIARRLRELNVYCEIHPYQNVTDAFLAEFAPKAVIFSGGPDSVMRDGSPRPPKSVYDLGVPILGICYGQQVMMHDLGGRVEAGEHATAEFGRAFVTPSEDRIDLLTGWFMDGSGREQVWMSHGDHVAEIAPGFSVYGTSPGAPFAITADEDRKFYAVQFHPEVHHTPNGKTIYENFVRAAGFSGDWTMGAYREEAIRKIREQVGDKQVICGLSGGVDSSVAAVLIHEAIGDQLTCVFVDHGLLRLNEADEVVKMFRDHYNIPLIHADESELFLGELDGVSDPETKRKIIGRLFIDVFQKHANSIDGAEFLAQGTLYPDVIESVSFSGGPSVTIKSHHNVGGLPEKMGLKLVEPLRELFKDEVRALGRELGLPDSFIGRHPFPGPGLAIRCPGEITREKLEILRKADAVYIDQIRKHGLYDDIWQAFVAILPVRTVGVMGDGRTYDFACALRAVTSVDGMTADYYPFSHDFLGETATRIINEVRGINRVTYDVTSKPPGTIEWE

SEQ ID NO: 37469 - protein, 335 aa, Eustoma grandiflorum
MKVQRVQEIASLSKVIDTIPAEYIRSENEQSVISTVHGVVLEVPVVDLSDSDEKKIVGLVSEASKEWGIFQVVNHGIPNEVIRKLQEVGKHFFELPQEEKELIAKPEGSQSIEGYGTRLQKEVDGKKGWVDHLFHKIWPPSSINYQFWPKNPPAYREANEEYAKRLQLVVDNLFKYLSLGLDLEPNSFKDGAGGDDLVYLMKINYYPPCPRPDLALGVVAHTDMSAITVLVPNEVQGLQVYKDGHWYDCKYIPNALIVHIGDQVEIMSNGKYKSVYHRTTVNKEKTRMSWPVFLEPPPDHEVGPIPKLVNEENPAKFKTKKYKDYAYCKLFKLPQ

SEQ ID NO: 37470 - protein, 204 aa, Oryza sativa (japonica cultivar-group)
MILEQFDESAAEKADAAMVVAPPSNFGMVDTGVYRSGFPDPASFGFLRGLGLRSVVYLCPEPYMETNAEFLKAEGIRLFQFGIEGNKLCLTTGEEDPNVSIPVDAIMGALRVILDVRNHPVLIHCKRGKHRTGCLVGCFRKLQNWCLSSVFEEYHRYAAGKSRLSDLKFIESFDVNCMTDCLLRLIYHYHGCLQKSKRLAYSER

SEQ ID NO: 37471 - protein, 181 aa, Arabidopsis thaliana
  misc_feature (10)..(10): Xaa can be any naturally occurring amino acid
  misc_feature (144)..(144): Xaa can be any naturally occurring amino acid
MAASMLSSFXFVTSPAQATMAGPFTDMKSFAFFPDTRKANNDITFITNNGGRINFLKAWPPFEKKTVGTLYYLPDLTDVELAKEVDYLLRNKRIPCVEFHLEHGFVYREHRNTTGYYDGRYWTMRKLTLIGCTDYAQVLKEVEXCKKDYPGALIMIIGINNTRHVQSITIIAYKRSSFTDA

SEQ ID NO: 37472 - protein, 400 aa, Campylobacter jejuni subsp. jejuni NCTC 11168
MSDIISIKDIDLAKKKVFIRCDFNVPQDDFLNITDDRRIRSAIPTIRYCLDNGCSVILASHLGRPKEISSKYSLEPVAKRLARLLDKEIVMAKDVIGEDAKTKAMNLKAGEILLLENLRFEKGETKNDENLAKELASMVQVYINDAFGVCHRAHSSVEAITKFFDEKHKGAGFLLQKEIDFASNLIKHPARPFVAVVGGSKVSGKLQALTNLLPKVDKLIIGGGMAFTFLKALGYDIGNSLLEEELLEEANKILTKGKNLGVKIYLPVDVVAAPACSQDVPMKFVPAQEIPNGWMGLDIGPASVRLFKEVISDAQTIWWNGPMGVFEIDKFSKGSIKMSHYISEGHATSVVGGGDTADVVARAGDADEMTFISTGGGASLELIEGKELPGVKALRSKENE

SEQ ID NO: 37473 - protein, 423 aa, Kluyveromyces lactis NRRL Y-1140
MRVIRQLHTSKRLLQSLVDKQKYQATTYARPNHLVLTRGKNAILYDDVNNKEYIDFTAGIAVTALGHANPEVAEIMYKQSKKLIHSSNLYYNEECLKLSENLVEATKSFGGQYDASRVFLCNSGTEANEAALKFAKRYGILKSPSKQGIIAFQNSFHGRTMGALSVTSNPKYREPFGSLIPGVEFLNINDELTKLDQQVSSLKEKTAGLIVEPIQGEGGVFPIPLDTLVGLKKICEDHDIIVIYDEIQCGLGRSGKLWAHSYLPKEAHPDIFTTAKALGNGFPIAATVTNDKVNDILKVGDHGTTYGGNPLGSAVGNYVVNVIAEQKFLDEVNKKGEIITNRLRKLQERFPEHIKDIRGKGLMIGCDFDEAPAKIVDAARDSGLLIITAGKTTVRFVPALTIEDNLLEKGLNIFEKAVEKVYS

SEQ ID NO: 37474 - protein, 367 aa, Debaryomyces hansenii CBS767
MSLDSTKLEITKTTTPKEKLPNDQLIFGKTFTDHMLEIEWTQENGWGVPKISPYHNFSFDPSTVVFHYAFELFEGMKAYRDTNNQIRTFRSDKNMIRMNQSAERIALPTFDGEELMKLIDKFLITDESFVPQGAGYSLYLRPTLIGTTASLGVGTPDKALLYVIASPVGPYYGTGFKPVSLEATDYAVRAWPGGVGNRKLGANYAPCILPQLEAAQRGYQQNLWLFGDEGYVTEVGTMNVFFAFKDSEGKKELVTAPLDGTILEGVTRDSILQLCKERLPSEWTVVERKFTIHEIEERAAKGELIEAFGAGTAAVVSPIERIGWKGKDISVPITAGDAGELTTQVAEWIRKIQYGEEEYKNWSRVAK

SEQ ID NO: 37475 - protein, 338 aa, Debaryomyces hansenii CBS767
MAFLFKRNPKTAPDLVRVLNDQVAKLDLNNDNNKKYQDECSRYLKQIKVILHGGDDSEPQPEQISQLAQEIYSSDCLYHLISNMRKLDFDSRKDVLILFLTLLRRQIGSTSPTVSYLLNSKPDILVLLMKGPETQETGLICGQILRDCIKFEAINKFIINNPLFWSYFKYVQIPIFEIATDSFITLHDLLTTHKKLVSEFLASNYEIFTSHINQLIQSNNYVTKRQSVRLLAELVLQRQNQFFLNKYFDDTNNLKLIMLLLSDKLKNLQIEGFHIFKFFVAKPKKSQKILDILIKNKENFIAFFRNFNINSFNDSNLIDERDYILNEIQKLPDIERIN

SEQ ID NO: 37476 - protein, 239 aa, Triticum aestivum
SIVPIEQVCTKKQAGTGPEFPGYRRPTRPGAVRKGERLVPAGTLDLFMRCTFPVPNARVKATERFEAAYPIIKELALVGTPGSKAVKQASQQLLPLAVKAMQENNAELAKEATDVFIWCLTQSPESYKLWDKLHAENIQASVAVLRKITADWKTLSPKLNSEALKATLKSLKAKNEAALEEAEDSGEKASIKEADKYCKAIIGRLSRGATCLKGSLLVIALAGGAGFMLSPNLDLTARP

SEQ ID NO: 37477 - protein, 889 aa, Desulfovibrio vulgaris subsp. vulgaris str. Hildenborough
MCGIAGIISRKDRNVSSQPLNRMLTSQEHRGPDAGYGVSFRRQSTGAFAAGRRHSADALAAGLEPAPVWLGHRRLSILDLSDKSAQPLRRGDLHIVFNGELFNYIELRSELTALGEHFETSGDTEVLLASYRHWGAGCLERFNGIFAFAIFDASRGSLFAARDPFGVKPFHYGVKPFHYAVTHDFLIFASEIKAISASGLVLRKWDPDVASAYLSYALTTAPQGRTFFENIRQIPPGHCLTLASPDDEPSVTRYYAPRITETPRSLHELVDEGAGLIRQSCRIRMRSDRDVGLCLSSGIDSANVAAALVAEGIAPECYSIDAASSSMLDEFPLITALADKLGLHVNPIRHPDAIPTADIVRYMLFNDEPSLFWGSYNQFHLYREMRKLGVIVSMSGHGGDELFCGYQRYYPAVVRDMLAQRRIMSLIWWCLRQSRHLMQDRRTIRSTWDSYSHPLGWANDYAHDIAALHLKHTIADPEEWISTFVGASSWGEQQQKSLFTYELQYLLRDADRNSMAHGIEERVPLLDTRLYEFCASVPLKDLCQDGYLKGLARQLFPAIPESLRFHQIKRGLYTDISSKLPQLQADLMPLVHRSPLLRELVDLQKLPQQLPGIVWWRLCSLAVLDVSGIEEWTAQTPLPRLVDDEMAERIGGVPSGTGRTAVIRHVLDEGLSYLEPGALHGLAETVGLIESAAIPGCIIEAGCALGGSTMVLATAKAKERPLHVFDVFGCIPPPGSNDGEEARARFAVIAAGESTGLNGKRYYGYEPDLLKNVQDNFVALGLPPAEHGITFVPGLYENTLYPSGPVALAHIDCDWYQSVKTCLERIAPHISPGGRMIIDDYDHYSGCRRAVDEFLEASNGQFIRERYARVHLVRTKADGQETDVHRPGD

SEQ ID NO: 37478 - protein, 194 aa, Listeria innocua Clip11262
MRSASKTRITGETSIELSINLDSQADSTISTGVGFLDHMLTLFSKHSRITLNVKADGDTYVDAHHTVEDVGITLGLCLKEALSDKASINRYGSSYVPMDESLGFCALDLSGRSYLVFDAELTNPKLGDFDTELVEEFFQAVAFNTEMNLHLRVLYGKNTHHKIEALFKAFGRALREAITINPEIKGVNSTKGVL

SEQ ID NO: 37479 - protein, 453 aa, Campylobacter jejuni subsp. jejuni NCTC 11168
MSECPFFPKPYKNKASTLLTFLLKRRSWLDGLYERSYKMQTGYVKMPNFDLYVINDTKEVKRMMVDEVREFPKSAFLHELLSPLLGESIFTTNGEVWKKQRELLRPSFEMTRINKVFNLMSEAVADMMDRFSKYPNHAVIEVDEAMTFITADVIFRTIMSSKLDEEKGKKILNAFVTFQEQSVHTAMRRMFRFPKWLSYVLGDCKRAKAGDVIRQVLSDIIKPRYDMADNAEFEDILGSLLLVVDADTNKRFSFEEILDQVAMLFLAGHETTASSLTWTLYLLSLYPKEQEKAYEEITQVLQGGVIEISHLRQFKYLTNIFKESLRLYPPVGFFAREAKKDTQVRDKLIKKGSGVVIAPWLIHRHEEFWTNPHGFNPSRFEGEYKKDAYLPFGVGERICIGQGFAMQEAILILANILKTYKLELEEGFVPDVVGRLTVRSANGMRIKFSKRKL

SEQ ID NO: 37480 - protein, 356 aa, Oryza sativa (japonica cultivar-group)
MENMRSENFNQGVSMEGVKHAPEMANTNRRALRDIKNIIGAPHQHMAVSKRVSLMGLNFLTCFSKPAAKNQAGHRPMTRKFAATLANQPSSAPLIYMQKLEMAPIGSERQKRTADSAFHGPADMECTKITSDDLPLPMMSEMDEVMGSELKEIEMEDIEEAAPDIDSCDANNSLAVVEYVDEIYSFYRRSEVHYKLELLDETLFLTVNIIDRFLARENVVRKKLQLVGVTAMLLACKYEEVSVPVVEDLILICDRAYTRTDILEMERMIVNTLQFDMSVPTPYCFMRRFLKAAQSDKKVGQKHTGASIFVLIYSSFAMECSKMMVELHQKAGHGKLTGVHRKYSTFRLLPIKSVGT

SEQ ID NO: 37481 - protein, 521 aa, Triticum aestivum
MGNQNGTPGNDYYNRFPREHPASRPTAAGILRQGLDPTSISVLGRKTADLREHYILGRKLGQGQFGTTYLCTEISTGCDFACKTILKRKLITKVDVEDVRREIQIMHHLSGHKNVVSIKDVYEDVQAVHIVMELLPGGELFDRIQGNGRYSEMKAAEITRIVVSIVAMCHSLGVMHRDLKPENFLLLDKDDDLSIKAIDFGLSIYFKPGQVFSELVGSPFYVAPEVLHKRYGPESDVWSAGVILYVLVSGVPPFWADTQKGIFDAVLKGHLDLESDPWPKISDSAKDLIRKMLCNCPSERLKAHEVLRHPWICQNGMATDGVLDPSVISRLKRFSAMNNLQKLALRVIAERLSEEEIAGLRELFKTVDIKNRGVITFGELRKGLTRYGNELVDTEICDIMEAADTDTDVTINYEEFIAATMPLNKIEREEHLKAAFTYFDKDGSGYITVDKLQRACAEYNMEGTLLEEIILEADQNNDGQIDYAEFVAMMQGNANGGNIGLGRPTMETSLNVTLRDAAQVH

SEQ ID NO: 37482 - protein, 464 aa, Listeria innocua Clip11262
MTYKFPDNFWWGSAASGPQTEGAANVDGRKPSIWDHWYKIEPGRFFNDVGPTNTSNFYYQYKEDIALMKQTGHNSFRTSIQWSRLIPDGIGEVNPKAVDFYNRVIDEMLANNVEPFMNLYHFDMPMSMQEKGGFESREVVDAYATFAKTCFELFGDRVKHWFTFNEPIVPVEAGYLYDMHYPNVVDFKRATQVGYHTTLAHALAVKEFHALEIPEGQIGIILNLTPSYPRSQNPADLKAAHIADLIFNRSFLDPVTKGEFPADLVEIIREHDALPEYTEEDLAIIKNNIIDILGVNYYQPRRVKAKEYAAHPDAPFMPEHLFDNYEMPYRKMNPYRGWEIFERAIYDIAINLRDNYDNIPFFISENGMGVEGESRYRNADGMIEDTYRIDFIKSHLKWLHKAIEEGSNCHGYHLWTFMDCWSWANAYKNRYGLVEVDLDNDFKRTVKASGHWYKELSENNGFED

SEQ ID NO: 37483 - protein, 566 aa, Artemisia annua
MDLRRKLPPKPPSTTTKQPSHRSHSPTPIPKASDALPLPLYLTNTFFFTLFFSVAYYLLHRWRDKIRSGTPLHVVTLTELSAIVLLIASFIYLLGFFGIDFVQSFISRENEQLNNDDHNVVSTNNVLSDRRLVYDYGFDVTGDNDDGNDDDVIVKSVVSGEVNSYSLEASLGDCYRAAKIRRRAVERIVGREVLGLGFEGFDYESILGQCCEMPIGYVQVPVGVAGPLLLNGGEFMVPMATTEGCLVASTNRGCKAICLSGGATAILLKDGMTRAPVVRFATAERASQLKFYLEDGVNFDTLSVVFNKSSRFARLQNIQCSIAGKNLYIRFTCSTGDAMGMNMVSKGVQNVLDFLQNDFPDMDVIGISGNFCSDKKPAAVNWIEGRGKSVVCEAVITEEVVRKVLKTTVPALVELNMLKNLTGSAIAGSLGGFNAHAANIVSAVFIATGQDPAQNIESSHCITMMEAVNNGKDLHVSVTMPSIEVGTVGGGTQLASQSACLNLLGVKGACIESPGSNAQLLARIVAGSVLAGELSLMSAISAGQLVKSHMKYNRSSRDMSAIASKV

SEQ ID NO: 37484 - protein, 537 aa, Oryza sativa
PPPPRERRASSRRRASPYARYPAATACPSSRRCATASTTSTSRAPRSTSDHAGLLIREIPGGYGVPFLSPLRDRLDYYYFQGADEFFRSRVARHGGATVLRVNMPPGPFLAGDPRVVALLDARSFRVLLDDSMVDKADTLDGTFMPSLALFGGHRPLAFLDAADPRHAKIKRVVMSLAAARMHHVAPAFRAAFAAMFDEVDAGLVAGGPVEFNKLNMRYMLDFTCAALFGGAPPSKAMGDAAVTKAVKWLIFQLHPLASKVVKPWPLEDLLLHTFRLPPFLVRREYGEITAYFAAAAAAILDDAEKNHPGIPRDELLHNLVFVAVFNAYGGFKIFLPHIVKWLARAGPELHAKLASEVRAAAPAGGGEITISAVEKEMPLVKSVVWEALRMNPPVEFQYGRARRDMVVESHDAAYEVRKGELLFGYQPLATRDEKVFDRAGEFVPDRFVSGAGSAARPLLEHVVWSNGPETGTPSEGNKQCPGKDMVVAVGRLMVAGLFRRYDTFAADVEELPLEPVVTFTSLTRAADGDGAARRGV

SEQ ID NO: 37485 - protein, 112 aa, Pseudomonas syringae pv. phaseolicola 1448A
METLFTKIINREIPAKIIYEDDQVLAFHDIAPQAPVHFLVIPKKPIRTLNDLTEEDKGLAGHILFTAQRLALELGCEEGFRVVMNCNDLGGQTVYHIHMHVLGQRQMNWPPG

SEQ ID NO: 37486 - protein, 154 aa, Haloarcula sinaiiensis
MSEHERTFVMVKPDGVQRGLIGDIVSRFEDCGLKMVGGKFMQIDQELAEEHYGEHEDKPFFDGLVDFITSGPVFAMVWEGQDATRQVRTMMGETDPAESAPGTIRGDYGLDLGRNVIHGSDHEDEGANEREIELFFDEDELVDWDQIDSSWLYE

SEQ ID NO: 37487 - protein, 154 aa, Haloarcula quadrata
MSEHERTFVMVKPDGVQRGLIGDIVSRFEDRGLKMVGGKFMQIDQELAEEHYGEHEDKPFFDGLVDFITSGPVFAMVWEGQDATRQVRTMMGETDPAESAPGTIRGDYGLDLGRNVIHGSDHEDEGANEREIELFFDEDELVDWDQIDSSWLYE

SEQ ID NO: 37488 - protein, 189 aa, Zea mays
MAAAASASTPQGVAERRGIPAAAFVEDVEAYLRQAGLDVNSALAFLQERLQQYKIVEMKLLAQQRDLQAKIPDIEKCLDIVSTLQAKKDLGEALIADFELSEGIYSCAKIEDTDSVCLWLGANVMLEYSCDEANALLKKNLENAKASLEVLVADLQFLRDQQTITQVTIARVFNWDVHHRRSKQAVKEP

SEQ ID NO: 37489 - protein, 349 aa, Glycine max
MAEKLVLVSDMASTMKQVPSNFIRPLGDRPNLQGVVQSSDVCIPLIDLQDLHGPNRSHIIQQIDQACQNYGFFQVTNHGVPEGVIEKIMKVTREFFGLPESEKLKSYSTDPFKASRLSTSFNVNSEKVSSWRDFLRLHCHPIEDYIKEWPSNPPSLREDVAEYCRKMRGVSLKLVEAISESLGLERDYINRVVGGKKGQEQQHLAMNYYPACPEPELTYGLPGHTDPTVITILLQDEVPGLQVLKDGKWVAVNPIPNTFVVNVGDQIQVISNDKYKSVLHRAVVNCNKDRISIPTFYFPSNDAIIGPAPQLIHHHHHPPQYNNFTYNEYYQNFWNRGLSKETCLDIFKA

SEQ ID NO: 37490 - protein, 427 aa, Bordetella bronchiseptica RB50
MPFTANRQFKSQPRLLARAEGMYYTSTDGRQILDGTAGLWCVNAGHCRPEIVQAIASQAGEMDYAPGFQLGHPLAFEAATAVASFMPAGIDRVFFTNSGSESVDTALKIALAYHRARGDAQRTRLVGRERGYHGVGFGGISVGGISANRKTFSGALLPAVDHLPHTHSLEHNAFSKGQPAWGEHLADELERIVALHDASTIAAVIVEPMAGSTGVLVPPKGYLQRLREITARHGILLIFDEVITAYGRLGSPTAAEHFGVTPDIITMAKGVSNAAVPAGAVAVKREVHDAIVNGVQGGIEFFHGYTYSAHPLAAAAILATLGIYRRDDLFGRARDLSPAFEKAAHALQGAPHVIDVRNIGLVAGIELASRPDAPGARAAEAFRKCFDSGLMVRYTGDILAVSPPLIIDEAQIGELFEGIGKVLKEIA

SEQ ID NO: 37491 - protein, 432 aa, Kluyveromyces lactis NRRL Y-1140
MSTLEELNNQSQPDDDDIDQEFFNLSASELTTRAKLLDNEIRIFRSELQRLSHENSQMLEKIKDNQEKIKNNKQLPYLVANVVEIMDMDELQDSNEIDTQGGNVNLDNAAKGKAAVIKTSSRQTVFLPMVGLVDPVKLKPNDLVGVNKDSYLILDTLPSEFDSRVKAMEVDEKPTETYSDVGGLDKQIEELVEAIVLPMKQGEKFKDMGIKAPKGALMYGPPGTGKTLLARACAAQTNATFLKLAAPQLVQMYIGEGAKLVRDAFALAKEKAPTIIFIDELDAIGTKRFDSEKSGDREVQRTMLELLNQLDGFGSDDRVKVLAATNRVDVLDPALLRSGRLDRKIEFPLPTEDARAQILQIHSRKMTTDDSINWQELARSTDEFNGAQLKAVSVEAGMIALRNAQSTIKHEDFVEAIGEVQARKSKSVSFYA

SEQ ID NO: 37492 - protein, 518 aa, Desulfovibrio vulgaris subsp. vulgaris str. Hildenborough
MRQGRPPLSLWGLADEDGVLTVGGASAVALAAAYGTPLLVVDEKALRAKVAEVRAVLDDELPGARLTYSYKTNCIPGILRVLHDAGVGAEAISAYEYWLAQSLGVPGEQLIYNGVDKSPESLAMAVAHGALINIDNRDEVDAVLATARAQGRVARIGLRLGLNRSAQFGLDPDSAEGDGDIAHVVARCKAHPEHASLEALHFNVTSNARHSGYHVRCLALALDVMRTLARVHGVHIRLLDVGGGFGVQTSKNMSGVEYGLYRLFGVAPGGAWLDPFQDFRLYIRDMAALLTSYCRDNALPQPVVCLEPGRLLTSGAELLLTRVKAVKERPGAEPFAITDGGRLSQAYPCDFEWHEAFLANDLRRPLARAYTVTGRVCTRSDWLYRGKVMPELASGDILAVLDAGAYFSSYAMNFAFPRAAVVGVEDGRARVMRHRETFRHLTAMDEVQLVDVKLDGVALDDEASAGAGPHETGCVGMSGALGASGAGGLPGMPAAPSPGTPSSPPRAHGTTGTRGGGA

SEQ ID NO: 37493 - protein, 344 aa, Thermus aquaticus
MRVAVLPGDGIGPEVTEAALRVLKALDEREGLGLTYETFPFGGAAIDGYGEPFPEVTRKGVEAAEAVLLGSVGGPKWDALPRKIRPESGLLALRKSQDLFANLRPAKVFPGLERLSPLKEEIARGVDVLIVRELTGGIYFGEPRGMSEAEAWNTERYSKPEVERVAKVAFEAARKRRRHLTSVDKANVLEVGEFWRKTVEEVHKGYPDVALDHQYVDAMAMHLVKNPARFDVVVTGNIFGDILSDLASVLPGSLGLLPSASLGRGTPVFEPVHGSAPDIAGKGIANPTAAILSAAMMLEHAFGLVELARRVEAAVAKALRETPPPDLGGSAGTQAFTEEVLRHL

SEQ ID NO: 37494 - protein, 348 aa, Coccidioides immitis RS
MASQLPKTMKALQYSKPEEYAIVNIPLPQLRENDVLIKVKACGVCGTDLHIHEGEFLAKFPLVPGHETVGIVAAMGPKVKGFTVGDRVVADNSELCGECFYCRRGEELLCEHFEAHGVTMNGGFAEYCAYPAGRVFKIQNLSDVDATLLEPASCAAHGLDKISPKMGSTVLMFGAGPTGLVLAQMLRLNGGCKVVIAAPEGLKMNLAKSLDAADEYIPLSRQDPSAQFEALKAANPYGFDIVVEATGSVKILEDAINYVRRGGKLVVYGVYANKDRVTWPPSKIFGDEITILGSFSETYKFPAAIDYLDSGKVRVGGIVNKVFKIEQWAECLESMRNKSAIKAAITFD

SEQ ID NO: 37495 - protein, 715 aa, Ashbya gossypii ATCC 10895
MSHLITLATCNLNQWALDFEGNRDRILESIRIAKEKNAKLRVGPELEVSGYGCLDHFLEDDVYLHSWEMYAQILKDEKTHGILLDIGMPVVHKNVRYNCRVLSLDGHILFIRPKLWLANDGNYREMRFFTPWMKPTVVEEFQLPPVIQKITGQHIIPFGDAVIRTLDTCIGAETCEELFTPQSPNIAMSLDGVEIITNSSGSHHELRKLHKRLDLILGATGRCGGVYLYANQRGCDGDRLYYDGCALIAVNGRVVAQGSQFSLRDVEVVTATVDLQEVRDYRMSVMSRGLQAVSNNVTFERIQVPVELAAMQDRFNPTINLTKAKAPYYHSPEEEIALGPACWLWDYLRRCRGTGYFLPLSGGIDSCATAVIVHSMCRMVVKEASEGNLQVIADARRLARASDDWIPTDAREFANMIFHTCFMGTANSTNETRSRAKKLAEHLGAYHVDLNMDSVVKSVVTLFEVTTGKRPIFKVFGGSNIENLALQNIQARLRMVLAYLFAQLLPWVRSIKNSGGLLVLGSANVDECLRGYLTKYDCSSADINPIGGISKKDLKNFISYASKEFDLPILREFVEATPTAELEPITEDYVQSDERDMGMTYEELSVFGYLRKVEKCGPYSMFLKLLHEWTPRLTPSEVAEKVKRFFYFYAINRHKQTVLTPSYHAEQYSPDDNRFDLRPFLIDPRFSWASKKIDLVVKQCEGGPSTTQLDVMSVD

SEQ ID NO: 37496 - protein, 363 aa, Arabidopsis thaliana
MLGILRQRAIDGASTLRRTRFALVSARSYAAGAKEMTVRDALNSAIDEEMSADPKVFVMGEEVGQYQGAYKITKGLLEKYGPERVYDTPITEAGFTGIGVGAAYAGLKPVVEFMTFNFSMQAIDHIINSAAKSNYMSAGQINVPIVFRGPNGAAAGVGAQHSQCYAAWYASVPGLKVLAPYSAEDARGLLKAAIRDPDPVVFLENELLYGESFPISEEALDSSFCLPIGKAKIEREGKDVTIVTFSKMVGFALKAAEKLAEEGISAEVINLRSIRPLDRATINASVRKTSRLVTVEEGFPQHGVCAEICASVVEESFSYLDAPVERIAGADVPMPYAANLERLALPQIEDIVRASKRACYRSK

SEQ ID NO: 37497 - protein, 372 aa, Chlamydomonas reinhardtii [sequence omitted]

SEQ ID NO: 37498 - protein, 234 aa, Brassica napus
MEALTFKGSVMEAILEAKTQKKLFVVYISGEDEEESDKLNKLTWTDASVAESLSKYCVLLHLEAASVDATNFSAIYPYSSVPCIAAIGFSGTQVWKNEGFIAAEDLASSLEKAWLGLHIQETTASIFSAALASQNSEQPTSSPSNVVLPSEEGSTSDTMAASQSTGTSVQPSERKSTVTSGSTKEKNDGTAAIKVKQSAETSNQPASSVQAEKEPRSSCSTKTNDSSTSKIFYR

SEQ ID NO: 37499 - protein, 332 aa, Ashbya gossypii ATCC 10895
MFVGVGAGRLGRGMLVAVIAVMCHLILTQAGFYQSAARRFFTRQAGTASYGAYAGWHGQGSDGLTYQTAVAFNAKERQDKKESSVTGEDNYFVGSGSSGLYVGVADGVGGWAAHGYDSSAISRELCASLQEYAERALGSPGPKELLRQAYGKVRKDGIVKVGGTTAVVAQLRPGGQLRVANLGDSWCGVFRESKLVFETAVQTLAFNTPYQLSIIPEHMLAEAARTGRSYILNTPEDADEYEFMLQRGDIVMLATDGVTDNVAPEDIEMFIRDHGNMKDLQAATEELVSEVARLSKDPNFPSIFAQELQKLTGEPHIGGKVDDITVVMVKVD

SEQ ID NO: 37500 - protein, 501 aa, Zea mays
MHLQAGGAAHLHLQYFMPQHQPQEPATDLEAQESSAVCRRSSSTSPPAPTTMWEYHQAAHAAALQTTSSPASSFPSWSPYAGTTAALLGASSAFISTDAAGADSSSPGMRLLPAGEHGGGHAYGEQSNIACYKENFLDLLASKNVTQEMFDDVPAGHYTAQALLSGRFAAGSDVAPPVKYEVTGGSPLFFGSAAAAAGGMHQQGMDMAAGCTTPRYTYGADHHQMKEGGDQQQQELASPAMASFLQQLSSNAGGGGGVGMHAASMDYSGTGGGLDRICHESRALEAGPFGMRSLPDLSSFGGYSRSTTAESTSSAQPYLQRSSSLAESSRQQEPDIVSARSSSSGSGAASERKKRASEERTSTVKKSKQEGSKPSPPKQQQVPKVKIGEKITALQQIVSPFGKTDTASVLFETIKYIKFLHEQVQLLSEPYTNSSRSKGNNHFPWGDHRAAAETSKQGDEAEHDLSDRGLCLVPVSWTPQVYRDGTAMDYWTPAYRGCLYR

SEQ ID NO: 37501 - protein, 1007 aa, Arabidopsis thaliana
MGNPVDNKFTWVIKNFCSVSPKPIYSDQFLIGGNKWHILAYSKKRDGHQFLCLDLELVDCEFLPSEWRKVVKVSFTVVNFFSKKLSRQIGLKHCFNKKERSKGGSLFHLSELTDKKSGFLVDGEVEIVAQITVLETDRRFHVSKDYNMEMQCWDGMATTLVENKELNDDDKAGLVNVKGFQVLPSQLGIVNRIFEKHPETALECCTKNQELRASYINVIFSLIKLLYKGAQEHSTHDLSDAEGALAYMKNLGFKLDWLEKKLDEVKEIKKKCERVTEMEKELHDLMNKHTNVSKLLEKEKLEIKNASAPDLSFSDARRIDNTSKTILSEILTSESNTTLVTRLVNDELKIIVEVDVLQEIPGDLVDVNGFQVLPSQYSFSVLRETLIVTMWNGDGTVEVNGFRVFYSEVDCVRRIFEKHPETATNIRPKNQMVKNAYMNNLLDLIDIICLAPQELTEEEIRNAENTLLELVEVGFKLDWLKNRLEELCVKKKKMEARGARMRELDGMIVEQRRVLWALETELKNEENEAVSDSARLGFDDVPIYEDQQHKSRKRSVVGFVCAVPHSPLFRVATESSMGRIGSPLGKNEFSWVIKDFSSLGVRAIYSDEFVIGGCKWRLIAYPMGNRIKKYMSLYVEVADSKHLPSGWSINTELRMEVTPSWGYKTMIRHSKLSGEEGFLVSGEVTIVVKIDVYRVFGKVAAIEISEEGSKEGYEYESEEVYKKESEEGYKYESEEDYEKRPIERFEYESEAESKKDYEERTRGGFEYESEPVSKKDYEERPRESFEYESEAESKKDSEEGSRERYEYESEEESKKDSENDCGEESEKDSEEGSRPLKKIKRNDDGVKSNDSVNKTQQVKETMDINGFQVLPSQVTLVSRILKKYPDIALGFNAKNRHLRTACMNVLISLIETLCQSPQELSDEDMDEADNALVYVQDAGFKVDWLDKKLKEVKEKKVVEQTGKTRIQELEEELKEFKQKCLDREALLEKEKAKVLAARASLTLDDFV

SEQ ID NO: 37502 - protein, 337 aa, Brassica napus
KGDEAESSAAEVDRGKKKALESLEEDEDELEPPLKRLRRRSEGVSASGASNNPDLGSPNLEEHTTHDEDTTISLPFHPQPTENNADAETNGHGDDPRTTIERYSEQRLATTLEESSTLELASSETGEVKINLSFAPATGGSNLRVPTMEELRRAMEDKCLRSYKILDPDFSVGRFMGDIVTCFLELSKNAASHSPETLPFLATNIDVLKKPAANQSLENLPTNVEEKGESMGLVVVPECQISADDFRLISSINDVTLGKETLEIPWVNEFNSKVPPPFRYIPQSYVYLDAAVKFSVGNIRDDQRCSSCCGDCLAPSVACSCATALSGFTSYTKDGLL

SEQ ID NO: 37503 - protein, 412 aa, Triticum aestivum
  misc_feature (236)..(236): Xaa can be any naturally occurring amino acid
  misc_feature (241)..(241): Xaa can be any naturally occurring amino acid
  misc_feature (348)..(348): Xaa can be any naturally occurring amino acid
  misc_feature (381)..(381): Xaa can be any naturally occurring amino acid
MDCGTASHGALLAAAPLAGRRPRLLPLSPPPSTPSIQIRNRLYSMSLLPLRKARGMGRCEASLASNYTQTSEFADLDWENLGFGLVQTDYMYTTKCGPDGNFDKGGMVPFGPIEMNPASGVLNYGQGLFEGLKAYRKTDGSILLFRPMENAMRMQTGAERMCMPAPPVEQFVDAVKQTVLANKRWVPPTGKGSLYIRPLLVGSGAVLGLAPAPEYTFLIFASPVGNYFKEGLARIXLVISXSRPRSTPGGTGGVKTIGNYASVLMAQKIAKEKGYSDVLYLDAVEKKYLEEVSSCNIFVVKGNVISTPAIKGTILPGITRKSIIDVALTKGFQVEERLVSVDELLDAXDEVFCTGTAVVVSPVGSITYQGKRVEYAGNQGXSGAVSQQLYTSLTSLQMGHTEDRMGWTMQLN

SEQ ID NO: 37504 - protein, 89 aa, Zea mays
MSGRGKGGKGLGKGGAKRHRKVLRDNIQGITKPAIRRLARRGGVKRISGLIYEETRGVLKVFLENVIRDAVTYTEHAKRKTVTAMDVVY

SEQ ID NO: 37505 - protein, 558 aa, Oceanicola granulosus HTCC2516
MAHKSDIEIAREAKKRPIQEIGARLGIGSDDLLPYGHDKAKVSQTFIDSVQDRPNGKLILVTAINPTPAGEGKTTTTVGLGDGLNRIGKNAAICIREASLGPNFGMKGGAAGGGYAQVVPMEEMNLHFTGDFHAITSAHNLLSAMIDNHIYWGNELEIDQRRVVWRRVLDMNDRALRDVVTSLGGVANGFPRQAGFDITVASEVMAILCLAKNLADLEKRLGDMIVAYRRDRSPVYCRDIKADGAMTVLLKDAMQPNLVQTLENNPAFVHGGPFANIAHGCNSVTATTTALKLADYVVTEAGFGADLGAEKFMNIKCRKAGLAPDAVVLVATCRAMKMNGGVTKDDLGREDVDAIRKGCANLGRHISNVKSFGVPVVVAINHFVTDTDAEVEAVKDYVARQGAEAILCKHWAHGSAGIEDLAHKVVQLAESGAANFAPLYPDEMGLFDKIDTIARRIYHADAAIADKSVRDQLHAWEQQGYGHLPICMAKTQYSFSTDANLRGAPTGHTVPVREVRLSAGAGFVVVICGEIMTMPGLPRQPSAENIRLNDAGEIEGLF

SEQ ID NO: 37506 - protein, 137 aa, Catharanthus roseus
MASADVEFRCFVGGLAWATTDQSLSEAFSQYGEVLESKIINDRETGRSRGFGFVTFGDEKSMKDAIEGMNGQTLDGRNVTVNEAQSRGSGGGGGGGGFRGPRREGGGCYGGGGRRNGGYGGNGGGYGGGRRDGGRRW

SEQ ID NO: 37507 - protein, 351 aa, Oceanicola granulosus HTCC2516
MLDFHRTRCTLAAVAALLPLAAAAQEPQMAEPTQEMQAVLDKLAELGAEPLSTLSVEAARSQPTPADAVAALIEERGIETDPALDAIATTDVMIPGAAGEVPARVFTPDGEGPFPVIVYWHGGGWVIAGIDTYAASARQLAAGTDAVVVSVSYRQAPEHPFPAAHEDAVAAYEWIVENAGQWNGDVDRLAVAGESAGGNLAANVAIAARDNGWIEPDHQLLVYPVAGDDMTTESYIENAEAQPLSKAGMEWFVDKVFTDPAMASDPRLDLVSREDLGGLPPATIINAEIDPLRTEGETYAEHLSEAGVEVTQETYEGVVHEFFGMAAVVPAAEEAMSLAVSELNDAFADAD

SEQ ID NO: 37508 - protein, 164 aa, Catharanthus roseus
MASADVEYRCFVGGLAWATTDQSLSEAFSQYGEILESKIINDRETGRSRGFGFVTFKDEQSMRDAIEGMNGQTLDGRNITVNEAQSRGSGGNGGGGFRGPRRDGGGGGGYGGGRRDGGYGGNGGYGGGRREGGYGGGDRGYGGGGGGGSRYSRGGGASDGNWRN

SEQ ID NO: 37509 - protein, 160 aa, Catharanthus roseus
MASADVEFRCFVGGLAWATTDQSLSEAFSQYGEVLESKVINDRETGRSRGFGFVTFGDEKSMKDAIVGMNGQTLDGRNITVNEAQSRGSGGGGGGGGFRGPRREGGGGYGGGGRRDGGYGGNGGGYGGGRRDGGYGGGDRGYGGGDRYSRGGGSDGNWRN

SEQ ID NO: 37510 - protein, 518 aa, Debaryomyces hansenii CBS767
MSAYSRRYTDGPLNYGQDVRGRSEKKVEASHTTKWSGTPSRHKKIGKEDFDTIVTGHLTQEQMDAYQQYFRIEEISDILRMALELQSEVLSLLPSGNIANNPNYEREPSPPPKYDAAGNRSNTREARTKLALEKERHYLVEVAAGSIKNYMSPIDYRKPVKTYEKIYIPVKDYPDINFVGLLLGPRGNTLRQLQEDSGATLAIRGKGSVKDGKSTSSNNDDDDSNSSLSFSNPNLNSSGNDDLHVVITSDSQLKIAKAIKLTNQVIEKAISSPVGQNDLKRGQLRELAILNGTLRETKPYNPETQQSRRLRPGLDVSQLVCKLCGKVGHFARDCKFRGTSDGNNNPIVQDQADSYQQTAPYSDSRRQREEEDPRNNGREEILPPWKKKKPNVPLPPWQKPQQPLPSTDAPPPPVGLAPPPSSLAPPPPPPSSLAPPPPPPPSSLAPPPPPSSDIAPPPPSSDRAPPPPPSGIAPPPPPSGIAPPPPKSPNGVAPPPPPANDAPPAPLSTKNPPPPPPA

SEQ ID NO: 37511 - protein, 309 aa, Zea mays
MAAAAVTSNGGAVAANGPAPGRLASVYSEVQTSRLLHTLPLPSVLRSNFSVVDGPASSAAGNPDEIAKLFPNLFGQPSASLVPSAEPAATRPLKVGVVLSGGQAPGGHNVICGIFDYLQERAKGSTLLGFKGGPAGIMKCKYVELTSDFVYPYRNQGGFDMICSGRDKIETPEQFKQAEDTANKLDLDGLVVIGGDDSNTNACLLGEYFRSRNLKTRVIGCPKTIDGDLKCKEVPTSFGFDTACKIYSEMIGNVMTDARSTGKYYHFVRLMGRAASHITLECALQTHPNAALIGEEVGVPNQIFKDTFH

SEQ ID NO: 37512 - protein, 206 aa, Triticum aestivum
MDLVPQPDSPHSDGSGGATSGASSAVSSLSPGGAVSPSPSRYESQKRRDWNTFGQYLRNHRPPLSLARCSGAHVLEFLRYLDQFGKTKVHAAGCPFFGHPVPPAPCPCPLRQAWGSLDALVGRLRAAYEENGGRPENNPFGARAVRLYLREVREHQSRARGVSYDKKKRRKPPHPPGSGDIPSHEGNSNGHHQYHQMPPPPPGAAA

SEQ ID NO: 37513 - protein, 119 aa, Brassica napus
MAAAPAGPQNRCVFVGNIPYDATEELLVQICEEVGPVVSFRLVVDKETGKPKGYGFCEYKDEETALSARRNLQGHDVNGRQLRVDFAENGRNTDRNREKVEDPQFITVEEPYFSPSKSY

SEQ ID NO: 37514 - protein, 259 aa, Hordeum vulgare subsp. vulgare
MAAAAGTREEMVYMAKLAEQAERYEEMVEFMERVVAATGTGELSVEERNLLSVAYKNVIGARRASWRIVSSIEQKEEGRGAAGHAAAARGYRARVEAELSNICAGILRLLDERLVPAAAAVDAKVFYLKMKGDYHRYLAEFKSAAERKDAADSTLGAYQAAQDIAMKELPPTHPIRLGLALNFSVFYYEILNSPDRACSLAKQAFDEAIAELDSLGEDSYKDSTLIMQLLRDNLTLWTSDMQDDAGDETRDSSKPEDEQ

SEQ ID NO: 37515 - protein, 266 aa, Hordeum vulgare subsp. vulgare
MSPAEPTRDESVYMAKLAEQAERYEEMVEFMERVAKATGGAGPGEELSVEERNLLSVAYKNVIGARRASWRIISSIEQKEEGRGNEAHAATIRSYRTKIEAELAKICDGILALLDSHLVPSAGAAESKVFYLKMKGDYHRYLAEFKSGAERKEAAESTMNAYKAAQDIALADLAPTHPIRLGLALNFSVFYYEILNSPDRACNLAKQAFDEAISELDSLGEESYKDSTLIMQLLRDNLTLWTSDTNEDDVDEIKEAPAPKESGDGQ

SEQ ID NO: 37516 - protein, 207 aa, Glycine max
MGYWKSKVLPKIKKVFEKNSTKKAAAAEATKSCGESKEEYNKAFEEKKTELQTKVVETDLPSSTEIKSLVKEPKEAGLKKNSTEVQKFLEELVKIDFPGSKAAFEASSKFAPALASGLFFFVFEKVPTFIVTEEKEVEAPPAVETKTEEETSSVVKERETVVEEEKKEEEKPQADETSDEKKVEEKQAETAAKEEEKPAEPAEPPKP

SEQ ID NO: 37517 - protein, 855 aa, Mycobacterium avium subsp. paratuberculosis K-10
MSADGISRDGCAPRHIIVVGHGMVGHRFVEALRARDTEGRWRITVFAEEADAAYDRVGLTSYTESWDRALLALPGNDYQGDPQVRLVLNQRVTEIDRATKSVVTADGQRHHYDTLVLATGSYAFVPPVPGHELPACHVYRTLDDLDAIRADAQRAAQTAHARAGVVIGGGLLGLEAANALRQFGLATHVVEMMPRLMAQQIDEAGGALLARMIGDLGISVHVGTGTEAIEPVEGPDGSTTVRVRLSDGQVIDAGLVIFAAGIRPRDELAVAAGLARAERGGVLTDLSCRTSDPDIYAIGEVAAIDGRCYGLVGPGYTSAEVVADRLLDGSAEFGEADLSTKLKLLGVDVASFGDAMGTTENCLEVAINDAVNRTYAKLVLSDDAKTLLGGVLVGDASSYGVLRPMVGSELPGDPLALIAPASSGGGTALGVGALPDSAQICSCNNVTKGDLKCAIADGCADVAALKSCTSAGTSCGSCVPLLKQLLEAEGVEQSKALCEHFSQSRAELFEIISATEIRTFSGLLERFGRGKGCDICKPVVASILASTGSEHILEGEQASLQDSNDHFLANIQKNGSYSVVPWVPGGDIKPEHLILIGQIAQDFGLYTKITGGQRIDMFGARVDQLPAIWKRLVDGGMESGHAYGKALRTVKSCVGTDWCRYGQQDSVQLAIDLELRYRGLRAPHKIKMGVSGCARECAEARSKDVGVIATEKGWNLYVGGNGGMTPKHAQLLASDLDTETLVRYIDRFVMYYIRTADRLQRTAPWVESLDGGLDHVREVVCEDSLGLAEEFEAAMERHVRNYKCEWKGVLDDPDKLSRFVSFVNAPDAVDSTVAFTEHAGRKIPVSIGMPKIRQG

SEQ ID NO: 37518 - protein, 436 aa, Mycobacterium leprae TN
MSGATSGLTPEQIGAIDAAHLWHPYSTIGAATGVIPPVVAVAAHGAWLTLIRDGKPIEALDAMSSWWTAIHGHGHSVLDAALTTQLGAMNHVMFGGLTHEPAARLAQLLVDITPAGLETVFFSDSGSVSVQVAVKMALQYWRSRGQPAKRRLMTWRGGYHGDTLTPMSICDPDGGMHSLWTDILARQVFAPQVPRDYDPAYSKAFETQLAQHTPELAAVVVEPVVQGAGGMRFHDPRYLCDVRDICRRHDVLLIFDEIATGFGRTGELFAADHCGVSPDIMCVGKALTGGYLSLAATLCTTDIAHAISVGAAGALMHGPTFMANPLACAVSVASVEVLLGQDWRSRVAEISAGLTAGLEAAQGLPGVIDVRVCGAIGVIECDRSVDLAVATPAALDRRVWLRPFRNLVYAMPPYICPPAEIAQITSAMVEVAGLVG

SEQ ID NO: 37519 - protein, 148 aa, Vicia faba
MEFTLRQEALVNSSWEAFNQNLPLFSVLFYTFILEKAPIAKNMFSVLKDANEIPLANPSINAHTEMVFEMVRDAAAQLQTTGQVVLGDTTLGVVHTQKRVDGLHFMVVKEALLKTIKEAVGDKWSEELSNAWEIAYDGLAVAIMKEMS

SEQ ID NO: 37520 - protein, 130 aa, Zea mays
  misc_feature (17)..(17): Xaa can be any naturally occurring amino acid
  misc_feature (40)..(40): Xaa can be any naturally occurring amino acid
MISPTNFLRGRKITLVXKGGAGTGTPFFPWGAERPRELLXGLQFGTGKGKVSLAAITLKDYLPRQTTEGKNRTSTDDFTGLKLITAVKTPFLPNGRFDLKAYDFFINMQIEGGAKGLIFGGPTGEGHLMS

SEQ ID NO: 37521 - protein, 802 aa, Arabidopsis thaliana
MMMDEDVEQATLVSYSDKPRTFPDMRSKTYSPLIIRILRNLNVRALSVLLLLSFGGIFYMGARTSPIIVFVFVVCIISFMLSVYLTKWVLAKDEGPPEMVQISDAIRDGAEGFLRTQYGTISKMAFLLAFVILCIYLFRNLTPQQEASGLGRTMSAYITVAAFLLGALCSGIAGYVGMWVSVRANVRVSSAARRSAREALQIAVRAGGFSALVVVGMAVIGIAILYSTFYVWLDVDSPGSMKVTDLPLLLVGYGFGASFVALFAQLGGGIYTKGADVGADLVGKVEHGIPEDDPRNPAVIADLVGDNVGDCAARGADLFESIAAEIISAMILGGTMAQKCKIEDPSGFILFPLVVHSFDLVISSIGILSIKGTRNASVKSPVEDPMVVLQKGYSLTIILAVLTFGASTRWLLYTEQAPSAWLNFFMCGLVGIITAYVFVWISRYYTDYKYEPVRTLALASSTGHGTNIIAGVSLGLESTALPVLVISVAIISAFWLGNTSGLIDEKGNPTGGLFGTAVATMGMLSTAAYVLTMDMFGPIADNAGGIVEMSQQPESVREITDVLDAVGNTTKATTKGFAIGSAALASFLLFSAYMDEVSAFANVSFKEVDIAIPEVFIGGLLGAMLIFLFSAWACAAVGRTAQEVVNEVRRQFIERPGIMDYKEKPDYGRCVAIVASSALREMIKPGALAIISPIAVGFVFRILGYYTGQPLLGAKVVAAMLMFATVCGILMALFLNTAGGAWDNAKKYIETGALGGKGSDSHKAAVTGDTVGDPFKDTAGPSIHVLIKMLATITLVMAPIFL

SEQ ID NO: 37522 - protein, 423 aa, Rhodospirillum rubrum ATCC 11170
MDQITEFQLDINRALKETLALVLAGGRGSRLRDLTNRESKPAVPFGGKYRIIDFPLSNCMNSGIRRMCVITQYRAHTLIHHIQRGWGFLRAEIGEFVELWPAQQQTDKESWYLGTADAVHQNLDLIRMHDPRFVLILAGDHIYKQDYSKLLAHHIARGSDCTVACVDVPREEATGYGCVEVDNDDNIVHFLEKPANPPGIPGRPDRAFASMGIYIFNADFLYEILESDALNEASQHDFGRDIIPSQVGKARIVAHRFSQSCVYSVGRREPYWRDVGTVDAYWSANIDLVSVTPALDLYDADWPIWTYQMQRPPAKFVFDTDERRGMAKDSLVSAGCIVSGGAVTGSLLFNDVRVNSYSSVIDTVILPMGDIGRHARLTKCILDTGCRIPEGLVIGEDPILDAKRFHVTEQGITLVTPDRLALL

SEQ ID NO: 37523 - protein, 172 aa, Lolium perenne
FAMAYYVINYSKLRIWEFVEYEKMVYLDADIQVFDNIDHLFDLEAGSFYAVKDCFCEKTWSHTPQYKIGYCQQCPDRVAWPEHDLGVPPPPLYFNAGMFVHEPSLATAKALLEKLVVTDPTPFAEQDFLNMFFRDVYKPISNVHNLVLAMLWRHPENVELGKVKAVHYCAAA

SEQ ID NO: 37524 - protein, 178 aa, Triticum aestivum
  misc_feature (56)..(56): Xaa can be any naturally occurring amino acid
MADDDVQALVIDNGSGMCKAGFAGDDAPRAVFPSIVGRPRHTGVMVGMGQKDSYVXGDEAQSKRGILTLKYPIEHGIVTNWDDMEKIWHHTFYNELRVAPEEHPVLLTEAPLNPKANREKMTQIMFETFNTPAMYVAVQAVLSLYASGRTTGIVLDSGDGVSHTVPIYEGYALPHAIL

SEQ ID NO: 37525 - protein, 487 aa, Sinorhizobium meliloti 1021
MNPETTAVPYERLGILIDGRWIYEAERSTEVVDPATGQTIARLPFAADGEIAEAVASSQRAFESWKDRSPLERGRILRRFADLARKHADEIARNMTRDQGKPLSEAIGEIRFAADHADWHAEEARRIYGRVIPARDPRVQQMVLREPVGVCIAFTPWNFPFSQALRKVVAALASGCTIILKGPGESPSSTVAIGRLMQEAGLPDGCLNILWGDPAHLSETLLAAPEVRKISFTGSVEVGKHLASLAGRHMKRSTMELGGHAPVILFDDADIEAAADALAGQKVRNAGQVCISPTRFYVQAKGHDRFLARFAEKIASTRVGNGFQESVQMGPLCHGRRVAAMEGFIQDAREQGAEIVTGGERVGNAGFFYAPTVVAAGTDELRLMKEEPFGPIAVVTPFGDFDEVIRRANSLPFGLASYVFTGSSSRAQNAARALAAGMVSVNHFGLALPETPFGGINDSGYGSEGGSETFDGYLNTKFVTRFDQIPQ

SEQ ID NO: 37526 - protein, 508 aa, Bacillus anthracis
RKPTALIILDGFGLREETYGNAVAQAKKPNFDGYWNKFPHTTLTACGEAVGLPEGQMGNSEVGHLNIGAGRIVYQSLTRVNVAIREGEFDKNETFQSAIKSVKEKGTALHLFGLLSDGGVHSHMNHMFALLRLAAKEGVEKVYIHAFLDGRDVGPKTAQSYIDATNEVIKETGVGQFATISGRYYSMDRDKRWDRVEKCYRAMVNGEGPTYKSAEECVEDSYANGIYDEFVLPSVIVNEDNTPVATINDDDAVIFYNFRPDRAIQIARVFTNGDFREFDRGEKVPHIPEFVCMTHFSETVDGYVAFKPMNLDNTLGEVVAQAGLKQLRIAETEKYPHVTFFFSGGREAEFPGEERILINSPKVATYDLKPEMSIYEVTDALVNEIENDKHDVIILNFANCDMVGHSGMMEPTIKAVEATDECLGKVVEAILAKDGVALITADHGNADEELTSEGEPMTAHTTNPVPFIVTKNDVELREDGILGDIAPTMLTLLGVEQPKEMTGKTIIK

SEQ ID NO: 37527 - protein, 299 aa, Brassica napus
MAEEKKVAPIGVWNTVKPFVNGGTSGMLATCVIQPIDMIKVRIQLGQGSAVSVTKNMLKNDGIGAFYKGLSAGLLRQATYTTARLGSFKMLTAKAIEANDGKPLPLYQKALCGLTAGAIGACVGSPADLALIRMQADNTLPLAQRRNYTNAFHALYRISADEGVLALWKGCGPTVVRAMALNMGMLASYDQSAEYMRDNLGLGETSTVVGASAVSGFCAAACSLPFDYVKTQIQKMQPDAQGKYPYTGSLDCAMQTLKSGGPLKFYTGFPVYCVRIAPHVMMTWIFLNQITKFQKTIGL

SEQ ID NO: 37528 - protein, 461 aa, Sinorhizobium meliloti 1021
MNDRPNSLHALDKQSLVHPYTNLAVHQETGPHVITGGDGIYVVDDEGKRYIEGLAGLFCAGLGFSEQRLVEAATRQLKTMPFYHSFAHKSTEPGIRLAEKLLSIAPVPMSKVFFAGSGSEANDTAIKLIWYYNNALGRPEKKKIISRRKAYHGVTVATASLTGLPFNHRDFDLPIANILHTDCPHYWRFAETGETEEDFATRMANNLEAIILEEGPETIAAFFAEPVMVSGGVITPPKTYFEKVQAVLRKYDILLIADEVICGFGRTGNMFGSETYGLKPDMISCAKQLSAAYMPISALMINAKIADALVDQSRKIGTFSHGFTYGGHPVAAAVALEALTIYEEIDIVGHVRSVAPAFQDRVRKLGEHPLIGEARGVGLVAGLEFVKDKATRENFPPAWQVANQAGKFATARGVLTRGLGDMVSLCPAMIIDDEQIDDLMTRMGLALDDTLAWARAQGHVG

SEQ ID NO: 37529 - protein, 351 aa, Synechococcus sp. WH 5701
MPTVLALETSCDESAAAIVRDRTVLAGAVASQVEEHARWGGVVPEIASRRHVEALPHLVERVMAESGLSYGDLDGIAATVAPGLVGALLVGSVTGRTLARLHDLPFLGVHHLEGHLCSVQLGEPLPPGPYLVLLVSGGHTELVRVEGVGAYQRLGRSHDDAAGEAFDKVARLMGLGYPGGPAIQAAAAAGDPERFPLPKGRVSRPEGGFHPYDFSFSGLKTAVLRLVQRLEQEPQALPLADIAASFERVVVDVLVERSCRCALDQGLDTVVLVGGVAANRRLRQAMEERCDALGLHWRVAPLAYCTDNAAMIGVAAAARLAGGARSGCDLGVLARLPLEQAGSLYETRSGC

SEQ ID NO: 37530 - protein, 570 aa, Arabidopsis thaliana
MHTAVSTPPDDPVKCVSGNTNCTVTNSYGAFPDRSTCRAANVAYPKTEAELVSVVAAATQAGRKMRVTTRYSHSITKLVCTDGTEGLFISTKFLNHTVQADATAMTMTVESGMTLRQLIVEAAKVGLALPYAPYWWGLTVGGMMGTGAHGSSLWGKGSAVHDYVTEIRMVSPGSVNEGFAKIRILSETTTPNEFNAAKVSLGVLGVISQVTFELQPMFKRSLTYTMRNDSDFEDQAVTFGKKHEFADFIWLPSQGKVVYRRDDRVAVNTSGNGLFDFLPFRSQLSAAIAIIRTSEETQERFRDANGKCVGATIISSTLFAPSYGLTNNGIIFTGYPVVGSQNRMMSSGSCLDSLQDGLITACAWDSRIKGEFFHQTTLSVPLTQVKSFISDIKSLVKIEQKSLCGLELHYGILMRYVTSSPAYLGKETEALDFDITYYRAKDPLTPRLYEDFIEEIEQIALFKYNALPHWGKNRNLAFDGVIRKYNNAPAFLKVKDSYDPKGLFSSEWTDQILGIKGNASIVKDGCALEGLCICSKDAHCAPAKGYLCRPGKVYKEARVCTRVDGIISVI

SEQ ID NO: 37531 - protein, 322 aa, Staphylococcus epidermidis ATCC 12228
MKKIAVLTSGGDSPGMNAAVRAVTRTAIYNNIEVYGVYQGYQGLLDDDIHKLELGSVGDTIQRGGTFLFSARCPQFKEEDVRKKAIENLRKRGIEGLVVIGGDGSYRGAQRISEECKEIQTIGIPGTIDNDINGTDFTIGFDTALNTIIESVDKIRDTASSHARTFIVEVMGRDCGDLALWAGLSVGAETIVLPEVNTDIKDVAEKIEQGIKRGKKHSIVMVAEGCMSGQECADELTKYINIDTRVSVLGHIQRGGSPSGADRVLASRLGGYAVELLKQGETAKGVGIRNNQLTSTPFDEIFAESDRKFNSQMYELAKELSI

SEQ ID NO: 37532 - protein, 424 aa, Roseovarius nubinhibens ISM
MSTIIDIHAREILDSRGNPTVEVDVILEDGTMGRAAVPSGASTGAYEAVERRDGDKSRYMGKGVLEAVAAVNGEIADTLLGFDAAEQVAIDEAMIELDGTDNKSRLGANAILGVSLATAKAAADFCAQPLFRYVGGTSARVLPVPMMNIINGGEHADNPIDIQEFMIMPTSAENIRDAVRMGAEVFHTLKKELSAAGLSTGIGDEGGFAPNIASTREALDFVLKSIEKAGYKPGDDIHLALDCAATEYFKDGKYVLSGEGKTLSSQENVDYLKALVADYPIISIEDGMAEDDWDGWIALTEALGDKVQLVGDDLFVTNPTRLAEGIERGAANSMLVKVNQIGSLTETLRAVEMAHRARMTNVMSHRSGETEDATIADLAVATNCGQIKTGSLARSDRLAKYNQLIRIEEMLGDTAIYAGRSILR

SEQ ID NO: 37533 - protein, 541 aa, Roseovarius nubinhibens ISM
MFKVQDELKARGEAARARGILPLFEEDAGRAEAFSIGFDGLLFDYAKTHLDREDRAALLGWAEAAGVAARRDAMFSGARINETEGRAVLHTALRNLEGGPVEVDGRDVMPEIRDTLERMKRFARRVRAQSYKGAGGEITDVVNIGIGGSHLGPEMAVRALETFRQGPRCHFLSNVDGADAADILDHLDPRQTLVIVASKSFTTQETMTNAATVRDWMATAVDNPAKQFVALSSSKEKTAEFGVPPEQVFDFGDYVGGRYSVWGPIGLSLMIAIGPEAFGMMLRGGAAMDRHFREAPLAENMPVMLGLVGLWHHQVMGFPTRAVLPYAQRLERLPAYLQQLEMESNGKRVRMDGRTLDLPSGPVVWGEPGTNGQHAFYQLIHQGTQVVPCEFIVAAEGHEPTLAHHHRLLLANCLAQSEALMRGRDMATAQALMAEAGYEGAERDRQAAHRVFEGNRPSVTLMIDQLTPYRLGQIIALYEHRVFVEGVMLGINSFDQWGVELGKELARALEPVLAGEESAEGKDGSTRALVAYAQRFWARER

SEQ ID NO: 37534 - protein, 154 aa, Lupinus luteus
MGVLTDVQVALVKSSFEEFNANIPKNTHRFFTLVLEIAPGAKDLFSFLKGSSEVPQNNPDLQAHAGKVFKLTYEAAIQLQVNGAVASDATLKSLGSVHVSKGVVDAHFPVVKEAILKTIKEVVGDKWSEELNTAWTIAYDELAIIIKKEMKDAA

SEQ ID NO: 37535 - protein, 264 aa, Thermus thermophilus HB8
MEPFLLYALLGGLFTWGLTAVGAASVFFAREPSRKLLDAMLGFAAGVMLAASVFSLLVPGMEMAEAQGKNPIFPAVVGFLLGGGLIRLLDRYLPHVHLGPKDAPEGLKTLWRRTTLLILAIALHNFPEGLAVGVAFGAAGLDPTGAATLGGAIALALGIGLQNLPEGLAIAWPLRRVGIGAGLAWFYGQLSAIVEPLGAVLGALLVAQMMALLPYLMAMAAGAMVFVVVEEVIPESQAEGNGDTATFGVMTGFALMMALDVALG

SEQ ID NO: 37536 - protein, 129 aa, Zea mays
MEIQHHRGLGNSKVVKVQSEEAWDLFTDQASNEGRPVVAHFGASWCVTSLSMNYKFEELAQTHPEVLFLYVDVDDVQSVSSRYGVKAMPTFFLIKSKEVVGKIVGANPDEVKKLVDASAEPLETQIVVE

SEQ ID NO: 37537 - protein, 147 aa, Medicago sativa
MSFTDKQEALVNSSWEAFKQNLPRYSVFFYTVVLEKAPAAKGLFSFLKNSAEVQDSPQLQAHAEKVFGLVRDSAVQLRATGGVVLGDATLGAIHVRKGVVDPHFVVVKEALLKTIKEAAGDKWSEELNTAWEVAYDALATAIKKAMS

SEQ ID NO: 37538 - protein, 147 aa, Medicago truncatula
MSFTDKQEALVNSSYEAFKQNLSGYSVFFYTVILEKAPAAKGLFSFLKDSAGVQDSPQLQAHAEKVFGLVRDSASQLRATGGVVLGDAALGAIHIQKGVVDPHFVVVKEALLKTIKEAAGDKWSEELSTAWEVAYDALATEIKKAMS

SEQ ID NO: 37539 - protein, 315 aa, Campylobacter jejuni subsp. jejuni NCTC 11168
MNTLEIAKEVFEKEAQAILDLATNLDENFNQAVNLMLNTKGRCIVSGMGKSGHIGAKIAATLASTGTPSFFIHPGEALHGDLGMLTSEDVLIAISNSGETEEILKIIPAIKKREIPLIVMCGKKNSTLVKQGDIFLNIAVEKEACPLQLAPMSSTTATLVMGDALAAALMKVRNFKPDDFALFHPGGSLGRKLLTKVKDLMVSSNLPIVHPDTEFNDLVDVMTSGKLGLCVVLENEKLVGIITDGDLRRALKASDKPRFDFKAKEIMSINPKVVDADAMASEAEGIMLKHKIKEIIVGKEEKVVGIIQLYAIGNV

SEQ ID NO: 37540 - protein, 322 aa, Staphylococcus aureus subsp. aureus MSSA476
MKKIAVLTSGGDSPGMNAAVRAVVRTAIYNEIEVYGVYHGYQGLLNDDIHKLELGSVGDTIQRGGTFLYSARCPEFKEQEVRKVAIENLRKRGIEGLVVIGGDGSYRGAQRISEECKEIQTIGIPGTIDNDINGTDFTIGFDTALNTIIGLVDKIRDTASSHARTFIIEAMGRDCGDLALWAGLSVGAETIVVPEVKTDIKEIADKIEQGIKRGKKHSIVLVAEGCMTAQDCQKELSQYINVDNRVSVLGHVQRGGSPTGADRVLASRLGGYAVDLLMQGETAKGVGIKNNKIVATSFDEIFDGKDHKFDYSLYELANKLSI

SEQ ID NO: 37541 - protein, 146 aa, Medicago truncatula
MGFTEKQEALVNSSWELFKQNPGNSVLFYTIILEKAPAAKGMFSFLKDTAGVQDSPKLQSHAEKVFGMVRDSAVQLRATGGVVLGDATLGAIHIQKGVVDPHFVVVKEALLKTIKEVSGDKWSEELSTAWEVAYDALAAAIKKAMG

SEQ ID NO: 37542 - protein, 429 aa, marine gamma proteobacterium HTCC2143
MPGSTNQVDTGNSAIPERFKVIGLTILAVFICYIDRVVISLTIIPMGAELGWSQTEKGIILGSFYAAYMLTQIYGGALSDRIGGKTVLGIGLIVWSIFTIVTPYAAAAGFFILILARLGMGLGEGVTFPAWHSLYARWVPIGERSRAVAATNSAIPIGTVFGLLVTPVIIINLGWQWAFYLYGGIGFVWYYFWKKYVTSSPKDSENISKEELDFIVANAPASESGETLPVKKWIRNKPLWAIIVAHFCNNYSLFVFLSWLPTFINEKLGIQLAAIGFIAMIPQLVSFAAGNFGGYFADRFAKRGMKLITIRRLFNSIGFGGLAFCLCLVPEFNSTFAVIGLLCVGNVFGGFIAGGFIINHADIGPKYTGRLMGITNTFAAIPGLVGGILTGVILDVTNSWDMVFYVTAGVTFFGGLFYLLFASTEKQFD

SEQ ID NO: 37543 - protein, 1130 aa, Solanum tuberosum
MASGSRTKHSHHNSSQAQSSGTSNVNYKDSISKAIAQYTADARLHAVFEQSGESGKFFDYSESVKTTTQSVPERQITAYLTKIQRGGHIQPFGCMIAVDEASFRVIAYSENAFEMLSLTPQSVPSLEKCEILTIGTDVRTLFTPSSSVLLERAFGAREITLLNPIWIHSKNSGKPFYAILHRVDVGIAIDLEPARTEDPALSIAGAVQSQKLAVRAISHLQSLPGGDIKLLCDTVVESVRELTGYDRVMVYKFHEDEHGEVVAESKRSDLEPYIGLHYPATDIPQASRFLFKQNRVRMIVDCHATPVRVTQDESLMQPLCLVGSTLRAPHGCHAQYMANMGSIASLTLAVIINGNDEEAVGGGRNSMRLWGLVVGHHTSVRSIPFPLRYACEFLMQAFGLQLNMELQLASQLSEKHVLRTQTLLCDMLLRDSPPGIVTQSPSIMDLVKCDGAALYYQGKYYPLGVTPTEAQIKDIVEWLLAYHGDSTGLSTDSLADAGYPGAASLGDAVCGMAVAYISSKDFLFWFRSHTAKEIKWGGAKHHPEDKDDGLRMHPRSSFKAFLEVVKSRSSPWENAEMDAIHSLQLILRDSFKDAEASNSKAIVHAHLGEMELQGIDELSSVAREMVRLIETATAPIFAVDVEGRINGWNAKVAELTGLSVEEAMGKSLVHELVYKESQETAEKLLYNALRGEEDKNVEIKLRTFGAEQLEKAVFVVVNACASKDYTNNIVGVCFVGQDVTGEKVVMDKFINIQGDYKAIVHSPNPLIPPIFASDENTCCSEWNTAMEKLTGWSRGEIVGKMLVGEIFGSCCRLKGPDAMTKFMIVLHNAIGGQDTDKFPFSFFDRNGKYVQALLTANKRVNMEGNTIGAFCFIQIASPELQQALRVQRQQEKKCYSQMKELAYICQEIKSPLNGIRFTNSLLEATNLTENQKQYLETSAACERQMSKIIRDVDLENIEDGSLTLEKEDFFLGSVIDAVVSQVMLLLREKGVQLIRDIPEEIKTLTVHGDQVRIQQVLADFLLNMVRYAPSPDGWVEIQLRPSMMPISDGVTGVHIELRIICPGEGLPPELVQDMFHSSRWVTQEGLGLSTCRKMLKLMNGEIQYIRESERCYFLIVLDLPMTRKGPKSVG

SEQ ID NO: 37544 - protein, 320 aa, Escherichia coli O6
MIKKIGVLTSGGDAPGMNAAIRGVVRSALTEGLEVMGIYDGYLGLYEDRMVQLDRYSVSDMINRGGTFLGSARFPEFRDENIRAVAIENLKKRGIDALVVIGGDGSYMGAMRLTEMGFPCIGLPGTIDNDIKGTDYTIGFFTALSTVVEAIDRLRDTSSSHQRISVVEVMGRYCGDLTLAAAIAGGCEFVVVPEVEFSREDLVNEIKAGIAKGKKHAIVAITEHMCDVDELAHFIEKETGRETRATVLGHIQRGGSPVPYDRILASRMGAYAIELLLAGYGGRCVGIQNEQLVHHDIIDAIENMKRPFKGDWLDCAKKLY

SEQ ID NO: 37545 - protein, 403 aa, Zea mays
MLANVCRRRLTIPLSPILAAAAAAASGKNPIHSNHARALLSQSYYSSAVQAAPDREPCPTTVSYLVSCGVSPAVAAARKVRIRDTDRADAVRALLRKYGFSEADITRTVRLDPLLLTFDPDRTIRPKLDFFVSLGIQPRLLATEPHILARSLEKHIIPCIEFFRTILRTDDNIRIAVSRVPRALMTDIESTMRPAVEAFLSHGLSMEAIAKLLMIHMGMIKTPPERIREAFHDLKALGLRVTDTGFLYGFRVICSLRRETMVRKVAVFKSFGVSESDLFRAFKTQPTILLVGDETIKKKFRFFLDVMKLEIADVMAQPLTLALSLEKNIMPRCAVLSILMKEGKLKRTQKLIPPLLSNSRVFSERYVLRHAKDVPDVVKAFEGKIKFQGFGESEVRTSVPLND

SEQ ID NO: 37546 - protein, 148 aa, Sesbania rostrata
MGFTEKQEALVNASYEAFKQNLPGNSVLFYSFILEKAPAAKGMFSFLKDSDGVPQNNPSLQAHAEKVFGLVRDSAAQLRATGVVVLADASLGSVHVQKGVLDPHFVVVKEALLKTLKEAAGATWSDEVSNAWEVAYDGLSAAIKKAMS

SEQ ID NO: 37547 - protein, 145 aa, Glycine max
MGAFTEKQEALVSSSFEAFKANIPQYSVVFYTSILEKAPAAKDLFSFLSNGVDPSNPKLTGHAEKLFGLVRDSAGQLKANGTVVADAALGSIHAQKAITDPQFVVVKEALLKTIKEAVGDKWSDELSSAWEVAYDELAAAIKKAF

SEQ ID NO: 37548 - protein, 107 aa, Brassica napus
LCWWPTHQKSTLNDASDLENGTEDLPSFTEFSFEQLGAATSGFSTDSIVSEHGVKAPNVVYKGRLEDGRWIAVKRFNRSAWPDTRQFLEEAKAVGQLRTDRLANLIG

SEQ ID NO: 37549 - protein, 506 aa, Frankia sp. EAN1pec
MERTPMERTPMERTPMERTLSNFVGGKQAPSLDGRTMPVLNPATGEVLAHAPSSGPADVDAAVRAAGEAFEGWRDSTPSERSRALLRLADAVEERAAEIADVECANTGKPRQLTLDEEIAPSADQIRFFAGAARLLEGRSAGEYLAGHTSYVRREPIGVCAQVTPWNYPLMMAVWKIAPALAAGNTVVLKPAETTPASSLLLAEIAAEILPPGVLNVVCGDRDTGRALVAHPGPAMISVTGSVRAGMEVARGAADSLKRVHLELGGKAPVIVFDDVDPAVVAAEIAGAAYFNAGQDCTAATRVLAGPGIAGELADALAEAARATTTGPPAAGGQTGGQTGGAAAGGGEADYGPLNSAGQLGRVSGFVERAPEHARLLAGGTPLDRPGYFYPATVIAGLRQDDELIQQEVFGPVVTVQEFSAEDEAVAWANGVEYGLASSVWTRDHSRAMRVARRLDFGCVWVNTHISIVAEMPHGGFKKSGYGKDLSVYGLEDYTRIKHVMHNIEF

SEQ ID NO: 37550 - protein, 364 aa, Dichodontium pellucidum
HGVLRLVLEMNGEVVERAEPHIGLLHRGTEKLIEYKTYLQALPYFDRLDYVSMMAQEHAYSLAVEKLCNCEVPLRAQYIRVLFCEITRILNHLLALTTHAMDVGALTPFLWAFEEREKLLEFYERVSGARMHASYIRPGGVAQDMPLGLSEDIFLFTQQFASRIDEIEEMLTNNRIWKQRLVDIGTVTAQQALDWGFSGVMLRGSGVCWDLRKSAPYDVYNQLIFDVPVGIRGDCYDRYCIRIEEMRQSIRIIMQCLNQMPSGMIKADDRKLCPPSRSQMKQSMESLIHHFKLYTEGFYVPASSTYTAVEAPKGEFGVFLVSNGTNRPYRCKIRAPGFAHLQGLDFMSKHHMLSDVVTIIGTQD

SEQ ID NO: 37551 - protein, 148 aa, Sesbania rostrata
MGFTEKQEALVNASYEAFKQNLPGNSVLFYSFILEKAPAAKGMFSFLKDFDEVPQNNPSLQAHAEKVFGLVRDSAAQLRATGVVVLADASLGSVHVQKGVLDPHFVVVKEALLKTLKEAGGATWSDEVSNAWEVAYDELSAAIKKAMS

SEQ ID NO: 37552 - protein, 183 aa, Zea mays
CALGGDGSPWLLVFASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVQANDRALVVDDLIATGGTLCAAVKLIERVGAKVVECACVIELPELKGRDKLGDRPVFVLVEADA

SEQ ID NO: 37553 - protein, 473 aa, Frankia sp. EAN1pec
MTVSNATTTTPRPGDPPRTGHAGRVTDLLEREERALQARTPASEAMHTRALRTMTGGVPSSYQLRDPWPIYLTHGRGSLVWDVDGNEYSDFHNGYGSMVQGHAHPAIVRAVTERMALGSHFAMPTEDSVLVSEELARRFGLPQWRYVNSGSEATMDAIRIARGVTGRDTIVKIFGSYHGHHDYVMVSIGTPYGDIGPADHMNSLAYGAGIPQAVVDLTVPVPFNDAAAMERRIAALEAEGRKPACVIMEAAMMNLGVVLPEPGYLEAVREITRRHGIVLIFDEVKTGLCVAAGGAVERFGVLPDMVTLAKALGGGLPAGAIGATAELMAAVAEDRVKQVGTFNGNPLVMAAARASLTEVLTPDAYAHLDRLNDRLVDGCTAILARHGIAGYAVGISSKGCVHFTDAPIRDYTSFMAHQNAVLPELAWLYNANRQVLMAPGREEEWTLSVQHTDADVDRYLASLDAMAADLARG

SEQ ID NO: 37554 - protein, 190 aa, Zea mays
EIDPEAIKFKEILGAPKKGSLGKDMPVGPMPLPRAEGDFCFGGALWPGEGGAIAQFVLQGKGFPRRGGGGFFPEGIQKFGVLGFVMGGGGPPGGNVFRFRKENQVFCVGGKGALALFFFGGGSKGGPKVLGGLQRLGRGTLGPDGGPSPDPFVFPEGGVRVFFLISPPFRGGFSCLGFLPPLVISVFELA

SEQ ID NO: 37555 - protein, 364 aa, Leucobryum glaucum
HGVSRLVLEMNGEVVERAEPHIGLLHRGTEKLIEYKTYLQALPYFDRLDYVSMMAQEHAYSLAVEKLCNCEVPLRAQYIRVLFCEITRILNHLLALTTHAMDVGALTPFLWAFEEREKLLEFYERVSGARMHASYIRPGGVAQDMPLGLSEDIFLFTQQFASRIDEIEEMLTNNRIWKQRLVDIGTVTAQQALDWGFSGVMLRGSGVCWDLRKSAPYDVYNQLIFDVPVGTRGDCYDRYCIRIEEMRQSIRIIMQCLNQMPSGMIKADNRKLCPPSRSQMKQSMESLIHHFKLYTEGFSVPASSTYTAVEAPKGEFGVFLVSNGTNRPYRCKIRAPGFAHLQGLDFMSKHHMLSDVVTIIGTQD

SEQ ID NO: 37556 - protein, 147 aa, Medicago sativa
MGFTADQEALVNSSWESFKQNLPGYSVFFYTTILEKAPAAKGMFSFLKDSAGVQDSPQLQAHAEKVFGMVRDSAVQLRATGEVVLGDATLGSIHIQKGVVDPHFVVVKEALLKTIKEAVGDKWSEELSTSWEVAYDGLASAIKKAMS

SEQ ID NO: 37557 - protein, 364 aa, Ulota crispa
HGVLRLVLEMNGEVVERAEPHIGLLHRGTEKLIEYKTYLQALPYFDRLDYVSMMAQEHAYSLAAEKLCNCEVPLRAQYIRVLFCEITRILNHLLALTTHAMDVGALTPFLWAFEEREKLLEFYERVSGARMHASYIRPGGVAQDMPLGLSEDIFLFTQQFASRIDEIEEMLTNNRIWKQRLVDIGTVTAQQALDWGFSGVMLRGSGVCWDLRKSAPYDVYNQLIFDVPVGTRGDCYDRYCIRIEEMRQSIRIIMQCLNQMPSGMIKADDRKLCPPSRSQMKQSMESLIHHFKLYTEGFSVPASSTYTAVEAPKGEFGVFLVSNGTNRPYRCKIRAPGFAHLQGLDFMSKHHMLSDVVTIIGTQD

SEQ ID NO: 37558 - protein, 417 aa, Schizosaccharomyces pombe 972h-
MALLPFFDLTNFESDASEELGWLKYVGRVQTRVFPQHFKDNLEKVRKISETIDVIVDTTAELGPEACVNLLNAGALAILVNEEMLNELADISPNRLVLKTDTTDIGKIEKLSQVAGSIQWIGSAENYPPDFFERASKIIHKAVMPEGGGRTLYLEFPEQPSMEVLKSFSVHSVVPVLSSSFLTVKPAEEPKKLSLADLILISANTDREDGLFSTLVVNELGIALGLVYSSKESVAESLKTGTGVYQSRKRGLWYKGASSGAVQHLIHIDVDCDEDCLRFVVYQTGKGFCHLDTLHCFGQASGLCQLEKTLIDRKNNAPEGSYTARLFSDPKLLRAKIMEEAEELCDATTKENVIWEMADLMYFAITRCVGSGVSLNDISRHLDLKHRKVTRRKGDAKVAWQEKLKDKGGVANTSYTA

SEQ ID NO: 37559 - protein, 343 aa, Atropa belladonna
MATLVSNWSTNNVSESFVAPLEKRAENDVPLGNDVPIIDLQQDHLVVVQQITKACQDFGLFQVINHGLPEKLMAETMDVCKEFFALPAEEKEKLQPKGEPAKFELPLEQKAKLYVEGEQLSDEAFLYWKDTLAHGCHPLDEELVNSWPEKPATYREVVAKYSVEVRKLTMRILDYICEGLGLKLGYFDNELSQIQMMLTNYYPPCPDPSSTLGSGGHYDGNLITLLQQNLPGLQQLIEDAKWIAVEPIPTAFVVNLGLTLKVITNEKFEGSIHRVVTNPTRDRVSIATLIGPDYSCTIEPAKELLSQDNPPLYKPYSYAEFGEIYLSDKSDYDAGVKPYKINA

SEQ ID NO: 37560 - protein, 145 aa, Psophocarpus tetragonolobus
MGGFTEKQEALVNSSYEAFKANVPQYSVVFYTSILEKAPAAKDLFPFLANGVDPTNPKLIGHAEKLFGLVHDSAAQLRAKGAVVADAALGSLHAQKGVTDPQFVVVKEALLKTVKEAVGDKWSDELSNAWEVAYNELAAALKKAF

SEQ ID NO: 37561 - protein, 216 aa, Arabidopsis thaliana
MAYQIDQKMIHDQEPMAEIMPNVITAMSSLLQRVSETNDDLSRPFREHKRISAFNAVTKPSISIRSYMERIFKYADCSDSCYIVAYIYLDRFIQKQPLLPIDSSNVHRLIITSVLVSAKFMDDLCYNNAFYAKVGGITTEEMNLLELDFLFGIGFQLNVTISTYNDYCSSLQREMVMRTMYSPLLEPAFLVRSFHKNLLKNLYDEDHRNSQVTSAV

SEQ ID NO: 37562 - protein, 394 aa, Magnaporthe grisea
MSQNRPAAFNTLRMGEVIREKVQDGITGETRDLQYTQCKIVGNGSFGVVFQTKLSPSNEDAAIKRVLQDKRFKNRELQIMRIVRHPNIVQLKAFYYSNGERRDEVYLNLVQEFVPETVYRASRFFNKMKTTMPILEVKLYIYQLFRALAYIHSQGICHRDIKPQNLLLDPTTGILKLCDFGSAKILVENEPNVSYICSRYYRAPELIFGATNYTTKIDVWSTGCVMAELMLGQPLFPGESGIDQLVEIIKVLGTPTREQIRTMNPNYMEHKFPQIKPHPFNRVLRKADNNAIDLIARLLEYTPTERLGAIDAMVHPFFDDLRNPSTKLPDSRHQTGQVRDLPPLFDFNRHELSIAPQLNHQLVPPHVRPTLAAQGLDIDHFTPMRKEDMLARLD

SEQ ID NO: 37563 - protein, 137 aa, Schizosaccharomyces pombe 972h-
MPPSTVNQEVNSILFIKNLSFKITAEEMYDLFGRYGPVRQIRLGNTVQTRGTAFVVYENVQDARRACEKLSGYNFMDRYLVVHYYNPERAKVDGQDLAARFPLSINSVEENIQQKNESAHIKQSFTSVSNLGIKKVL

SEQ ID NO: 37564 - protein, 208 aa, Oryza sativa
MSRAHGSPRSFFPVGNPFRVMFPGGAHLSRKLQELLASYEDALALSLRKLKPEAASDVLTLSWMRLAVDCLSELHTNIANLITDLELPVSDWDDQWVDIYLNSSLKLLDICIALSSELSRWDPGQLLLQYALHVWGSESGVPSPEPLQRTEPFLREWMSWWALMSRAVTCPRLAGPAGTLSIKVNPVKESALDLLQWYGPIWSDRAPT

SEQ ID NO: 37565 - protein, 998 aa, Cryptococcus neoformans var. neoformans JEC21
MDRLQRTRSQHFVSSPRKTASPLIARHTLYPRHPPKKRRLGVTTFVASHNEAGQNYSNELEDDLEKAIMKTGESSSAPARRTSRSRSQSRPVRRKSNDKVWADSLPNGQDGEDAASPKKRKRSRAGSLSTEDSWVETSGDEWEPDFIAESDRNMIHYAPSTALHRLRKAELVRLWRVAGMWDSEDIPDDMNEDETIGDMGKKELVDGLISARKHQTGRLISPLPSSPNRLIRRQSTLSPIPATPPPSSPLAESSSPDVTPKPRPRTRSRVRLETPVVRRQPRPSRPTRTLTKRHTKSEARSRRVRAQLTKKVNGKSENGDEIELTESSDSDDDVNGIESTPIVKRLRPRGVGERKSFMKEPSTDITDFEDDAEEADAEATEVEEEPQPKERKLRRKSISQASLSKYGGDIDMAPTSEQRSSKNLPTRGAKKKAIQRMQGGESGTEDEDMEVDEERDIGMKEGTPTPQPAIPPRRGRASRSSTPKLDEDSAMVGSPTPSVATETEASTPRPVHTTRSGKTFGAIQNRRRQLLQEARNDPDMDEEDESDEEDGEPELDIDLSEATVASLIRLLRDELVQMCETRGIEVGGTKPQLAKALLEWRDEQKGSYPSSASTARPSPPRTAMPRRKSKSKSKTKSKFKSNKHVPAIGTAAHAPGKPTPVLLRSHIHANDPETPPLSKGEEGDVEEEKKGTEAELNLDLQELGLEDSVIKPSQLIKLEKIGSGGFKDVYVGKFRGRKVAISEFRSHLSEMDIRELKLLAEFSHPNIVRFVSPFLSSERIIAYIEQRGICIPEDSTHVPCMLVSELCENGDLFDYIRNVPCPTLKRLLSLMLDIARGLEYLHTRKPSIIHRDCKSSNILINRSGVAKVGDFGLARVKNSTRSMIRSLVGTVNWQAPELWHPTPRYDYKVDVFSAGMVYWEMMSGWIGEKKYPWEGHNEHYIYDAVGTKHRRPPVTGMRKHWGSEPVNLMERMWHQDPAERPTMTDVVHDLESILAELK

SEQ ID NO: 37566 - protein, 210 aa, Mycobacterium leprae TN
MTNTEVGKTTRRARIERRTSESDIVVELDLDGTGQVHIDTGVSFYDHMLTALGSHASFDLTVCTKGDVEIEAHHTIEDTAIALGQAFGQALGNKKGIRRFGDAFIPMDETLVHAVVDVSGRPYCVHTGEPDHLQHNIISGSSVPYSTVINRHVFESLAANARIALHVRVLYGRDPHHITEAQYKAVARALSEAVKFDPRFSGVPSTKGVL

SEQ ID NO: 37567 - protein, 529 aa, Fragaria x ananassa
MGNCCVTPPQTGSPLKNKKNKPNPFAIDYVVANGGKLSVLKNPTGTEIEQTYELGRELGRGEFGITYLCTDKATNENYACKSISKQKLRTAVDIEDVRREVEIMKHLPKHPNIVSLKDTYEDDNAVHLVMELCEGGELFDRIVSRGHYTERAAAAVTKTIVEVVQMCHKHGVMHRDLKPENFLFANKKETAPLKAIDFGLSVFFKPGERFSEIVGSPYYMAPEVLRRNYGPEVDVWSAGVILYILLCGVPPFWAETEQGVAQAIIRSVVDFKRDPWPKVSDNAKDLVKKMLDPDPKRRLTAQQVLDHTWLQNAKRAPNVSLGETVRARLKQFSVMNKLKKSALKVIAEHLSQEEVAGIQEGFKIMDTSNKGKINIDELRVGLHKLGHQIPDADVHILMEAGDVDNDGYLDYGEFVAISVHLRRMGNDDEHLRKAFDFFDQNKSGFIEVEELRTALATEVDDHVEDVISAIISDVDTDKDGKISYEEFATMMKAGTDWRKASRQYSRERFNSLSLKLMRDGSLEGKTESK

SEQ ID NO: 37568 - protein, 115 aa, Mycobacterium leprae TN
MTLDPDIAVRLKRNAEGLFTAVVQERSSGDVLMVAWMDDQALARTLETREANYYSRSRAEQWIKGSTSGNTQHVHSVRLDCDGDTVLLTVDQVGGACHTGAHSCFDSAMLLAPQD

SEQ ID NO: 37569 - protein, 584 aa, Treponema denticola ATCC 35405
MPKIEVNESLFFNMLGAELEAKLGAKQNYDKLEEILTSAKAELDEKPDTSLPEKERIIKIELNDTNRPDLWSTAGLARLLRIHAGGKSNTKSYQSFLSSKEKTQDSAERMVKASPELKEIRPFAAGFVISGKPIDELMLADIIQTQEKLCRNFGRKRKTVSMGVYRSKLIKWPIEYTAVDPDKTEFTPLDMEKPLSCRKILKEHPKGIEYASLLEDKKLFPLLKDANGEVLSMPPVINSAKIGAVQAGDTDLFVEFTGTDMTSILLSANIVACDFADCGYTILPVKIEHPYETGYGKTITTPFYFQENAETSVEAVNKLLGSSFKAEEIADALKRMDSETEISGNKIRLKPSPYRNDFLHEVDIIEDVMMGKTVNFFTPERPNEFTIGRLLPATMLSRKIKGLMTGMGYQEMIFNYLGSKKDYIERMCIDEASVIEISNPMSENYQFVRNSILPSLLNAEMGSANAVYPHKIFETGKIAFFDDSNSTGTSTSQSLGFLTAEQNANFNTAASEAANLLYYLGIEYKVCETDDPRFIPGRQAGLLYNGEQIGIFGEVHPQVLENWDINIPCFAGELNIEKILKSQN

SEQ ID NO: 37570 - protein, 169 aa, Triticum aestivum
MAASAAAKKLTLKSSDGEDFEVEVAVAMASQTIHPSVEDGCADNIIPLPNVTAKILSKVIEYCTQHAPKADDAAAADSTGTATAVKPDEEKLKAFDTEFVKVEQATLFDLILAANYLDIKGLLDLTCQTVADMIKGKTPEEIRKTFNITNDFTPEEEEEVRKENQWAFE

SEQ ID NO: 37571 - protein, 364 aa, Takakia lepidozioides
HGVLRSVSEMNGEVVERAEPHIGLLHRGTEKLIEYKTYLQAIPHFDRLDYVSMMAQEHAYSSAVERLCNCEVPLRAQYIRVLFREITRILNHLLALTTHAMDVGALTPFLWAFEEREKLLEFYERVSGARMHASYIRPGGVAQDMPLGLSEDIFLFTQQFASRIDEIEEMLTNNRIRKQRLVDIGTVTAQQALDWGFSGVMLRGSGVCWDSRKSAPYDVYNQLDFDVPVGTRGDRYDRYCIRIGEMRQSIRIIMQRPNQMPSGMIKADDRKLCPPSRSQMKQSMESSIHHFKLYTEGVSVPASSTYTAAEAPKGEFGVFLVSNGTNRPYRCKIRAPGFAHLQGPDFMSKHHMPADVVTIIGTQD

SEQ ID NO: 37572 - protein, 140 aa, Brassica napus
TRRIEEEDEDPTPYDANLSRKKATLPQPSKKLVIKLNKAGPSLPTNFEDTGWDNLQSAITAIFLKHPFPFDLERLYQAVDNLCLHKLEGKLYKRIEKECEEHISVALQSLVGQDTDLSVFLSLVEKCWQDFCDQMLMIRR

SEQ ID NO: 37573 - protein, 191 aa, Kluyveromyces lactis NRRL Y-1140
MQTLKCVVIGDGAVGKTCLLISYTTNQFPADYVPTVFDNYAVTVMIGDEPYTLGLFDTAGQEDYDRLRPLSYPSTDVFLVCFSVISPPSFENVKEKWFPEVHHHCPGVPCLIVGTQIDLRDDKVIIEKLQRQRLRPITPEQGERLARELRAVKYVECSALTQRGLKNVFDEAIVAALEPPVIKKSKKCIIL

SEQ ID NO: 37574 - protein, 204 aa, Gibberella zeae PH-1
MATLDNANPTILSASQLPTRQKKAEPRRGPESKYDDIIFAKPSYLSGPFAGPTSAAWPQLNDQHDEFSSEAIDEQEIYDLISTISDPEHPVSLGQLSVINLSDIHITPSPAFGVPDPNTIVQVVVEITPTITHCSLATVIGLGVRVRLEQALPPNYRVDVTCKENSHNQDDQVNKQLGDKERVAAALENDTLKGVLDKMLETCA

SEQ ID NO: 37575 - protein, 196 aa, Oryza sativa (japonica cultivar-group)
MAGGKKRKAEAARLEETDRALYGAFRGAANSLSQLYTLAMGGQKLSFQAGERHAMEKLYEWILRQHENGLRLTVADIASHIQHEIQYGGDNASASPRSQHASQSTQATVPIPNTMSQQPSPNLFALGNTGLVQSKNSAVFSNALSSPVRRSLQPFHLEQGGDAGYFANGVNRDQNSTASNDSSMDMHSDSPAHDSY

SEQ ID NO: 37576 - protein, 506 aa, Saccharomyces cerevisiae [sequence omitted]

SEQ ID NO: 37577 - protein, 721 aa, Capsicum annuum
MAVPTIALYASPPSSVCSTPYQCHSHASYDFDLNGRSTSSSSSTTSSSQKSIVGGLSSLFSSPTVKANYSTGTEDLGLGSLWHDRGDELSSSFRGSSLKRDHQSPVSVFQGPVSCSTSSSGIGSYSRSPPKRIGGDVCSIRSGSGGLFNGFVRHALGSCVDHDPATFQVLDVDSGSSGLLDELTFNMEEGFLESNSEPYAKNLLLGAQARHKIFYDDFVVKAFYEAEKAHRGQVRATGDPYLQHCVETAVLLATIGANSTVVAAGLLHDTLDDTFITYDYIFRTLGAGVADLVEGVSKLSQLSKLARDFNTASKTVEADRLHTMFLAMTDARAVLVKLADRLHNMITLDALPPMKQQRFAKETLEIFAPLANRLGISTWKEQLENQCFKHLNPDQHNELSSKLMDSFDEAMITSAVGKLEQALKDKSLSYHVLSGRHKSLYSIYCKMLKKKLNMDEVHDIHGLRLIVETEEDCYKALQVVHQLWCEVPGRSKDYIAKPKCNGYQSLHTVVLGEGMVPLEVQIRTKEMHLQAEYGFAAHWRYKEDDCKHSSFVLQMVEWARWVVTWQCETMSRDQSSVGHTESIQPPCKFPAHSEDCPFSCKPDCGTDGPVFIIMIENDKMSVQEFAANSTVKDLLERAGRGSSRWTPYGFPLKEELRPRLNHEPVSDPNCKLRMGDVIELTPAIRHKSLTEYREEIQRMYDRGVSPLPAAAAANTVVGLRS

SEQ ID NO: 37578 - protein, 254 aa, Rhodobacter sphaeroides 2.4.1
MSDFLQGLFSLTGRRAMVTGASRGLGQAIALGLAEAGADLVLTARAAGALEETAARIRALGREALCLALDQSDPASVAAPMEAAGRIDILVNNAGTEEVCPSEAVTPELWDRILDTNLRGAFFVTQAAARGMLARGQGSIVNLCSLTSFVGVPTAVPYGSSKSGLLGMTRALAAEWAPRGVRVNAIAPGYFRTALTEVFYQNEDWAQAMQARIPQGRFGEGRDLVGAAVFLASDASAYVTGQCLGVDGGYLGSI

SEQ ID NO: 37579 - protein, 585 aa, Magnaporthe grisea 70-15
MLGGKSIRVNGAECGVESLFLGAVTSLGGFLFGYDTGQISGMLIFEDFQRRFATGPVGENGIREWVPIIQSTMVSLMSIGTLIGALSGAYTADWWGRRRSLAFGVILFIIGNIIQITAMESWIHMMMGRLIAGFGIGNLSVGVPMFQSECAPREIRGAVVASYQLLITFGILISNIINYGVRNIQGSDASWRIVIGLGIFFSVPLGIGILLVPESPRWLAGRQDWDGARMSIARLRGMKHDPNNVLVETDISEMYKIIKEESSVGVGSWAECFTGKGGSEGIPKVVYRTILGMFMHFTQQWTGVNYFFYYGATIFQSAGVDDPIVTQLILGAVNVAMTFLGLYIVEKFGRRGPLFIGGAWQAVWLAVFAAIGTALPPTENRVSGIVMIVSACMFIASFASTWGPICWVVIGETFPLRTRAKQASLSTAGNWLGNFMISFLTPIATDGISFSYGFVFAAVNLCGALGVYFFLYESRMLSLENVDRMYGDPSIKPWNSRKWTPPGYINRRTKDEKYVPEGEHVQGGVRGSVGSDNTAVPGEADVNHDHAKQRPGSDGVPTTEQHEQAVLRNAKLTGLAASESIYIQT

SEQ ID NO: 37580 - protein, 428 aa, Zea mays
  misc_feature (87)..(87): Xaa can be any naturally occurring amino acid
  misc_feature (130)..(130): Xaa can be any naturally occurring amino acid
MSSSMESSYLPATTESLAQAQEAKDASESISILYRVIQDPSSSADALRTKEVAITNLTNYLTKENRAEELRNLLTQLRPFFAVIPKXAKTAKIVRGIIDAVAKIPGTSDLQISLCKEMVEWTRAEKRTFXLRQRVEARLAALLLENQEYTEALTLLTSLIKEVRRLDDKLLLVDIDLLESKLHFSLRNLPKAKASLTAARTAANAIYVPPAQQGTIDLQSGILHAEEKDYKTAYSYFFEAFEAFSALEDPKAIFSLKYMLLCKIMVNQADDVAGIISSKAGLKYLGPDVDAMKAVADAYSKRSLKYFETALRDYKSQLEEDPIVHRHLSSLYDTLLEQNLCRLIEPYSRVEIAHIAEMIELPIDHVEKKLSQMILDKKFAGTLDQGAGCLIIFEDSKTEEIFPATLETISNVGKVVDSLYVRSAKIMA

SEQ ID NO: 37581 - protein, 383 aa, Zea mays
MALLSPRVPRLPPSTFTSVAGARCFGPAARCQATAAGGVAAAGPPSSELEAIRWGSAKLQGARDEMEDEVLLRPGSLLDGFSFAAVLDGHAGFSAVQFLRDELYKECAAALDGGAVLSTKNLDAITASIQRAFAAVDAKLSTWLEQTDKDDSGATATVMFLRSDVLVVSHIGDSCLVISRGGRSEALTGSHRPYGNNKTSLEEVKRIRAAGGWIVDGRICGDISVSRAFGDIRFKTQKNEMLVKGVKQGRWTDKFISRIQFKDDIVISSPDVSLVELGPDVEFVLLATDGLWDYIKSSEAVAFVRDQLRQHGDVQLACEALGQKALDQRSQDNISIVIADLGRTNWKALPDERPNLFLELSQAVATVGVVSIGIWVSSFLGLQ

SEQ ID NO: 37582 - protein, 413 aa, Rhodobacter capsulatus
MDGDIRHNSYDDGSEDVLTGEQSIRNFNINFGPQHPAAHGVLRMVLELDGEIVERADPHIGLLHRGTEKLMESRTYLQNTPYFDRLDYVAPMNQEHAWCLAIEKLTGTAVPRRASIIRVLFSEIGRILNHLLNVTTQAMDVGALTPPLWGFEEREKLMIFYERACGARLHANYFRPGGVHQDLPPDLIDDIEIWAKAFPQVLDDIEGLLTENRIFKQRNADICIITEAEIEKWGYSGVMVRGSGLAWDLRRAQPYECYDEFDFKVAVGKNGDCYDRYLVRMAEMRESTKIILQACAKLRAPDGQGDILARGKLTPPKRAEMKTSMEALIHHFKLYTEGFKVPAGEVYAAVEAPKGEFGVYLVADGTNKPYRAKIRAPGYAHLQSIDAVAKGHQLADVSAIIGTMDVVFGEIDR

SEQ ID NO: 37583 - protein, 213 aa, Campylobacter jejuni subsp. jejuni NCTC 11168
MNKTILFDLDGTLIDSTDAILNSFQGAFKALGLTSKNNEEIKNLIGYPLEQMFRMLYPDKVNLSKEFVLAYREIYAQIYLEQTTLLPKAKEALELGSEIADLGIVTTKGGKFTPILLDYLGVKKFFKTLITLEDVTNPKPSSEPIILALKGLNKTQENAYMIGDTILDIQAAISANITPLALTCGYGNENELKAHSMVFLNAYEAVNYIARLN

SEQ ID NO: 37584 - protein, 113 aa, Synechococcus sp. WH 7805
MVEDTIFARILRGEIPCDEVYSDDRCLAFRDVAPQAPVHVLVIPREPIPSLREAQEQHASLLGHLMLVAARVAQQEGLDDWRTVINTGAAAGQTVFHLHVHVMGGRPLAWPPG

SEQ ID NO: 37585 - protein, 198 aa, Triticum aestivum
  misc_feature (184)..(184): Xaa can be any naturally occurring amino acid
MERVLKDDAIQEKGERARMASFVGAMAIADLVKTTLGPKGMDKILQSTGRGRSVTVTNDGATILKSLHIDNPAAKVLVDISKVQDDEVGDGTTSVVVLAGELLREAEKLVNMKIHPMTIIAGYRMAAECARNALLQKTMDNKDNTDKFRSDLMNIAMTTLSSKILSQDKEYFAELAVDAVLRLXGSTNLGIIPISEET

SEQ ID NO: 37586 - protein, 842 aa, Pichia pastoris
MTFPLLPAYASVAEFDNSLSLVGKAVFPYAADQLHNLIKFTQSTFLQVNVQVESSVTEDQFEELIDNLLKLYNNGINEVILDLDLAERVVQRIPGARVIYRTLVDKVASLPANASIAVPFSSPLGDLKSFTNGGSRTVYAFSETAKLVDVTSTVASGIIPIIDARQLTTEYELSEDVKKFPVSEILLASLTTDRPEGLFTTLVADSSNYSLGLVYSSKKSIPEAIRTQTGVYQSRRHGLWYKGATSGATQKLLGIELDCDGDCLKFVVEQTGVGFCHLERTSCFGQSKGLRAMEATLWDRKSNAPEGSYTKRLFDDEVLLNAKIREEADELAEAKSKEDIAWECADLFYFALVRCAKYGVTLDEVERNLDMKSLKVTRRKGDAKPGYTKEQPKEESKPKEVPSEGRIELCKIDVSKASSQEIEDALRRPIQKTEQIMELVKPIVDNVRQNGDKALLELTAKFDGVALKTPVLEAPFPEELMQLPDDVKRAIDLSIDNVRKFHEAQLAETLQVETCPGVVCSRFARPIEKVGLYIPGGTAILPSTSLMLGVPAKVAGCKEIVFASPPKKDGTLTPEVIYVAHKVGAKCIVLAGGAQAVAAMAYGTETVPKCDKIFGPGNQFVTAAKMMVQNDTSALCSIDMPAGPSEVLVIADKYADPDFVVSDLLSQAEHGIDSQVILLAVDMTDKELARIEDAVHNQAVQLPRVEIVRKCIAHSTTLSVATYEQALEMSNQYAPEHLILQIENASYVDQVQHAGSVFVGAYSPESCGDYSSGTNHTLPTYGYARQYSGVNTATFQKFITSQDVTPEGLKHIGQAVMDLAAVEGLDAHRNAVKVRMEKLGLI

SEQ ID NO: 37587 - protein, 180 aa, Tolypocladium inflatum
MGNKVFFDIEWEGPVMQGCKPTSTVKEQSGRINFKLYDDVVPKTAENFRALCTGEKGFGYEGSSFHRIIPEFMLQGGDFTRGNGTGGKSIYGEKFADENFQLKHDRPGLLSMANAGPNTNGSQFFVTTVVTSWLNGHHVVFGEVADQESLDVVKALEATGSGSGAVKYNKRATIVKSGEL

SEQ ID NO: 37588 - protein, 358 aa, Nakaseomyces delphensis
MSEWKVDPDNRRRLLQLQKVGANKRCVDCNAPNPQWASPKFGIFICLECAGTHRSLGVHISFVRSITMDQFKQEELVRMEKGGNEPFIEYMTSHGIDMTLPHKIKYDNPIAEDYKEKLSCEVEDKEFVEPKHPDFDPKALGKTSTPSVATKAGAGSITSNATSRQDTPIESRRTGTPQQKEKNEQYFAQLGQKNQERPDHLPPSQGGKFQGFGNTPVNNSKQANTNTMSLENLQTDPVGTLSRGWGLFSSALQKSFDDVNETYIKPNVQQWNTGELSEETKRAAAQFGQKFQETSTYGVQAFSSFTKQYITGEEDTMSNFNRTSPMPGTANSTNSTDNLLKKEKMRPPKAGEDEWEEF

SEQ ID NO: 37589 - protein, 445 aa, Magnetospirillum magnetotacticum MS-1
MLLLVFAILAAVPAQAASGGVEKINHIVVIYLENRSFDNMFGRFPGADGLEAAKGAPVQVDREGKPYTVLPPILDEKTKQPDPRFPAQIANAPFDIGPHVGQSEKHRDLVHRFYQNMEQINGGRNDKFAAWSDAGGLVMGTYDTSNTRLWALAREFTLADNFFQAAFGGSFLNHFWLICACTPQYEAAPASIRAQLDGDGHLVKDGAVTPDGYPVNTIFSFYPPYPPSATDLAKRLPPQTAPNIGDRLSGKNVSWAWYSGGYAAALEGRNQGNFQYHHQPFVYFASTGEGTKAKARHLKDEAPLFESVAAGRLESVVFYKPVGDENQHPGYADLASGDAKAARLVDAIRASALWKDTAIIITYDENGGFWDHVAPPKGDRWGPGTRIPALIISPYAKRGFVDHTVYDTTSILKLIETRFGLPPLGRRDAVANDLTAAFDFTSERR

SEQ ID NO: 37590 - protein, 458 aa, Sinorhizobium meliloti 1021
MLERSNELTAWDRDHFFHPSTHMGMHARGETPTRVIGGGEGVYITDISGKRSLDAFAGLYCVNVGYGRQKIADAIAEQAKNLAYYHAYVGHGTEASIRLSKMIIDRAPEGMSRVYFGLSGSDANETNIKLIWYYNNILGRPEKKKIISRWRGYHGSGVMTGSLTGLHLFHNAFDLPRAPILHTEAPYYFRRPDRSMSEEQFSQYCADKLEEMILAEGPDTVAAFIGEPILGTGGIVPPPKGYWEKIQAVLQKYDILLVADEVVTGFGRLGTMFGSDHYGIKPDLITIAKGLTSAYAPLSGTIVSDKLWQVLVKGSDELGAIGHGWTYSAHPICAAAGIANLELIDELGIVENAGSTGAYFRAELQKAVGDHRHVGEVRGDGLMAAIEFVEDRDDRAFFDPGRKVGPQVAAALLERGVIGRAMPQGDILGFAPPLCLTRDEADIVVKAAADTIQSVLGR

SEQ ID NO: 37591 - protein, 498 aa, Sinorhizobium meliloti 1021
MTAVFARTAFHDALKNLSDRQLLRELAYVGGRWVAGRDGTCLEVSDPASGAALAFVASLDAAQTSEAIDAAQKAFRSWHNMLPQARAAILRKWHDLMLEAREDLALLMTLEQGKPLAESRGEIDYAASFIEWYAEEGKRLNAESVTSHLAGAEMIVRREALGVVGIVTPWNFPSAMITRKAAAALAAGCTVVAHPSSETPLSALALAELGERAGLPAGVFNVVTGKAATIVGRMCEDARVRAMSFTGSTEIGRLIASQCAPTMKRLVMELGGHAPLIVFADANVEKAADIAIAAKFATSGQDCLAANRIYVERPALKAFQEAFAARIAGLKVGSGMEPDTDIGPLMHERAVAKVEEQVADALKLGARLAVGGKRHAAGPLFFQPTLLTDVPDDALIMREETFGPVAAVTAFDSEEEVVARANDTEYGLVAYVVTENGARQMRLARALEYGMVAVNRVKITGGPIPFGGWKQSGLGREGSRHGMEAFTELKYLCIDTAA

SEQ ID NO: 37592 - protein, 576 aa, Arabidopsis thaliana
  misc_feature (491)..(491): Xaa can be any naturally occurring amino acid
  misc_feature (499)..(499): Xaa can be any naturally occurring amino acid
MGKYSVLMIFIASSLLIVLQNVEIVNAVGCTGSFFNGNSSYAQNRRDLFSTLPNKVVTNGGFYNSSLGKSPNIVHAVALCGRGYEQQACIRCVDSAIQGILTTTSCLNRVDSFTWDKDEEDNVSCLVSTSNHSTFGNLELRPSVRYQSPNSIEPSKNMTLFEQEWNAMANRTVESATEAETSSVLKYYSAEKAEFTEFPNVYMLMQCTPDITSQDCKTCLGECVTLFKEQVWGRQGGEVYRPSCFFRWDLYAFHGAFDNVTRVPAPPRPQAQGNESSITKKKGRSIGYGGIIAIVVVLTFINILVFIGYIKVYGRRKESYNKINVGSAEYSDSDGQFMLRFDLGMVLAATDEFSSENTLGQGGFGTVYKGTLLNGQEVAVKRLTKGSGQGDIEFKNEVSLLTRLQHRNLVKLLGFCNEGDEQILVYEFVPNSSLDHFIFDDEKRSLLTWEMRYRIIEGIARGLLYLHEDSQLKIIHRDLKASNILLDAEMXPKVADFGXARLFDSDETRAETKRIAGTPGYMAPEYLNHGQISAKSDLYSFGVMLLEMISGERNHSFEGEGLAAFVSFFTIFFFFE

SEQ ID NO: 37593 - protein, 431 aa, Bacillus anthracis str. Ames
MSTIIDVYAREVLDSRGNPTVEVEVYTESGAFGRAIVPSGASTGEHEAVELRDGDKSRYLGKGVMNAVNNVNEAIAPEIVGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERIGDKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEIAVYDGIKSFYNIKR

SEQ ID NO: 37594 - protein, 228 aa, Magnetospirillum magnetotacticum MS-1
MGDHEARRGEIALSDALISDDNEKASLIEAGRLLFARECTFMQGASGLDHLPAATLTEVAFAGRSNVGKSSLINALTGRNTLARTSNTPGRTQELNFFNLGGRLVLVDMPGYGFAQAPKGLVEKWTRLVNGFLKGRSVLRRAVVLVDSRHGLKDSDRDMMKMLDKAAVVYQVVLTKADKLKASELDAVQARTLEEIKSRVAAHPSLIVTSSEKGTGIPELRAELASLA

SEQ ID NO: 37595 - protein, 509 aa, Bacillus anthracis str. Ames
MRKPTALIILDGFGLREETYGNAVAQAKKPNFDGYWNKFPHTTLTACGEAVGLPEGQMGNSEVGHLNIGAGRIVYQSLTRVNVAIREGEFDKNETFQSAIKSVKEKGTALHLFGLLSDGGVHSHMNHMFALLRLAAKEGVEKVYIHAFLDGRDVGPKTAQSYIDATNEVIKETGVGQFATISGRYYSMDRDKRWDRVEKCYRAMVNGEGPTYKSAEECVEDSYANGIYDEFVLPSVIVNEDNTPVATINDDDAVIFYNFRPDRAIQIARVFTNGDFREFDRGEKVPHIPEFVCMTHFSETVDGYVAFKPMNLDNTLGEVVAQAGLKQLRIAETEKYPHVTFFFSGGREAEFPGEERILINSPKVATYDLKPEMSIYEVTDALVNEIENDKHDVIILNFANCDMVGHSGMMEPTIKAVEATDECLGKVVEAILAKDGVALITADHGNADEELTSEGEPMTAHTTNPVPFIVTKNDVELREDGILGDIAPTMLTLLGVEQPKEMTGKTIIK

SEQ ID NO: 37596 - protein, 251 aa, Bacillus anthracis str. Ames
MRKPIIAGNWKMNKTLSEAVSFVEEVKGQIPAASAVDAVVCSPALFLERLVAATEGTDLQVGAQNMHFEKNGAFTGEISPVALSDLKVGYVVLGHSERREMFAETDESVNKKTIAAFEHGLTPIVCCGETLEERESGKTFDLVAGQVTKALAGLTEEQVKATVIAYEPIWAIGTGKSSSSADANEVCAHIRKVVAEVVSPAAAEAVRIQYGGSVKPENIKEYMAQSDIDGALVGGASLEPASFLGLLGAVK

SEQ ID NO: 37597 - protein, 168 aa, Oryza sativa (japonica cultivar-group)
KDAVRRAIQLGVAPGSQMFRHALSTAGCIGQDKIDAKVAVLKESLGWSQEEVNLAVSKAPRILVASEERLRRNAEFLIDEVGLQPQYVARRSVLLMYSLERRLVPRHLVVKLLKERGLIEQDRCFFNAVAPTEEKFLEKFVVPFEGCVPGLADAYESACAGKTPVQAE

SEQ ID NO: 37598 - protein, 394 aa, Bacillus anthracis str. Ames
MNKKSIRDVDLKGKRVFCRVDFNVPMKEGKITDETRIRAALPTIQYLVEQGAKVILASHLGRPKGQAVEELRLTPVAARLGELLGKDVKKADEAFGPVAQEMVAAMNEGDVLVLENVRFYAGEEKNDAELAKEFAALADIFVNDAFGAAHRAHASTAGIADYLPAVSGLLMEKELEVLGKALSNPERPFTAIIGGAKVKDKIGLIRHLLDKVDNLIIGGGLAYTFVKALGHEIGLSLCEDDKIELAKEFMQLAKEKGVNFYMPVDVVITEEFSETATTKIVGIDSIPSNWEGVDIGPKTREIYADVIKNSKLVVWNGPMGVFEMTPFAEGTKAVGQALADAEGTYSVIGGGDSAAAVEKFGMADKMSHISTGGGASLEFMEGKELPGVVCLNDK

SEQ ID NO: 37599 - protein, 334 aa, Bacillus anthracis str. Ames
MTKIGINGFGRIGRNVFRAALNNSEVEVVAINDLTDAKTLAHLLKYDTVHGTLNAEVSANENSIVVNGKEIKVIAERDPAQLPWSDYGVEVVVESTGRFTKKSDAEKHLGGSVKKVIISAPASDEDITVVMGVNHEQYDAANHNVVSNASCTTNCLAPFAKVLNEKFGVKRGMMTTIHSYTNDQQILDLPHKDLRRARAAAENMIPTSTGAAKAVALVLPELKGKLNGGAVRVPTANVSLVDLVVELDKEVTVEEVNAAFKAAAEGELKGILGYSEEPLVSIDYNGCTASSTIDALSTMVMEGNMVKVLSWYDNETGYSNRVVDLAAYMTSKGL

SEQ ID NO: 37600 - protein, 385 aa, Methanococcoides burtonii DSM 6242
MYADRINSLPPYLFATIDEAKAVVKAKGVDVIDLGVGDPDMPTPEHIVESMCEAVRDPATHRYPSYTGMIEFREAVANWCKDTRGLELDAATETLTLIGSKEGVAHIPLAFVNPGDVALIPDPGYPVYKIGTQFAGGEPHVMPLLEENGFLPDFDAIPADKLAKAKLMFLNYPNNPTSATADVKFFKEVVEFAKNNDITVVHDNAYSEMVYDDYTAPSFLSVDGAMDVGMELYSMSKTYNMTGWRLAFAVGNKDLIAGFGKVKSNIDSGAFDAVQRAGITAVSSSQQCVTDMNSIYQKRRDALLKGLRGIGLDAKAPKATFYMWVPTPDGYDSMGFSKLLLEESGIVATPGVGFGEYGEGYIRFALTQSVERIEEAVARMDKLTI

SEQ ID NO: 37601 - protein, 926 aa, Silicibacter pomeroyi DSS-3
MADGAHVEMVSFTLNGEEVTVPEGLTIWEAAHGRGLVIPHLCHKPDPGYRPDGNCRACMVEVAGERTLVASCIRPVAAGMVVTTDSARAEGARKMVVELLLADQPEVAHDASSHFHAMAGLNGVSESRFPARDAAHVPLLDASHVAMRVNLDACINCNLCVRACREVQVNDVIGMAGRGAGAQVVFDQNDPMGASTCVACGECVQACPTGALMPATVLDAEQAGDSKDYDREVTSVCPFCGVGCQLSFKVKDNKIKYVTGVDGPANESRLCVKGRFGFDYIDHPHRLTKPLIRRADAPKGLNVDPGNPLSHFREASWEEALDFAARGLADLRAQKGSYVAGFGSAKCSNEEAYLFQKLIRQGFGHNNVDHCTRLCHASSVSALLENVGSGAVTATFNEIENADVAIVIGCNPIENHPVAATYFKQFTKRGGKLIVCDPRGVGMGRFATHRLQFKPGADVSMLNAMMHVIVEEGLYDQAYIDQFTENWEEMKAHLADYSPEKMEPICGIAAGELRDAARTFAAGKAGMIFWGMGVSQHIHGTDNSRCLISLALMTGNVGKPGAGLHPLRGQNNVQGASDAGLIPMFLPDYQSVTDDGVRSAFTSVWNSGDFSNQKGLTVVEIMHAIHDGDIRGMYILGENPAMSDPDVDHARAALAMLEHLVVQDIFLTETANYADVILPASAWAEKTGTVTNTNRQVQMGRPAVAPPGQAKEDWWIEVELARRLGLDWNYSHPSEVFAEMKRNMKSLDNITWARLEGEAVTYPSLSPEDPGQAIVFGDGFPRANKRARFTPAKIVEPDERPDADYPFVLITGRQLEHWHTGSMTRRASVLDAVEPEANCSMHPATLRAMGIEPGDMIRLTTRRGSVQVMVRADRAIAQDNVFLPFAYVEAAANILTNAALDPYGKIPEFKYAAVKVERTDTAASAV

SEQ ID NO: 37602 - protein, 558 aa, Silicibacter pomeroyi DSS-3
MAYKSDIEIAREARKLPILEIGAKLGIAADELLPYGHDKAKVSQGFIDSVQDRADGRLILVTAINPTPAGEGKTTTTVGLGDGLNRIGKNAMICIREASLGPNFGMKGGAAGGGYAQIVPMEEMNLHFTGDFHAITSAHSLLSAMIDNHIYWGNEADIDTRRVVWRRVVDMNDRALRQITCSLGGVSNGFPREAGFDITVASEVMAILCLARDLKDLEKRLGDIIVAYRRDKSPVYCRDIKAEGAMTVLLKDAMQPNLVQTLENNPAFVHGGPFANIAHGCNSVIATKTALKVADYVVTEAGFGADLGAEKFMNIKCRKAGIAPSAVVLVATVRAMKMNGGVAKGDLGAENVAAVNKGCANLGRHIENVKSFGVPVVVAINHFVTDTDAEVQAVRDYCANHGVEAVLSRHWELGSEGSEALARKVVELAESGKANFAPIYPDDMSLFEKIETIAKRIYRADEVLADAKIRNQLKEWEEAGYRNLPVCMAKTQYSFTTDPNRRGAPTGHSVPVREVRLSAGAGFIVVVCGEIMTMPGLPRKPAAETIRLNDAGQIEGLF

SEQ ID NO: 37603 - protein, 203 aa, Brassica napus
MAGATSSSLIWSPWQATLHHYNNRFHHVKGYPFPCHAFHPICNSFNFKRRFSSSIFKDDHVIMDSSSFSNKQGRLSMSGCGCSWIQDNSMVHASATKKCSALPTKTVDVSSVSDLFEFICSGPLVDKIGITPENVGQAIDKWLLYGSQLCRLFQLNELKLTIPQKARLYHYYIPVFVWCEDQIALHNSKFKDGDDVPPLVIGF

SEQ ID NO: 37604 - protein, 210 aa, Sinorhizobium meliloti
AGGIAEMSHLPPEVRKSTDALDAVGNTTKAVTKGYAIGSAGLGALVLFAAYSNDLAYFAANGDKHPYFADVGTISFDLSNPYVVAGLIFGGLIPYLFGGIAMTAVGRAGSAVVEEVRRQFKEKPGIMEGKDRPDYGRAVDMLTKAAIREMIIPSLLPVLAPIVVYFGVLLISGSKASAFAALGASLLGVIVNGLFVAISMTSGGGAWDNA

SEQ ID NO: 37605 - protein, 492 aa, Oceanicola granulosus HTCC2516
MLDDTTDFTALLSDPSLVCSQAFVGGKWVDAASGETFDVTNPARGDVIARIPDLSREEVAEAIAVADRARHAWAAKTGKERAAVLRKWFDLMMANQEDLAIIMTAEQGKPLAESRAEIAYGAGFIEWFGEEAKRIYGETIPGHQPDKRITVLRQPIGVAAGITPWNFPNAMITRKVAPALAAGCSFVIRPASQTPLSALAMAKIAEEAGVPAGVFSVVTSTSASEIGREFCENPKVRKLTFTGSTEVGRILLRQAADQVMKCSMELGGNAPFIVFDDAEIDAAVQGAIMCKFRNNGQTCVCANRIYVQDAVYDTFAEKLKAEVEKLSVGDGLDDGTQLGPLIEPAAIKKVREHLQDALDKGAKILTGGEAHPLGEQFFQPTVVTEANQQMKVATEETFGPFAPLFRFKDEDEVIELANDTIFGLASYFYAKDLSRVVKVQEALEYGIVGVNTGIISTEVAPFGGVKQSGLGREGSRHGIEDYLELKYICTSV

SEQ ID NO: 37606 - protein, 199 aa, Rhodobacter capsulatus
MSEKLQDLAAHVAQQRPGDVISAEVVQGELTVTVKPEGIADFVRFLRDDAGCRFTTLVDLTAVDWPERVERFEMVWHFLSMWKNQRIRVKAGLAEDAMCPSIVEVYPAANWYEREVFDMFGILFSGHPDLRRLLTDYGFRGHPLRKDFPTTGYIELRYDEVQKRVVYEPVKLAQEYRQFDFLSPWEGAQSVLPGDEKRS

SEQ ID NO: 37607 - protein, 1478 aa, Gibberella zeae PH-1
MSSSCQFNSGASTPKPLYHNNNGSACSTNVCTEKNIDGNTEIPMSEGEPDVHNENVMQLARQLTKRSTAAPGTLFPQADGPLNPSSPIFNAKKWAKAFYQLRTDTSEGNPPRTTGVAFRNLNVFGFGSDTDFQKSVGNVFLEAGTLVKKLLHDKQRRVDILQNLEGVVQSGEMLAVLGPPGSGCSTFLKTIAGDTHGFHIDNGSEINYSGIRPEEMRTAFRGEAIYTAEVDHHFAHLTVGDTLYFAARARCPKNIPEGIGRREYAEHLRDVTMAMFGISHTKNTRVGDDFVRGVSGGERKRVTIAEAALSYSPLQCWDNSTRGLDSANALEFCRTLRTQADVMGCTSAVAIYQASQDAYEIFDKVLVLYQGRQIFFGRTGEAKAYFERLGFICPEQQTTADFLTSMTSHQERIIRPGFEGKAPRSPDEFAQAWKDSIHRQTLLTEVDDYIQRHPFGGEHYENFVDSRKRDQSKSQRVKSPFTLSYMEQMSLTLGRSWVMLKADPSVTVTLLLCNLVESLVIGSIFYNLPETTDALMKRGLFIFFILLMNAYNNVLEIMTLYAKRNIVEKHARYALYHPSAEALSSMLVDLPYKIFNTIMMNTTMYFMGNLRRDAGHYFFFLLVSFVTALNFSMLFRLIASLTKTIAAALARASIMLLVIALYTGYAIPPQYMPVWIGWLRWINPTFYGLESLFINEFGGQSYPCSNFVPSGPEYSDISRFSQACAVQGSVPGEDFVRGSAYLSTAYGYLDSHKWRNFAVVIAFSILFMGLHLIATETIASERSKGEVLVFTRKEMKKHAGKGKSDEEAGSTGGTQLASGNEATEEVTDVEEQTSVFHWKNVCYDVKIKGETRRILDHVDGWVKPGTLTALMGSSGAGKTTLLDVLASRVTMGVVTGEMLVDGKLRDESFQRKTGYVQQQDLHVHTQTVREALNFSALLRQPAKYTRQEKLDYVDTVIGLLDMEEYSDAIIGVPGEGLNVEQRKRLTIGVELAARPQLLLFLDEPTSGLDSQTSWSICNLMQKLTNNGQAILCTIHQPSAMLFQRFDRLLLLSRGKTIYFGDIGKNSRVLVDYFARNGGPKCPAGVNPAEYMLEVIGAAPGAHTEIDWPEVWRSSQEHELVQQELERLAGQGSSHAEQDDGTEYNEFAATSYVQYTQVTKRLFQQYWRSPGYIYSKVILSAGASLFIGLSFLNGQNTERGLQNQMFGILVFLTIFTQVVQQMLPDYVAQRTMYEARERPSKTYSWKAFMVSTILVEAVWNSIMAVLSFICWYFPTGLYRNGYATDAANSRNATVFLFVWMFFMFTSTFAHMIIAGFDTAEVAGGLVTLIMIMMFSFCGILATPEELPGFWIFMNRASPFTYVVEGLMGTSMANADAGCETNEFISFTAPNGTTCGDYMKTYLSEVGGYIVSGTTSECQYCKISGTNRFLESKSMSYDNRWRDFGFLWVYCVFNIAAAFAIYWVVRVPKKNKGKKEKGME

SEQ ID NO: 37608 - protein, 352 aa, Glycine max
MGEVDPAFIQDLEHRPKLSIIQAEGIPIIDLSPISNHTVSDPSSIENLVKQIGSACKEWGFFQVTNHGVPLTLRQNIEKASRLFFAQNLEEKRKVSRDESSPNGYYDTEHTKNIRDWKEVFDFQAKDPTFIPVTFDEHDDRVTHWTNHSPQYPPNFRDIIEEYVQEVEKLSFKLLEIIALSLGLEAKRFEEFFIKDQTSFIRLNHYPPCPSPHLALGVGRHKDIGALTILAQDDVGGLEVKRKADQEWIRVKPTPGAYIINVGDLIQVWSNDLYESVEHRAMVNSEKERFSIPFFLFPAHYTEVKPLEELTNDQNPAKYRPYNWGKFLVRRKGSNFKKLNVENIQIYHYKIA

SEQ ID NO: 37609 - protein, 617 aa, Saccharomyces cerevisiae
MADLPQKVSNLSINNKENGGGGGKSSYVPPHLRSRGKPSFERSTPKQEDKVTGGDFFRRAGRQTGNNGGFFGFSKERNGGTSANYNRGGSSNYKSSGNRWVNGKHIPGPKNAKLEAELFGVHDDPDYHSSGIKFDNYDNIPVDASGKDVPEPILDFSSPPLDELLMENIKLASFTKPTPVQKYSIPIVTKGRDLMACAQTGSGKTGGFLFPLFTELFRSGPSPVPEKAQSFYSRKGYPSALVLAPTRELATQIFEEARKFTYRSWVRPCVVYGGAPIGNQMREVDRGCDLLVATPGRLNDLLERGKVSLANIKYLVLDEADRMLDMGFEPQIRHIVEECDMPSVENRQTLMFSATFPVDIQHLARDFLDNYIFLSVGRVGSTSENITQRILYVDDMDKKSALLDLLSAEHKGLTLIFVETKRMADQLTDFLIMQNFKATAIHGDRTQAERERALSAFKANVADILVATAVAARGLDIPNVTHVINYDLPSDIDDYVHRIGRTGRAGNTGVATSFFNSNNQNIVKGLMEILNEANQEVPTFLSDLSRQNSRGGRTRGGGGFFNSRNNGSRDYRKHGGNGSFGSTRPRNTGTSNWGSIGGGFRNDNEKNGYGNSNASWW

SEQ ID NO: 37610 - protein, 434 aa, Arabidopsis thaliana
METPTMKPDTVLILDYGSQYTHLITRRIRSLNVFSLVISGTSSLKSITSYNPRVVILSGGPHSVHALDAPSFPEGFIEWAESNGVSVLGICYGLQLIVQKLGGVVVEGESKEYGKMEIEVKGKSEIFGSESGGEKQMVWMSHGDEAVKLPEGFEVVAQSAQGAVAALESRKKKIYGLQYHPEVTHSPKGMETLRHFLFDVCGVSADWKMEDLMEEEIKVINKTVASDEHVICALSGGVDSTVAATLVHKAIGDRLHCIFVDNGLLRYKEQERVMDTFERDLHLPVTCVDASERFLSELKGVVDPETKRKIIGREFINIFDQFAQELEKKHGKKPAFLVQGTLYPDVIESCPPPGTDRTHSHTIKSHHNVGGLPKDMKLKLIEPLKLLFKDEVRELGRILNVPVGFLKRHPFPGPGLAVRVLGDVTQGNALEVLR

SEQ ID NO: 37611 - protein, 347 aa, Triticum aestivum
MSSRVAGSVLLRHLGPRVFGPTTPAAQRPLLAGGEGGAVAVAMWARPLSTSAAEAAREEATASKDNVASTAAATAEAMQAAKAGAVQAAKEGKSPAASSYWGIVPAKLVNKDGAEWKWSCFRPWEAYTSDTTIDLSKHHKPKVLLDKIAYWTVKSLRVPTDIFFQRRYGCRAMMLETVAAVPGMVDGMLLHLRSLRRFEQSGGWIRALLEEAENERMHLMTFMEVANPKWYERALVLAVQGVFFNAYFLGYIVSPKFAHRVVGYLEEEAIHSYTEFLRDLEAGRIENVPAPRIAIDYWRLPADARLKDVVTVVRADEAHHRDVNHFAADIHFQGLELNKTPAPLGYH

SEQ ID NO: 37612 - protein, 483 aa, Rhodobacter sphaeroides 2.4.1
MRAQPAASHFVDGRPLEDETGAPIPVIYPATGEEIARLHEATPAVIEAALASGARAQAAWAAMRPVERARILRRASDLIRAHNEELSLLETLDTGKPLQETLVADWASGADALEFFAGLAPVVTGETVPLGQDFVYTIREPLGLCVGIGAWNYPSQIACWKAAPALALGNAMVFKPSEVTPLGALKLAEILIEAGLPPGLFNVVQGRGAVGASLVTDSRVAKVSLTGSVPTGRRVYAAAAEGVRHVTMELGGKSPLIVFDDADLESAIGAAMLGNFYSAGQICSNGTRVFVQKGIKEAFLARLAERADAIRMGDPLDPEVQMGPLVSQAQLEKVLAYIEKARAEGGRLVCGGEASVSPGCYVQPTVFADVTDAMTLAREEVFGPVMAVLDFETEEEAIARANATDFGLAAGVFTADLTRAHRVVAQLQAGTCWINAYNLTPVEAPFGGVKLSGVGRENGRAAVQHYTQVKSVYVGMGPVDAPY

SEQ ID NO: 37613 - protein, 498 aa, Mycobacterium leprae TN
MATLAESPEPKSGASRAGVLGEEAGYHKGLKPRQLQMIGIGGAIGTGLFLGAGGRLAKAGPGLFLVYAVCGVFVFLILRALGELVLHRPSSGSFVSYAREFFGEKAAYVVGWLYFLDWAMTAIVDTTAIATYLHRWTIFTALPQWTLALLALAVVLVMNLISVEWFGELEFWAALIKVCALMAFLVVGTIFLGGRYPVDGHNTGLSLWTSHGGLFPTGVAQLIVVSSGVMFAYAAVELVGTAAGETVEPKKIMPRAINSVIARIAIFYVGSVILLALLLPYSAFKASESPFVTFFSKVGFYGAGDLMNIVVLTAALSSLNAGLYATGRVMHSIAINGSGPKFTARMSKNGVPYGGILLAAVICLCGVALNAFNPGQAFEIVLSVAALGIIAGWGTIVLCQLRLHKMAKAGIMRRPRFRMPLAPYSGYLTLAFLFAVLVVMAFDKPIGTWTVASLIVIVPALIAGWYSIRKRVMTIARERMGYTGPFPAIANPPVKSSD

SEQ ID NO: 37614 - protein, 505 aa, Mycobacterium leprae TN
MATLAESPEPKSGASRAGVLGEEAGYHKGLKPRQLQMIGIGGAIGTGLFLGAGGRLAKAGPGLFLVYAVCGVFVFLILRALGELVLHRPSSGSFVSYAREFFGEKAAYVVGWLYFLDWAMTAIVDTTAIATYLHRWTIFTALPQWTLALLALAVVLVMNLISVEWFGELEFWAALIKVCALMAFLVVGTIFLGGRYPVDGHNTGLSLWTSHGGLFPTGVAPLIVVSSGVMFAYAAVELVGTAAGETVEPKKIMPRAINSVIARIAIFYVGSVILLALLLPYSAFKASESPFVTFFSKVGFYGAGDLMNIVVLTAALSSLNAGLYATGRVMHSIAINGSGPKFTARMSKNGVPYGGILLAAVICLCGVALNAFNPGQAFEIVLSVAALGIIAGWGTIVLCQLRLHKMAKAGIMRRPRFRMPLAPYSGYLTLAFLFAVLVVMAFDKPIGTWTVASLIVIVPALIAGWYSIRKRVMTIARERMGYTGPFPAIANPPVQPSERSHSQNP

SEQ ID NO: 37615 - protein, 460 aa, Pediococcus pentosaceus ATCC 25745
MNANKKRISPYVILISCAAALGGLLFGYDTAVISGAVGFLQIKFTLSSAQVGWVTSCILIGCALGVSIAGILSDLFGRKKILALSAVIFALSSLGAAFAGSYMILVIWRMLAGIGIGLTSLITPLYIAEMAPSNVRGKLVSVNQLAITIGIFIVYFVNAAIASNATQLWNVSTGWRWMMGVGVIPSLLFLIALIPAGESPRWLSQHGKSEAAYKVLQKVEISDEAAEKSLEEIQMSEEVVDDTKFRDLFNKTWLPVLIIGVLLALFQQFSGSNAIMYYAPEIFKGAGFGQSGAFMATVSIGVINMVITIVALGLVDKIGRKKLLGWGSFAMSCCLLVVSICFFVHAATSITLTFVLLAIAAYAVSLAPVTWILISEIFPLKIRGRAMSICTAVLWLSDFTLSYTFPILTQNIGEGWTFMLYVVVTALSAIFVWKLVPETRGKSLEEIEVYWHAKSKTHVK

SEQ ID NO: 37616 - protein, 918 aa, Neurospora crassa [sequence omitted]

SEQ ID NO: 37617 - protein, 64 aa, Brassica napus
FLLYSFPKVLIDGPYGAPAQDYKKYEVVLLVGLGIGATPMISIVKDIVNNIRAKEQAELNRMEH

SEQ ID NO: 37618 - protein, 337 aa, Cryptococcus neoformans var. neoformans JEC21
MFYVIGLGLSDEKDITVKGLEAVKNSARVYLESYTSILMVEKEKLEAFYERPVITATREMVELEADDILKDADKVDISFLVVGDPLGATTHSDLLLRAQSRNIPTSIIHNASILTALGSTGLQMYSFGQTLSLPFYTETWRPDSWYPRLEENLRLGVHTLVLLDIKVREQSEENMARGRLIYEPPRFMNPAQAFNQMLLTESIRHPAPRHPSQSQSTDQTQKPSQLPSSSHSDSEEEEEEAERVDPYPSLMPPSQTLAISLSRVGTPSQRLISGTLSELAALDEEEFGGPLHSVVIVGKRLHPLELEYAGKFAVGGEQGDWWKVGKEVYGVERETFY

SEQ ID NO: 37619 - protein, 906 aa, Yarrowia lipolytica CLIB122
MKADYKFSNLLGTVYRQGNLVFTPDGTALLSPVGNRVSYFDLVKNTSFTFPYEHRRNITCIALNAQGSLMLTVSDDGKAILVNFKRRTVIHHFNFRDVVSDVQFSPDSQYFAINIGARLEVWAIPSDTNSRSFAPFVRHKRYEGHFAEITSITWSDDSRFFLTTSKDLTCRVWSLMDKDSGAAATLGGHRDTITNAFFSQDQETIYTVSKDGACFEWAYDDNDDGDDGFVGWKIKDRHYFHQQSVLKCSAFHAKSNILVVGFANGTFAMYELPSMTQIQTMSVSQHGIDFVTINSTGEWMALGASKLGQLLVWEWQSESYILKQQGHFDSMNSLVYSPDGSKVVTASEDGKIKLWDTSSGFCLVTFTEHSAAVTALEFSRKGNVLFSASLDGSVRAWDLIRYRNFRTFAAPERIQFSSLAVDPSGEVVCAGSLDNFDIYVWSVQTSQLLDTLAGHEGPVSCLSFGAEIANASILASASWDHTVRVWNIFARTQTVEPFQLTSDVLQVVMRPDSKQLSVSTLNGEISVWDIEEGKQVGSIDGAKDISGGRHSSDRFSAKNSARSKYFTCMTYSADGKCLIAGGNSRFICLYDVQSGVLLKRFEVSRNMSLEGTLDYLNSKNMTEAGALNLINDPDGSDWEDRVDDTLPGVVRGDKSKRRTRPEIRTTGIKFSPTGRQFAAASTEGLLMYSIDDELMFDPFDLDVDVTPQTTMEALENKEYLIALVMAHRLNVPRLIQRVYESIPVDTIERVARGLPVVYLERFLRFLASATEATPHAEFHLRWIKAVITAHGRHMAQRKHEYAQVLRAVQKFVTRVNKEVARLAGTNGYSAEFLLGSKPSVPVDESRMITGEPDEVLVPIETEMEVEDEDDDDDDDEEGWFGPESKNDAFAQMDVDEDDDDEEEEDE

SEQ ID NO: 37620 - protein, 873 aa, Zea mays
  misc_feature (525)..(525): Xaa can be any naturally occurring amino acid
  misc_feature (530)..(530): Xaa can be any naturally occurring amino acid
  misc_feature (709)..(709): Xaa can be any naturally occurring amino acid
MFGNIGKIPIIGDLTGSNKNAHLKGNLVLMRKTVLGFDVTSIAGSLMDGLGEFLGRGVTCQLVSSTVVDPNNGNRGKVGQEASLEQWLLHPPPLLAGEDQFRVTFDWEVEKHGVPGAIIVKNNHASEFFLKTITIDDVPGHGPIVFVANSWVYPQYKYRYNRVFFSNDTYLPSQMPAALKPYRDDELRNLRGDDQQGPYQEHDRVYRYDVYNDLGNPDAKNPRPVLGGSKHHPYPRRGRTGRKPTQTDPNSESRLTLTDGDVYVPRDERFGHIKNSDFYGYTIKAFVDGLVPILEGYLLGIEFNSFKDILQLYEGGIKLPDIPALEEFRKQFPLQMVKDLMPAGGDYVLKLPMPKIIKEDKKAWMSDEEFARETLAGVNPLIIRRLTEFPPKSTLDPSKYGDQTSTITEAHIAGSLEGLTVQQALDSNRLYILDHHDHYMPFLIEVNSLNDNFIYATRTLLFLRGDGTLAPVAIEMSLPELRDGITAAKSTVYTPAPPDGRRGGRGCGRLAKAYVNVNDYCWHQXISHWXLNTHAVMEPFVIATNRQLSVTHPVHRLLLPHYRDTMNINALARQKLINAGGIFEMTVFPRKYAIEISSKVYGSWNFTEQALPDDLIKRGMAVPDPSSPYKVRLLIEDYPYASDGLAVWHAIEQWVTEYLAIYYPNDGVLQADVELQAWWKEAREVGHADLKDEHWWPKMQTVPELVKAXTTIIWIASALHAAVNFGQYPYCGYHPNRPSVSRRPMPVPGSDAYKELEKNPEKFFVRSITAQFQAVVGISLLEILSSHSSDEVYLGQRDTKEWTSDAKAQEAFKRFGARLTEIEKRVEAMNKDPRFKNRYSAAQFPYTLLFPNTSDKGDNTGVTAKGIPNSISI

SEQ ID NO: 37621 - protein, 442 aa, Silicibacter pomeroyi DSS-3
MTIDLAKFAKDKGVKYFMISFTDLFGGQRAKLVPAQAIADMQEDGAGFAGFATWLDMTPAHPDMLAVPDPSSVIQLPWKPEVAWVAGNCVMEGADVAQAPRNVLRRLIAEAAAEGMHVKTGIEAEFFLLTPEGDQISDPFDTAAKPCYDQQAVMRRYDVVREICDYMLELGWGPYQNDHEDANGQFEMNWEFDDALSTADKHSFFKFMTKSVAEKHGFRATFMPKPIEGLTGNGCHAHISVWDAPGAASKVNVFAGAGDGPTGEVGLSERGKHFLGGIMKHASALAAITNPTVNSYKRINAPRTMSGATWAPNTVTWTGNNRTHMVRVPGPGRFELRLPDGAVNPYLLQAVIIAAGLSGIHSKADPGKRWDIDMYAEGHKVRGAPKLPLNMLDAIREFDRDKELKKSMGDEFSASYIKMKMQEWNSFVTHFSRWEKENTLDI

SEQ ID NO: 37622 - protein, 217 aa, Oryza sativa (japonica cultivar-group)
MDSKDKEKEHEQTASGRNPDVNDVEEEEEDEEGNKRAVVLGPQVPLKEQLELDKDDESLRRWKEQLLGQVDTEQLGETAEPEVKVLNLTILSPDRPDLVLPIPFVPDEKGYAFALKDGSTYSFRFSFIVSNNIVSGLKYTNTVWKTGVRVENQKVMLGTFSPQLEPYTYEGEEETTPAGMFARGSYSAKLKFVDDDGKCYLEMSYYFEIRKEWPTIQ

SEQ ID NO: 37623 - protein, 336 aa, Pseudomonas syringae pv. syringae B728a
MSRVTLSRYLIEQTRSNNTPADLRFLIEVVARACKEISHAVSKGALGGVLGSMGTENVQGEVQKKLDVISNEILLEANEWGGHLAGMASEEMDNAYQIPGKYPKGAYLLVFDPLDGSSNIDINAPVGTIFSVLRCPNEYLSQNEALNEKAFLQPGTEQVAAGYAIYGPQTMLVLTLGDGVKGFTLDREMGSFVLTHEDITIPESTQEFAVNMSNQRHWEAPVQRYVSELLAGEDGPLKKNYNMRWVAAMVADVHRILTRGGLFMYPRDSREPSKPGKLRLMYEANPMSFLVEQAGGASTDGHQRILDIQPEGLHQRVAVYLGSKEEVERATAYHKA

SEQ ID NO: 37624 - protein, 388 aa, Synechococcus sp. WH 5701
MKLSARAEALHPSLTLAIAARAKQLRAQGQDICSLSAGEPDFDTPAFIRQAASEALEAGATRYGPAAGEPALREAIAVKLSEENGVPTKAEQVLVTNGGKQALFNLFQVLLGPGDEVLLPAPYWLSYPEMVQLAGASVRLLPSDAEHGFRLDPQQLEAAITPASRLLVLNSPSNPTGMVLSRQELEAIAAVLRRHPHVAVVCDEIYEFLLAPGHVHHSFAAVAPDLSDRVFIVNGFAKGWAMTGWRLGFLAGPSAVVSAAIALQSQSTSNVCSFAQFGALAAVSGPRDCVVEMARQFSERRALLHQGLASLPGLTLQPPEGAFYAFPDVSAYGLDSMTFCNRLLNEVGLALVPGVAFGDDRCVRLSCAASPATLRDGLARLGHFISSL

SEQ ID NO: 37625 - protein, 496 aa, Pseudomonas aeruginosa PAO1
MFELSDWQRRAATQRFIDQALIGGRQRPAASGATFDAIDPASNRLLARVAACDAADVDAAVAAARRAFDEGPWARLAPVERKRVLLRLAELMLAHREELALLDSLNMGKPVMDAWNIDVPGAAHVFAWYAESLDKLYDQVAPTAQQTLATITRVPLGVIGAVVPWNFPLDMAAWKLAPALAAGNSVVLKPAEQSPFSALRLAELALEAGVPEGVLNVVPGLGEQAGKALGLHPEVDALVFTGSTEVGKYFMQYSAQSNLKQVWLECGGKSPNLVFADCRDLDLAAEKAAFGIFFNQGEVCSANSRLLVERSIHDEFVERLLAKARDWQPGDPLDPASRAGAIVDRRQTAGILAAIERAQGEGATLLGGGRQLTINGSDNFIEPTLFGDVRPDMQLAREEIFGPVLAISAFDSEDEAIRLANDSRYGLAASLWSDDLHRAHRVARRLNAGTVSVNTVDALDVAVPFGGGKQSGFGRDLSLHSFDKYTQLKTTWFQLR

SEQ ID NO: 37626 - protein, 460 aa, Pseudomonas aeruginosa PAO1
MTAQLNPQRDTRDYQQLDAAHHIHAFLDQKALNREGPRVMVRGDGLQLWDNDGKRYLDGMSGLWCTNLGYGRQDLAAAASRQLEQLPYYNMFFHTTHPAVVELSEMLFSLLPDHYSHAIYTNSGSEANEVLIRTVRRYWQILGKPQKKIMIGRWNGYHGSTLGSTALGGMKFMHEMGGMLPDFAHIDEPYWYANGGELSPAEFGRRAALQLEEKILELGAENVAAFVAEPFQGAGGMIFPPQSYWPEIQRICRQYDVLLCADEVIGGFGRTGEWFAHEHFGFQPDTLSIAKGLTSGYIPMGGLVLGKRIAEVLVEQGGVFAHGLTYSGHPVAAAVAIANLKALRDEGVVTRVREETGPYLQRCLREVFGDHPLVGEVQGAGFVAALQFAEDKVTRKRFANENDLAWRCRTIGFEEGVIIRSTLGRMIMAPALVAGRAEIDELIDKTRIAVDRTAREIGVL

SEQ ID NO: 37627 - protein, 59 aa, Crocosphaera watsonii WH 8501
MNGLLADASTRLEKALRYTRISEDAIERLKYPKTSLSVSIPVRMDDGSLRIFSRVPSAL

SEQ ID NO: 37628 - protein, 474 aa, Coccidioides immitis RS
MASTLRLGSAALRSTSIAQKPVVQSAAFNCLRYYSSAKTKSLKDTFADKLPGEVEKVKKLRKEFGSKVIGEVTLDQVYGGARGVKSLVWEGSVLDSEEGIRFRGYTIPECQKLLPKAPGGEEPLPEGLFWLLLTGEIPSEQQVRALSAEWAARSDVPKFVEELLDRCPSTLHPMAQFSLAVTALEHESSFAKAYAKGINKKDYWQYTFEDSMDLIAKLPTIASKIYRNVFKDGKVAPIQKDKDYGFNLANQLGYGENKDFVELMRLYLTIHSDHEGGNVSAHTTHLVGSALSSPMLSLAAGLNGLAGPLHGLANQEVLVWLQKMKKAIGNDLSDQAIKDYLWSTLNAGQVVPGYGHAVLRKTDPRYVSQREFALRKLPDDPMFKLVSQVYKIAPGVLTEHGKTKNPYPNVDAHSGVLLQYYGLTEASYYTVLFGVSRALGVLPQLIIDRALGAPIERPKSFSTEAYAKLVGAQL

SEQ ID NO: 37629 - protein, 334 aa, Crocosphaera watsonii WH 8501
MRYDDTRGPGKGGVRYHPNVTMDEVQSLAFWMTFKCALLNLPFGGAKGGITLNPKELSKQELERLSRGYIEAIADFIGPDIDILAPDVYTNQMIMGWMMDQYNIIQRKISPGVVTGKPQTMGGSQGRDTATGTGAYYVIQTILPKFELIPEKTTVAVQGFGKAGAVVAELLGKVGYKVVAVSDSKGGIYAEQGLDIVSIRNYKEEHQGIAAIYCQDTVCNIGEHQSITNEELLGLDVDVLIPAALENQITEENADNVRAKFIFEVANGPINSAADTILDEKGIYVFPDILVNAGGVTVSYFEWVQNRSGLYWTKTEVNQRMRDKMMSEAQEVWV

SEQ ID NO: 37630 - protein, 352 aa, Sinorhizobium meliloti 1021
MSGAPTRTRFARLYGPRDLRLEVADVPAPGDGEVLLKMAAGGICGSDLHYYQDGGFGPVRVREPIIPGHEASGRVAVLGAGVSGLAIDDLVAVNPSQPCGTCRFCGEGLPVHCLDMRFLGSAMRLPHTQGMFRDWLVVPAVQCHPAGSQVSPGEAACAEPLAVCLHAAAQAGEIRGKKVLVTGAGPIGALVVAAARHAGADEIVVTDLADAALDRAKAMGATRIVNVHRDPAGLAAYEADKGKFHVAFECSAAEPALRGAVAAVRPRGTIVQVGVTGEITLPLHALVGKELRLVGSQRFDGEFALAVALISDRRIDVRPIISHQFPVDEAVRAFEQAGDRSAACKVQLTFLS

SEQ ID NO: 37631 - protein, 305 aa, Saccharomyces cerevisiae
MSSSSQFKQLEKLGNGTYATVYKGLNKTTGVYVALKEVKLDSEEGTPSTAIREISLMKELKHENIVRLYDVIHTENKLTLVFEFMDNDLKKYMDSRTVANTPRGLELNLVKYFQWQLLQGLAFCHENKILHRDLKPQNLLINKRGQLKLGDFGLARAFGIPVNTFSSEVVTLWYRAPDVLMGSRTYSTSIDIWSCGCILAEMITGKPLFPGTNDEEQLKLIFDIMGTPNESLWPSVTKLPKYNPNIQQRPPRDLRQVLQPHTKEPLDGNLMDFLHGLLQLNPDMRLSAKQALHHPWFAEYYHHAS

SEQ ID NO: 37632 - protein, 402 aa, Streptococcus agalactiae A909
MKEILVLGAGYAGLKAVRNLQKQSGDFHITLVDMNDYHYEATELHEVAAGSQPKEKITFPIRDVINTNKVNFMQDEVLRVDAENKTVTVKNNGELHYDYVVVALGFVSETFGIKGAMENALQMTNISQAENIHNHIVNTMKLYRETKDENLLKLLVCGAGFTGIELAGAMVDERPKYAALAGVKPEQIEIICVEAATRILPMFDDELAQYGVNLIKDLGINLMLGSMIKEIKPGEVVYGTSKEDEELKSITAGTIIWTTGVSGSPVMGESGFDQRRGRVMVNSDLRDPKYDNVYVIGDVSAFMDTESGRPFPTTAQIATRMGAHVAKNLLHQIKGEATEDFSYSPQGTVASVGNTHGLGVVGKTKIKKYPASVMKKIIMNKSLVDMGGLKELLAKGRFDLYH

SEQ ID NO: 37633 - protein, 504 aa, Oryza sativa
MLRAAATAALRRLPQSQAPRRQARGLQYASPERRPLDGARWALYARLSAHLPSGGMVEELGRWLRERRPLSEEQVLFCVRRFRKFKQNKHALQLMDWMEARGVNLELKHHALRLDLVSKLNGIHAAEEYFGSLPDIFRSKQTYSTLLNCYAEHRMAEKGLELYENMKAMNIVSDILVYNNLMCLYLKTDQPEKIPTTVVKMQESGIQPNKFSYFVLTESYIMMNDIESAEKVLKELQEVNSVPWSLYATLANGYNKLQQFDKAEFTLKKAEEVLDKHDVFSWHCLLSHYANSRAAGIGTRIWESLKSAFKKCTNRSYLVMLKALKKLDDFDTLQQIFQEWESSHEHYDMKIPNIIIQAYLDKGMVDKAEAMRQTTMAQDHSNYRTFCIFAKFYLEKSKMNEALQVWKDAKKMVKGQDWVPEKLVNRYLKHFEDSKDVDGMETFCECLKNLGRLDAEAYEALIRTYISVGRTNPSIPQRMEVDRVDIRPEMFESLKAISTEGVES

SEQ ID NO: 37634 - protein, 484 aa, Francisella tularensis subsp. holarctica
MSQKLKRGLHTRHMSMIALGGCIGTGLFVALGGAIADAGPGGTVLAYVIIAIMVYFLMASLGEMAAHSPVSGTFCEYATRYVDSALGFSTGWSYWFNWAITVATEVIAAALIMQYWFPGSSILLWSGFFFVLVFALNIFSVKIYGEVEYWLSFIKVSTVIIFIIVGFLSILGLVGNHQSVGFQNWHIGDAPFHNGWWGFISVFMIAGFSFQGSELIGVTAGEAKDPNTSIPKAIKQTFWRLFIFYILAVVIISFLIPYNNPSLIKVGASNDVSVSPFTIVFENVGLNSAATIMNVIILTAIISACNASMYSATRVLWHLGNIKQAPQFFATTNSKGTPMIALLVTAVIGSSFFFVSFVGSGYIFTWLVNVSSLAGFIAWFTIALSHYRFRRAYIKQGKSLEDLPYVAKFFPWAPIIALTMVSIVIVGQGVTMLTMDGRTWFSVIIEFLSTYIGFFAFVILYFVYKFIKKTKLIRLEDCDLTRES

SEQ ID NO: 37635 - protein, 206 aa, Cryptococcus neoformans var. neoformans JEC21
MAAHSEQIKNNFLNNPYAQQVFNIANGQVSALDAELNKYPILRQLEQQTKVPKAYGVIALGFSSVLLIFFNMFGLAQPISNLIGWALPAYLSILAIESPQTNDDKQWLTYWVVFGSLNLVESMGLRAVLYWVPMYFVFKTLFTIWLMLPATRGAEILYFHFLRPMVGNVKSRSQSSFGTSDPLAKETGFNPAGTTAPSSFAHEKTL

SEQ ID NO: 37636 - protein, 441 aa, Arabidopsis thaliana
MYGGDEVSAIVVDLGSHTCKAGYAGEDAPKAVFPSVIGAVDGVEAMDVDVDSTKTNSNSEDSKTESEKEKSKRKLYVGSQAMSYRRDHMEVLSPIKDGIVSDWDLVDNIWEHAFKSCLMIDPTEHPMLLAEPPLNTQQQREKAAELMFEKYKVPALFMAKNPVLTSFATGRATSLVVDCGGGSTTISPVHDGYVLQKAVVSSPLGGEFLTDCLLKSLESKGIKIRPRYSFKRKEVRAGEFQVEDVDIPDTTESYKLFCQRMIVGDIKDSICRVPDTPYDDKSYSNIPTTSYELPDGQTLEIGADRFKVPDVMFNPSIVQTIPGMEKYAEMIPSVRGLPHMVMESINKCDVDIRRELYSSILLAGGTSSMQQLKERLEKDLIEESPHSARVKVLASGNTTERRFSVWIGGSILASLGSFQQMWFSKSEYEEHGASYIQRKCP

SEQ ID NO: 37637 - protein, 346 aa, Arabidopsis thaliana
MAIGPSSVIVIVGIILALTYQSILKPPPPKLCGSPGGPPITAPRIKLRDGRHLAYKEYGLPREKAKHKIVFIHGSDSCRHDAVFATLLSPDLVQERGVYMVSFDKPGYGESDPDPIRTPKSLALDIEELADQLSLGSKFYVIGKSMGGQAAWGCLKYTPHRLAGVTLVAPVVNYYWRNLPLNISTEGFNLQQKRDQWAVRVAHYAPWLIYWWNTQNWFPGSSVVNRDGGVLSQPDKDIILKLGSSRKPHLAEVRQQGIHESINRDMIVGFGNWEFDPLELENPFLNREGSVHLWQGDEDMLVPVTLQRYIADKLPWLHYHEVAGGGHFFPLAKGVVDEIVKTALNH

SEQ ID NO: 37638 - protein, 423 aa, Trichoderma viride
MSLSNKLSITDVDVKGKRVLIRVSPDCPVDFNVPLDENKNITNPQRIAGAIPTIKHALDNGAKAVILMSHLGRPNGAVNAKYSLKPVVPKLEELLGKPVTFAPDCVGPEVEAIVNKADNGAVILLENLRFHIEEEGSSKDKEGNKTKADKAKVEEFRKGLTALGDVYVNDAFGTAHRAHSSMVGVDLPQKAAGFLMKKELDYFAKALESPQRPFLAILGGAKVSDKIQLIDNLLDKVNTLIICGGMAFTFKKVLDNLAIGDSLFDKAGAETVPKLVEKAKAKNVKIVLPTDFITADKFDKDANTGLATDKDGIPDGWMGLDCGDESIKLYKEAIDEAKTILWNGPAGVFEFEKFAGGTKATLDAVVEGCKNGKIVIIGGGDTATVAAKYGVEDKLSHVSTGGGASLELLEGKELPGVTALSSK

SEQ ID NO: 37639 - protein, 529 aa, Cryptococcus neoformans var. neoformans JEC21
MESHTVLRPTAIPDLAAIKTWGLEGLTKAKFSFDTKTTTATILTLILSLLVLEQLVYRAKKAHLPGAKWTIPVIGKFADSLNPTLANYKAQWNSGPLSAVSVFNIFIVIGSSNEMARKILNSPNHAEPCLVASAKKVLLPENWVFLHGKVHADYRKALNVLFTKQALSIYLPIQEKIYRSYFNKWMSDPAPAQQYMMKMRDLNMDTSLSVFIGPYLTEAQKQEINDKYWLITISLELVNFPLAIPGTKVYNAIQARKIVMKYLSAASAASKIRMEDDDAEPECLLDHWVRAMILARRAKDDGEQTRLLSREYSDHEIAMVLLSFLFASQDAMSSALVYTFQLTADHPEVLEKVREEQYRVRGNDLERPLTLDMLDDMVYTRATIKEVLRFRPPVIMVPYMTTKPFPVSPEYTAPKNSMIIPAFWNSLHDETCYPEPDRFLPERWLPQADGSAPIADSKPQNYLVWGSGPHKCIGGQYASMHLAATLGTASVLMDWKHERTELSDEVQVIAAIFPKDHCLLKFTPRAPPS

SEQ ID NO: 37640 - protein, 565 aa, Pisum sativum
MNMLIKRVIAIKNPRGDDNNNNKLSDLETLTDKCTTCPLTLMRVMAFFVVSFMLFSVLFSLSVVLRDPPSDAAISSTTTLFQLNQGLGSDDFDSVELLNDKLLGGLLADGFDEKSCLSRYQSAIFGKGLSGKPSSYLISRLRKYEARHKQCGPYTESYNKTVKELGSGQFSESVDCKYVVWISFSGLGNRILTLVSAFLYALLTDRVLLVDPGVDMTDLFCEPFPDASWFVPPDFPLNSHLNNFNQESNQCHGKILKTKSITNSTVPSFVYLHLAHDYDDHDKLFFCDEEQLFLQNVPLLIMKTDNYFIPSLFLMPSFEQELNDLFPKKEKVFHFLGRYLLHPTNNVWGLVVRYYDAYLAKVDERIGIQIRVFDTDPGPFQHVLDQVLACTLKESILPDVNREQNINSSSGTPKSKAVLITSLSSGYFEKVRDMYWEFPTETGEVVGIYQPSHEGYQQTQKQFHNQKAWAEMYLLSLTDVLVTSSWSTFGYVAQGLGGLKPWILYKPENRTAPNPPCQRAMSMEPCFHAPPFYDCKAKRGTDTGALVPHVRHCEDMSWGLKLVDN

SEQ ID NO: 37641 - protein, 196 aa, Oryza sativa (japonica cultivar-group)
MKGLLKGLRYISQIFDPSVKEPEMQIGNPTDVKHVAHIGWDNASVTAPSWVIAAALLLPPDRAISHVSNCSDHWSQMNEFKPTAGGTEGGEAEENQGGGGGRADQAERPRRAGRGKERRDGGSEGSRRPPKTEVGENNCEGKTPPGAAPKQRRKKARVLGGTFLGRSKFFPVSRGGGPSGGARPAPAGDYNGEKGL

SEQ ID NO: 37642 - protein, 219 aa, Burkholderia vietnamiensis G4
MAFLLHQARFYTTVNHLRDLPPTVQPEIAFAGRSNAGKSTAINVLCNQKRLAFASKTPGRTQHINYFSVGPAAEPVANLVDLPGYGYAEVPGAAKAHWEMLLSSYLATRSQLCGLILMMDSRRPLTDLDRRMIEWFAPTGKPIHTLLTKCDKLTRQESINALRNTQKGLDAYRDQGVKGKLTVQLFSALKRTGLDEAHELIESWLRPSVADAEGAPVAQ

SEQ ID NO: 37643 - protein, 293 aa, Pseudomonas aeruginosa PAO1
MSASIHGIIGYTITPFAADGGLDLPALGRSIERLIDGGVHAIAPLGSTGEGAYLSDPEWDEVVDFTLKTVAHRVPTIVSVSDLTTAKTVRRAQFAESLGAEAVMVLPISYWKLNEAEVFQHYRAVGEAIGVPVMLYNNPGTSGIDMSVELILRIVREVDNVTMVKESTGDIQRMHKLRLLGEGRVPFYNGCNPLALEAFVAGAKGWCSAAPNLIPTLNGQLYQAVLDGDLEKARALFYRQLPLLDFILRRGLPTTIKAGLGLSGLEVGAPRLPVQALDTEGCRYLQGLLEELR

SEQ ID NO: 37644 - protein, 480 aa, Schizosaccharomyces pombe 972h-
MSKRAAEETVEFNSKNGPGQRGTVADNVDTEMGEFEDAYEDEIESEEEYIEADGEKDNGMDEEEQNDAQPSKIPWLPGGKINADEKLVADPSVYEMLHNIQVKWPFLSFDILQDSLGEERRAWPHQMYLVGGSQALDSNDNELTVMKLSQLYKTQHDENDDASDNSDVEEDPILEHKSISTKGACNRVRSARRPANSSKESLLASFHETGKVHIWDIAPHLRSLDSPGVMVSRKENSPLYTVNRHKTEGYALDWSPFEYSLLSGDNANEIFLTKYSNGGWQTDSSPFLSHTAAVEDLQWSPSEKNVFSSCSCDGTFRIWDVRNKQKTSALTVNAHPGVDVNVLSWNTRVPNLLATGADNGVWSVWDLRSLKSSSSVATPVASFKWHRAPIYSIEWHPNEDSVIGVVGADNQISLWDLSVELDEEEQDSRAAEGLQDVPPQLMFIHMGQQEIKEMHWHRQIPGTIVSTAMTGINVFKTITF

SEQ ID NO: 37645 - protein, 470 aa, Bacillus cereus ATCC 14579
MVVGDFPIELDTVVVGAGPGGYVAAIRAAQLGQKVAIIEKANLGGVCLNVGCIPSKALINAGHRYENAMHSDDMGITAENVKVDFTKVQEWKNGVVKKLTGGVEGLLKGNKVEIIRGEAYFVDANTLRVMTEDAAQTYTFKNAVLATGSTPIEIPGFKYSKRVINSTGALSLPEIPKKLVVIGGGYIGMELGTAYANFGTEVTVVEAGDEILAGFEKAMSSVVKRALQKKGNVNIHTKAMAKGVEETETGVKVSFEVKGEIQTVEADYVLVTVGRRPNTQEIGLEQVGVKMTDRGIIEIDEQCRTNVPNIYAIGDIVPGPPLAHKASYEGKVAVEAISGHASAIDYIGIPAVCFTDPELASVGYTKKQAEEAGMTVTVSKFPFAANGRALSLNSTDGFLQLVTRKEDGLLVGAQVAGAGASDIISEIGLAIEAGMTAEDIAQTIHAHPTLGEITMEAAEVALGMPIHIVK

SEQ ID NO: 37646 - protein, 336 aa, Schizosaccharomyces pombe 972h-
MSATSINPNNWHWTSKDCRVWSHEYFNKELPKIQASEGPTSARITQVNSCEGDVDVSMRKRKVITIFDLKIQMEFKGETKDGVEATGSITCPELSYDLGYSDYVFDIDIYSASKEKEPIKELVREKIIPQIRQLFSGFSQVLLQTHGDDVYLSTEEHNGNAARGLPVHSSFKQNNSSQTSSNKGTTTVAAGSGSDGSRVSAVVNTADISENYTFDAPANELYATFLDPARVAAWSRAPPQLDVRPQGAFSLFHGNVVGKFLVLEENKKIVQTWRLSSWPTGHYAEITFTFDQADSYTTLRMIMKGVPIGEEEVVQGNIQDYYIRPIKTVFGFGAVL

SEQ ID NO: 37647 - protein, 429 aa, Bacillus cereus ATCC 14579
MAFEFKLPDIGEGIHESEIVKWFIKPGDEVNEDDVLLEVQNDKAVVEIPSPVKGKVLEVLVEEGTVAIVGDTLIKFDAPGYENLKFKGDDHDEAPKAEEAAVEAPAAEATPAATAEVVNERVIAMPSVRKYAREKGVDIHKVAGTGKNGRIVKADIDAFANGGQTVAATEAPAAVEATPAAAKEEAPKAQPIPAGEYPETREKMSGIRKAIAKAMVNSKHTAPHVTLMDEVDVTELVAHRKKFKAVAADKGIKLTYLPYVVKALTSALREYPMLNTSLDDASQEVVHKHYFNIGIAADTDKGLLVPVVKDTDRKSIFTISNEINDLAGKAREGRLAPAEMKGASCTITNIGSAGGQWFTPVINHPEVAILGIGRIAEKPVVKNGEIVAAPVLALSLSFDHRLIDGATAQKALNQIKRLLNDPQLLVMEA

SEQ ID NO: 37648 - protein, 129 aa, Arabidopsis thaliana
  misc_feature (27)..(27): Xaa can be any naturally occurring amino acid
  misc_feature (95)..(95): Xaa can be any naturally occurring amino acid
  misc_feature (112)..(112): Xaa can be any naturally occurring amino acid
RNIRGDPRVRAQATMVAPFTEHEVFLXFPATPKAGDDITFITSNGGRVSCMKVGTPVVKHKAETLSYLPDLRDVELANEADYLPRNNSPRWVRFXLEHGFVFREHGNTSGYXDGRYWTMWKLPLFGCTD

SEQ ID NO: 37649 - protein, 391 aa, Oryza sativa (japonica cultivar-group)
MEPAHAPGRDRLSALPDNVLRRIMSFLNARQSVQTCVLSRRWRHLWRSLPRINADYTEFCFACLDEKKEKVQEARFKKFVSTLLLRRDPVPLLDKFWLRYQVSDGNNNEKASAEAGLWISHALQLQTPVVEVLTFQFPLMLDHAVFTSDYLRKLGLSNAYLRMGFFEQLSRGCPQLEDVFLNDCIILDDEISSTTLKTLNIYASRFSEDYRASISTPSLTSLTLYKPDASVPSLKDMKSLVSASIILDDNTDIHELLMSLSGVRNLDLECPQKMVTIAKNTQWCPEFKDLVNLSLGQFCLGSKLYALTVFLKNSPKLEKLTLDPPEVIIDKLEERSFECEHLKIVEVICSEDDSTLLKLVEDIFVTSGMNSLQINRKSSYKQYYSDDFFQI

SEQ ID NO: 37650 - protein, 879 aa, Magnetospirillum magnetotacticum MS-1
MALLVIPCLAALTVWQAVGSYRKDVADTERLVEALARVSEEHIAGVMRSFDQLLSEMEEAAPDGILADPQRALTAIGNRAKFIPELRSAAFINDQGIMLAGNLPGMAGTNVHDREYFRALLENPNLSIFISAPLRSRVVTGTSIVIVRSIRKGGGQLAGALAVAIDPKIFEDELRSVLPGDGGRVTLLRDDGVILARLPDSDKWRGVSVAQGNVMVNVAKEGRGTLVGSSVTDGLDRVIAYRRLENYPLVVAVGMSLSEALSDWRRDVSLQGGASLLLALLTFGLSMVSDRRLAERQRIQQALAASEARYRMLTEHSPVGVFQADPEGTCLYANERWLDLAGRSRDEMLGAKWCRVVHPDDREAVAALWQSHVSGQGEFLAEMRLMRGDGSIRWVRGHAAALSDSEGPAGGLVGTIEDITAAKEAERRLLLSEEKFAKAFRASPDAMVISLAEDGRYIELNDTFSSMLGYGRDELMGHTALEMGVWALPEDRAALVAAARRDGQVVNFETRLRRKNGETFDTLISVQEVVLDDQDCLLFICRDISERKAMEARGKELLARLDASNKELEQFAYVTSHDLQEPLRMIAGYAQLIERRYRGRLDKDADEFIAFLVDGAMRMQAMIRDLLEYSRVDRLSGQFTCFSMGDVLDDARANLGAALAEAGGTIEVGPMPEVNADRSQMLRLFQNLIGNALKYRSAERPPKVRVSAEQTARGWVFSVADNGIGIDPAYFDRIFLVFQRLHTREHYDGTGIGLAICKKIVERHSGHIWVESRPGEGCDFRFSLFEGQVDFAHGARRRTWSVSAQAASAKLRKAVGGGRVTLCDDCCLFLKFISKKRGLLQVSLVFFIIFNAESLYFVLVFLVAMTGFAFASNWINCVR

SEQ ID NO: 37651 - protein, 267 aa, Arabidopsis thaliana
MGSAFDPLVTATEDLAAVNSAPPLSNLTQEELKKIAAYKAVEFVESGMVIGLGTGSTAKHAVARISELLREGKLKDIIGIPTSTTTHEQAVSLGIPLSDLDSHPVVDLSIDGADEVDPALNLVKGRGGSLLREKMIEGASKKFVVIVDESKLVKYIGGSGLAVPVEVVPFCCDFTRGKLEELFRDSGCVAKLRMKIGSNGEEAAPAVTDNGNYVVDLYLERDIGDLEVASEAILRFPGVVEHGMFLGMATTLIVAGKFGVTVKDRFG

SEQ ID NO: 37652 - protein, 358 aa, Cryptococcus neoformans var. neoformans JEC21
MAPSSALPATSKKAKKPQPTPKAPLPLPSTFSTAQAEKAVKALLAHHAKVSKQKEEEQLLPREEHVWVVVNTKTGSTRRSLNPVKIQLPHPALPPPPTSSVCLFTKDPQRQYKDLLAQHNIKFISRVVGVEKLKGKFKPYEARRELLRDHDLFLCDERVLGVMPKLLGKMFFEAKKQPIPVNLQRKDLTSTLARAISSTYFHPTTGTSTSTRIATPSHSSTSQTLANLLEAVPQIVAEVDGGWEGVLSVGIKTSGSVMLPVWTGKLGGRFEKAEKPEKSANSGEEMEVEVEEKSETPSAPAPTVEKREKKEKAAAAPVEKPKKKSSTIGSTAGGAAKRAKQVAVGAKKPAVKKSKSKL

SEQ ID NO: 37653 - protein, 342 aa, Ralstonia solanacearum
MGSMDDVTAYPRLVGDVGGTNARFALEMAPMRLAHIGVLAGDDYPSLEAAMRAYLAALPPEIAAAGVRHAAIGIANPVLGDQIRMTNRDWAFSTEAMRQSLGFDTFVVLNDFAALAHALPYLGADELEQVGGSTCVADAPRALLGPGTGLGVASLLPTQAGRFIAVAGEGGHVAFAPMNDEEVVIWRFARERFGHVSAERLISGMGLELIYEALGACFDLWQQGPAVRRAADITAIALGEMEDTAGDHARCRYAVDTFCAMLGTVAANLAVTLGARGGVYIGGGIVPRLGAAFANSPFRRRFEDKGRFSGYVAAMPVYVIHAPYPGLIGLCAAMDHAVASGH

SEQ ID NO: 37654 - protein, 932 aa, Ostreococcus tauri
MRALTLGACALNQWAMDFNGNHERIRASIVEAKSKGCRYRLGPELETCGYGCEDHFHESDTEAHAWEIIARLCAEPGLLRGSAMVADVGAPATMDGCRYNARVIIVDGKIALVRPKRSLADDGNYRESRWFTAWTRTNETATWRLPDSCRGLAYDGGDEVPFGDGAVVFDDCGLGCETCEELWTPDAPHVALALNGIEIIANGSGSHHQLRKLDARMSLIQSASGKVGGIYLYANQRGCDGGRLYYDGCACIAVNGNIVAQGKQFDVSDVEVVVATVDLDEVRSYRNCFQSMSVQAAKVTPISKVRVHQRLCVPDDVGRLERPKLSAPRDVEFHSPEEEIALGPACWLWDYLRRSGASGYFLPLSGGADSSSTAAIVGSMCQLVTKAAREGDEVVAMDIRRIAQLAPNASIPSANELAELIFTTVYLGTDNSSAETRARAKALAIDIGASHLSVAIDVVVTAVVTFFTMVTGKTPKFKVDGGSNPENLALQNIQARVRMVLSFLFAQLLPWVRGKSGFLLVLGSANVDEGLRGYMTKYDCSSADINPIGGISKGDLRSFLRWGSVNLGYPTLAEVEQAPPTAELEPIRDDYVQTDEEDMGMSYDELGVYGRLRKIYRLGPFSMFKRLASEVAEKVKKFFFFYSCNRHKMTTLTPSYHAENYSPDDNRFDQRQFLYNVRWPWQFRKIDEFSTTMTFIKLHLDSYVNQVSLVGFGDSIVFVQPDVFEQTRGSVHVAHIGAFSKSFFCASLRRAFWRSLPRRTRVTLLVAGSTSTVGPLERRSAPPRDTPSPPPYQSSKSRRHPAVSPNLLPGVRASLRSPVVSLAASARFSPRAPSAEYPSPPPRRCFLRSSSAASFHSASSAAAARTHSSALTLSPRPLAVSFSRAARSSQLNRRNSQNASTQFLCTRQFAYASRAIRPSTAPWTFAHKAVRR

SEQ ID NO: 37655 - protein, 1283 aa, Cryptococcus neoformans var. neoformans JEC21
MLRQTLVSLSSLAASAPIEVITTTFIFATLAYFQLLHAIKGSEFFNVPSVSPPSRPAHFVRLAHQPSSEDASYILPSSHGVAGSSWVGDVESKREWTPISPSDFRKILEQNALGGYTFPIEAGGNTSGEKASVAIVKQLVVTRDGAQEPIDEFEQWLLNELSVEVDGEKYTYRDLCFNTSDHPSFVPHPLYPSQSTLTMFLQPPSPSDPTLTYLNRLNRLPAFTLSDSTTAFQLLPPSGANWGFLPSIDGVGLFSKLGEGMISGQGESYPMQNVRWFAYAARALVGRFWTLAKNADSADIFVVLLGYIVMHGVFVNLFIGMRKLGSSFWIPVATLCSSTFAFLIALLSAYLLDLPVDPICLSEAIPFLVITVGFDKPYHLAKAVLQNPDIDPVPSSPEPSIAGYSGELAKDPKSGSSLGLDLGTLHKELAPLERLQRLAEGQVKWVAPVAAKKIVVDAVKTSGVRIVRDYVLEIIALCVGAASGIGGLREFCYLAALIMAVDCVFLFTFYVAILSVMVEVHRIKLIRGNRRVKSVKRVSSSASLNGHANGNGGTTNTSSSTSSPSTKRSFWSRSPSSEREDQPQNPVVRLKLLLIISFLTLHVLNLCTTLTEQTALKRHSTHSGAEITSRAMLNPRGISLSPVLQALYESQPPETDLAVQIMPPTQILMTSETLIPSRLSSFDHFMSEWTLLVGDPVLSKWIVVFLAISVLLNGYLLKGIALNSMGGKGPVAAAAQALAGIFDAERGQRALRETTPRGRKMELSAHMVGTNASTSTRDGDSTPRVEEVGKVAASHTVNVPIIKEPRIPSPSFPSASDDSALTFGRRSFEECVEIYAGGVGANNLSDEEIILLVQKGKIAPYGLEKALKNLERAVRIRRAVISRSSLTKSLETSLLPMADYDYKQVIGACCENVIGYLPLPVGIAGPLNIDGQLLHIPMATTEGTLVASTSRGCKALNAGGGVTTVLTHDAMTRGPAIDFPNIVQAAQARLWIDSPDGYATLKTAFESTSRFAKLQTLECALAGRTLYVRFATQTGDAMGMNMISKGVEKALEVLRGHFPDMHVLALSGNYCTDKKPAAINWIEGRGKSVVAEAVVPGHVVKTVLKTTVKDLCNLNIKKNLIGSAMAGSIGGFNAHAANILTAMYLACGQDPAQNVESSNCMTLMEPINDGEDLLISCSMPSVEVGTVGGGTILSPQRAMLDMLGVAGAHATSPGANAQRLARIIVAAVMAGELSLMSALAAGHLIQAHMKHNRSTPATPGAVTPFGGITPLRESVLINGPGAK

SEQ ID NO: 37656 - protein, 325 aa, Bacillus cereus ATCC 14579
MAQMTMIQAITDALRVEMKNDPNVLVFGEDVGVNGGVFRATEGLQAEFGEDRVMDTPLAESGIGGLAVGLALEGFRPVPEIQFFGFVYEVMDSISGQLARMRYRSGGRWTAPVTVRSPFGGGVHTPELHADSLEGLVAQQPGLKVVIPSTPYDAKGLLISAIRDNDPVIYLEHMKLYRSFRQEVPEGDYTIDLGKADIKREGTDVSVIAYGAMVHAALKAAEELEKEGISLEVVDLRTVQPLDIETIIASVEKTGRVVVVQEAQKQAGIAANVVAEINDRAILNLEAPVVRVAAADTVFPFSQAESVWLPNHKDIVEAVNKVMNF

SEQ ID NO: 37657 - protein, 467 aa, Hyphomonas neptunium ATCC 15444
MADDLLKLMKDQDVQYVDLRFTDTRGKLQHVSFHKDMVDKSFFEDGQMFDGSSIAGWKAINESDMLLKPDAKGAFIDPFFQQTTLVVFCDILDPISGQAYSRDPRTTAKKAEAYLAASGVGDTAFFGPEAEFFIFDDVRWSTDPHNTGYSFDSTELPANSGREYPMGNLGHRPGPKGGYFPVPPIDSEQDMRGEMLSIMGDIGLEPEKHHHEVAPAQHELGLKFSTLTVMADRMQLYKYVIHQVAASYGKTATFMPKPMFKDNGSGMHVHQSIWKGGKPLFAGDKYADLSEMCLYYIGGIIKHAKALNAITNPSTNSYKRLVPGYEAPVMLAYSARNRSASIRIPYGSNPKAKRIETRFPDPMANPYLAFAALLMAGLDGIENKIHPGDAMDKDLYDLPPAEAKQIPQVCGSLREALAALDADRAFLKKGGVFDDDQIDAYIELKMEENMRYELHPHPVEFDMYYKN

SEQ ID NO: 37658 - protein, 554 aa, Yarrowia lipolytica CLIB122
MYKVHNPYLTAAVATMGGMLFGFDISSVSAFVGEDNYMNYFGHPTSFQQGGITASMAGGSMLSCAFAGYISDRVGRKPTIQFAAAWWMVGASIQCSAQNMGQLIAGRAISGLGIGLGSSQIPVFISELSPKKIRGRLVGCFQWSVTWGILIMFYISFGCSYIKGHSSFRLAWGIQLIPGAMLAFGMMLLDESPRWLASKDRWEEAIQIIRSINANYGSEEDILMEIEDLREVVRIDHESKSVTIWDLFRKDSINRTMVGVWAQIWQQLTGMNIMMYYVVIIFKMAGYSGKSAVIVSGSIQYIINVVMTIPALLFIDKIGRRPLLLCGSMLMATWLLAVGGMLGAYGIQMPQGLPAVPSKNQAADPYTTIYIPDNQAPARKAIIACCYLFVASFAPTWGPGIWLYCSEIFPNKQRALANSLTAGANWGFNFALALFVPTAFKNINWKVYIIFGVFCIVMSIHVFLLFPETKGKSLEVIDQMWDARVPAWKTASWVPDHMPSHYAGDQEEKPTDELAEAPFHEENAPVNTETPPHEDEPTFAETEPKTQYPGTEHV

SEQ ID NO: 37659 - protein, 130 aa, Pseudomonas syringae pv. syringae B728a
MKDWLDEIHWNSDGLVPAIAQDHKTGRVLMMAWMNREALSLTAAENRAIYWSRSRGKLWRKGEESGHVQKLHELRLDCDADVIILMVEQIGGIACHTGRESCFYRVYEKSGWKTVDPVLKDPDAIYPAGH

SEQ ID NO: 37660 - protein, 539 aa, Pseudomonas syringae pv. syringae B728a
MKLLAVRRLFRIQRVVIRYRLDDLLFALPLPWWMLALRFVLPWRWLPRRKSELSRGVRFRLALQDLGPIFIKFGQLLSTRRDLLPEDIADELMLLQDRVPPFDQQLAIKLIEEQLGARICDVFSRFDEKPLASASVAQVHAACLKTGEEVVVKVVRPGLKPIIGQDLAWLFILARMAERVSADARLLHPVQVVMDYEKTIYDELDLLREAANASQLRRNFEGSDLLYVPQVYWDWCRPKVLVMERIYGLQVTDMAGLADQRTDMKLLAERGVEIFFTQIFRDSFFHADMHPGNIFVSTVNPWAPKYIAIDCGIVGSLTPEDQDYLARNLFAFFKRDYRRVAQLHIDSGWVPAETKLNEFEAAIRTVCEPIFEKPLKDISFGQVLMRLFQTARRFNMEVQPQLVLLQKTLLNIEGLGRQLYPELDLWSTAQPYLERWMRERVSPKTLLGNLQSQVEQLPHIAGMTRDLLERMSRPHASDPPRPWHDRKDEPVLRLIGAALLVGGAIQGWVMSEAATQLLTLTAWPAAIMLIAGLYLIVRR

SEQ ID NO: 37661 - protein, 260 aa, Oryza sativa (japonica cultivar-group)
MTAANLDSEMGLIGEMMVQYPYVTIDVEFAGVVHHPPYTGSRPTPDEIYAALKSNVDEVPAVQIGITLSDAEGNLPTRSSSSPEQEIAWEVVFSDFDAGRDPHVVDSVEFLKNQGIDFDLARQIGVTSTAFGEKLLAILPPPSRRGELTWSAFGGAYDMGYLLKMLTGGQPLPETRQQFMQLVKSRLGGGRIFDSKYLVEHDRQDLRNAGLRHTADVLGVRQQEGVKMLAGHKSVVAAAIFATIRSQGVHLLHGVIDGIL

SEQ ID NO: 37662 - protein, 284 aa, Oryza sativa
  misc_feature (265)..(265): Xaa can be any naturally occurring amino acid
SHSQQFFPWVGVIDSLPNWTEEENLRLISAWLSNSVDPTDGNDKKGEYYWKDVADEFNNNRPTNGHKRTVKQLKTHWGNVKKDIGKFCGVYAQVRRTCTSGHSDDMIMEKAHLWYKNQSNQKKPFTLEYMWRELKDQPKWRSIIKKEENKNKRTKISESGAYTSSSNQETEEESSNKERHPEGQKKAKERLKGKGKGKAQSSPLGNQPSQNIVLYNEAMKIKAEALLKSAEATAKSAEAKREQIRMEKWQAYIKLEEKDTSNFSXKLRRHEAMLNKLSKELAEE

SEQ ID NO: 37663 - protein, 383 aa, Solanum demissum
MASDSIIPLLLPDELITEILLRLPIKSLSKFMCVSKSWLQLISSPAFVKKHIKLTANDKGYIYHRLIFRNTNNDFKFCPLPPLFTNQQLIEEILHIDSPIERTTLSTHIVGSVNGLICVAHVRQREAYIWNPAITKSKELPKSTSNLCSDGIKCGFGYDESRDDYKVVFIDYPIRHNHRTVVNIYSLRTNSWTTLHDQLQGIFLLNLHGRFVNGKLYWTSSTCINNYKVCNITSFDLADGTWGSLELPSCGKDNSYINVGVVGSDLSLLYTCQLGAATSDVWIMKHSGVNVSWTKLFTIKYPQNIKIHRCVAPAFTFSIHIRHGEILLLLDSAIMIYDGSTRQLKHTFHVNQCEEIYVESLVNPLKISDQGRRNQESPQSSHS

SEQ ID NO: 37664 - protein, 620 aa, Polygonum tinctorium
MRYNPKNPFWFNRDRFVLSAGHGCMLQYALLHLAGYDSVKEEDLKQFRQWGSKTPGHPENFETIGIEVTTGPLGQGIANAVGLALAEKHLAARFNKPDSEIVDHYTYVILGDGCQMEGIANEACSLAGHWGLGKLIAFYDDNHISIDGDTEIAFTESVDKRFEALGWHVIWVKNGNTGYDEIRAAIEEAKKVKDKPTMIKVTTTIGFGSPNKSNSYSVHGAALGAKEVEATRKNLGWPYEPFHVPEEVEKHWSRHVPEGAALEAEWNAKFAEYKSKYPTEAAELKSIIEGEFPAGWEKALPTYTPESPGDATRNLSQTCLNALAPVVPGLLGGSADLASSNMTLLKSFGDFQKDTPEERNVRFGVREHGMGAICNGIALHSPGFVPYCATFFVFTDYMRGAIRISALSLARVIYVMTHDSIGLGEDGPTHQPIEHLASFRAMPNILMMRPADGNETAGSYRVAVLKKQTPSILALSRQKLPNLPGTSIEGVEKGGYTITDNSTGNKPDVILIGTGSELEIAAKAGDELRKAGKAVRVVSFVCWELFEEQSDEYKESVLPAAVTARVSIEAGSTFGWEKIVGSKGKAIGIDRFGASAPAGRIYKEYGITVEAVIEAANSVS

SEQ ID NO: 37665 - protein, 483 aa, Saccharomyces cerevisiae
MLSATKQTFRSLQIRTMSTNTKHYDYLVIGGGSGGVASARRAASYGAKTLLVEAKALGGTCVNVGCVPKKVMWYASDLATRVSHANEYGLYQNLPLDKEHLTFNWPEFKQKRDAYVHRLNGIYQKNLEKEKVDVVFGWARFNKDGNVEVQKRDNTTEVYSANHILVATGGKAIFPENIPGFELGTDSDGFFRLEEQPKKVVVVGAGYIGIELAGVFHGLGSETHLVIRGETVLRKFDECIQNTITDHYVKEGINVHKLSKIVKVEKNVETDKLKIHMNDSKSIDDVDELIWTIGRKSHLGMGSENVGIKLNSHDQIIADEYQNTNVPNIYSLGDVVGKVELTPVAIAAGRKLSNRLFGPEKFRNDKLDYENVPSVIFSHPEAGSIGISEKEAIEKYGKENIKVYNSKFTAMYYAMLSEKSPTRYKIVCAGPNEKVVGLHIVGDSSAEILQGFGVAIKMGATKADFDNCVAIHPTSAEELVTMR

SEQ ID NO: 37666 - protein, 427 aa, Rubrobacter xylanophilus DSM 9941
MADVTGVGREGAGEAPRSWGARLKYIGPGFVVAATGVGAGDMVSSLSAGTNFGTVLIWAIVIGALLKYVLTEGLGRWYMATGTTILEGWRSLGLWASLYFVIYLLIVTFVFGAAVVSASALAVTAMFPGVMPLWAWAVLHGIFGFVVIGIGRYRLFERIMEFFVALMFVTVVGLAIMLTPDLGELALGIVVPRIPEGSVLYALAVIGGVGGTFTLASYPYWVRERGWSRPSWIPMMRLDLSVGYLFTALFMVSMLVIGAEMLFARGEGISGEEGLVALSDPIRERFGTLASWFFLVGFWAAATSSILGAWNGAAYLFADSVRTILRVPDERAGEYLSETGLWFRLMLVWITFPPMLLLSFGQPVLLVVVYAALGAFFMPFMALTLLWLLNSSRVSREYRNGWLTNALLAAAILLFVVVGVQEVAGAL

SEQ ID NO: 37667 - protein, 473 aa, Oryza sativa (japonica cultivar-group)
MASLAVSASASASGEEVTHLAQREAAEIDEQLMGPLGFSVDQLMELAGLSVAAAVAEVYKLGEHTRVLVICGPGNNGGDGLVAARHLHHFGYKPSVCYPKRTPKPLYSGLCTQLESLTIPFVPVEDLPANLSEEFDIIIDAMFGFSFHGTPRPPFDDLINRLVSLSAIDNSAKRPAIVSVDIPSGWHVEEGDINGGGFKPDMLVSLTAPKLCAKKFTGPHHFLGGRFVPPPIVSKYKLHLPPYPGTSMCVRIGKAPSVDISSLRENYISPELLENQVMPDPFDQFVRWFDEAVTAGLREPNAMALTTADKEGKPSSRMVLLKGVDKQGFVWYTNYGSQKAHDLSENPNAALLFYWNEMNRQVRVEGSVQKVPEEESEKYFHSRPRGSQLGAIVSKQSTIIPGREVLQQAYKELEQKYSDGSVIPKPDYWGGYRLTPKLFEFWQGQQSRLHDRLQYSLREVDRSTVWHIERLSP

SEQ ID NO: 37668 - protein, 132 aa, Prochlorococcus marinus subsp. marinus str. CCMP1375
MSPTVQNSIETELAPSPVGPYNQAIVAGDWLYCSGQIALDPSTGEIVGGGNIEEETHQVLNNLLAVLNEAGANATNVIRTTIYLVNLNDFNKVNKIYSDFFEGSIFPARACVQVAALPKGGLVEIDCVAWLG

SEQ ID NO: 37669 - protein, 317 aa, Oryza sativa (japonica cultivar-group)
MAFLRKVGNLVRQSAGSGSPLFQAVRCMSSSKLFIGGISYGTDDQSLKEAFANYGEVIEARVIVDRTTGRSRGFGFVTYTSTDEAAAAITGMDGKDLQGRIVRVSYAHDRGSRAGGYGGGGYSGQGTYGGGGGYGGGGYGGQDAYGGRGVGGYSEGGRGYVGGGYGDGNNYGGYNTSGGYNSEGGRGGYSVFEGGHGYGSGGTGYTGGSGGYNSAPGNYSSDNFNQGGAAPGAYEGANYGGGNNYMNNATSDDSTGKLDELLNDLKVDGDGKEDGEGKADGAGLVNEDLKGDDGQDELLQNDFKDEDVSDDYANKRR

SEQ ID NO: 37670 - protein, 348 aa, Thermus caldophilus
MKGLILAAGRGTRLRPLTHTRPKPAIRVAGRPIIHYAVENLLEAGVREIGVVVSPETERDLKVALEGYPVRYVFQEEPQGLAHAVDVARGFLGESPFVLYLGDNLFQKGIRRFLEAFKPGVSAVIALVRVEDPRQFGVAVLEGNRVVRLLEKPKEPPSDLAVAGVYVFSPEVLEVVRGLKPSARGEYEITDAIQGLIDRGKTVVGVEVEGWWKDTGRHQDLLDANRLLLEELTPKVEGDVVESQLTGRVVVEKGAKVVRSTVIGPAHIGAGAVVEEAFVGPFTSVGPRARVARSEVEYSLLEEEAVVEEVRLRLQECILGVRAEVKSRDGLPRAHRLILGDLSQVELA

SEQ ID NO: 37671 - protein, 338 aa, Sclerotinia sclerotiorum
MAPTKVGINGFGRIGRIVFRNAIEHDDIDIVAVNDPFIETEYAAYMLKYDSTHGQFKGDIKVLSDGLEVNGKKVKFYTERDPANIPWAESEAYYVVESTGVFTTTEKAKAHLKGGAKKVVISAPSADAPMYVMGVNNETYNGEADVISNASCTTNCLAPLAKVINDEFTIIESLMTTIHSYTATQKTVDGPSAKDWRGGRTAAQNIIPSSTGAAKAVGKVIPELNGKLTGMSMRVPTATVSVVDLTVRIEKAASYDEIKEVIKKAANGPLKGILAYTEDDVVSTDMNGDNHSSIFDAKAGISLNKNFVKLVSWYDNEWGYSRRVLDLLHYISKVDNKQ

SEQ ID NO: 37672 - protein, 542 aa, Rhodococcus sp. RHA1
MDPFTTQLTPLSFLRRSADVYPDKTAVIYGDEALTYRALAEAVELRVRALRAAGVRPGDRVAYLMPNVPEMLIAHFAVPLAGAVLVAINTRLSGEEIRYIVDHSQSTFLVIDTALSSSIVDVAEKFETVETIVTVTDDAASGTAALAECRDFSDLLAMVHGVNLPAIEWAVDDERSLLSINYTSGTTGKPKGVMYSHRGAYLNAIGELIHSKHDVDSVYLWTLPMFHCNGWSTGWAVAAAGGTQVCLREVRSELIWNLIDRHGVTHLNGAPTVIITIMNSGRAHKLDRPIIVTTAGAPPSPTTIERMADIGFEVVHVYGLTETYGPYSICEPQSSWKSLDAATRARRMARQGVGMIQADRMRVVSTESPEGLLVDVPADGVTIGEIVMRGNNVMSGYYRNPEATRSAFGGGWFHSGDLGVMHPDGYVELRDRAKDIIISGGENISTVEVEQALMTHPAVIEAAVVGVPDPQWGERPKAFVVVIEPGDVTAADLLEHVQTRIARYKAPREIVVVPNLPKTSTGKIRKFELRESEWGDRDARIN

SEQ ID NO: 37673 - protein, 76 aa, Glycine max
  misc_feature (47)..(47): Xaa can be any naturally occurring amino acid
VTGHTHQFKAYKHEGGVVINPGSATETYSSITYDVNPSFVLMDIDGXRVVVYVYELIDGEVQVDKIDFKKTATMHG

SEQ ID NO: 37674 - protein, 424 aa, Silicibacter pomeroyi DSS-3
MIRLNSQADWVERARAVLPAAGFGNFDPAVVIARGQGARVWDQDGREYVDYLIGSGPMLLGHGDPEVMEAVLEQLPLGTTFFANNTKGIELAEAIVQAVPCCEQVRFVTSGGEADMYAIRLARAFTGKPRIVKFEGGYHGMSAEAQMSLAPARAVNFPTPVPDSAGIPPGVADQVLVAPFNDLEAVASLLAEHDDIAAIIAEPLQRIIAPAPGFLQGLRALCDRHGVLLIFDEIVTGFRLSYGGAQEHYGVTPDIVTLGKVIGGGFPLAALGASARIMAHFDKGAVGGEGWLMQLGTLSGNPVAAAAGLKTLEILRRPGQYARLRDLGERLMAMHERALGAQGIAHRLSGDATLFDVYFTDAACTDYRTARHAAPELAQVWNAVLRAEGVLKSPGKLYPSLALGEEELERTEAALNRAAAAVTG

SEQ ID NO: 37675 - protein, 133 aa, Mycoplasma pneumoniae
MAQFIQEVKADGIVCPEARGFIFGGALASKTKLPLVLVRKPHKLSGELARETYDLEYRQNSILEMRVDALENCKRCVIVDDLLATAGTVAAIDKLIARLGSQTVGYCFLIELQKLHGKAKLQPNVATKILLHY

SEQ ID NO: 37676 - protein, 288 aa, Solanum demissum
MVGSVNIDQQGKGGYVSDEVLGTFLPIVVYWVYSGLYLMLGNMDNYRLHSKKDEDEKNLVSKKEVVKGVLLQQIVQAAVATVLFALGLLSLDSTNALLWFPFTLVTGDDGESGGDRHTSIFVLGRQLFIAMLMLDTWQYFMHRYMHQNKFLYKHIHAQHHRLIVPYAFGALYNHPLEGLILDTIGGALAFLVSGMSPRTSIFFFSFATIKTVDDHCGLWLPGNLFHIFFKNNSAYHDIHHQLYGTKYNYSQPFFVTWDMILGTYMPYELERRPEGGFEAKPVKDCKEH

SEQ ID NO: 37677 - protein, 284 aa, Pseudomonas aeruginosa PAO1
MSAPRSVLAGLIGAGIQASRTPALHEREGDAQGIRYLYRLIDLDPLGKSADDLEFLLAAASDLGFTGLNVTFPCKQAIIPLLDDLSAEARGIGAVNTVVLRDGRRIGHNTDCLGFAEGFRRGLADAPRQRVVQMGAGGAGAAVAHALLAEGVERLVLFDVDPARAQALADNLNQHFGAPRALAGSDLAGALGDAQGLVNTTPVGMAKLPGMPVPAELLRADLWVAEVIYFPLETELLRQARALGCRTLDGGTMAVFQAVKAFELFSGVTADAARMQAHFASLGD

SEQ ID NO: 37678 - protein, 205 aa, Oryza sativa (japonica cultivar-group)
MSIDDYLFKLLLIGDSSVGKSCLLLRFADDSYIDTYISTIGVDFKIRTIELDGKTVKLQIWDTAGQERFRTITSSYYRGAHGIIIVYDVTDMESFNNVKQWLSEIDRYASDSVCKLLVGNKCDLVDSKVVDTEEAKAFAESLGISFLETSAKESINVEEAFLTMSSDIKKRMATQPAVERKPTVHIHMRGQPIQQQNSSSSCCSS

SEQ ID NO: 37679 - protein, 196 aa, Zea mays
MVVYTQEHVYRHPWDRVTAAAWRKFTDPASCTALSHVADVHTLHRRLDSDTGRLQAARSITVRSPPLPFVLRRLLPSAAASPNGAALCHCVETSLVDAQRRAMDVVVRNVSLRGLIGTRERASYRPHPDRPDDWTQFRQETTIRCRPLAALAAVAEKVETRCAERFLQNSAKGREVVERICRYLEAESAGAAPSVT

SEQ ID NO: 37680 - protein, 439 aa, Schizosaccharomyces pombe 972h- [sequence omitted]

SEQ ID NO: 37681 - protein, 144 aa, Pseudomonas aeruginosa PAO1
MKTVAQLLNAKQNQQVYTIGADEMVLDALRLMAEKNIGALLVVNHGEVVGVVSERDYARKMVLKGRSSIGTPISAIMSAPVVSVDSKQSVDTCMNLMTDRHLRHLPVVEDGQLLGLLSIGDLVKAAIAEQAELIQQLEQYIRGD

SEQ ID NO: 37682 - protein, 458 aa, Bacillus halodurans C-125
MTTLVREKQTYDVQYYVQHVYETVKRRNPNEHEFHQAVKEVFDSLLPVLVKHPQYVKQAILERIVEPERVISFRVPWVDDQGNVQVNRGFRVQFNSALGPYKGGLRFHPSVNASIIKFLGFEQIFKNALTGQPIGGGKGGSDFDPKGKSDGEIMRFSQSFMSELSNYIGPDIDVPAGDIGVGAKEIGYMFGQYKKMRGGFEAGVLTGKGIGYGGSLARKEATGYGTVYFVEEMIKDHGFSFAGSTVVVSGSGNVSIYAMEKAMQLGAKVVACSDSGGYVYDKNGIDLQTVKRLKEVERKRISEYVNEHPHAHYVQGCSGIWSVPCDIALPCATQNELDEAAATMLIANGVKAVGEGANMPSTLQAVHTFQEHGVLFAPAKAANAGGVSVSALEMAQNSTRLAWTFEEVDAKLYEIMKNIYRESIKAAELYEASGNLVVGANIAGFVKVADAMISHGVV

SEQ ID NO: 37683 - protein, 449 aa, Thermoplasma acidophilum DSM 1728
MMQEELNGIKIKVTPPGPEAKKIIDMNDRYLARSTQSLPVVGKIGRGVYVEDVDGNVYLDFSSGISVTNLGHVDPYVTAKVEDQLHKMWHFPGTDFYTEMQVLAAKSLIEVTPGKFEKRVFFTNSGTESVEAAIKVAKSYTGRGMFIGFIGAFHGRTQGSLSFTASKPIHHRGFFPSMPGVEHVPYPNPYRNPFGIDGYENPDELVNRVIDYIETYLLKTYVPPEDVAGILAEPVQGEGGYIVPPMNFFRELRKLADSYNIPLMMDEVQSGFGRTGKFFASEHFGVEPDVITLAKAIASGIPMGAVVMRKEMNFKESGLHSNTFGGNLIASAACVATIEEMKKLNVVENSAKQGAYLRKRLEELQSKYDAIGDVRGLGLMQAIDFVKDRRTKEPNSKLRNAVIDNAFRLGLILLSTGSSAIRIIPPLIITQDQIDEGIEVLDKAIKQSL

SEQ ID NO: 37684 - protein, 322 aa, Pediococcus pentosaceus ATCC 25745
MKRIGIMTSGGDAPGMNLAIRAVARKALSSGLEAYGINYGFAGLVAGDIHEFKAADLDDMVSQGGTMLYSARYPEFAQEESQLKGIEQLKKFGIDALVVIGGDGSYHGALRLTEHGYNTIGLPGTIDNDIPFTDFTIGFDTALNTAVDAIDKIRDTAKSHQRVFAVQVMGRNAADIALWAGVASGADAVIAPGFDYDVEAIANKLKKNRANGKDYGIIVIAEGDANSDAAPEFIDQLKQYGDFDARATVIGHVQRGGVPSAKDRVLASKMGAYAVELLLEGKGGLAVGILENKVQAHNMLDLFDAKHQADDSLYQLSEDLSF

SEQ ID NO: 37685 - protein, 242 aa, Akebia trifoliata
MGRGRVGLRRIENKINRQVTFAKRRNGLLKKAYELSVLCDAEVALIIFSNRGKLYEFCSSSSMFKTLERYQKCNFGAPEPNVSTREALEHSSHQEYLKLKARVEGLQRSQRNLLGEDLGPLSGKELETLERQLDMSLKQIRSTRTQYMLDQLSDYQRREQMLSEANKALRRRLEEGSQPNPHQWDPNVQVVNFGRQQAPAQGEGFFQHIECEPTLHIGYQPDQITVAAAGPSMNNYMQGWIG

SEQ ID NO: 37686 - protein, 453 aa, Prochlorococcus marinus subsp. marinus str. CCMP1375
MNYSFDLIVLGAGSGGLAAAKRAASYGARVAIVEGDRVGGTCVIRGCVPKKLLVYGSQYGEYLKNAPSFGVKLTASKIEPSILLKNVRNEVDRLNKLHIDLLEKSNVVLIKGWGSIAGPNSVVVKSKDVQDQAIELFAEKILIAVGGRPSFPEIPGASLGWTSDDVFLQEGFPDKVVVVGAGFIACEFACILNGLGVKVKQLVRGRNLLKNFDNEVAFNLQQSMESSGIEFQFASEVNSIEGEIGDLNLVVNHDSNIKSGAVIFATGRKPFIEGLNLEKVDIRTSNNRINVDNKNSTNISNIFAIGDVTDKVNLTPVAIEEGRVFADNNYSDKNRYVNYEFIPKAVFSQPELAYVGKTEEESKRIYGESNIKIYRANFKPMSKMLVKSKEKCFLKLIIEKNSNKVVGCHMLGEHASEIIQMAAISMNMGATKLDFDQTMALHPTISEEFVTMK

SEQ ID NO: 37687 - protein, 409 aa, Arabidopsis thaliana
MDSVSKDMINVLPDALLCHILSFLTTKEAASTSLLSRRWRYLLAFVPNLEFDDSVYLHHRILALQGNSPLDKFSLKMVDGHDPVDPDSVVPWIHKVLVRGVSDLHLVVDMNEWTSDPLPSRIFLSETLVKLTIKIRDGPFIDVKHVHLPKLKTLYLQSVMFDENDIGFRKLLSGCPVLEELVLDGMGSCVWTSFTVSVATLKRLTFCCQKMSSFGYMHDDENPNNVSFDTPNLVYLEYAQVIANNYPKVNFDLLVEVLNFCCKTIPLFNNLTYLTIETNEDVGWESLSNILENCPNLETIIFKDADMCMCKPWEATPICLSSSSVKILEVLKFGEVTSYKDDMDRQTEVIKFFLETMPNLEQVILYYDTPFDDDLSILSTELQMLEKVASPKCKIQVISDNISYSSTKK

SEQ ID NO: 37688 - protein, 104 aa, Triticum aestivum
  misc_feature (81)..(81): Xaa can be any naturally occurring amino acid
MGPTVVAWGATSVDPFQGLKSTEGLHVRRRYNGARLGSVRNGGRVRCMQVWPIEGMKKFETLFYLPPFSTGALLKQVDYLXIRSKWGPCLEVSKGGFIFREHNA

SEQ ID NO: 37689 - protein, 694 aa, Rhodobacter sphaeroides 2.4.1
MKRPTRPAPPLKFDMSSAHPNRLGADFDGEGTNFPLFSENATRVELCLFDETGQTQTHCLDLPSYEGGIWYGYLPGIREGQTYGYRVHGPHAPEEGHRFNPNKLLIDPYARELRGDLIWDDALFGYPIGGDDLELDPRDSAPFMPKAVVVDPAFDWEADKALRHRWQDTVIYEAHVKGLTMRHPGVPEEDRGTFKGLASPAVIDHLKAIGVTAIELLPIHGFLNDRHLIEKGLSNYWGYNTLSFFAPYRPYTKSGSMREVKRAIKRFHDAGIEVILDVVYNHTCEGNEKGPTLSFRGIDNASYYLLSPEAKRHSFDTTGTGNTLNVAHPMVLRMVMDSLRYWVEVMHVDGFRFDLASTLGREPEGFERGGTFFAAIRQDPVLSMVKLIAEPWDIGEGGYQVGGFPWPFREWNDKARDDLRAFWRRDPGLIGDVSQRLLGSPVQFSHSHRPATSSVNFIAAHDGFTAWDLVSYDEKHNEANGEDNRDGHSHNLSHNLGAEGPTDDPGILEARLRRVKAMLATLFLSQGVPMILAGDEFGQSQQGNNNAYCQDNEIAWLDWEEARDELIRAVADLAEFRKADGGISRARFAVGPDAVQHDTPVATWLHPAGREMEEGDWNEGELRLFALRLDLPRGRDLLVVLNAGDDGDFALPEGEWRLKIDTSRERIACDEPALGTLPVGWQSVMVLVAAEEAD

SEQ ID NO: 37690 - protein, 337 aa, Methanococcoides burtonii DSM 6242
MSKTAAVIEGDGVGPELVDAMVKVAEAVGTNVEFVKCEAGVQWWEKNGGATLIPDETWALLDEADACFKGPTTTPGGAGSPRSVAVSIRQKYNLYANVRPIKTFPNTNNPLGDVDFVCVREGTEGMYIGEEVKLTDDVYIAIRKITRPACKNIATYSFEEAKKRGYDTVVPIHKSNILKMTCGTFLEEVEKVAEGYPGIDVWEYHVDNIAQQLIKNPQLFNNKILLSTNLFMDVISEECSALIGSIGLIYSANIGDNFAMFEPAHGSAPKYAGLDKVNPVATILAGAWMLDYLGESDKFAQIFKATEDVISEGKHLTYDLGGKASLSEMTDAIISKL

SEQ ID NO: 37691 - protein, 203 aa, Triticum aestivum
GDVATGRGSEKVHVAIYYESLCPYSVRFVANHLFKAYRDGLLDAANLTLVPYGNAVVRNDGTISCQHGPEECLLNTVEACAIDAWPDVKVHLGFIYCVSDLVLKNKHREWESCFQKQGLDPKPVTECYKGERGHNLSLEYGRQTAELVPPHQFVPWVVVDGKPLYNDYGNFKAYICKAYKGYPLLEACRSLGLEAHDDVYGRL

SEQ ID NO: 37692 - protein, 1562 aa, Ostreococcus tauri
MRLRVRTSDGAQAVVDIADNATVGALKTAIARTTDIVESEQEWHFGFPARPVDATDFSASCASLGITNGETIAVSRVTIENASTTPLGTTIEGDSTLVEELAAMDEDEALARALAASMEDGANADASTSVDVTSMHAVRRVIASDNSCLFNAVAYCVERSLKEATRLRRVVADAVAADAATFSEGFLGKSPKAYVEWITKPNSWGGQVELFILSKYYRVEIAAYDIQTERCDIYGEGEGYNDRIMVIYDGLHYDALVLHPVFGGADVSRDVTRVPPGVALPAVQRLVREQHASKKFTDTANFSLRCLVCQKGLVGQAEAVAHAKSTGHANFAPHSLSLWRTRDNRLANNVDALHVHGVSRACEAGVMRIKQVVVEGFKTYREQTVVDFDDGLNCIVGANGSGKSNLFHAIRFVLSDVFGTLRAEDRQRLLHEGAGHAVMSAYVEIVFDNADGRLPVEREEVRLRRNIGLKKDEYYLDKKHVTRAEVVNLLESAGFSRTNPYYVVQQGKIMKMATMQDEERLDLLKEIGGTSVFEAKRKESLKGLDETKSKREQVQETVEFIESRLSELDAEKDELQKYTDLDKTKRSLEYTIYEQELSDTRNKLDEIEQKRSAVHECSRVDDEKLNAVNDKIRAREKEFKDGNRAAAQLKKELDTAEAESLDVKDLRETIQSGEQALPGIAGQKTDVEKATAETQQKLDVVRKKYDAEAAVEEAKDREIADVDRRLQSLYQKQGRSDRFKSKAERDAWLKGQIKETNKTKQQKLKEVEMLENDLNDIRKTQSSDEKDRATMEAELVVEEEKLAEVDAQYKKVMAERNQAQNTRKDLQRQENDIDNSLASCDEDIKKRDKQLEFTMPRDLQRGMAAVQRIVKEHNIEGVHGPLIELMETDERFHAAIEASAGNQLFHIVVDHDDIGSRIIEYLNKEKGGRVTFLPLNRMNAPNVTYPEGSDAFPLVSKLKYDAKYDAAFKQIFARVLICRNIDVAVTKAASSALNCVTMDGDTVSNKGSMSGGYHDSGRSKIAAMTALRELNINRESLREKISIVKKSLEASEQKMSSVLGDISRLESQRRYSMQHVERLKSELRFYGDTGTRASSLLEQTEKRIATMRADIAQLEMQVTDLTSEIGSSLDATLTPAETQELGKLTAQASTLKQEKVVIAARRLDVYAQLSELQTSLETNLARQQKRIAITSGEVDINGLRAELAKLEGQLKAVQNDEAIARKQYDGVAEKMRTAQASVEAASAEIEQLRGSQVSMNMSMSEREKEIETLITKTSMLANKREQYQKKIRELGSLPADAFDRYRSESVSALRKLLGKTNTQLEKLGHVNKKALDQYQQFTEQRSELEKRRAEINKAHESITQLIDHLDRKKDEAIERTFKQVSVNFRDVFHKLVPGGRGELVMQRKRVANRDPDEEGGARAADLTSFSEKYSGVKIKVSFGQGETMQMKQLSGGQKTVVAVALIFAIQRCDPMPFYLFDEIDAALDPQYRTAVAHMIKSQAVGKTQFICTTFRPEIVKEATCIQGVSHSHKVSTVQKVNLEEALNFVGDDTQQVAPIERGPPTP

SEQ ID NO: 37693 - protein, 394 aa, Ostreococcus tauri
MARDDAQSDVSVDGANARDAEDARSSDDDAVNDASSSSSSSSSSSSSGYGFGRESAEMVALMERLAAQRLGTTTEALARATVDKALESFDLAGVASYVKSGRAKNVVVMTGAGISVSAGIPDFRSESGLYARLGEYDLPYPQAVFELGYFKDRPGPFYRLAKELYPGAFAPTPTHYFIKLLHDKGILRRCFTQNIDSLERATGLPKEKVVPAHGNFDGAHCLRGHEADVDEVADACRAGTPMICSKCGEYVKPDIVFFGENLPRRFFECAQEDFEVCDLLIVIGTSLVVHPFAGLIERPKEDVPRLLINMEKCGEAPDSHMSRLYRLAGLGRGTGFDFDEDTNYRDALYLGACDDGIAELSELLGWKEDLDALIKSCEIRNKLAQEAPAECLNG

SEQ ID NO: 37694 - protein, 673 aa, Zea mays
MGGVGAGSLALLRLLLLLLLRSEASALHGCSSYICTEPLTATPIGSPCGCVEPISVIVDLDLAPYLLFMSIAELEVEVAAGTFLKQSQVKIMAAVASIQDDQKTRVTIYLVPLREQFDTYTASLISDRFMEKKVQINSSIFGDYKVINISYHGLQSPPSSLPGGSDPSGTEEYPITAEVPDQKKKHNKSDILVIVVVLGSSLGLLMTCAVVLILLVRWKKLGRLHEAMTPATIPAVNRRYGTRPTLSTSMVSSASASVFSTVATCTTSVKTFSLAQLQKATDGFDSRRVLGQGGFGRVYHGTIEDGNEIAVKLLTREDRSGDREFIAEVEMLSRLHHRNLVKLIGICIERSKRCLVYELIRNGSVESHLHGADKAKGKLNWDVRMKIALGAARGLAYLHEDSNPHVIHRDFKASNILLEEDFTPKVTDFGLAREASNATQPISTRVMGTFGYVAPEYAMTGHLLVKSDVYSYGVVLLELISGRKPVNISESKDPENLVTWARPLLSHKEGLEKLIDPSLDGNFNFDNVAKVASIASMCVHTDPSQRPFMGEVVQALKLIYNDPDEACDDSYSPRNSSDQDGDYEGDLVFESGSWGFGASGCLDYRNSLPFVTMDYSSGRIEGPHDPRAALSAGSHAQSPVLLNRSGPLRMKKKLASFYRSRGSISEHGHLPRH

SEQ ID NO: 37695 - protein, 128 aa, Prochlorococcus marinus subsp. marinus str. CCMP1375
MKLHWESKAPVDNFLKAFRCFILIALVISSVFGTPNRVLANNQTNGERLFIENCAGCHINGGNIIRRSKTLRLKDLHRNGLDNADAIAKIAKEGIGIMSGYKDVLGENGDNLVANWIWEQSQKAWVQG

SEQ ID NO: 37696 - protein, 255 aa, Salmonella enterica subsp. enterica serovar Typhi str. CT18
MRHPLVMGNWKLNGSRHMVNELVANLRKELTGVAGCDVAIAPPEMYIDLAKRAAAGSHIMLGAQNVDLNLSGAFTGETSAEMLKDIGAQYIIIGHSERRTYHKESDELIAKKFAVLKEQGLTPVLCIGETEAENEAGKTEEVCARQIDTVLKTQGAAAFEGAVIAYEPVWAIGTGKSATPAQAQAVHKFIRDHIAKADAKIAEQVIIQYGGSVNASNAAELFAQPDIDGALVGGASLKADAFAVIVKAAEAAKQA

SEQ ID NO: 37697 - protein, 101 aa, Glycine max
  misc_feature (21)..(21): Xaa can be any naturally occurring amino acid
  misc_feature (34)..(34): Xaa can be any naturally occurring amino acid
  misc_feature (86)..(86): Xaa can be any naturally occurring amino acid
EATLAELHCSQPAALKVRARXDAYLGTKLSLKAXLHTVRSTNFRIDAVVAKSGDKSVYYDSEDLGNTTGQCDLYGSHATSRYNRSXSKVCATFAAPLTNRG

SEQ ID NO: 37698 - protein, 171 aa, Solanum demissum
MGSDNNVIAVIAKNIDVLALPLVSLVYPLYASIKAIETKSRADDRQWLTYWVLYSLITLFELSFSKLIEWFPIWSYAKLGAICWLVLPYFNGACYVYENFIRPFYRNPLVKIWYVPLKKDIFSKPDDVLTAAEKYIEKHGPQAFERLLAKADRDARTRRNNYMTFDDDYRY

SEQ ID NO: 37699 - protein, 1112 aa, Arabidopsis thaliana
MEDLRRRFPTKKNGEEISNVAVDPPLRKASDALPLPLYLTNTFFLSLFFATVYFLLSRWREKIRNSTPLHVVDLSEICALIGFVASFIYLLGFCGIDLIFRSSSDDDVWVNDGMIPCNQSLDCREVLPIKPNSVDPPRESELDSVEDEEIVKLVIDGTIPSYSLETKLGDCKRAAAIRREAVQRITGKSLTGLPLEGFDYNSILGQCCEMPVGYVQIPVGIAGPLLLDGVEYSVPMATTEGCLVASTNRGFKAIHLSGGAFSVLVKDAMTRAPVVRFPSARRAALVMFYLQDPSNFERLSLIFNKSSRFARLQSITCTIAGRNLYPRFACSTGDAMGMNMVSKGVQNVLDFVKSEFPDMDVIGISGNYCSDKKASAVNWIEGRGKHVVCEAFIKAEIVEKVLKTSVEALVELNTLKNLVGSAMAGSLGGFNAHSSNIVSAVFIATGQDPAQNVESSHCMTMILPDGDDLHISVSMPCIEVGTVGGGTQLASQAACLNLLGVKGSNNEKPGSNAQQLARIVAGSVLAGELSLMSAIAAGQLVKSHMKYNRSSRDIGPSSQVNSVCFVMIMYVTELGTTNKCRNVVVNIADDGGVIWCMMVNDSQVLIHFVLLVSRQGKVRLTKWYSPYTQKERSKVIRELSGVILNRGPKLCNFIEWRGYKVVYKRYASLYFCMCIDEADNELEVLEIIHHYVEILDRYFGSVCELDLIFNFHKAYYILDELLIAGELQESSKKTVARIISAQDQLVEVAKEEASSISNIIAQATNNFPMASSSEKTPLIPSDEKNDTKEESKSTTKPESGSGAPPSPSPTDPGLDFNAFDFSGMAGILNDPSIKELAEQIAKDPSFNQLAEQLQRSVPTGSHEGGLPNFDPQQYMQTMQQVMENPEFRTMAERLGNALVQDPQMSPFLEALGNPAASEQFAERMAQMKEDPELKPILAEIDAGGPSAMMKYWNDKDVLAKLGEAMGIAVGADQTVAAEPEEAEEGEEEESIVHQTASLGDVEGLKAALASGGNKDEEDSEGRTALHFACGYGEVRCAQVLLDAGANANAIDKNKNTPLHYAAGYGRKECVSLLLENGAAVTQQNMDNKNPIDVARLNNQLDVVKLLEKDAFL

SEQ ID NO: 37700 - protein, 308 aa, Arabidopsis thaliana
LKQIQFVDMCDPTRDDGSSRSRVVSTMQKRAYFQRQWPLVDVVRASVVVIVHFLCLLAPFNFKWEALRFGLVLFALTTLSITFSFHRNLSHRSFKIPKWLEYPWAYSAVFALQGDPMDWVSIHRFHHQFTDSDRDPHSPKEGLLFSHILWIFDTQYIKYKCGGRDNVLDLKKQWFYKFLRRTIAVHILMFWTILYLYGGLPYLTCGGGVGIFIGYHVTWLVNSACHIWGSRSWNTKDTSRNVWWLSLFTMGESWHNNHHAFESSARQGLEWWQIDITWYLIRLFEVLGIATDVKLPSELQKQKMALVR

SEQ ID NO: 37701 - protein, 166 aa, Arabidopsis thaliana
  misc_feature (124)..(124): Xaa can be any naturally occurring amino acid
NVGTWAAKLIHEKGGKVVAVSDITGAIRNPEGIDINALIKHKDATGSLNDFNGGDAMNSDELLIHECDVLIPCALGGVLNKENAGDVKAKFIVEAANHPTDPDADEILSKKGVIILPDIYANAXGVTVSYFEWVQNIQGFMWEEEKVNLELQKYMTRVFFFFCEIH

SEQ ID NO: 37702 - protein, 337 aa, Ajellomyces capsulatus
MVVKVGINGFGRIGRIVFRNAIEHGEVNVVAVNDPFIETHYAAYMLKYDSTHGQFKGTIDVNSNGLTVNGKAVTFYQERDPASIPWGKHGVEYVVESTGVFTTTEKASAHLKGGAKKVIISAPSADAPMFVMGVNEKTYDPSVNVLSNASCTTNCLAPLAKVINDNFGLTEGLMTTIHSYTATQKTVDGPSSKDWRGGRTAAQNIIPSSTGAAKAVGKVIPSLNGKLTGMSMRVPTANVSVVDLTCKTEKPVTYDQIKQTIKKASEGELKGILGYSEDALVSSDLNGDSRSSIFDASAGIALNDHFIKLISWYDNEWGYSRRVVDLIAYIAKVDAGK

SEQ ID NO: 37703 - protein, 187 aa, Brassica napus
MASLVEKQLFKALFSFFLLVLLFSDTVYSFRKTLDQRKPCKHFSFYFHDILYDGDNVANATSAAIVSPPGLGNFKFGKFVIFDGPITMDKNYLSEPVARAQGFYFYDMKTDFNSWFSFTLVFNSTEHKGTLNIMGADLMMEPTRDLSVVGGTGDFFMARGIATFVTDLFQGARYFRVKMDIKLYECY

SEQ ID NO: 37704 - protein, 409 aa, Rhodobacter sphaeroides 2.4.1
MRDAQRPDLSTTFTVLLAGGRGSRLHELTSRECKPALPFAGPRRIVDFTLANAARSGLTRMIVATQYRPETLAHHLESRWASRFAGGSLRLREGTAVTGSPQGYGGTAAAVAANLAELQSEGVRELVVLAADHVYEMDYADMVAAHRASGASATVAVDTVPTDRASEFGVVRTSEGGRIESFLEKPAVVPADPAIPGRAQVSMGIYVFDLDWLASVLRIIPGATQDFGHDILPLAVALGEAHAYRVPGDNFYWRDVGTLDAYRLAQLEFQTGEAPCALPPRIAASEHEMKAATGELIQFAFRMQTGGIALHSPRLGGDLPGRWTMLDESVLLPGARVAPGVRLTRTIVAPGTSVPAGLVIGEDPDEDARWFRRTEEGTVLVTTPMLARRAADRGRLVAPFADSRMGRSA

SEQ ID NO: 37705 - protein, 338 aa, Aspergillus oryzae
MATPKVGINGFGRIGRIVFRNAIASGDVDVVAVNDPFIETHYAAYMLKYDSTHGRFQGTIETYDEGLIVNGKKIRFFAERDPAAIPWGSAGAAYIVESTGVFTTTEKASAHLKGGAKKVIISAPSADAPMFVMGVNNKEYKTDINVLSNASCTTNCLAPLAKVINDNFGLVEGLMTTVHSYTATQKTVDAPSAKDWRGGRTAAQNIIPSSTGAAKAVGKVIPSLNGKLTGMSMRVPTANVSVVDLTCRTEKAVTYEDIKKTIKAASEEGELKGILGYTEDDIVSTDLIGDAHSSIFDAKAGIALNEHFIKLVSWYDNEWGYSRRVVDLIAYISKVDGQ

SEQ ID NO: 37706 - protein, 316 aa, Salmonella typhimurium LT2
MSMNKAVSSEQKPLDVICLGRVAVDLYGQQIGSRLEDMTTFAKYLGGSSGNVAYGTAIQGLRSAMLARVGDEHMGRFVREELNRVGVDTQCLLSDRDRLTALVILGIKDQDTFPLIFYRDNCADMALTPEDIREDYIASSRALAVTGTHLSHPNTRAAVLKALEYAQKHGLRRALDIDYRPVLWGLTSLGDGETRFIASSQVTEQLQQVLRHFDLIVGTEEEFHIAGGSTDTLTALRRVRQLTQAVLVCKRGALGCSVFEGNIADDWSQVKIHSGVRVDVLNVLGAGDAFMSGLLRGYLNDESWEQACRYATPAAR

SEQ ID NO: 37707 - protein, 337 aa, Phaeosphaeria nodorum
MVVKVGINGFGRIGRIVFRNAIEHNDVEIVAVNDPFIEPHYAAYMLKYDSQHGQFKGDIKVEGNDLTINGKTIRFYTEKDPANIPWSETGAYYVVESTGVFTTTDKAKAHLKGGAKKVVISAPSADAPMFVMGVNNETYTKDIEVLSNASCTTNCLAPLAKVIHDKFTIIEGLMTTVHSYTATQKVVDGPSAKDWRGGRTAAQNIIPSSTGAAKAVGKVIPDLNGKLTGMSMRVPTSNVSVVDLTVRLEKGATYDEIKEAVKAAADGPLNGILGYTEDEIVSTDLNGDTRSSIFDAKAGISLNKNFVKLVSWYDNEWGYSRRVLDLLVYIAKVDGNA

SEQ ID NO: 37708 - protein, 334 aa, Pichia ciferrii
MAITVGINGFGRIGRLVLRIALSRKDIQIVAINDPFIAPEYASYMFKYDSTHGRYSGEVSHEGENIVIDGKKIRVYQERDPVNIPWGKDGVDYVIDSTGVFKELDSAQKHIDAGAKKVVITAPSSTAPMFVVGVNEDKYTPDLNIISNASCTTNCLAPLAKIINNKFGIEEGLMTTVHSITATQKTVDGPSHKDWRSGPTASGNIIPSSTGAAKAVGKVIPELAGKLTGMSLRVPTVDVSVVDLTVKLLKDATYDEIKAAVKEAAEGPLKGVVGYTEDQVVSSDFLTDNRSSIFDAEAGIWLSPRFVKLIAWYDNEYGYSTRVVDLLEYVASKN

SEQ ID NO: 37709 - protein, 337 aa, Cryptococcus curvatus
MATKVGINGFGRIGRIVLRNALEHGDIDVVAINDPFIDLDYMVYMFKYDSTHGRFKGKVETKDGKLVIEGKPISVFGERDPAAIPWGKAGADYVVESTGVFTTIEKASLHLKGGAKKVIISAPSADAPMFVCGVNLEAYKPEYEVISNASCTTNCLAPLAKVIHDNFGIVEGLMTTVHATTATQKTVDGPSHKDWRGGRGAAANIIPSSTGAAKAVGKVIPSLNGKLTGMSFRIPTSDVSVVDLVVRLEKGASYDQIKEVIKKASEGELKGILGYTEDEVVSTDFLGSTESSVFDAKAGIPLNDKFVKLISWYDNEYGYSRRVCDLIAYVAKKDKSA

SEQ ID NO: 37710 - protein, 384 aa, Thermoplasma acidophilum DSM 1728
MVSHRYKGFNTKAVQSGELRDPRFGNVTTPIFETSTFVYPNPEKEAYTDHTRDQPYIYTRWGNPTVQAFEEKYAAVEGAEYALSFSSGMGAITSAITGLLHPGSRMLSLSDLYGQTFYFFNKVLGDLGIKVDYIDTERINSLDFDPSKYDAIYMESITNPTLKVPDIRSVSDYAKKSLVIVDATFASPYNQHPLDLGADVVIHSATKYIGGHSDIVMGVVGTNSKEIFNSLVIRRKTYGSNPDPIQAYLALRGLKTLGLRMEKHNRNGMEIATFLRKNDSISRVYYPDTEMGKKVLSGFGGMVSFEIRRDRDVHSFLRKLSIPMVAASLGGVESLITLPAETSHSSLSREERERMGISDNLVRFSIGIEDAEDLIADIQNALGA

SEQ ID NO: 37711 - protein, 715 aa, Rubrobacter xylanophilus DSM 9941
MSEQRSVVWPGEPYPLGATWDGEGVNFALFSENAERVELCLFDPSGRREVERIELREQTDQIWHCYLPYGRLGQLYGYRVYGPYDPENGHRFNPNKLLLDPYAKSIAGSLDWRHPHFGYRPGEDDLSFDERDNAAGALKCRVVDTAFTWGDDRPPRTPWHDTIIYELHVKGFTRLHPEIPPHLRGTYAGLASAPAIEHLKRLGVTAVELMPVHFFVDDKHLLDRGLRNYWGYNSIGFFAPDARYSATGSINEFKTMVKRLHSAGLEVILDVVYNHTAEGNHLGPTLSFRGIDNAAYYRLVPDDRRYYMDYTGTGNTLNMMHPRVLQLIMDSLRYWILEMHVDGFRFDLASALARELHDVDKLSAFFDIIRQDPVISQVKLIAEPWDVGEGGYQVGNFPVGWTEWNGKYRDAVRSYWKGDGGLVDELAYRLTGSSDLYERDGRRPYASINFVTAHDGFTLQDLVSYNEKHNEANGEDNRDGHDDNRSWNCGVEGPTGDRGIRRLRARQKRNLMATLLLSQGVPMILHGDEMGRTQNGNNNAYCQDNETSWVSWNLAPADRNFLAFVRRMIRLRREHPIFRRRSFFQGRRLRGAGVKDITWLTPDGDEMTDEEWASSFARSLGLQMSGILEGEVDAQGRQIQDDDFLLLLNAHHEDLSFVLPPVPEDARWEAVVDTAHAAGLKPAGFYKPGDAYPLKARSMAVLANARREAPEEEEE

SEQ ID NO: 37712 - protein, 451 aa, Magnetospirillum magnetotacticum MS-1
MPDYDYDLITLGAGSGGVRACRMAAAAGRKVAVVESSRVGGTCVMRGCVPKKLLVYGARFAEDLADSLGFGWSLEGADFDWARLVAAKNVELQRLEGVYMRLLKEPGVTVVEGKGHLLDAHTVQVGLQVLSAETILVATGGRPSLPDVPGIEHAVTSDQALDLMQLPERVVIVGGGYIAVEFAGIFNALGVGVTLVLRGDTLLRGFDADIRATLAEEMGKKGVELRTTTQVRAIERRGHGYCVLLSDGDSLEADLVMYATGRVPNTEGLGLEKAGVVLNSKGAVMVDALSRTSVRNIWAVGDVTDRVNLTPVAINEAMAFVRTAFLGQSTAMDYDNIPSAVFSLPPVGTVGLTEAEASKRYGAIDVYLSRFKLMRNILAGREERTMMKLVVDRASDRVLGVHMVGSDAPEIVQGFAVALKCGATKAQFDATVGIHPTAAEELVTMRDKRAD

SEQ ID NO: 37713 - protein, 604 aa, Rubrobacter xylanophilus DSM 9941
MIRRHRLPLGAEYLGDGRTRFSLWAPAASSVELVLEGGSSRMERGEGGVFSLTTGAAPGARYRYRIDGGQEVPDPASRFQPEDVHGPSAVVDPASFEWGDGGWRGRPWHEAVVYELHVGTFSPEGTFRGACERLDHLAGLGVTAVELMPLADFPGSRNWGYDGVLPYAPDSSYGTPEELKELVQAAHGRGIMVLLDVVYNHFGPEGNYLPLYAPRFFTERHATPWGAAVNFDDAGSETVREFFVHNALYWIEEYGFDGLRLDAVHAIRDDSGRHFLAELAERIRGGPGRGRRVHLVLENEENEASLLRPAGEGRSLYDAQWNDDLHHALHVALTGEDAAYYADYADAPVRHLGRCLAEGFAYQGDPSRHRGDRRGEPSADLAPPAFVAFLQNHDQVGNRAFGERITDLASPEAVRAAAAVYLLSPQVPMLFMGEEWGASSPFLFFCDFGGDLAPLVTQGRREEFASFPEFSDPETRGRIPDPNAPGTFGASRLDWGEREAPEHARWLDLYRELLALRRERIVPLLSGAPGGGGRYRLVGERGLEVRWGLGGGARLALRANLGPEPLGGFGLPEGDLLYATEGAEAAGRRLPGWAAVWHLAGAGA

SEQ ID NO: 37714 - protein, 226 aa, Prochlorococcus marinus subsp. marinus str. CCMP1375
MMPMNQEFIQKLRFNEKGLIPAIAQDWLDGAILMMAWMNKESLEKTLITGEVHYWSRSREKLWHKGETSGHFQILKGIRFDCDSDVMLLSIEQVGSIACHTGARSCFFQEVEENIPDLEQNSTFNRPLSNTCSELFEVIKDRSSNPQKNSYTNSLLKDGDNKILKKIGEEGSEFVMACKDNDHESISNEAADLIFHIQVALKYHKVEWRDVLEVLAKRRQSKSNPK

SEQ ID NO: 37715 - protein, 333 aa, Oryza sativa
MPAVAGSLYMASQHKGVPPPLPPPPRPLPVINLGRLTMDSASRALAVRDIVLACRERGCFEVVNHGISRSCMNGALEAASEFFQLSTERKEEFASDDIRQPIRYDTSSRDGISMSRSFLKHYANPLDDWIKFWPTQPPTYREKMGEYAVETQRVSMQLMEAILQGLGLGPSYLQEKLEGGVQFVALTNYPQSSAKKADKIGLAPHSDYGFLTILLQSSPGLEVMHHEDDAWTSVPAIPGALHVHVGDHLEVLSNGQLKSLVHRAVLNPNESRISIASIHGLSMDEEVHCAEELVDEHHPKMYRGSSFQDFLDFLPADMNRYRRYVESLRIDKP

SEQ ID NO: 37716 - protein, 259 aa, Arabidopsis thaliana
MELLSSSPAQLLRPNLSSRALLPPRTSIASSHPPPPRFLVMNSQSQHRPSISCASPPPGDNARIGEVKRETKETNVSVKINLDGHGVSDSSTGIPFLDHMLDQLASHGLFDVHVRATGDTHIDDHHTNEDVALAIGTALLKALGERKGINRFGDFTAPLDEALIHVSLDLSGRPYLGYNLEIPTQRVGTYDTQLVEHFFQSLVNTSGMTLHIRQLAGKNSHHIIEATFKAFARALRQATESDPRRGGTIPSSKGVLSRS

SEQ ID NO: 37717 - protein, 706 aa, Oryza sativa (japonica cultivar-group)
MGGGGGGGFFVLLMLGAVYTLHATALPSPAPHPSGSPDTRILGPRISPAFSPRAMSPESTGGPVHPPSHKHHRRPYHPHSPSPSPLPQAPYLLFMRIAELEVEVAAGTFLKQSQVKIMAAIPSIQDDQKTRVTIYLVPLREQFDGYTASLISDRFWNNKIQINSSIFGDYEVINVTYPGLRSPPPSLPETSHGSDPTGTGEDPITADVHHGKNKKLDSWIIVVVAGSSITLIAACIGLGVLLLKWYKLRQLQEAVSPATTPAVNRRYGGRSTLSVSRVSSASASMLSTVATCTTSVKTFSLSQLEKATDGFDSKRVLGQGGFGRVYHGTMDGGDEIAVKLLTREDRSGDREFIAEVEMLSRLHHRNLVKLIGICIEHNKRCLVYELIRNGSVESHLHGADKAKGMLNWDVRMKIALGAARGLAYLHEDSNPHVIHRDFKGSNILLEEDFTPKVTDFGLAREATNGIQPISTRVMGTFGYVAPEYAMTGHLLVKSDVYSYGVVLLELLSGRKPVCMSDTNGPQNLVTWARPLLCHKEGLERLIDPSLNGNFNFDDVAKVASIASMCVHNDPSQRPFMGEVVQALKLIYNDAEAACDDSYSHRDSSCDQYDDYHGALALDSGSGSWWNRSSNPSGFFDNRNPLPVITMEYSSGRIEGARDPRFALSTGGHAQSPALQNRSGPIRMKKKLASFYRSRGSFSEHGQLPRH

SEQ ID NO: 37718 - protein, 319 aa, Salmonella enterica subsp. enterica serovar Typhi str. CT18
MKAMNKVWVIGDASVDLVPEKQNSYLKCPGGASANVGVCVARLGGECGFIGCLGDDDAGRFLRQVFQDNGVDVSSLRLDAALTSAVLIVNLTADGERSFTYLVHPGADTYVSPQDLPPFRQHEWFYFSSIGLTDSPAREACLEGARRMREAGGYVLFDVNLRSKMWRNTDEIPELIARSAALASICKVSADELCQLSGASHWQDARYYLRDLGCDTTIISLGADGALLITAEGEFHFPAPRVDVVDTTGAGDAFVGGLLFTLSRANCWDHALLAEAISNANACGAMAVTAKGAMTALPFPDQLNTFLSSHSLAQAMTVK

SEQ ID NO: 37719 - protein, 323 aa, Synechocystis sp. PCC 6803
MISTTSLFAPVDQDLRLLTDNLKRLVGARHPILGAAAEHLFEAGGKRVRPAIVLLVSRATLLDQELTARHRRLAEITEMIHTASLVHDDVVDEADLRRNVPTVNSLFDNRVAVLAGDFLFAQSSWYLANLDNLEVVKLLSEVIRDFAEGEILQSINRFDTDTDLETYLEKSYFKTASLIANSAKAAGVLSDAPRDVCDHLYEYGKHLGLAFQIVDDILDFTSPTEVLGKPAGSDLISGNITAPALFAMEKYPLLGKLIEREFAQAGDLEQALELVEQGDGIRRSRELAANQAQLARQHLSVLEMSAPRESLLELVDYVLGRLH

SEQ ID NO: 37720 - protein, 483 aa, Pseudomonas aeruginosa PAO1
MQLKDAKLFRQQAYVDGAWVDADNGQTIKVNNPATGEIIGSVPKMGAAETRRAIEAADKALPAWRALTAKERANKLRRWFDLMIENQDDLARLMTIEQGKPLAEAKGEIAYAASFLEWFGEEAKRIYGDTIPGHQPDKRIIVIKQPIGVTAAITPWNFPSAMITRKAGPALAAGCTMVLKPASQTPYSALALAELAERAGIPKGVFSVVTGSAGEVGGELTSNPIVRKLTFTGSTEIGRQLMAECAQDIKKVSLELGGNAPFIVFDDADLDAAVEGALISKYRNNGQTCVCANRLYVQDGVYDAFVDKLKAAVAKLNIGNGLEAGVTTGPLIDAKAVAKVEEHIADAVSKGAKVVSGGKPHALGGTFFEPTILVDVPKNALVSKDETFGPLAPVFRFKDEAEVIAMSNDTEFGLASYFYARDLARVFRVAEQLEYGMVGINTGLISNEVAPFGGIKASGLGREGSKYGIEDYLEIKYLCLGGI

SEQ ID NO: 37721 - protein, 426 aa, Pseudomonas aeruginosa PAO1
MSKTNESLLKRRQAAVPRGVGQIHPVVAERAENSTVWDVEGREYIDFAGGIAVLNTGHLHPKVIAAVQEQLGKLSHTCFQVLAYEPYIELAEEIAKRVPGDFPKKTLLVTSGSEAVENAVKIARAATGRAGVIAFTGAYHGRTMMTLGLTGKVVPYSAGMGLMPGGIFRALAPCELHGVSEDDSIASIERIFKNDAQPQDIAAIIIEPVQGEGGFYVNSKSFMQRLRALCDQHGILLIADEVQTGAGRTGTFFATEQLGIVPDLTTFAKSVGGGFPISGVAGKAEIMDAIAPGGLGGTYAGSPIACAAALAVLKVFEEEKLLERSQAVGERLKAGLREIQAKHKVIGDVRGLGSMVAIELFEGGDTHKPAAELVSKIVVRAREKGLILLSCGTYYNVIRFLMPVTIPDAQLEKGLAILAECFDELA

SEQ ID NO: 37722 - protein, 450 aa, Streptococcus pyogenes M1 GAS
MVIPYDYIVIGGGSAGIASANRAAMHGAKVLLAEGKEIGGTCVNLGCVPKKVMWYGAQVADILGTYAKDYGFDFKEKAFDFKQLKANRQAYIDRIHASYERGFEQNGVDRIYDYAVFKDAHTVEIAGQLYTAPHILIATGGHPVFPDIEGAQYGISSDGFFALDEVPKRTAVVGAGYIAVELAGVLHALGSKTDLFIRHDRPLRSFDKTIVDVLVDEMAVNGPRLHTHAEVAKVVKNTDESLTLYLKDGQEVEVDQLIWAIGRKPNLEGFSLDKTGVTLNDKGYIETDAYENTSVKGIYAVGDVNGKLALTPVAVAAGRRLSERLFNGKTDEKLDYQNVATVIFSHPVIGSVGLSEEAAVKQYGQEAVKTYQSRFTSMFTAITNHRQPCLMKLVTVGDTEKIVGLHGIGYGVDEMIQGFAVAIKMGATKADFDNTVAIHPTGSEEFVTMR

SEQ ID NO: 37723 - protein, 150 aa, Saccharomyces cerevisiae
MFLPKFNPIRSFSPILRAKTLLRYQNRMYLSTEIRKAIEDAIESAPVVLFMKGTPEFPKCGFSRATIGLLGNQGVDPAKFAAYNVLEDPELREGIKEFSEWPTIPQLYVNKEFIGGCDVITSMARSGELADLLEEAQALVPEEEEETKDR

SEQ ID NO: 37724 - protein, 1511 aa, Saccharomyces cerevisiae
MSSTDEHIEKDISSRSNHDDDYANSVQSYAASEGQVDNEDLAATSQLSRHLSNILSNEEGIERLESMARVISHKTKKEMDSFEINDLDFDLRSLLHYLRSRQLEQGIEPGDSGIAFKNLTAVGVDASAAYGPSVEEMFRNIASIPAHLISKFTKKSDVPLRNIIQNCTGVVESGEMLFVVGRPGAGCSTFLKCLSGETSELVDVQGEFSYDGLDQSEMMSKYKGYVIYCPELDFHFPKITVKETIDFALKCKTPRVRIDKMTRKQYVDNIRDMWCTVFGLRHTYATKVGNDFVRGVSGGERKRVSLVEAQAMNASIYSWDNATRGLDASTALEFAQAIRTATNMVNNSAIVAIYQAGENIYELFDKTTVLYNGRQIYFGPADKAVGYFQRMGWVKPNRMTSAEFLTSVTVDFENRTLDIKPGYEDKVPKSSSEFEEYWLNSEDYQELLRTYDDYQSRHPVNETRDRLDVAKKQRLQQGQRENSQYVVNYWTQVYYCMIRGFQRVKGDSTYTKVYLSSFLIKALIIGSMFHKIDDKSQSTTAGAYSRGGMLFYVLLFASVTSLAEIGNSFSSRPVIVKHKSYSMYHLSAESLQEIITEFPTKFVAIVILCLITYWIPFMKYEAGAFFQYILYLLTVQQCTSFIFKFVATMSKSGVDAHAVGGLWVLMLCVYAGFVLPIGEMHHWIRWLHFINPLTYAFESLVSTEFHHREMLCSALVPSGPGYEGISIANQVCDAAGAVKGNLYVSGDSYILHQYHFAYKHAWRNWGVNIVWTFGYIVFNVILSEYLKPVEGGGDLLLYKRGHMPELGTENADARTASREEMMEALNGPNVDLEKVIAEKDVFTWNHLDYTIPYDGATRKLLSDVFGYVKPGKMTALMGESGAGKTTLLNVLAQRINMGVITGDMLVNAKPLPASFNRSCGYVAQADNHMAELSVRESLRFAAELRQQSSVPLEEKYEYVEKIITLLGMQNYAEALVGKTGRGLNVEQRKKLSIGVELVAKPSLLLFLDEPTSGLDSQSAWSIVQFMRALADSGQSILCTIHQPSATLFEQFDRLLLLKKGGKMVYFGDIGPNSETLLKYFERQSGMKCGVSENPAEYILNCIGAGATASVNSDWHDLWLASPECAAARAEVEELHRTLPGRAVNDDPELATRFAASYMTQIKCVLRRTALQFWRSPVYIRAKFFECVACALFVGLSYVGVNHSVGGAIEAFSSIFMLLLIALAMINQLHVFAYDSRELYEVREAASNTFHWSVLLLCHAAVENFWSTLCQFMCFICYYWPAQFSGRASHAGFFFFFYVLIFPLYFVTYGLWILYMSPDVPSASMINSNLFAAMLLFCGILQPREKMPAFWRRLMYNVSPFTYVVQALVTPLVHNKKVVCNPHEYNIMDPPSGKTCGEFLSTYMDNNTGYLVNPTATENCQYCPYTVQDQVVAKYNVKWDHRWRNFGFMWAYICFNIAAMLICYYVVRVKVWSLKSVLNFKKWFNGPRKERHEKDTNIFQTVPGDENKITKK

SEQ ID NO: 37725 - protein, 451 aa, Bacteroides fragilis NCTC 9343
MSFNIVKNDKKRVIIVGGGFGGLKLANKLKKSGFQVVLVDKNNYHQFPPLIYQVASAGLEPSSISFPFRKIFQKRKDFYFRMAEVRAIFPEKKMIQTSIGKAEYDYLVLAAGTTSNFFGNEHIEEEAMPMKTVSEAMGLRNALLANFERSITCSTERERQELLNVVVVGGGATGVEIAGVLSEMKKFVLPNDYPDMPSSLMHIYLIEAGDRLLAGMSEDSSRHAEQFLREMGVNILLNKRVTDYKDHKVMLEDGTEIATRTFIWVSGVAAITFGNIDGELLGRGRRIKVDEFNRVQGTDTIFAIGDQCIQTTDKNYPNGHPQLAQVAIQQGELLAKNLQRLQKGKPMQPFHYRNLGSMATVGRNRAVAEFSSFKTAGWLAWVMWLVVHLRSILGVRNKANVLLNWVWNYFTYDQSLRMIVYAKKAKEVRDREELEAKTHWGEETQTQQPNG

SEQ ID NO: 37726 - protein, 393 aa, Arabidopsis thaliana
MRYNCFGLLDMCNGSDRLGQREAEEICTNNVRVFSYNSLRSATDSFHPTNRIGGGGYGVVFKGVLRDGTQVAVKSLSAESKQGTREFLTEINLISNIHHPNLVKLIGCCIEGNNRILVYEYLENNSLASVLLGSRSRYVPLDWSKRAAICVGTASGLAFLHEEVEPHVVHRDIKASNILLDSNFSPKIGDFGLAKLFPDNVTHVSTRVAGTVGYLAPEYALLGQLTKKADVYSFGILVLEVISGNSSTRAAFGDEYMVLVEWVWKLREERRLLECVDPELTKFPADEVTRFIKVALFCTQAAAQKRPNMKQVMEMLRRKELNLNEDALTEPGVYRGVNRGRNHRGIGLRVGQGGSSQESSSTQRDKGKSSAVPQGSTSNSNISFQSITELAPR

SEQ ID NO: 37727 - protein, 181 aa, Cryptomeria japonica
MASADVEFRCFVGGLSWSTDDRSLKDAFTAFGEVMDSKVVSDRETGRSRGFGFVTFMDEQSMRDAIEGMNGRDLDGRNITVNRAQARGGGGGGGGGGGGYRGGGGGSGGYGGGGSGGYESRRSGGGGSGGGGYSGGGRERSERGYGGGSRNGGGYGGYSGGGGGGSRYGGGGVSDDGGWRS

SEQ ID NO: 37728 - protein, 442 aa, Sulfitobacter sp. EE-36
MKSHIFGRSTKGALPVATRGDGCYLIDADGRRYLDGSGGAAVSCLGHSNQAVRAALHAQIDQLAFAHTGFFTSDPAERLADRLIENAPAGIDRVYLVSGGSEAVEASIKLARQYFLEIGQPKRHRVIARRQSYHGNTLGALAAGGNAWRRTQFAPLLADTTHISPCYEYRDRQDGETQEAYGLRVANELETEILRLGPDTVMAFLAEPVVGATSGAVPAVPGYLKRIREICDQYGVLLILDEVMCGMGRTGKLFACTEDGVAPDMITIAKGLGAGYQPIGALLTSAAIYDAIAAGTGFFQHGHTYMGHAMAATAANAVLSEILDRDLLSHVTTQGDKLDAALKAQFGDHDNIGDIRGRGLFRGIELVADRSTKAPFDPSRGLAARIKKEAFAAGLICYPMSGTIDGQYGDHVLLAPPFIIEDAQIDELVGKLSTAIDKALAA

SEQ ID NO: 37729 - protein, 523 aa, Arabidopsis thaliana
MDSSYSFALGTSSSILPKLSFRNVENRFYGEKNNNNGLCKRFGSDLGSKKFRNQKFKHGVVYAVATSDNPKKAMTVKTSMFERRKVDPQNVAAIILGGGNGAKLFPLTMRAATPAVPVGGCYRLIDIPMSNCINSCINKIFVLTQFNSASLNRHLARTYFGNGINFGGGFVEVLAATQTPGEAGKKWFQGTADAVRKFLWVFEDAKNRNIENILILSGDHLYRMNYMDFVQSHVDSNADITLSCAPVSESRASNFGLVKIDRGGRVIHFSEKPTGVDLKSMQTDTTMLGLSHQEATDSPYIASMGVYCFKTEALLNLLTRQYPSSNDFGSEVIPAAIRDHDVQGYIFRDYWEDIGTIKTFYEANLALVEERPKFEFYDPETPFYTSPRFLPPTKAEKCRMVDSIISHGCFLRECSVQRSIIGERSRLDYGVELQDTLMLGADYYQTESEIASLLAEGKVPIGIGKDTKIRKCIIDKNAKIGKNVIIMNKGDVQEADRPEEGFYIRSGITVIVEKATIQDGTVI

SEQ ID NO: 37730 - protein, 271 aa, Rubrobacter xylanophilus DSM 9941
MEAGNTKTALVTGSTDGLGRGVARELARRGYAVILHGRSEARCEEAAAELPGGAAGYLVADLSSLGEVRKMAREVLAGRERLDLLVNNAGVISRERRESREGFELTFAVNYLSHFLLTLLLLPLLRRSAPARVVNVASAAQSPIDFEDPMMERSYSPMEAYARSKLAQVMFSFALAGRLSGTGVCVNALHPASLMDTKMVRESFGRPMSSVEEGVRAVVRLAASSELEGVSGRYFEGTREARAHPQAYDPAARERLWELSEGLCGALDAGR

SEQ ID NO: 37731 - protein, 411 aa, Magnetospirillum magnetotacticum MS-1
MMPEAKYLLVGSSHAALEALRAIRLVDPDGSMAMLTRDERLPYSPTILPYVVSGRSGSDKVLLRDPAFFAANNCAYVPNARAVSLDPKAKAVTLESGEVWRYQSLLVASGAAPAIPPVKGLDGVKYHVLRSLADAEGLRAAMGSAKSAVVLGAGLVGLHAAENLAEAGLAVTVVEMQDHVLPGYFDAKASTRIEEAFAKHGVDLKLGHRVTEASAGKLTLSDGTTIAADLLLVATGVRPVTDWLEGSGVLVDKGVVVDEAMRTNLDGVWAAGDVAQATDFATGGKALIGIIPTAVEQGKIAGQGMAGDSYRKDYAGGLPVNTYRFFGRVALSIGRAAATEGVEAVESEAGAYRRVVMEGNRLVGYASVDEPFDVGIMGELIRRRIDLTECKDAFLAHPVETGRRLMSEQWR

SEQ ID NO: 37732 - protein, 195 aa, Rhodobacter sphaeroides 2.4.1
MRKAEISRKTAETDISVTVDLDGTGRYDIRTGVGFFDHMMDQLARHALIDITLRCEGDLHIDDHHTVEDCGIALGQALTRALGDKRGIRRYGSFHLAMDDALVRAALDLSGRPFLVWNLPFPTEKIGSFDTELVREFFQALATHGGITLHVDLIHGVNSHHIAEAAFKAVARSLREAVEPDPRRADAIPSTKGML

SEQ ID NO: 37733 - protein, 433 aa, Burkholderia vietnamiensis G4
MTPSDVKATLSFSDNSPSVEMPIYKGTMGPDVIDIRKLYGQTGKFTYDPGFMSTASCNSAITYIDGDKGELLYRGYPIDNLAQNADFLESCYLLLKGELPNAAQKKEFVDTVTKHTMVHEQMHFFFRGFRRDAHPMAILVAAVGALSAFYHDSLDINDPRHREVSAIRMIAKLPTLVAMAYKYSIGQPFVYPKNSLSYSANFMHMMFSNPCEEYKVNDVLVRALDRILILHADHEQNASTSTVRLAGSSGANPFACIAAGIACLWGPAHGGANEAALNMLEQIGSPDNIPEFIKQVKDKNSGVKLMGFGHRVYKNYDPRAKLMRETCYEVLNELGLHDDPLFKLAMQLEKIALEDEYFVSRKLYPNVDFYSGIVQRALGIPTSMFTCIFAMARTVGWIAQWNEMIADPEQKIGRPRQLFIGDTPREAKPLNAR

SEQ ID NO: 37734 - protein, 573 aa, Pichia anomala
MFKSQLRTATARSSFRSLASKLNPQRFNSSKTPLLNATRGSNRSKNSLIALAISLSAVSSSYYLYQKDKFISADVPHWKDIELTPEIVSQHNKKDDLWVVLNGQVYDLTDFLPNHPGGQKIIIRYAGKDATKIFVPIHPPDTIEKFIPPEKHLGPLVGEFEQEEEELSDEEIDRLERIERKPPLSQMINLHDFETIARQILPPPALAYYCSAADDEVTLRENHNAYHRIFFNPKILIDVKDVDISTEFFGEKTSAPFYISATALAKLGHPEGEVAIAKGAGREDVVQMISTLASCSFDEIADARIPGQQQWYQLYVNADRSITEKAVRHAEERGMKGLFITVDAPSLGRREKDMKMKFEADSDVQGDDEDIDRSQGASRALSSFIDPSLSWKDIAFIKSITKMPIVIKGVQRKEDVLLAAEHGLQGVVLSNHGGRQLDYTRAPVEVLAEVMPILKERGLDQKIDIFVDGGVRRGTDVLKALCLGAKGVGLGRPFLYAMSSYGDKGVTKAIQLLKDEIEMNMRLLGVNKIEELTPELLDTRSIHNRAVPVAKDYLYEQNYQRMSGAEFRPGIED

SEQ ID NO: 37735 - protein, 190 aa, Platanus x acerifolia
PELPLFNFENLAMATNNFHGANKLGKGGFGEVYKGKLANGQEIAVKRLSKNSGQGIEEFLNEVIVISKLQHRNLVRLLGRCVEGVEKMLIYEYMPNKSLDAFLFDPVKATLLGWRKRFNIIEGIARGLLYLHRDSRLRIIHRDLKASNILLDEQLNPKISDFGMARIFGGTQDEADTRRVVGTYGYMSPE

SEQ ID NO: 37736 - protein, 320 aa, Salmonella enterica subsp. enterica serovar Typhi str. CT18
MIKKIGVLTSGGDAPGMNAAIRGVVRAALTEGLEVMGIYDGYLGLYEDRMVQLDRYSVSDMINRGGTFLGSARFPEFRDENIRAVAIENLKKRGIDALVVIGGDGSYMGAKRLTEMGFPCIGLPGTIDNDIKGTDYTIGYFTALGTVVEAIDRLRDTSSSHQRISIVEVMGRYCGDLTLAAAIAGGCEFIVVPEVEFNREDLVAEIKAGIAKGKKHAIVAITEHMCDVDELAHFIEKETGRETRATVLGHIQRGGSPVPYDRILASRMGAYAIDLLLEGHGGRCVGIQNEQLVHHDIIDAIENMKRPFKSDWMECAKKLY

SEQ ID NO: 37737 - protein, 414 aa, Methanococcoides burtonii DSM 6242
MASKTETTMKEDELLEKVVSGEMPLRKIDAYTDTDTAVRVRKCAIEKMNGVKFEHIQNYTIDAEAATKRNIENMIGTIQIPLGVAGAIMVNGEYASGEFMLPLATTEGALVASVNRGCTVITASGGSNVRIFQDLMTRAPVFKLENVNKVKEFVDWVKREETFTNMKEKAGETTRFGELLSVDPFITGNTVFLRFAYDTKDAMGMNMVTIATDAVLNFISEDFGVYPISLSGNMCTDKKPAAINNILGRGKTVAADVTIPKEIVEKKLKTTPKMMEEVNYRKNLLGSARAGALGFNAHAANIIAALYLACGQDAAHVVEGSSAITTMEVNENGDLYCSVTLPSIQVGTVGGGTGIATQRDCLNLLGVAGAGEVPGHNSKKLAEIIAAAVLAGEISLIGAQAAGHLAKAHAELGR

SEQ ID NO: 37738 - protein, 307 aa, Synechococcus sp. WH 7805
MVRPRVLVVAGTHGNEINGPWLLDQWRQYPALIDSEGLNVQLAIGNPAACAKGRRYLDRDLNRSFHPDLHKEASESAAESDREMVQALELLKQFGPKGQTPCDLVVDLHSTTSAMGNCLVVYGRRPVDLALAALVQHRLGLPIYLHEADAAQQGFLAERWPCGLVIEVGPVPQNVRRSDIVLQTRLALEAVLAAITSVRDGSARYPDQVVIHLHLGSLDVPRRSSGDPDALVHPNLQGRDWQPLKAGDPLFIDAESNTVVFDGEDGLVPVFINEAAYAEKAIALSLTKRETWPLPKDWKEALAELLR

SEQ ID NO: 37739 - protein, 141 aa, Burkholderia pseudomallei K96243
MALERTLSIIKPDAVAKNVIGQIYSRFENAGLKIVAARMAHLSRADAEKFYAVHAERPFFKDLVDFMISGPVMIQVLEGEDAILKNRDLMGATDPKKAEKGTIRADFADSIDANAVHGSDAPETARAEVAFFFPEMNVYSR

SEQ ID NO: 37740 - protein, 536 aa, Linum usitatissimum
MASSALNNLVAVNPNTLSPSPKSTPLPNTFSNLRRVSAFRPIKASLFGDSPIKIPGITSQPPPSSDETTLPIRQIPGDYGLPGIGPIQDRLDYFYNQGREEFFKSRLQKYKSTVYRANMPPGPFIASNPRVIVLLDAKSFPVLFDMSKVEKKDLFTGTYMPSTELTGGYRILSYLDPSEPNHTKLKQLLFNLIKNRRDYVIPEFSSSFTDLCEVVEYDLATKGKAAFNDPAEQAAFNFLSRAFFGVKPIDTPLGKDAPSLISKWVLFNLAPILSVGLPKEVEEATLHSVRLPPLLVQNDYHRLYEFFTSAAGSVLDEAEQSGISRDEACHNILFAVCFNSWGGFKILFPSLMKWIGRAGLELHTKLAQEIRSAIQSTGGGKVTMAAMEQMPLMKSVVYETLRIEPPVALQYGKAKKDFILESHEAAYQVKEGEMLFGYQPFATKDPKIFDRPEEFVADRFVGEGVKLMEYVMWSNGPETETPSVANKQCAGKDFVVMAARLFVVELFKRYDSFDIEVGTSSLGASITLTSLKRSTF

SEQ ID NO: 37741 - protein, 310 aa, Oryza sativa (japonica cultivar-group)
MRASSPTHAKAAAALAAAGAVDDERAAWMVRHPSALSKFEQIVAASKGKKIVMFLDYDGTLSPIVDDPDSAFMSDTMRRAVRSVAKHFPTAIVSGRCRDKVFEFVKLAELYYAGSHGMDIKGPAKASRHNKAKAKGVLFQPASEFLPMIEQVHDSLIERTKCIPGAKVENNKFCVSVHFRCVDEKSWSTLADIVKAELKDYPKLKLTQGRMVFEIRPTIKWDKGKALEFLLESLGFADCTNVLPVYIGDDRTDEDAFKVLRKRGQGIGILVSKYPKDTNASYSLQEPAEVMEFLLRLVEWERLSRARPKW

SEQ ID NO: 37742 - protein, 547 aa, Zea mays
MAMASAACSCTDGTWWVYALPALLGSDTLCAHPALLAGLIFLATVSVALLAWATSPGGPAWTNGRGASASLLSWDPVVCPCSAASSRCPGAAAPRPRRDGPRRRPRAKELMAFSVGDTPAVVSSCPATAREVLAHPSFADRPVKRSARELMFARAIGFAPNGEYWRRLRRVASTHLFSPRRVASHEPGRQGDAEAMLRSIAAEQSASGAVALRPHLQAAALNNIMGSVFGTRYDVTSGAGAAEAEHLKSMVREGFELLGAFNWSDHLPWLAHLYDPSNVTRRCAALVPRVQTFVRGVIDEHRRRRQNSAALNDNADFVDVLLSLEGDEKLGDDDMVAILWEMVFRGTDTTALLTEWCMAELVRHPAVQARVRAEVDAAVGAGGCPTDADVARMPYLQAVVKETLRAHPPGPLLSWARLATADVPLCNGMVVPAGTTAMVNMWAITHDAAVWADPDAFAPERFLPSEGGADVDVRGVDLRLAPFGAGRRVCPGKNLGLTTVGLWVARLVHAFQWALPDGAAAVCLDEVLKLSLEMKTPLVAAAIPRTA

SEQ ID NO: 37743 - protein, 482 aa, Escherichia coli K12
MKLNDSNLFRQQALINGEWLDANNGEAIDVTNPANGDKLGSVPKMGADETRAAIDAANRALPAWRALTAKERATILRNWFNLMMEHQDDLARLMTLEQGKPLAEAKGEISYAASFIEWFAEEGKRIYGDTIPGHQADKRLIVIKQPIGVTAAITPWNFPAAMITRKAGPALAAGCTMVLKPASQTPFSALALAELAIRAGVPAGVFNVVTGSAGAVGNELTSNPLVRKLSFTGSTEIGRQLMEQCAKDIKKVSLELGGNAPFIVFDDADLDKAVEGALASKFRNAGQTCVCANRLYVQDGVYDRFAEKLQQAVSKLHIGDGLDNGVTIGPLIDEKAVAKVEEHIADALEKGARVVCGGKAHERGGNFFQPTILVDVPANAKVSKEETFGPLAPLFRFKDEADVIAQANDTEFGLAAYFYARDLSRVFRVGEALEYGIVGINTGIISNEVAPFGGIKASGLGREGSKYGIEDYLEIKYMCIGL

SEQ ID NO: 37744 - protein, 426 aa, Escherichia coli K12
MNSNKELMQRRSQAIPRGVGQIHPIFADRAENCRVWDVEGREYLDFAGGIAVLNTGHLHPKVVAAVEAQLKKLSHTCFQVLAYEPYLELCEIMNQKVPGDFAKKTLLVTTGSEAVENAVKIARAATKRSGTIAFSGAYHGRTHYTLALTGKVNPYSAGMGLMPGHVYRALYPCPLHGISEDDAIASIHRIFKNDAAPEDIAAIVIEPVQGEGGFYASSPAFMQRLRALCDEHGIMLIADEVQSGAGRTGTLFAMEQMGVAPDLTTFAKSIAGGFPLAGVTGRAEVMDAVAPGGLGGTYAGNPIACVAALEVLKVFEQENLLQKANDLGQKLKDGLLAIAEKHPEIGDVRGLGAMIAIELFEDGDHNKPDAKLTAEIVARARDKGLILLSCGPYYNVLRILVPLTIEDAQIRQGLEIISQCFDEAKQ

SEQ ID NO: 37745 - protein, 466 aa, Escherichia coli K12
MGQSSQPHELGGGLKSRHVTMLSIAGVIGASLFVGSSVAIAEAGPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYAEVSGISRLWDSGGFMPNGFGAVLSAMLITMFSFMGAEIVTIAAAESDTPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRMRKILRAEGSEIRLRMWLYPWLTWLVIGFITFVLVVMLFRPAQQLEVISTGLLAIGIICTVPIMARWKKLVLWQKTPVHNTR

SEQ ID NO: 37746 - protein, 388 aa, Burkholderia sacchari
MSETDNTTQAAGAIKPKKSVALSGVCAGNTALCTVGRTGNDLHYRGYDILDLATACEFEEVAYLLVHGKLPNIAELAAYKTKLKALRGLPANVKAALEWVPASAHPMDVMRTGVSVLGTVLPEKDDHNLPGARDIADRLMASLGSMLLYWYHNSHNGKRIEVETDDDSIGGHFLHLLHGREPSKSWVDAMHVSLNLYAEHEFNASTFTGRVIAGTGSDMYSAITGAIGALRGPKHGGANEVAFEIQSRYDTPDQAESDIRRRVEAKAVVIGFGHPVYTISDPRNKVIKEVAKKLSKEQSNLKLFDIAERLESTMWEIKKMFPNLDWFSAVSYHMMGVPTAMFTPLFVISRTAGWSAHIIEQRIDNKIIRPSANYTGPENLKFTLIGKR

SEQ ID NO: 37747 - protein, 419 aa, Streptococcus pyogenes M1 GAS
MKDVIYDVEEVPKAGMLVGLSFQHLFAMFGATVLVPILVGIDPSVALLSSGLGTLAHLSVTKFKIPAYMGSSFAYIAAMQLLMKTNGIGAVAQGAMTGGLVYLIVALIVKAIGNDWIDNILPPIVVGPIVMVIGLSLASTAVNDVMLKNGNYNLTYLVIGLVTLLSVIFFNIYGKGIVAIVPLLLGLLVGYVVALLVGVLTGQEIVDFTNVAQAKWFSIPSVEIPFLTYGVKFYPSAILTMAPIAFVTMTEHFGHIMVLNSLTKRDYFKDPGLEKTLTGDGFAQIIAGFLGAPPVTSYGENIGVMALNKIFSVYVIAGAAVIAALLSFIGKVSALIQSIPTPVIGGISVALFGVIASSGLKILIESKVDMDNKKNLLIASVILVSGIGGLMLQVNGLQISGVAFSTLLGIILYQVLPEK

SEQ ID NO: 37748 - protein, 302 aa, Cryptomeria japonica
MNSLLHLTGRRSMGKEMHRIRKSYKSMNDTVPPLLFRFTLLSVFVLFVLAIWVFSVPVKRTPYQISRQLSESIAADYAKRSDGKDEPKERVEVLSWEPRAFLYHNFLAKDECEYLINIAKPHMVKSMVVDSKTGGSMDSNVRTSSGWFLNRGQDKIIRRIEKRIADFSHIPVEHGEGLHVLHYEVEQKYDAHYDYFSDTINVKNGGQRGATMLMYLSDVEKGGETVFPQSKVNSSSVPWWDELSECGRSGLSVRPKMGDALLFWSVKPDASLDPSSLHGSCPVIQGNKWSATKWMRLNKYSV

SEQ ID NO: 37749 - protein, 382 aa, Mycobacterium smegmatis str. MC2 155
MRAMVYRGPYKIRLEDKPIPAIEHPNDAIVRVTKAAICGSDLHLYHGMMPDTRVGTTFGHEFIGVVEKVGPSVQNLSVGDRVMVPFNIFCGSCYFCARGLYSNCHNVNPNATAVGGIYGYSHTCGGYDGGQAEFVRVPFADVGPSIIPDRLDDEDALLLTDALATGYFGAQLGNIAEGDTVVVFGAGPVGLFAAKSAWLMGAGRVIVIDHLEYRLEKARTFAHAETINFVDCDDIVVKMKRTTDHLGADVAIDAAGAEADGNFLQHVTATKLKLQGGSPIALNWAIDSVRKGGTVSVVGAYGPMFSAVKFGDAFNKGLTLRMNQCPVKREWPRLLSHIKNGYLKPNDIVTHRIPLEHIAEGYHIFSAKLDDCIKPIIVPTAS

SEQ ID NO: 37750 - protein, 336 aa, Streptococcus suis
MVVKVGINGFGRIGRLAFRRIQNVEGVEVTRINDLTDPVMLAHLLKYDTTQGRFDGTVEVKDGGFEVNGKFVKVSAEREPGNIDWATDGVDIVLEATGFFASKEKAEQHIHANGAKKVVVTAPGGNDVKTVVFNTNHDILDGTETVISGASCTTNCLAPMAKALHDAFGVQKGLMTTIHGYTGDQMVLDGPHRGGDLRRARAAAANIVPNSTGAAKAIGLVIPELNGKLDGAAQRVPVPTGSVTELVATLDKKVTAEEVNAAMKAAATESFGYTEDQLVSSDIVGISFGSLFDATQTKVIEVDGEQLVKVVSWYDNEMSYTAQLVRTLEYFAKIAK

SEQ ID NO: 37751 - protein, 430 aa, Pediococcus pentosaceus ATCC 25745
MAKKEEYHNPEAILDIHDKVKFPQLVGLSIQHMFAMFGSTVLVPILVGLNPGIALFSSGVGTLLYILITRAKIPAYMGSSFTFIVPMLALMKTTGYQGIAQGTISVGVVYLIVALLISWMGSDWLDKILPPIVVGPIIMVIGLSLAGTAATDATMRSVGSQSVYDIKYFIIALATLLITIVFNMYLKGFISLIPILLGLIAGYLIALVMGVVDLSTVQQAKWLVAPNFEIPFVNYQMHFNIGAVLSMMPLAFVTMTEHTGHIMVLNTLTHRNFFKDPGLHYTLSGDGVASIVAGFIGGPPVTSYGENIGVLAVTKVHSVYVLMGAAVSAIIFSFVGKLSALIQSIPNPVIGGISFLLFGTIAANGLRILIDNKIDFNQKRNLMIAASILVIGIGNASFNIGNLSFSGLAVATVLGVILNLVLPKQALSEK

SEQ ID NO: 37752 - protein, 336 aa, Streptococcus suis
MVVKVGINGFGRIGRLAFRRIQNVEGVEVTRINDLTDPVMLAHLLKYDTTQGRFDGTVEVKDGGFEVNGKFVKVSAEREPGNIDWATDGVDIVLEATGFFASKEKAEQHIHANGAKKVVVTAPGGNDVKTVVFNTNHDILDGTETVISGASCTTNCLAPMAKALHDAFGVQKGLMTTIHGYTGDQMVLDGPHRGGDLRRARAAAADIVPNSTGAAKAIGLVIPELNGKLDGAAQRVPVPTGSVTELVATLDKKVTAEEVNAAMKAAATESFGYTEDQLVSSDIVGISFGSLFDATQTKVIEVDGEQLVKVVSWYDNEMSYTAQLVRTLEYFAKIAK

SEQ ID NO: 37753 - protein, 426 aa, Helicobacter pylori 26695
MLTIKDIHALEVMDSRGNPTIQASVVLSDNTKASAIVPSGASTGKREALELRDNDKTRFLGKGVLRACENVNSVIKHHLIGLEAINQAFVDERLRALDGTPNYANLGANAVLGVSMALARASAKALNLPLYRYLGGANALTLPVPMLNIINGGTHANNSIDFQEYMIMPLGFESFKEALRASAEVYHTLKKLLDGKNQLTSVGDEGGFAPNFSNNVEPLEVISQAIEKAGYKLGEEIALALDVASSELVDENFNYHLKGENKILDSHELVAYYKELVAKYPIVSIEDGLSEDDWEGWAFLSKELGRQIQLVGDDLFVTNASLLQKGIEKNIANAVLIKPNQIGTISETLETIRLAKHHAYQCVMSHRSGESEDSFIADFAVALNTGEIKTGSTARSERIAKYNRLLEIEHELKGGIYIGKELFKHG

SEQ ID NO: 37754 - protein, 292 aa, Bordetella pertussis Tohama I
MQFQGSLVALVTPMQPDGSLDYDAYRSLIDWHVAEGTDGLVVVGTTGESPSVSMEEHAELIRVAVEHAAGRIPVIAGVGANSTDEAIHLARHAKAVGAQAGLSVVPYYNKPNQEGIYRHFRAVAEAVDLPTVLYNVPGRTVADMSNDTVLRLAEVPGIIGIKEATGDIARGALLLREAPAGFQVFSGDDPTAAALILLGARGNISVTANVAPRLMHELCTAARGGDVPRTRELNARLARLNKALFIEANPIPVKWALAQMGHTALGYRLPMVELSEQYHSLVRTALQEVGLL

SEQ ID NO: 37755 - protein, 381 aa, Saccharomyces cerevisiae
NSARVTLAPLDASKVKITTTQHASKPKPNSELVFGKSFTDHMLTAEWTAEKGWGTPEIKPYQNLSLDPSAVVFHYAFELFEGMKAYRTVDNKITMFRPDMNMKRMNKSAQRICLPTFDPEELITLIGKLIQQDKCLVPEGKGYSLYIRPTLMATTAGLGVSTPDRALLYVICCLWVLITKLDLRRSDWKPLIMPQELAQEAVGDKKLGANVRPRASCQQLQAASRGYQENLWLFGPNNNITEVGTMNAFFVFKDSKTGKKELVTAPLDGTILEGVTRDSILNLAKERLEPSEWTISERYFTIGEVTERSKNGELLEAKGSGTAAIVSPIKEIGWKGEQINIPLLPGEQTGPLAKEVAQWINGIQYGETEHGNWSRVVTDLN

SEQ ID NO: 37756 - protein, 759 aa, Bordetella pertussis Tohama I
MAFPGLKYASSGLLAALRLGRRTGKKGRTPPSPSPGAQEAVDAAASPVASLAPLTEIISTYLDPKEVERVREAYRFADQAHLGQFRASGAPYISHPIAVTEICAGWKLDANALSAALLHDVMEDQGVGKHELAEKFSPEVAELVDGLSKLDRLDFATKAEQQAESFRKMLLAMARDVRVILIKLADRLHNMRTLDAVNPEKRRRIARETLEIYAPIAHRLGLNLLFRELQDLCFAAMYPNRYQVLYRAVLAARGNRREVISKIEDAVRAALPAAGIEAEVTGREKTLYGVYRKMTEQKKSFSEVLDIYGFRVIVHTLPECYLALGTLHQLYRPVPGKFKDYIAIPKVNGYQSLHTTLVGPYGTPVEFQFRTRDMHHIAEEGVASHWLYKDADLTLNELQKRTHQWLQSLLDIQSQTGDSGEFLEHVKVDLFPDAIYVFTPRGKIISLPRGATPVDFAYAIHTDIGNQAVAAKVNGEFVPLRTELSSGDTVEIITSPASRPNAQWLNYVRTGRARSEIRHYLRTVKYEESVAFGERLLEQAMIELHLPVPSTDDPQWDKLARSSGTSSRDEILADIGLGKRLAAVVARRFAPEHDLIATTAAAVDQITSARAAPILIQGSEGQAVQLAPCCGPLPGDPIIAGMRLGHGLVVHTSDCPVALRARAREPERWINVAWDAQTAKHLPTRLDIVTRNERGVLGRLAAEVTAADANIVHVTMHDDAVSTVSLHLTVQVDSRKHLAQVIRAIRHVPQVQKIVRVKG

SEQ ID NO: 37757 - protein, 347 aa, Streptomyces avermitilis MA-4680
MRATTIHAPYDMRVEDVPEPVVRQPTDAVVRVLRACICGSDLWAYRGEAARQPGQRIGHEFLGIVEETGSEVTGVRRGDLVVAPFMWSDGVCDYCREGLTTSCEHGGFWGSVGHDGGQGEAVRVPYADGTLVQLPKDAASDEHLLSALLTLSDVMGTGHHAALGAGARPGATVAVVGDGAVGLCAVLAAKRLGAERIIALGRHEVRTDIARRFGATDVVAERGEAAVEAVRELTRGQGAHCVVEAVGTEQSMRTAVDITRDGGAIGFVGVPHGSGTGLDLGVMFDRNIALRGGVAPVRAYIPELLPDILAGRIDPSPVFDRTVDLEGVPEGYKAMDERTALKVLVTN

SEQ ID NO: 37758 - protein, 428 aa, Lactobacillus johnsonii
MTVYVEKVRALEIFDSRGNPTVEVHAYLSDGTVAKAEVPSGASTGEKEAVELRDGGKRLQGKGVTQAVANVNGPINDALKGLSPYNQAEIDRTMIKLDGTQNKAKLGANAILGTSMAIARAAARSKDEPLYRYLGGCDLEMPQTFHNVINGGKHADNGIDIQEFMITPVAKNSFRDGFEKIVNTYHALKAVIEEAGFETGLGDEGGFAPNLKSSEEALKMLRTAIIKAGYKPGEDIAIAFDAAASSFYNTEDGKYHFEGHIWNGEEMLQYYDKLLKEFPEIISCEDPFDENDWENFEKFTAKFGSTHQVVADDNVCTNPKLVRKAIKDKLCNSILIKLNQIGTITETLETIRLARKNNMTTMVSHRSGETGDTFIADFTVATNAGQLKSGAPARSERVEKYNRLLEIENQIGVENERLNHFPNNVDFD

SEQ ID NO: 37759 - protein, 1058 aa, Streptococcus pyogenes M1 GAS
MPKRKDIQKIMVIGSGPIIIGQAAEFDYAGTQACLALKEEGYKVILVNSNPATIMTDKEIADKVYIEPLTLEFVNRIIRKERPDAILPTLGGQTGLNMAMALSKAGILDDLEIELLGTKLSAIDQAEDRDLFKQLMQELDQPIPESTIVKTVDEAVTFARDIGYPVIVRPAFTLGGTGGGICSSEEELCEITENGLKLSPVTQCLIERSIAGFKEIEYEVMRDSADNALVVCNMENFDPVGIHTGDSIVFAPTQTLSDIENQMLRDASLKIIRALKIEGGCNVQLALDPYSFKYYVIEVNPRVSRSSALASKATGYPIAKLAAKIAVGLTLDEMINPITGTTYAMFEPALDYVVAKIPRFPFDKFEHGERQLGTQMKATGEVMAIGRNLEESLLKACRSLEIGVCHNEMTSLSNISDEELVTKVIKAQDDRLFYLSEAIRRGYSIEELESLTKIDLFFLDKLLHIVEIEQELQMHVDHLESLKKAKRYGFSDQKIAEIWQKDESDIRAMRHSHSLYPVYKMVDTCAAEFDAKTPYFYSTYELENESVQSNKESILVLGSGPIRIGQGVEFDYATVHSVKAIQKAGYEAIIMNSNPETVSTDFSVSDKLYFEPLTFEDVMNVIDLEQPKGVIVQFGGQTAINLAQALSEAGVTILGTQVEDLDRAEDRDLFEKALKELGIPQPQGQTATNEEEALEAAKKIGFPVLVRPSYVLGGRAMEIVENKEDLREYIRTAVKASPEHPILVDSYIFGKECEVDAISDGKSVLIPGIMEHIERAGVHSGDSMAVYPPQQLSKQIQETIAEYTKRLAIGLNCIGMMNVQFVIKNEQVYVIEVNPRASRTVPFLSKVTGIPMAQIATKLILGQTLKDLGYEDGLYPQSPLVHIKAPVFSFTKLAQVDSLLGPEMKSTGEVMGSDTSLEKALYKAFEANNSHLSEFGQIVFTIADDSKAEALSLARRFKAIGYQIMATQGTAAYFAEQGLSACLVGKIGDAANDIPTLVRHGHVQAIVNTVGIKRTADKDGQMIRSSAIEQGVPLFTALDTAKAMLTVLESRCFNIEAI

SEQ ID NO: 37760 - protein, 408 aa, Flaveria pringlei
MESRVLSSGATTISGIPRLTRPAGRTTTTTVVAVASPAKLNTNGGNLVWGRQLRPSLLNLDHSSPVSLVTKPVKRDVLKPCTATASDSAGDAAPVGFFAKYPFLVTGFFFFMWYFLNVIFNILNKKIYNYFPYPYFVSAIHLAVGVVYCLGGWAVGLPKRAPMDSNLLKLLIPVAFCHALGHVTSNVSFAAVAVSFTHTIKSLEPFFNAAASQFILGQSIPITLWLSLAPVVIGVSMASLTELSFNWLGFISAMISNISFTYRSIYSKKAMTDMDSTNLYAYISIISLLFCIPPAIILEGPQLLKHGFSDAIAKVGMTKFISDLFWVGMFYHLYNQLAINTLERVAPLTHAVGNVLKRVFVIGFSIIVFGNKISTQTAIGTSIAIAGVAVYSLIKAKIEEEKRGLKSA

SEQ ID NO: 37761 - protein, 392 aa, Pseudomonas aeruginosa PAO1
MWFNGFLDLSPWQLVAVTLVLTHITIVSVTVYLHRYSAHRALDLHPALQHFFRFWLWLTTGMNTREWTAIHRKHHAKCETVEDPHSPVHKGLFTVLRAGAELYKAEAKNQDTLRIYGKNCPDDWIERNLYSRFPIGGVVLMALIDLALFGALGLTVWAVQMVWIPFWAAGVVNGLGHAVGYRNFECRDAATNLVPWGILIGGEELHNNHHTYPNSAKLSVKKWEFDLGWAWIKLFSFLRLARVARVAPIAHRVEGKHSLDMDTAMAILNNRFQIMAQYRKLVIAPLVKQEVAKADESVRHLFRRAKRLLSRETSLLQDRHHVRIDSMLAHSQALKVIYEKRLALQQIWAKTSANGHDMLAAIKDWVHEAEASGIQSLKEFAAQLKTYSLRPA

SEQ ID NO: 37762 - protein, 407 aa, Flaveria trinervia
MESRVLSSGATAISGVPRLTKPAGRITTTTVAVAFPARLNATGGNVVWGRQLRPSLLNLDHSSPVSLVTKPVKRDVLKPCSATASDSAGDAAPVGFLAKYPFLVTGFFFFMWYFLNVIFNILNKKIYNYFPYPYFVSVIHLAVGVVYCLGSWTVGLPKRAPVDSNILKLLIPVGFCHALGHVTSNVSFAAVAVSFTHTIKALEPFFNAAASQFVLGQSIPISLWLSLAPVVIGVSMASLTELSFNWLGFISAMISNISFTYRSIYSKKAMTDMDSTNLYAYISIIALLFCIPPAVLFEGPQLLKHGFNDAIAKVGMIKFISDLFWVGMFYHLYNQIATNTLERVAPLTHAVGNVLKRVFVIGFSIIVFGNKISTQTAIGTSIAIAGVAIYSLIKARIEEEKRRMKSA

SEQ ID NO: 37763 - protein, 147 aa, Pfiesteria piscicida
MALRRIQKELADLGNDPPANCSAGPTGEDMFSWSATIMGPHDSAYQGGVFFLNIHFPTDYPFKPPKVAFTTKIYHCNVNANGAICLDILKDQWSPALTISKVPLSISSLLTDPNPNDPLVPEIAQVYLKDRKKHDQTAREWVQKYAV

SEQ ID NO: 37764 - protein, 336 aa, Streptococcus suis
MVVKVGITGFERIGRLAFRRIQNVEGVEVTRINDLTDPVMLAHLLKYDTTQGRFDGTVEVKDGGFEVNGKFVKVSAERKPGNIDWATDGVDIVLEATGFFASKEKAEQHIHANGAKKVVITAPGGNDVKTVVFNTNHDILDGTETVISGASCTTNCLAPMAKALHDAFGVQKGLMTTIHGYTGDQMVLDGPHRGGDLRRARAAAANIVPNSTGAAKAIGLVIPELNGKLDGAAQRVPVPTGSVTELVATLDKKVTAEEVNAAMKAAATESFGYTEDQLVSSDIVGISFGSLFDATQTKVIEVDGEQLVKVVSWYDNEMSYTAQLVRTLEYFAKIAK

SEQ ID NO: 37765 - protein, 172 aa, Pediococcus pentosaceus ATCC 25745
MTLDLHDYVASIQDFPEKGVTFRDISPLMENGEAYRQATNAIIKFARDKGVEMIVGPEARGFIVGCPVAYEMGIGFAPARKKGKLPRETVKATYGLEYGKSELYLQKDAIKPGQKVLITDDLLATGGTIAATIELVEKLGGIVVGTAFFIELKDLNGREKIKDYDTLSLMEY

SEQ ID NO: 37766 - protein, 455 aa, Bacteroides fragilis NCTC 9343
MARFEIKMPKLGESITEGTILSWSVQVGDVVNEDDVLFEVNTAKVSAEIPSPVAGKVVEILFKEGDTVPVGTVVAIVDMDGEGSGEASETAGSVETASAPKAAEVSDTASVPKVQAEVAAPKVERWYSPAVLQLAREAKISQEELDSIPGTGYEGRLSKKDIRTYIEMKKGAPAADVSTTVVSTVLANNSGSSPVPSAEVQKKAAAAAPQAQHGQSASAVSSDASVEVKEMDRVRRIIADHMVMSKKVSPHVTNVVEVDVTRLVRWREKTKDAFFRREGVKLTYMPAIAEATAQALAAYPQVNVSVDGYNILYKKHINVGIAVSQDDGNLIVPVVHDADRLNLNGLAVAIDSLAKKARVNKLMPDDIDGGTFTITNFGTFKMLFGTPIINQPQVAILGVGVIEKKPAVVETPEGDVIAIRHKMYLSLSYDHRVVDGSLGGNFLHFIADYLENWKE

SEQ ID NO: 37767 - protein, 122 aa, Magnetospirillum magnetotacticum MS-1
MAYDSNNIFARILRGEIPCKKVHEDDHTLAFHDINPQAPVHILVIPKGAYVSMNDFSARASDAEIAGLVRAVGKVAEMAGVTADGWRMLSNIGENGHQEVPHLHIHIFGGCKLGHMLPRTGA

SEQ ID NO: 37768 - protein, 215 aa, Magnetospirillum magnetotacticum MS-1
MRAAFLILNGADYGGSHAQGCHHAQYHRDSIKVAVDLDGSGKYAVKTGVGFLDHMLEQLSRHSLMDLEVEAKGDLHIDAHHTTEDVGISIGQAVAQALGDRKGIRRYGSAYVPMDEALTRVALDLSNRPYLIWKVAFGGDKLGTMDTELFKEWFQAFAQAAGATLHVESLYGDNDHHIVESCFKALARALREAVEIDPRKADAVPSTKGTLGGSL

SEQ ID NO: 37769 - protein, 325 aa, Rubrobacter xylanophilus DSM 9941
MEEREMPERERLLDFYERMVRCMLWEQKLLRFIDEGKISGFYHAGRGQEGTQVGAVAALGPDDYMMYAHRGCGYMVARGMPMSKLFGDFLANTEGSTRGLGAGIVHIAWPQLGILGQSGTLGGCFPIAAGAALSAKYRGTDQVCLCFFGDGTANRGTFHEAANAASVWKLPVIWLCENNQWAVSVSVREATAVKQIADRAGAYGMPGEVVDGQDVVAVYEAVSRAVERARRGEGPSLIEAMTYRFRGHYEGDPDTYRDREEVERWRKERDPILLLANRLRSEGLASEQDLEQIRARVQREVDEAAEEALGAPMPERERIFEFVTA

SEQ ID NO: 37770 - protein, 163 aa, Platanus x acerifolia
TADAVRQYLWLFEEHNVMEFLVLAGDHLYRMDYERFIQAHRETDADITVATLPMDEKRATAFGLMKIDEEGRIIEFSEKPKGEQLKAMKVDTTILGLDDERAKEMPYIASMGIYVVSKDVMLKLLREKFPGANDFGSEVIPGATSIGMRVQAYLYDGYWEDIG

SEQ ID NO: 37771 - protein, 298 aa, Escherichia coli W3110
MIRVACVGITVMDRIYYVEGLPTESGKYVARNYTEVGGGPAATAAVAAARLGAQVDFIGRVGDDDTGNSLLAELESWGVNTRYTKRYNQAKSSQSAIMVDTKGERIIINYPSPDLLPDAEWLEEIDFSQWDVVLADVRWHDGAKKAFTLARQAGVMTVLDGDITPQDISELVALSDHAAFSEPGLARLTGVKEMASALKQAQTLTNGHVYVTQGSAGCDWLENGGRQHQPAFKVDVVDTTGAGDVFHGALAVALATSGDLAESVRFASGVAALKCTRPGGRAGIPDCDQTRSFLSLFV

SEQ ID NO: 37772 - protein, 256 aa, Pseudomonas syringae pv. tomato str. DC3000
MRLPAEALKDARKIVCFSGAGISAESGILTYLDQMPKLWAPYDPRALETANAFRESPALVWGWYLWRRRQVDRAQPNAAHLVWPQMVNLGYEVSVVTQNVDDLHERAGSTDVIHLHGSLTMPKCFACHRPAELTSDQMEIPDEGALVEPPRCKRCRGKLRPGVVWYGEDLPPGTWKNAVSLVKNCDALISVGTSGVVTPAADLPHIALASGATVIHVNTVDVGAQAANELMLVGRATDVLAKIHESLSTGKNNDNG

SEQ ID NO: 37773 - protein, 482 aa, Pseudomonas fluorescens
MLDVPLLIGGQSRPARDGRTLERRNPVTGAVVSRVAAATLDDADAAVAAAQAAFPAWAALAPNERRSRLLKAAEQLQARSGEFIAAAGETGAMANWYGFNVRLAANMLREAASMTTQINGEVIPSDVPGSFAMALRQPCGVVLGIAPWNAPVILATRAIAMPLACGNTVVLKASELSPAVHRLIGQVLQDAGLGDGVVNVISNAPVDAAAIVERLIANPAVRRVNFTGSTHVGRIVGELAARHLKPALLELGGKAPLLVLDDADLDAAVAAAAFGAYFNQGQICMSTERLIVDAKVADAFVAKLAAKVATLRAGDPSAADSVLGSLVDVSAGTRIKALIDDALSKGARLVVGGQLDGSILQPTLLDGVTESMRLYREESFGPVAVLLRGSGDEELLRLANDSEFGLSAAIFSRDTGRALALAQRVESGICHINGPTVHDEAQMPFGGVKSSGYGSFGGKASIEHFTQLRWVTLQHGPRHYPI

SEQ ID NO: 37774 - protein, 1016 aa, Salmonella enterica subsp. enterica serovar Typhi str. CT18
  misc_feature (196)..(196): Xaa can be any naturally occurring amino acid
MQVSRRQFFKICAGGMAGTTAAALGFAPGVALAETRQYKLLRTRETRNTCTYCSVGCGLLMYSLGDGAKNAKASIFHIEGDPDHPVSRGALCPKGAGLVDFIHSESRLKFPQYRAPGSDKWQQISWEEAFDRIAKLMKEDRDANYQAQNAEGVTVNRWLTTGMLCASASSNETGYLTQKFSRALGMLAVDNQARVXHGPTVASLAPTFGRGAMTNHWVDIKNANLVVVMGGNAAEAHPVGFRWAMEAKIHNGAKLIVIDPRFTRTASVADFYAPIRSGTDIAFLSGVMLYLLTNEKYNREYTEAYTNASLIVREDFGFDDGLFTGYDADKRQYDKTSWHYELDENGFAKRDTTLQHPRCVWNLLKQHVSRYTPDVVENICGTPKADFLKVCEYIAETSAKDKTASFLYALGWTQHSIGAQNIRTMAMIQLLLGNMGMAGGGVNALRGHSNIQGLTDLGLLSQSLPGYLTLPSEKQTDLQTYLAANTPKPLLKDQVNYWGNYPKFFVSMMKAFFGDKATAENSWGFDWLPKWDKGYDVLQYFEMMKQGKVNGYICQGFNPVASFPNKNKVVASLSKLKYLVTIDPLNTETSTFWQNHGESNDVDPSKIQTEVFRLPSTCFAEENGSIVNSGRWLQWHWKGADAPGIAMTDGEILAGIFLRLRKMYSEQGGANPEQVLNMTWNYTKPYEPASEEVAMESNGKALADLIDPATGAVVVKKGQQLSSFAQLRDDGTTSSGCWIFAGSWTPEGNMMARRDNADPSGLGNTLGWAWAWPLNRRILYNRASADPQGNPWDPKRQLLKWEGGKWAGWDIPDYSAAAPGSDVGPFIMQPEGMGRLFAIDKMAEGPFPEHYEPFETPLGTNPLHPNVISNPAARIFKDDADALGKADKFPYVGTTYRLTEHFHYWTKHALLNAIAQPEQFVEIGEKLANKLGIAHGDTVKVSSNRGYIKAKAVVTKRIRTLKADGKDIDTIGIPIHWGYEGVAKKGFIANTLTPFVGDANTQTPEFKSFLVNVEKV

SEQ ID NO: 37775 - protein, 250 aa, Hordeum vulgare subsp. vulgare
MPVSRIAVGSHREVYEVGALKAALAEFISTLIFVFAGQGSGMAFSKLSPDGVATPAGLISAAIAHAFALFVAVSVGANISGGHVNPAVTFGAFVGGNITLFRGLLYWVAQLLGSTAACFLLRFSTGGLPTGTFGLTGIGAWEAVVLEIVMTFGLVYTVYATAVDPKKGSLGTIAPIAIGFIVGANILVGGAFSGASMNPAVSFGPALVSWEWGYQWVYWVGPLIGGGLAGVIYELLFISRTHEQLPTTDY

SEQ ID NO: 37776 - protein, 595 aa, Nocardioides sp. JS614
MSRVLSAVAWPYANGPRHIGHVAGFGVPSDVFSRYMRMAGHDVLMVSGSDEHGTPILIAADEAGLSPQELADRNHRIIAEDLASLGLTYDLYTRTTTRNHHAVVQELFLGVYENGYFVEQTTYGAISPSTGRTLPDRYIEGTCPICGYDGARGDQCDNCGNQLDPHDLIDPRSKINGETPEFIETQHFFLDLPALAEALGEWLDGREATGLWRPNVIRFSQNILKEIRPRAMTRDIDWGIAVPLDGWRENPTKRLYVWFDAVIGYLSASIEWARRLDEPDRWRDWWNDPDALSYYFMGKDNITFHSQIWPAELLAYSGKGAKGGTPRQYGELNLPTEVVSSEFLTMEGRKFSSSKRVVIYVRDLLSRYQPDAFRYFVAAAGPENQDSDFTWSEFVRRTNDELVAGWGNLVNRTANLIAKNFGEIPKAGELTAADQALLDSVASAFGVVGDLIGRHRQKQAIGEAMRAVAEVNKYVSDTEPWKIKDDPDRLGTILHVVAQCVADLNLILSPFLPFAANEVDRALGGSGEIAPMPRLEEVDDLDGGAPYPIITGEYSGFPAWERRPIVPGTPVSKPTPIFTKLDPSIVDEELARLES

SEQ ID NO: 37777 - protein, 678 aa, Bacteroides fragilis NCTC 9343
MKKYDIKTTDEQTLRKWYHLMTLGRALDEKAPAYLLQSLGWSYHAPYAGHDGIQLAIGQVFTLGEDYLFPYYRDMLTVLSAGMTPEELILNGISKATDPGSAGRHMSNHFAKPEWHIENISSATGTHDLHAAGVGRAMVYYGHKGVAITSHGESATSEGFVYEAINGASNERLPVIFVFQDNGYGISVPKKDQTANRKVADNFSGFKNLRIIHCNGKDVFDSMNAMTEAREFAIANRTPVIVHANCVRIGSHSNSDKHTLYRDENELAYVKEADPLMKFRRMLLRYKRLTEEDLQQIEAAAKKELAAANRKALAAPDPIPESIYDFVLPEPYIPQKYKDGLPGPVEGEKSFMVNAINETLKEEFRRNPDTFIWGQDVANKDKGGVFNVTKGMQQEFGDARVFSAPIAEDYIVGTANGMCRFDPKIHVVIEGAEFADYFWPAVEQYVECTHEYWRSNGKFTPNITLRLASGGYIGGGLYHSQNLEGALTTLPGARIVCPSFADDAAGLLRTSMRSKGFTLYLEPKALYNSVEAAAVVPEEFEVPFGKARIRREGTDLTIITYGNTTHFCLDVAERLAREGVGSVEVIDLRSLIPLDKEAIFASVRKTGKVMVVHEDKVFSGFGAEIAAQIAGEMFRYLDAPVQRVGSTFTPVGFNPILERAILPNDEKIYKAAKELLEF

SEQ ID NO: 37778 - protein, 422 aa, Leptospira interrogans serovar Lai str. 56601
MQSIEKLKFLTESQVRSIAGQFGTPVFVYSRERIEKSCEVALAFPNAYGLTVRYAMKANPNRTVLEIMKRKGIQIDASSEYEVLRAIHYGFKPEQIMLTSQELAKGLKELVEKGVVFNACSLRQLETFGNLFPGKEVSVRFNPGLGSGQTKKTDVGGKTSSFGIWYEDINQVKEIASKFDLKIFKVHTHIGSGSDPEVWKVVAQVSLDIAAQFSECKILNLGGGFKVGRMEDEKTTDFQKIGPPVVELFQEFAKKHGTELRLEIEPGSFLMVNNGSILTTVDDVVSTGPGGYTFVKLDAGMDVNTRPSLYAAKHPLVVVSKEGVHSGKTADYVYVGHCCESGDLFTQAEGGGPITRITGEAKLGDYVVMEGAGAYCSSMSTKNYNSFPETAEVLVDSDGSFQLIRRRQNWEQIFQNEVTVSL

SEQ ID NO: 37779 - protein, 452 aa, Pseudomonas aeruginosa PAO1
MTTKLDQLTSWLKERKITEVECLISDLTGIARGKISPTNKFIAEKGMRLPESVLLQTVTGDYVEDDIYYDLLDPADIDMVCRPDENAVFLVPWAIEPTAMVIHDTFDKLGNPIELSPRNILKRVLKMYADKGWRPIVAPEMEFYLTKRSDDPDYPLQAPVGRSGRQETGRQSFSIDAANEFDPLFEDMYDWCEAQGLDLDTLIHEEGTAQMEINFRHGDALDLADQILVFKRTMREAALKHNVAATFMAKPMTGEPGSAMHLHQSIVDVKTGKNIFSNADGTMSELFLHHIGGLQKFIPEVLPLFAPNVNSFRRFLPDTSAPVNVEWGEENRTVGLRVPDSSPENRRVENRLAGADANPYLALAASLLCGYIGMVEGIKPSAQVKGRGYERRNLRLPLTIEAALERMENCKPLEQYLGSKFISGYVAVKRAEHENFKRVISSWEREFLLLSV

SEQ ID NO: 37780 - protein, 456 aa, Pseudomonas aeruginosa PAO1
MNSQITNAKTREWQALSRDHHLPPFTDYKQLNEKGARIITKAEGVYIWDSEGNKILDAMAGLWCVNVGYGREELVQAATRQMRELPFYNLFFQTAHPPVVELAKAIADVAPEGMNHVFFTGSGSEANDTVLRMVRHYWATKGQPQKKVVIGRWNGYHGSTVAGVSLGGMKALHEQGDFPIPGIVHIAQPYWYGEGGDMSPDEFGVWAAEQLEKKILEVGEENVAAFIAEPIQGAGGVIVPPDTYWPKIREILAKYDILFIADEVICGFGRTGEWFGSQYYGNAPDLMPIAKGLTSGYIPMGGVVVRDEIVEVLNQGGEFYHGFTYSGHPVAAAVALENIRILREEKIIEKVKAETAPYLQKRWQELADHPLVGEARGVGMVAALELVKNKKTRERFTDKGVGMLCREHCFRNGLIMRAVGDTMIISPPLVIDPSQIDELITLARKCLDQTAAAVLA

SEQ ID NO: 37781 - protein, 498 aa, Solanum lycopersicum
MAIVTVIGATIGILIALFFVKSFYTLWWWPKMIEKKLKKEGIHGQPYQFLFGNLKEMTRMSREAKKKPLVNHDIVPWVNPFILHLSKTYERLFVMWAGPTPRITVTDPKLIKEVVNRHNEFQKPQANAFIDMFVTGLASYNGQKWDHHRKILNPAFHIEKIKRLYPAFCECCDEMINRWEDLVSKTGSCELDVADEFLNVGGDVISRAAFGSNIEEGRTIFILQKEQCDLILASPFTLFFPLLRFFPTESNRRARYIYKKVLSLIKGIIEKKEDAMRRGVSESDDILGLLLKGGLSTTEIIEECKEFYLAGQDTTTALLSWTLVALSMHPEWQDKARNEVFQVLGKNKPKFEDLNQLKIMNMIFQEVLRLYPALTLMRSTSKDTKLGEMTIPAGVQIFVPIYIAHRDPQVWGDDALIFNPNRFSEGVSKAAKEPLYFPFGWGPRMCIGNNFGMAEAKLVLSQILQRFWFKLSPSYVHAPQAILVMKPQYGAQIILNKL

SEQ ID NO: 37782 - protein, 248 aa, Zea mays
MSVIMLGSKKERNLSMHFQSDQKSSAKFCLFSKVQSASPPPGNTLVYLNVYDLTPVNGYVYWAGLGVFHSGIEVHGVEYAFGAHDYSISGVFEVEPRQCPGFKFRKSICMGTTSLDPLQIREFMEIQSVNYNGDTYHLISKNCNHFCEDICKRLTGNFIPKWVNRLARMGAVCNCILPESLKINAAGHDPASRAEDSERKMLTSSFSCFCSISLCQRHFSTSSPSLRSSANGTSWDTKQSNSTRLKKS

SEQ ID NO: 37783 - protein, 266 aa, Triticum aestivum
  misc_feature (58)..(58): Xaa can be any naturally occurring amino acid
  misc_feature (147)..(147): Xaa can be any naturally occurring amino acid
  misc_feature (160)..(160): Xaa can be any naturally occurring amino acid
  misc_feature (182)..(182): Xaa can be any naturally occurring amino acid
MAQPAKLSREENVYMAKLAEQAERYEEMVEFMEKVAKTVDSEELTVEERNLLSVAYKXNVIGARRASWRIISSIEQKEESRGNEDRVTLIKDYRGKIEVELTKICDGILKLLDSHLVPSSTAPESKVFYLKMKGDYYRYLAEFKSGXTERKDAAENTMVXAYKAAQEIALKELPPTHPIRLXGLALNFSVFYYEILNSPDRACDLAKQAFDEAISELDSLSEESYKDSTLIMQLLRDNLTLWTSDISEDAAEEMKDAPKGESGDGQ

SEQ ID NO: 37784 - protein, 360 aa, Sulfitobacter sp. EE-36
MKKLFTLLGIALLALLAYLAFWPVSVAPVAWEAPPDQGYTGDFAANDRLTALKIVELEGRSGPEDADIGPDGLVHVATHDGEILRIEENGAITVFAQTGGRPLGIEFDDSGTLYVADAYRGLLSVDRGGKVTLLAETTTDGSPILYADDVDIAADGSVYFSDASTRFGAQDNGGTLAASVLDLVEHSSNGRILKYDPTSGETTVFADGLNFANGVAVDDANSAVFVVETGSYRVWRFPMDGSAGTVVLENLPGFPDNINNAPDGTFWVGLVSPRNPVMDQLANSPFLRRVIMRLPDAMKPAPLRYGFVLRMDASGKVLETLQDPAGDYALTTGAVTLPDGRIAVTSLTEPRLGMLDAAPR

SEQ ID NO: 37785 - protein, 448 aa, Oryza sativa (japonica cultivar-group)
METEANGGREAKAMKDHIDLECSQAKKPQPKDLKEIAGSFWLAASVFSKKWQKWRRKQKLKKQDAAGSKAAAAAMPPPEKPSKPSFLRRSRLRGEACSEFAGGRRSCDTDPRFSLDAGRMSVDDVGFSWDEPRASWDGYLFGAGTGIGLGRAPPPLSRLPPILSAMEDSPAGIVERSDGQIPVEDDSQPEPDPDADTPGGSVQTRDYYDTSSSSRRRRSLERTSSVRRPSFEVTDAKPVLPAAAAITSVKDSPLIGSSEFYHFQHAEDLLEHHRFSTSSLIEDFPMSLDAAFPGPDKKPRRWRKAWSLWGLIHRRAAGRRGGASDVADRAFSEPWPELRVRGCNARMQRCNSNASARSSFSSNSGGLGSSRRSYVDGNGNVVKRRREECALERNRSARYSPGHADNGMLRFYLTPMRSASGRRAPGLPAKGGRQLRSQSFARSMLRLY

SEQ ID NO: 37786 - protein, 338 aa, Mucor racemosus
MVTQVGINGFGRIGRIVLRASLSNPEVQVVAINDPFIPLEYMVYMFKYDSVHGRFQGTVEAKDGKLVVNGKEISVFSERDPAQIPWGSVEAAYVVESTGVFTSIDAASAHLQGGAKKVIISAPSGDAPMFVCGVNLEKYTSDLKVISNASCTTNCLAPLAKVINDNFGIVEGLMTTVHATTATQKTVDGPSNKDWRGGRGAGANIIPSSTGAAKAVGKVIPELNGKLTGMAFRVPTPDVSVVDLTVRLEKGATYEEIKAVIKKASENELKGILGYTNDQVVSTDFVGDAQSSIFDAAAGIALNDKFVKLVSWYDNEFGYSNRVIDLLAYAAKVDAAAQ

SEQ ID NO: 37787 - protein, 457 aa, Wolbachia endosymbiont of Drosophila melanogaster
MNEYDITVIGSGPGGYIAAIRAAQLGFKTAIVEKEKNLGGICLNWGCIPTKSLLRASEVYRLIKRSKEFGIEVKGANFDIQSIVKYSRNVVDKLSSGVAYLMKKNNIKVHQGFGKLAGNGTIKVVSDKEEQEIVSKHIILATGVRARNLPGIEADGDLIWNAQHAMTPERLPKSLLIIGSGAIGIEFASFYSTLGVDVTIIEIKSTILPLEDKDISDLAQEIFTKQGIKIYTNSSVKALTKSKDSAQVLLSSGESKEFERVIVAVGIQANIENIGLENTKIKLSPSGFIETNEWYETSESNVYAIGDVAGPPCLAHKASHEAVICIEKIAGKNAHALKKECIPNCTYSHPQIASIGLTEEQAIKGGYDIKIGKFHSNFNGKSVALSETEGLVKTIIDKKTGEILGSHMIGAEVTELISNFALAKQLEGTDFDIKSTIFPHPTISEMIHESVLAADVK

SEQ ID NO: 37788 - protein, 110 aa, Porphyra purpurea
MKKTLSVLFTAFSFCVIGFTQVAFAADLDNGEKVFSANCAACHAGGNNAIMPDKTLKKDVLEANSMNGIDAITYQVTNGKNAMPAFGGRLVDEDIEDAANYVLSQSEKGW

SEQ ID NO: 37789 - protein, 220 aa, Brassica napus
YIVCGEFEKFITSFPMLEELEMGTMKWEDFNVTVSSANLRSLSLHGSGIEGWDDFENPKSFSFDAPNLLFLNYSELVPEDYPVVNMGKLLEAHINLMVTDEQMKRVREPNHDLLEGDDEVLQFSNVVKLVNGTRNVQRLTLTSDTLEVLSQCCDSMPVFNNLKFLNVTSEEGRGWQAMPSILRNCPHLETIIIQGILHYVTDECGDVCPCISREGKGRSL

SEQ ID NO: 37790 - protein, 271 aa, Arabidopsis thaliana
MGNHQADKKFTWVIKNYNSLGSGSVYSDTFKAGRCKWRLLAFPKGNNIYDYFFLYICVPNSESLPSGWRRRAKVSFTMVNQIPGGLSQQREAVYWFDEKDTTHGFESMFLLSEIQSSDKGFLVNGEVKIVAEVDVLEVIGELDVPEEPERIDINGFQVPASQVESMNSLFEKYRGFASKIFPKNQHLRKTFLDVVLSMTEILCKFPEELSSGDLAEAYSALRFVTKAGFKLDWLEKKLKETGKSRLQEIEEDLKDLKVKCADMDALLDFLR

SEQ ID NO: 37791 - protein, 308 aa, Burkholderia pseudomallei K96243
MPATFPDVLALGEAMVEFNQARPGEPNYLQGFGGDTSNFCIAAARQGARAGFVSAVGGDHFGRLLLDLWRGERVDTSYVRVDDGAPTGVYFVSHGEHGHAFDYLRAGSAASRYAIRDLPLDALAAARFVHLSGVSLAISTSACDAAFAAIAHARANGARVSFDTNLRLKLWPLPRARAVMTEALRHTDVCLPSWDDVTALTGLDERDAIVDALLALGPRVVALKLGRKGAYVATPGERRVVPGFVVDALDATGAGDCFGGAFVARLAAGDDPFSAARYANAAAALSTQGIGAVAPIPSRDAVERLLGA

SEQ ID NO: 37792 - protein, 470 aa, Bordetella pertussis Tohama I
MASPKDVLKQIADNEVKFVDFRFTDTLGREHHVSVPTSAVDEDKLESGQAFDGSSIPGWKGIEASDMLLIPDLDTANLDPFREEPTLILSCDVVEPSDLKGYDRDPRSLAKRAEAYLKSSGLGDTAYFGPEPEFFVFDGVTWNTDMSGTFVKIKSEEAPWSSGLEFEGGNMGHRPGPKGGYFPVPPVDSFQDMRSEMCLLLEQMGVPVEVHHHEVAAPGQLEIGTKFSTLVQRADWNQVMKYVIHNVAHVYGKTATFMPKPIVGDNGSGMHVHQSIWKDGQNLFAGNGYAGLSEFALYYIGGIIKHARALNAITNPGTNSYKRLVPHFEAPVKLAYSARNRSASIRIPYVGNPKARRIETRFPDPLANPYLAFSALMMAGLDGVQNKIHPGDPADKNLYDLPPEEDAKIPTVCASLEEALAALDKDREFLTRGGVFSNDMLDAYIELKMGEVTRLRMTTHPVEFDMYYSL

SEQ ID NO: 37793 - protein, 470 aa, Triticum aestivum
  misc_feature (231)..(231): Xaa can be any naturally occurring amino acid
MARTGLADATAPEADAMPAASKDAADVRMISTKELQAHAAADDLWISISGDVYDVTPWLRHHPGGEVPLITLAGQDATDAFMAYHPPSVRPLLRRFFVGRLSDYTVPPASADFRRLLAQLSSAGLFERVGHTPKFLLVAMSVLFCIALYCVLACSSTGAHMFAGGLIGFIWIQSGWIGHDSGHHQITRHPALNRLLQVVSGNCLTGLGIAWWKFNHNTHHISCNSLDHDPXDLQHLPLFAVSTKLFNNLWSVCYERTLAFDAISKFFVSYQHWTFYPVMGFARINLLVQSIVFLITQKKVRQRWLEIAGVAAFWVWYPLLVSCLPNWWERVAFVLASFVITGIQHVQFCLNHFSSAVYVGPPKGNDWFERQTAGTLDIKCSPWMDWFHGGLQFQVEHHLFPRLPRCHYRMVAPIVRDLCKKHGLSYGAATFWEANVMTWKTLRAAALQAREATTGAAPKNLVWEALNTHG

SEQ ID NO: 37794 - protein, 547 aa, Acinetobacter sp. ADP1
MYLYTDFDQQLINERVAQFRDQTERYLAGKLTEDEYRPLRLQNGLYVQRYAPMLRIAVPYGLMNSKQLRKIAEISKEYDRGYAHVSTRQNIQLNWPALEDVPDILAELATVQMHAIQTSGNCIRNTTTDQYAGVVAGEIADPRPTCELIRQWSTFHPEFAFLPRKFKIAVSALEEKDRAATSFHDIGVYIVKNDAGEMGYKIKVGGGLGRTPIIGSVIREFLPREDLIAYLDAVLRVYNLHGRRDNKYKARIKILVKALTPAVFAEKVEAEFAQIRESLKIQPEVLNKLDQVFTPFSYQALNDEDFSAVFAEHPKFKQWYNINTNAHKVKGYRIVNISLKRAGVAPGDMTTEEMNLIADLADQYTFGELRTTHEQNISLVDVPQKDLFALWQTLEQHNMARAHIGFLTDIICCPGGDFCSLANAKSIPISEAITRRFEDLDTIYNLGELDLNISGCMNACGHHHVGNIGILGVDKKGAEFYQITLGGNADHDASIGDILGPSFAADAVPDVVEEILNTYLDLRQDQERFIDTYRRVGIQPFKERAYA

SEQ ID NO: 37795 - protein, 792 aa, Xanthomonas campestris pv. campestris str. ATCC 33913
MNENILWLHELRLVDLARVGGKNSSLGEMIGNLAGLGVSVPGGYATTAEAFKDFIAHNDLSKRIFDKLETLDVEDVTALTVAGKEIRGWVIDAPLQPELDRDIRSAYEKLCAENGGGEVAVAVRSSATAEDLPDASFAGQQETFLNVTGADDVVHKVKEVFASLYNDRAIAYRVHHGFKHEDVFLSAGVQLMVRSGVGSSGVLFTLDTESGFRDVVFVTSSFGLGEMVVQGAVNPDEFYVYKPTLTAGKPAILRRSLGSKAIRMVYSDVPGERVRIEDTPVELRNTFSISDEDVQELSKQALVIEKHYGRPMDIEWAKDGVSGKLFIVQARPETVKSRSHATQIERFSLEAKDAKILVEGRAVGAKIGSGVARVVRSLEDMNRVQAGDVLIADMTDPDWEPVMKRASAIVTNRGGRTCHAAIIARELGVPAVVGSGNATDVISDGQEVTVSCAEGDTGFIYEGLLPFERTTTDLGNMPPAPLKIMMNVANPERAFDFGQLPNAGIGLARLEMIIAAHIGIHPNALLEYDKQDADVRKKIDAKIAGYGDPVSFYINRLAEGIATLTASVAPNTVIVRLSDFKSNEYANLIGGSRYEPHEENPMIGFRGASRYVDPSFTKAFSLECKAVLKVRNEMGLDNLWVMIPFVRTLEEGRKVIEVLEQNGLKQGENGLKIIMMCELPSNALLADEFLEIFDGFSIGSNDLTQLTLGLDRDSSIVAHLFDERNPAVKKLLSMAIKSARAKGKYVGICGQGPSDHPELAEWLMQEGIESVSLNPDTVVDTWLRLAKLKSEG

SEQ ID NO: 37796 - protein, 345 aa, Carboxydothermus hydrogenoformans Z-2901
MKAAVLMEPKKIIFKEVPVPELEKGKVLIKVEAVGICGSDMHLYLDGHIGATVLDKPLVLGHEIVGTVIEVGEGVNRELLGQRVIVDPGENCGQCEHCRTGAYNLCSFSKFKGIPPVDGGMAEYITALATHVIPLPENLDSPTATLLEPFSVGLQAVDVADFRAGAKIAVLGGGPVGVLTAIAAKIRGCGDLWLTELYERRIEIARKLGIEKVINVAQEDPLKTIMEVTKKSGVDVVFETTGNPKAVEQALQIVKRGGTVVFLGIGAGKVPINIDQVTRTGLKLLGSFRYQYHFAGAVALVKKHNLDFSPLVTNIYDFVDIPKALEEVSTYKDRIMKGVIVFPQK

SEQ ID NO: 37797 - protein, 385 aa, Sulfitobacter sp. EE-36
MAEFDIIIYGATGFTGRLVAEYIHATYPDRPWAMAGRSASKLGQVRDEMGLPADTPLIEADASDPASLDAMVARARVVITTVGPYLLYGEPLVAACVKAGTDYVDLSGEPPFMWDMIEKYNDAAKASWARIVHSCGFDSIPFDMGVYFLQQEAQKRFGAPLKDVKGRVRGMKGTFSGGTAASGKETMKLAMGNPDVMKRLVSSFALTPGFEGPTQPYGNKPYEDPDFGIWVAPFVMASINTKNVHRSNMLMGHPYGTDFTYEEMMFTGKGEKGEAIAKSIAKSNPMGDDDIKPGEGPSKEERDNGSYDLMFTGTSADGERLTVGVKGDRDPGYGSTSKMLTEAALCLIEEAADTPGGVLTAAPAFGGAIIDRLTANAGLTFQVES

SEQ ID NO: 37798 - protein, 170 aa, Carboxydothermus hydrogenoformans Z-2901
MDLKKYIYDIPDFPSPGIIFRDITPLLQNPETFRRTVELLAEKVVDLRPTHVVAIESRGFMFGAPLAYKLGLGFVPVRKEGKLPRESISVSYDLEYGNNTLEIHTDALKPGDRVVIVDDVLATGGTMKATVELCERLGAKVEALLFVIELLALEGRKKLTGKKVISLVQY

SEQ ID NO: 37799 - protein, 774 aa, Arabidopsis thaliana
MVKTGYVWSSLGLLNNEYALTDADIVHRKIELDLLKCIDFPEFTGSVVKALKREEKNSETIPFDLVIEILTRLPVKSIARFRCLSKLCASTLNNSDFTESFFTISSSRPKLLFTCPKDGETFFFSSPKPRDSSPLASYENLKGRTISKPLICNPSTGESWPLPRVKTNRTIITSYFGYDPINKEFKVLCMTKSKFGVFGEHQVLTFGTGKELSWRKIKCDMAHYPDVVDYEASGYPRPLYDGICINGVLYYLGRVHDDLDGFPDIVCFDIKFEKFSYIKKANGMKRNSGVNLQPTLVNHKGKIAKLQANIGPGSIRYTGIQLWVLEDAEKHQWSSYIYVLPPPWKNIIEETKLRFVGTSDTGDIVLSPCNISNSFYLLYYNPERNAITRVEIQGVEAFKSHKSYAFLDYAENIVKPKPTRLFFVVSVHGSDTTGTESISGILVNGKVNSPIPGGGARSFTFKELAAATRNFREVNLLGEGGFGRVYKGRLDSGQVVAIKQLNPDGLQGNREFIVEVLMLSLLHHPNLVTLIGYCTSGDQRLLVYEYMPMGSLEDHLFDLESNQEPLSWNTRMKIAVGAARGIEYLHCTANPPVIYRDLKSANILLDKEFSPKLSDFGLAKLGPVGDRTHVSTRVMGTYGYCAPEYAMSGKLTVKSDIYCFGVVLLELITGRKAIDLGQKQGEQNLVTWSRPYLKDQKKFGHLVDPSLRGKYPRRCLNYAIAIIAMCLNEEAHYRPFIGDIVVALEYLAAQSRSHEARNVSSPSPEISRTPRRDL

SEQ ID NO: 37800 - protein, 175 aa, Oryza sativa (japonica cultivar-group)
MAPTVMASSATSVAPFQGLKSTAGLPVSRRSTNSGFGNVSNGGRIKCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 37801 - protein, 337 aa, Mucor racemosus
MVVQVGINGFGRIGRIVLRATESNKDVQVVAINDPFIPLDYMVYMLKYDTVHGRFDGSVEAKDGKLVVNGHAIAVSAERDPTSIPWGSAGADYVVESTGVFTTTEAASAHLKGGAKKVIISAPSADAPMFVCGVNLEAYKSEYKVISNASCTTNCLAPLAKVINDNFGIADGLMTTVHATTATQKTVDGPSHKDWRGGRAAAANIIPSSTGAAKAVGKVIPALNGKLTGMAFRVPTPDVSVVDLTVNLSKGASYDEIKQAIKKASETTMKGVLGYTSDAVVSSDFVGEVCSSVFDAAAGIQLTPTFVKLIAWYDNEYGYSNRVVDLLVHAAKVDGAL

SEQ ID NO: 37802 - protein, 488 aa, Oryza sativa (japonica cultivar-group)
MGENVVGTYYYPPSAAAMDGVELGHAAAGSKLFDDDGRPRRNGTMWTASAHIITAVIGSGVLSLGWAIAQLGWVAGPAVMVLFSLVTYYTSSLLSDCYRSGDPVTGKRNYTYMDAVNANLSGFKVKICGFLQYANIVGVAIGYTIAASISMLAIGRANCFHRKGHGDPCNVSSVPYMIVFGVAEVFFSQIPDFDQISWLSMLAAVMSFTYSVIGLSLGIVQVVANGGLKGSLTGISIGVVTPMDKVWRSLQAFGDIAFAYSYSLILIEIQDTIRAPPPSESAVMKRATVVSVAVTTVFYMLCGSMGYAAFGDDAPGNLLTGFGFYEPFWLLDIANAAIVVHLVGAYQVFCQPLFAFVEKWAAQRWPESPYITGEVELRLSPSSRRCRVNLFRSTWRTAFVVATTVVSMLLPFFNDVVGFLGALGFWPLTVYFPVEMYVVQKKVPRWSTRWVCLQMLSVGCLVISIAAAAGSIAGVMSDLKVYRPFKGY

SEQ ID NO: 37803 - protein, 282 aa, Mycobacterium smegmatis str. MC2 155
MSGADNRRPPINKDTKVCISLAARPSNHGTRFHNYLYDKLGLDFLYKAFSTTDIAAAIGGVRALGIRGCSVSMPFKQDVMALVDEIEPSARAIDAVNTIVNDLSVPGGYLVASNTDYIAVQALIEQHGLAEDDPVLIRGSGGMANAVAAAFRDNGFRRGTIVARNRDTGAALASRLGYEYTPEVAERTAAILVNVTPIGMAGGPEAQLSAFEPGTVEAAAVVFDVVAMPAETPLIVAARSAGKPVITGAEVIALQAAEQFERYTGVRPTAEQIAEASAFSRA

SEQ ID NO: 37804 - protein, 404 aa, Solibacter usitatus Ellin6076
MKAVVYKGKNKVAVEEVSNPKIEAPGDVIVKITTAAICGSDLHMYEQRSNAEPGTVFGHENQGVVEEVGNGVVSIKRGDRVVLPFNIACGFCFNCARGYTNACLTANPEAPTAGYGYAGMGPYRGGQAEFLRVPFADFNCLKLPGQPGDQFEDDFVLLADIFPTGWHAAELANVKGGDSVAVFGAGPVGLLSAYSAFIKGASEVYVVDRAPDRLARAKSIGAIAVDFTQGDPVEQIKELRSKNRAHSQALRPGEEKMAGVNCAIDAVGYQARSQSDPDREDPMQTIRQITDIVNPTGSVGLIGVYFDEDPGGVDKHAKKGEFLFPLGKLWSKGITIGQGQAPVKKYNVYLRDLIIAGKAKPSFIVSHRLPLARAEEAYAHFDHRGVGSGKDWTKVLLKPEMKAA

SEQ ID NO: 37805 - protein, 293 aa, Hordeum vulgare subsp. spontaneum
MSPTLSLKLKKSSHTPQSSVSSSTKLRLFKKEAACQSPSTLPVAMDMGLEVSSSSPSSSSVSSSPEHAARRASPAKRPAGRTKFCETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLAIAVAKEASSGAPSLSPSSGSDSAGSTGTSEPSANGVFEGPVVMDSEMFRLDLFPEMDLGSYYMSLAEALLMDPPPTATIIHAYEDNGDGGADVRLWSYSVDM

SEQ ID NO: 37806 - protein, 225 aa, Brassica napus
KKIWLVDSKGLIVNSRKESLQAFKKPWAHEHEPVNDLLGAIKAIKPNVLIGSAGIGRSFTKEVIEAMSSINERPLIMALSNPTTQSECTAEEAYTWSKGRAIFASGSPFDPVEYEGSVFVSTQANNAYIFPGFGLGLVISGAVRVHDDMLLAAAEALAGQVSKENYEKGMIYPSFSSIRKISAHIAANVATKAYELGLAGRLPRPKEIVKCAESSMYSPTYRIYR

SEQ ID NO: 37807 - protein, 452 aa, Dactylis glomerata
MAQEEKEKPDESTSSRRPQAKETKPNPAPEPEPEMATVAMDISKPPPAAAGDDSAKGARAGGEGLRQYYLQHIHDLQLQIRTKTHNLNRLEAQRNDLNSKVRALREELQLLQEPGSYVGEVVKVMGKSKVLVKVHPEGKYVVDIDKSIDITKITPSTRVALRNDSYMLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEDSRGDILKIHSTTMNLMRGIDLKKIAGKMNGASGAELKAVCTEAGMFALRERRVHVTQEDFEMAVAKVMKKDNEKNMSLRKLWK

SEQ ID NO: 37808 - protein, 779 aa, Frankia sp. CcI3
MSSIQALQAEGSGIDLSGRALGLVAGVAIVAALALLVAGYLVREVLAASPGTPRMVEVGRAVQEGAAAYLRRQFTTLAGFVVVIPFVLLLLPAENTGAKIGRSIFFVVGAIFSALVGFVGMSLATRANTRTAAAAMTRGERAAVRIAFRTGGVVGMFTVGLGLLGAAAVVLVFRDTAPQVLEGFGFGAALLAMFMRVGGGIFTKAADVGADLVGKVEQGIPEDDPRNAATIADNVGDNVGDCAGMAADLFESYAVTLVAALILGVEAFGERGLVFPLLIPAVGVVTAVIGIFAVSPRAGDRTGMSAINRGFFISAVVSAIGVVAVSLLYLPTSFADFPGMQGSTQSGNPRVIAIGAVLIGIVLAAAIQLLTGYFTETGRRPVRDIAKASLTGPATNILAGIGVGLESAVYSSLLIGAAIFGAYLLGSGSVTIALFAVALAGTGLLTTVGVIVSMDTFGPVSDNAQGIAEMSGDMDEAGAAILTSLDAVGNTTKAITKGIAIATAVLAASALFGSFTDTVTTALRDAGALPEAGRGIVGGLNIAYPDALVGLTIGASVVFLFSGLAINAVGRAAGRVVLEVRNQFRSRPGIMTGDEKPDYSAVVDICTRDSLRELITPGTLAVLAPIAVGFGLGYPPLGAFLGGAIAGGVLMAVFLANSGGAWDNAKKMVEDGHHGGKGSEVHAATVIGDTVGDPFKDTAGPSINPLLKVMNLVSLLIAPTVVKYSVGADENTGLRIGVALAALAAIAAVIIISRRRSSMINDVPDMTQPTPAPSEKINA

SEQ ID NO: 37809 - protein, 282 aa, Atropa belladonna
  misc_feature (15)..(15): Xaa can be any naturally occurring amino acid
  misc_feature (24)..(24): Xaa can be any naturally occurring amino acid
EVMVGLPNSDVKHIXSGMEHAKWXVQKNVKDFWPDVKIKYIAVGNEISPVTGTSYLTSFLIPAMVNIYRAVGEAGLGNDIKVSTSVDMTLIGNSYPPSQGSFRNDARWFTDPIVGFLRDTRAPLLANIYPYFSYSGNPGQISLPYALFTAPNVVVQDGSRQYRNLFDAMLDSVYAAMHRSGGGSVGIVVSESGWPSAGAFGATTDNAATYLRNLIQHAKKGTPRKPGPIETYIFAMLDENNKNPEVGETFWIVFHPTSSPNTNSSWRISAETSVTASLKSDM

SEQ ID NO: 37810 - protein, 134 aa, Vibrio vulnificus
MRSTGLADTVLVGPEPEFFLFDDVKFATDMSGSFFKIDDVEAAWNTGSDYENGNKGHRPGVKGGYFPVAPVDSSQDLGSAMCLVMEEMGLVVEAHHHEVATAGQNEIATRFNTLTTKADEIQIYKYVVHNVAHA

SEQ ID NO: 37811 - protein, 478 aa, Burkholderia pseudomallei K96243
MKTCEQFYIGGAWRPSTGKGMIDVIDSGTEAVIGRVPEGTAEDAKAAVAAARAAFDGWAATPPAERARYLHKITENLKARSEELAQSITGEVGMPIKLSRAIQVGGPIYNWGAYAKLAETFAFEEQVGNSLVVREPVGVVAAITPWNYPLNQITLKVAAALAAGCTVALKPSEVAPLNAFILAEAIHDAGLPAGVFNLVCGYGPVVGEALASDADVDMVSFTGSTRAGKRVAELAAAGVKRVALELGGKSASVILDDADFAAAVKGTVSACYLNAGQTCSAHTRMLVPESRYEEARDLAKAAAQAYVAGDPRDDATRLGALASSVQQKRVQDYIRRGIDEGAELVTGGLGMPEGITRGFFVKPTVFGRVKPDATIAQEEIFGPVLSILTYRDEDDAVRIANDSPYGLGGAVWAGSDERAMRVARRIRTGQVDINGGAWNMAAPFGGFKQSGIGRENGVYGLDEYLEYKSMQLRPHKRA

SEQ ID NO: 37812 - protein, 444 aa, Xanthomonas campestris pv. campestris str. ATCC 33913
MSSEIVPIAEPIRPADGGLGAAHASVAVPKGGHWWFRLLAFLGPGYMVSVGYMDPGNWATDLAGGSQFGYLLLSVILLSNLMAIVLQGLSARLGIATGLDLAQACRARYPRGINLALWGLCELAIIACDLAEVIGTAIALKLLFGIPLTLGAIITALDVVLVLLLMNRGFRALEAFVMALLLVIFVCFGIQIALAAPPIAAVLAGFIPRAEVVTNPHALYLAIGIIGATVMPHNLYLHSSIVQTRAYPRTDAGRRSALRWAVTDSTVALMFALFINAAILILAAAVFHAQGRTDVQEIEQAHALLAPMLGVGLASTLFAVALLASGVNSTVTATLAGQIVMEGFLRLRLPPWMRRLLTRGIAIVPVVVVTWLYGEAGTARLLVLSQVVLSMQLPFAVIPLVRFVADRGLMGALVAPAWLVRLAWVIALVIVGLNLKLLWEFALG

SEQ ID NO: 37813 - protein, 435 aa, Burkholderia pseudomallei K96243
MNSRPLAARSPSSRRPSASGGPGGGRRWAAFVGAGVLVAVGYMDPGNWATALAGGAGYGYALLGVVIAASLMAMLLQWLAARIGVVSGRDLAQLCRERFDPRATVLLWIAAEIAIVACDVAEVVGAAVALQMLLGVSLSTGVLVSAVGTLAMLALERHGRRTLEAAIASLIFFVGLCFVIEVALARPDWHAALAGAAPSPRLLREPGMLWLAAGILGATVMPHNLYLHSMLVKHHASARDEPSIRRALFGVNLDTFVSLGFAFVINAALLIVAAAVFHASGHDDVTDLADAHRLIAPLVGNRWAGPLFAAALLACGLSATVTGTLAGQAIMEGFLKLTLPRWQRALLTRALAIGPALAAVGLFGQHGSNQLLVASQVVLSLQLPLAMVPLVVFASSRALMGRWRVRGLPLAAAWMCAAAIVALNGALVWQVVAAG

SEQ ID NO: 37814 - protein, 128 aa, Bordetella pertussis Tohama I
MSKQIIHTDAAPAAVGPYSQAVAATGAKTVYLSGQIGLEPGTGDLVSENFDAQVRQAFANMQAVIKEAGGTLDDIVKLTLFLTDLNKFAAANAIMAELIPQPFPARSTVGVASLPKGAQFEMEAVLVL

SEQ ID NO: 37815 - protein, 893 aa, Magnetospirillum magnetotacticum MS-1
MIRFVLDGAEVEAKEGETIWQVSKRLGTTIPHLCHTDRPGFEPEGNCRACVVEIKGERVLVASCRRLPTPGMVVESRGERVEKSRRLVFELLLADHVSPDLDSAFLGWAKAVGVEQSRFAPRTASCAPDTSHPAMAVRLDACIHCALCLRACRDVQVNDVIGMSGRGAHSRISFDFADPMGASSCVGCGECVQACPTGALALAGGPVRAERMVDSLCPYCGVGCQLTYHVTGDAIIAATGRDGQANHERLCVKGRFGFDYSRHPQRLTVPLIRKDGVPKEPLDPADPFTHFRPASWEEALDRAAQGFKRLPKSALAGLGSAKGSNEEAYLFQKLVRTGFGTNNVDHCTRLCHASSVAALLEGIGSGAVTAPVAEVANADLIILIGANPSANHPVAASFIKNAVKRGAQLVILDPRGQALTRFASHHLKFKNGTDVALLNAMLHTIVAEEIYDRDFVAARTTGFAQLAEHLKSYSPEAMAPLCGIDAGTIRMVARAYARAGSAMILWGMGVSQHSHGTDNSRALIALALLCGQLGKKGSGLHPLRGQNNVQGASDAGLIPMMLPDYGRVGIEAARSRFEAGWSVDLDPNPGLTVVEMMDAAAAGTLRGMYIEGENPAMSDPDLAHAREALAGLDHLVVQDIFLTETAMLADVVLPASSFFEKTGSFTNTDRHIQMGRQVIDPPGEARPDLWIITEMAKRLGLDWTYTGPDEVFDEMCGLMGSLSGITWKRLDAEGGITTPGGKAILFGESFPTEDGKARLVPAKGLSAAENPDSDYPFVLSTGRVLEHWHTGSMTRRSGVLDRLQGLPAVNVSPADMERLGLTEGARVRLESRRGSVEAAVAADSRLSPGALFLPFCFTEAAANWLTNPVLDPVGKIPELKVSAVRLVPLRHPG

SEQ ID NO: 37816 - protein, 342 aa, Thermosynechococcus elongatus BP-1
MVQERSLPSLSIPQTAITREQGLMLYEDMVLGRTFEDKCAEMYYRGRMFGFVHLYNGQEAVSTGVIKAMRPDDYVCSTYRDHVHALSAGIPAREVMAELFGKATGCSKGRGGSMHLFSAKHNFLGGFAFVAEGIPVATGAAFQTLYRRQVMGDAKADQVTACFFGDGASNNGQFFECLNMAALWKLPILFVVENNKWAIGMAHERASSETEIYKKAKVFGMVGEEVDGMDVLAVRTVAEAAIARARAGEGPTLIEALTYRFRGHSLADPDELRSKEEKEFWLKRDPIKKLGAYLVEQELATGEDLRAIEQKVQAIVEDAVTFAEQSPEPKPEELYDYIFADE

SEQ ID NO: 37817 - protein, 118 aa, Brassica napus
MQDQLVCHGCRNTLMYPRGATNVRCALCHIVNMVPLHPHPPPPHHAHAGMDMAHIVCGGCRTMLMYTRGASSVRCSCCQTVNLVPGPPPSNQVAHINCGNCRTTLMYPYGASSVKCAV

SEQ ID NO: 37818 - protein, 392 aa, Deinococcus radiodurans R1
MTEVTSVRPSSIKNAAVNLPYGGGKGGIRIDPRKYSQGELERVTRRYTTEIGLIIGPEKDIPAPDVNTGPQTMAWMMDTYSMNVGRTATGVVTGKPVSLGGSLGRADATGRGVFVTGAEAMKKLGMPLEGARIAVQGFGNVGEAAARIFHQHGAKIVAIQDVTGTIHSAAGIDPGKALAHLRQTGKITGLEGSEEMQKDDFWSVDCDVLIPAALEKQITLQNADKIRARLVVEGANGPTIPAADDLLAQKGVTVVPDVLANAGGVSVSYFEWVQDFSSFFWTEDEINERLDRIMREAFQSLWDVKEQHGVTLRTAVYIVACTRVLEARACAGCIRKSTREKGRFLDGAALFVGCWGAFRTFDRKRHPPPLFARPSPIKVKGQRQNRSFCQML

SEQ ID NO: 37819 - protein, 563 aa, Zea mays
GQAAAPPPPFFAQPTPTPSVSATMDTAVSQNATVAAAAGAGSGGGLAGLLPEVQTLEVLVAVSIFVAIHSLRQRRTQGLPTWPVVGMLPSLLLGIRGDMYEWITGVLKARGGTFTFRGPWFTNLQCVVTADPRNLEHLLKTRFGSFPKGPYFRDTVRDLLGDGIFGADDEAWRRQRKAASLEFHSAEFRALTASSLVELVHGRLLPLLAGAKAAGAAVDLQDVLLRLTFDNVCMIAFGVDPGCLRPGLPEIPFARAFEDATEATTLRFVTPTAAWRAMRALGVGHERVLRRSLAAVDEFAYDVIRRRREELGGDDAGAGRRSSDLLTVFTRMRDEDGRPYTDKFLRDICVNFILAGRDTSSVALAWFFWLLRRNPGAEARILEEIEGILAARKEAGEVVVEEEVVFRPEEVKRMEYLHAALSEALRLYPSVPVDHKEVVEDEVFPDGTVLKKGTKVVYAMYSMGRMESIWGDDCREYRPERWLRDGRFMSESAYKFTAFNGGPRLCLGKDFAYYQMKFAAASILRRYRVDVVEGHPVAPKMALTMYMKHGLKVTLTKRDKTKL

SEQ ID NO: 37820 - protein, 400 aa, Bacillus anthracis str. Sterne
MMTYTLATRMKAFQSSIFSELGAYKKEKIAAGHKMIDLSIGNPDMPPADFVREEMVHTANQKESYGYTLSGIQEFHEAVTEYYNNTHNVILNADKEVLLLMGSQDGLVHLPMVYANPGDIILVPDPGYTAYETEIQMAGATSYYMPLKKENDFLPNLELIPEEIADQAKMMILNFPGNPVPAMAHEDFFKEVIAFAKKHNIIVVHDFAYAEFYFDGNKPISFLSVPGAKDVGVEINSLSKSYSLAGSRIGYMIGNEEIVGALTQFKSNTDYGVFLPIQKAACAALRNGAAFCEKNRGIYQERRDALVDGFRTFGWNVEKPAGSMFVWAEIPKGWTSIDFAYALMDRANVVVTPGHAFGPHGEGFVRIALVQDKVVLQQVVENIRNSGIFALEKVDELVKN

SEQ ID NO: 37821 - protein, 385 aa, Oryza sativa (japonica cultivar-group)
MGAVSMSTTTRLPLVAALLSAAACVAAAQPATAEAAPETPGVGIKVSFRPSVAIVVGIFTMIFSLTFLLLMYAKFCHPSSPVAAPAPTVVPAAAADDGVAKPVIESLPFFRFAALRGARQGLECAVCLARFDDADLLRLLPRCRHAFHLDCVDRWLESKASCPLCRARVDAEDAALGLKYASSARFVPAGGASESERFDGDQDLLGIFVERVPSSRMEPAAAAHCPDLDRYKHRIVVSDAVFKSRWSEINSSDLIALDTELLRSMETMEVEMEMELYKETEEEETDHDHQRKTLLAASGGRSSVDAAARARMISSSSSSGSVRSMSEMVSLPRLRAAMRERLAHEDRWVPIARRTARWFAGRESRHDEAAPVVDSPPASHSNSLV

SEQ ID NO: 37822 - protein, 545 aa, Wolbachia endosymbiont of Drosophila melanogaster
MEQFENFYITTPVYYVNDKPHIGHAYTSLLCDVVARFMKLAGKNVKFTTGTDEHGQKIEKAAKAKEMQPKEFTDEVSVSFKELAKFMNFEYDDFIRTTEERHKKAVIALWNRLEERGQIYLDSYSGWYSVRDEAFYQESELIDGKAPTGAEVQWIKEESYFFRLSNWQEKLLELYKNQPSFIFPESRRNEVISFVRSGLIDLSISRTSFNWGIKVPGNGKHVIYVWIDALTNYLTSIGFPSTEGEEYKRFWAEPETQIPVSSTGMTPNQGKTQIPVSSAANLADNSFNVHVIGKDILRFHAVYWPAILLAADLPLPKQIAVHGWWLNEGEKISKSLGNVIDPIGLAQEFGVDQLRYFLLREASFGQDGNFSKKNMISRINSELANNIGNLVQRTISFLHKQCSGIVPTIDQSLLKGEESLPGCKAILDQVMNHLSKYEFNHIILLIINISSEANAYIDKSAPWTLSKTDRERMNLVIYKLLEYIRIIGILLQPIVPKSAEMILNQLQIPKEQRDLKSLCDACVSSGITLPKPTPVFLRVDAKEEK

SEQ ID NO: 37823 - protein, 510 aa, Sorghum bicolor
MERATQQQDDPRPHFVLVPWQGGISHIIPMTDIGRLLASHGAAVTIITTPANAPLVQSRVDDDDDLVTTPPEGAITVTAIPFPAAEAGLPPDDGCERLDLLRSPADVPRFFAANRHFGEAVASYCRAGEAMPRRPSCVVAGMCHTWALGMARELAVPCYIFHGFGAFALLCIEYLYKHRPHEAADDDDGLVVNIPALPAPFDDCCRLSRAQLPPHFAPSTAVGGGAMQEIREFDVAVDGVVVNTFDELEHGSCELLAAATGKAVVAVGPVSLCRRRSPDLDPQAMADDDARRVMEWLDAKETTRSVVYVSFGSAGCMPPAQVRQLGMALASCPWHVVWVVKGADAMPGDVKKWLSESFDSDKCLVVRGWAPQVAILAHRTVGGFLTHCGWGSTLEAIAAGVPMATWPLFAEQFLNERLIVDVLGVGVSVGVTRPTENVLSAGKLNGGGADVEAEVGMEQVMKALERLMDEGDEGEQRRKKAQELKAKANGALEKGGSSYMNLEKLIQCAS

SEQ ID NO: 37824 - protein, 295 aa, Methanopyrus kandleri AV19
MKTGTWRVKTGFARMLKGGVVMDVTNVEQAQIAEDAGAVAVMVLEKVPADIRAAGGVARMCDPAKIEEIMDHVTIPVMAKCRIGHVAEAQVLEAIGVDMIDESEVLTPADEEHHINKWEFEVPFVCGARNLGEALRRIAEGAAMIRTKGEAGTGNVAEAVRHMRIIRREISELTRLDKEELYGKAKEYGVPFDLVAEVASLGRLPVVNFAAGGIATPADAALMMQLGADGIFVGSGIFKSDRPQEMAEAIVEATAYYDDPEVVAEVSKNLGDEVAMRGLEISEIPEEERMQLRGE

SEQ ID NO: 37825 - protein, 521 aa, Xanthomonas campestris pv. campestris str. ATCC 33913
MSSLHNDKILILDFGAQYTQLIARRIREIGVYCEIWAWDHDPSEIAGFGAKGIILSGGPESTTLPGAPVAPQEVFDSGLPVFGICYGMQTLAAQLGGATEAADQREFGHAEVDVVAADALFSGLTDHAGASRLNVWMSHGDHVSQVPPGFTITAVTDRIPVAAMSNEDKRWYGVQFHPEVTHTLQGQTLLRRFVVDVCGCQTLWTAANIIDDQIARVREQVGDDEVILGLSGGVDSSVVAALLHKAIGDKLTCVFVDTGLLRWQEGDQVMAMFAEHMGVKVIRVNAADRYFAKLEGVSDPEAKRKIIGNLFVDIFDEESNKLANAKWLAQGTIYPDVIESAGSKTGKAHVIKSHHNVGGLPEHMKLGLVEPLRELFKDEVRRLGVELGLPRTMVYRHPFPGPGLGVRILGEVKREYAELLAKADAIFIDELRKADLYDKTSQAFAVFLPVKSVGVVGDARAYEWVIALRAVETIDFMTAHWAHLPYDFLGTVSNRIINELRGVSRVVYDISGKPPATIEWE

SEQ ID NO: 37826 - protein, 432 aa, Kineococcus radiotolerans SRS30216
DAAVERAAAAFPAWRDVAPADRARLLRRVAAAVDADLDHLADLEVREAGHPTANARWEAGNLRDVLEYSAAAVERHLGDQIPVAGGIDVTFHEPLGVVGVITPWNFPMPIAGWSVGPALAAGNTVVLKPAELTPLTSLRFAELAREAGLPEGVLQVLPGRGDVAGQRLVEHPAVRKLVFTGSTAVGRGVMAGAARHVKRVTLELGGKSANIVFADSDLERAAATAPDGVFDNAGQDCCARSRILVQRSVHDRFLELLEPAVKGVRVADPRSPDAQMGPLISAAQRERVAGFLTEESLGASAEVAFTGTAPEGAGFWFRPTVVLAPDPRVRVATEEVFGPVVTVTPFDDEADAVRIANDSRYGLSGSIWTRDLGRALRVSRAVEAGNLSVNSHSSVRYGTPFGGVKESGLGRELGPHALDAFTDVKNVFISTT

SEQ ID NO: 37827 - protein, 490 aa, Nocardioides sp. JS614
MQTVMPSGGRVSGLLVGAGWETGRGAQLLEVRAPYGGELLARIAESTPDEVDAAVTLAARTFARNELTPHERADILRRTSQLIAQRAEEFAHSVVAEAGKPLRDARAEVARAVLTFELCAQEATRLAGEVVPVEGTPGSENRRAFTIRRPAGVVCAITPFNGPVNQLSHKVPTAIAAGCTVVVKPAEVTPLSAIKVVQAMLDAGLPPGHVTVVQGRGETVGQQLLEDPRFAVYSFTGSTAVGAHIRRTVGLRKTLLELGNNSANIVHADADLGLAAKVLAKSSTAYAGQVCISAQRILVHEDVFEEFSALLADQVSALSVGDPSDEGTDVGPMISLDAARRAEQWVAQAIDDGAKLVCGGSRDGQFFVPTVVARPAAHSALACQEAFAPVAVLIAYRTLREAIDIANSTEYGLQAAVFTEGLDVAMAVARRLDVGGVIVNDASSYRVDSMPYGGVKHSGTGREGVRYAVEEMTESQLVVLNLRDPVGEGL

SEQ ID NO: 37828 - protein, 479 aa, Solibacter usitatus Ellin6076
MSSQLFGTKSLSRIIAESEGGEHHLKKTLGPVNLVALGIGAIIGAGLFSLTGIAAADNAGPAVVLSFIVAAIGCAFAGMCYSEFSTMIPIAGSAYTYAYATMGELLAWIIGWDLVLEYAVGAATVSVSWSSYVVKLLQSFSIELPSSFIHCPWDEVPGIINLPAVLIVCAISILLMIGISESAKVNAVIVVVKVAIVIVVIAVGYSYIKPENYTPFIPPNTGTFGEFGFSGVMRAAAVIFFAYIGFDAVSTAAQEAKKPQRDMPIGIIGSLIVCTILYILFARVLTGMVNYKTFHGDASPVATVIHLFPSVALQTTIVIGIIAGYTSVILVMLLGQSRVFFSMSKDGLLPAVFSDIHPKFQTPWRCNMIFMVFVSLFSGFLPIAKLGHMTSIGTLLAFVIVCIGIIWMRKTNPNAPRPYRTPFVPVVPILGVLVCFAMMASLGAETWIRLFVWLAIGLVIYFTYGVKNSHLRKAPLNKR

SEQ ID NO: 37829 - protein, 411 aa, Glycine max
MNALAATNRNFKLASRLLGLDSKLEKSLLIPFREIKVECTIPKDDGTLQSYVGFRVQHDNARGPMKGGIRYHPEVDPDEVNALAQLMTWKTAVANIPYGGAKGGIGCDPAELSISELERLTRVFTQKIHDLIGTHTDVPAPDMGTGPQTMAWILDEYSKFHGYSPAVVTGKPIDLGGSLGRDAATGRGVLFATEALLNEYGKSVSGQRFVIQGFGNVGSWAAQLISNKGGKVVAVSDITGAIKNSNGLDIPSLLEHSKVHRGVKGFNGSDPIDPNSILVEDCDVLVPAALGGVINRENANEIKAKFIVEAANHPTDPEADEILKKKGVVILPDIFANSGGVTVSYFEWVQNIQGFMWDEEKVNNELKTYMTKGFKDVKEMCKTHECDLRMGAFTLAVNRVARATVLRGWEA

SEQ ID NO: 37830 - protein, 293 aa, Hordeum vulgare subsp. spontaneum
MSPTLSLKLKKSSHTPQSSVSSSTKLRLFKKEAACQSPSTLPVAMDMGLEVSSSSPSSSSVSSSPEHAARRASPAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLSIAVAKEASSGAPSLSPSSGSDSAGSTGTSEPSANGVFEGPVVMDSEMFRLDLFPEMDLGSYYMSLAEALLMDPPPTATIIHAYEDNGDGGADVRLWSYSVDM

SEQ ID NO: 37831 - protein, 152 aa, Triticum aestivum
YNKFVQKSRLVPVRNSRDIVDPRVRKSVPSISVVGLNGAMLWNHEGYISPEDLKESIDKAWAALQLQETAATLLAASLASRMSEPANTASTTMPGEDGSSTSENHSNSSGQSSESSAVRGFANSTDLVPTPIDSMLTLESTPNQSVCTTVRK

SEQ ID NO: 37832 - protein, 431 aa, Bifidobacterium longum NCC2705
MATEHEEKLGTEDSKWLGEYSQVHMNVFGTPLRVMDHGQGAHIWDVDGNEYLDFLAGIAVNSLGYAHPKWVKAVADQAAKVAHISNYFASEPQIELASKLVKLAGAPEGSKVYFGNSGAEGNEAALKLAKLYGRTLPGALPSIGGKPARILAMTHGFHGRTMGALSATWKPGIRKPYDPLVPNIEFVRAGDKVALHDAFAQTGLGRYGKGPVAAVILELIQGEAGVQPLGADYVKFVRELCDINHALLIIDEVQTGIGRTGKWFAFQRDDLSGGVTPDMVTFAKGVAGGFPMGGMIAFGEKLAALFTPGSHGSTFAGNPLGAAAGLATLDVIEDENLVANAEARGEQLRDGIMATGNPLFVSVRGRGLLDAVELKHPCSHAVMNYCLEHGLIVNAVAPNALRFAPPLIVTAQDVDQALAILKDVPTDLPDD

SEQ ID NO: 37833 - protein, 222 aa, Candida albicans SC5314
MSDPINANPTIIDVADLPTRLNNDNNNNNDNNYQTTNKLNLKKNKQMISQLVSLSLLNPDESPEAADDETSLSSDEENEDDDFDPIDEQEIFDLIATISDPEHPLTLAQLAVVNLSDIKITNPPNCGGDGGDGGGGGISEVLIKITPTITHCSLATLIGLGIRVRLDRSLPSRYRIKILIKEGTHQSENQVNKQLNDKERVAAACENDQLLNVISQMLSTCK

SEQ ID NO: 37834 - protein, 356 aa, Oryza sativa (japonica cultivar-group)
MRLALAASLLVISCFIVVKIRKSGKFQLRIIGKNSNPKENIEELLDNYGSLAPKRYKYSQLKDMTGSFSEKLGEGGYGMVYKGTSPDGHSVAVKFLHDLTRNGEEFVNEVISIRRTSHVNVVTLVGFCLEGSKRALIYEYMPNGSLEKFIYAENSKTTLGWDKLYDIAVGIARGLEYLHRGCNTRIIHFDIKPHNILLDHDFVPKIADFGLAKLCNPKESYLSMAGMRGTIGFIAPEVFSRRFGVVSTKSDVYSYGMMLLEMVGGRKNLKASVDNPSEMYFPDWIYRCLADVGSLHSFDMEHETEEIARKMASIGLWCIQVSPSSRPTMSKVLEMFERSADELEIPPKHCFYSAIQ

SEQ ID NO: 37835 - protein, 420 aa, Zea mays
RRMLTCIACSKQQFSGGGPPLHEPPEDDDVVGGGAGTSAGAATPSTRHAIKALTAQIKDMALKASGAYRQCKPCAGSSAAASRRHHPYHHRGGSAFGGSDADSGASDRFHYAYRRAGSSAASTPRLRSGGAALSSGDATPSISVRTGTDFPAGDDDDDEMTPEATGGCGGKDDDAKEWVAQVEPGVLITFVSLAEGGNDLKRIRFSREMFNKWEAQRWWAENYDKVMELYNVQKFNQTVPLPATPKSEDESSKEDSPVTPPLDKERLPRTFHRQGGGAMGSSSSDSLEHHSNHYCTGRHHHHHHHGHQCCDSMGLASTPKLSSISGAKTETSSMDASMRTSSSPEEIDRSGELSVSVSNASDQEREWVEEDEPGVYITIRALPGGIRELRRVRFSREKFSEMHARLWWEENRARIHEQYL

SEQ ID NO: 37836 - protein, 321 aa, Bacteroides fragilis NCTC 9343
MDKKISISQIKEVVQQAYEQVKGNTGGKNADYIPYLANIDKNLFGISVCLLNGQTITVGDFDYRFGIESVSKVHTAILILRQYGAQKVLEMIGADATGLPFNSIIAILLENDHPSTPLVNAGAISACSMVTPIGNSDKKWDAIVQNITDLCGSAPQLIEELYKSETATNFNNRSIAWLLKNYNRIYDDPNMSLDLYTRQCSLGVTAQMLSVAAGTVANGGVNPVTKKQVFDAELTPKITSMIATVGFYEHSGDWMYTSGIPAKTGVGGGVMGVLPGVFGVSAFAPPLDGSGNSVKAQLAIKYIMNKLGLNVFNGARVTIVD

SEQ ID NO: 37837 - protein, 488 aa, Psychrobacter arcticus 273-4
MLKTTLNLSNPDLIKQQCLIKDGWYAANDEATIEVSNPFNGDVIGTVPSLTTADVNDAVTYSHEAQITWAAKTPQERAQLLQKWADLIDANKEDLAIIMTAEQGKPLAESRGEIGYANSFIRWFAEEGKRVYGDVIPATNSQLRYVVLKQPVGVCAAITPWNFPAAMITRKAAPALAAGCTIIIKPATETPFSALALGALAEQAGIPAGVIQVVTGKSSTIGDILTGDARIHKLSFTGSTEVGRTLMAQCAPTIKKLSLELGGNAPFIVFDDADLEKAADGLIASKYRNAGQTCVCANRVYVQDSIKDEFLGIFIKKVAELKVGNGMEEGVNVGPLINEKALQKVQALLKDALDKGATLIAGGSTNNASALAYNPTVITDISADMDIASEEIFGPIAPVFTFSSEEEVIRAANDTIYGLAAYFYSSDYARAWRVTEGLEYGMVGHNTGMLSTEVAPFGGVKQSGFGREGSKYGIEEYVVTKYWCSDVS

SEQ ID NO: 37838 - protein, 419 aa, Psychrobacter arcticus 273-4
MTTNQSLLARRKAILPTGLGVAFPIFAEKAKNSEVWDVEGNRYIDFVGGISVLNTGHSHPKITQRVHEQLDKFTHTAAQMINYECYVDLAEKLCEKAPISGDTKAFFLTTGAEAVENCIKIARAKTGRPGVISFVGGWHGRTLMCMSLTGKVLPYKKNFGPMPGPVFHALFPAEELNVTEEQALHSLEMIFQADIDPSEVAAIIIEPVQGEGGFHQVTPSFAKSLRDICDEYGIVLIFDEVQCGFARTGTLFACEQLGVEPDLMTSAKSLAGGYPISAVIGRADIMDAPQIGGLGGTYSGNPLACVAALAVMEVIEEENLLERSIEIGDKIESFLKDLNLSSIGHIRHKGAMLAFELIDNEGKPDVEATTNLKAKSFEQGLLLASCGMYGNAIRVMVPLTVEDEVLQEGLDIIKGILTA

SEQ ID NO: 37839 - protein, 131 aa, Zea mays
VDPRVRPRVRPTFKVRKEKLGDRITALQQLVSPFGKTDTASVLHEAIEYIRFLHDQVASLSSPYLGCGRPVVQQIQQRRQAKDDGGAAAKEDLRSRGLCLVPVASTTTYAVAAGGETAPEFWLPNFGGTLR

SEQ ID NO: 37840 - protein, 540 aa, Zea mays
MATTMSVSAVSPPAAAVTRPRTMVCVPATARAPREMAAELAAAAALGADVAELRLDCLAGFTPRRDLPVILAKPRPLPALVTYRPKWEGGEYEGDDDSRFEALLLAMELGAEYVDVELKVADKFMKLISGRKPDNCKLIVSSHNYETTPSSEELANLVAQIQATGADIVKIATTATEIVDVAKMFQILVHCQVPIIGLLMNDRGFISRVLCPKYGGFLTFGSLKKGKESAPAQPTAADLINLYNIRQIGPDTKVFGIIGKPVGHSKSPILHNEAFRSVGFNAVYVPFLVDDLAKFLDTYSSPDFAGFSCTIPHKEAAVRCCDEVDPIARDIGAVNTIVRRPDGKLVGYNTDYVGAISAIEDGIKASESEPTDPDKSPLAGRLFVVIGAGGAGKALAYGAKEKGARVVIANRTFARAQELANLIGGPALTLADLENYHPEEGMILANTTAIGMHPNVNETPLSKQALRSYAVVFDAVYTPKETRLLREAAECGATVVSGLEMFIRQAMGQFEHFTGMPVDDYKFRAIASSLDNPNTMKPRL

SEQ ID NO: 37841 - protein, 140 aa, Carboxydothermus hydrogenoformans Z-2901
MTKLNGTGLLKGLAITFKELWKKPVTLEYPEHKEKLPPRFHGSFTLHSEKCIACGLCQQACPNKVIKVGSIKDENNKRKLASYEMEMKYCLFCGLCVEACPTNALVFNQEYELAKYRIEDIKLTLFKREEITTGEGSENA

SEQ ID NO: 37842 - protein, 473 aa, Nocardioides sp. JS614
MTGSGGHERAHTVVVGGGISGLTTAYFLRQRLGPDAVLRVVEASDAPGGKIRTASIAGHPVDTGPDAFLSRAPELRRVVDALGLADLVVEPQSTGTFIWSRGRLRRLPPGTAFGLPERLWPLLRSGLLGPAAVARAGLDLVLPRTALPDDPSVADVVRPRFGAGVYDRLVVPLLGGVHAGDPALLSATSTVPEIAAMARSGRSLYRTLRRRRRSAPPATGRPSAPLVSLRGGLAALTDRLVEELGPDTVLTGTPARAIERDENGGYTVRTDRGAFAARQVVLATPAYVAAELVADLAPDAAALLREIGYVDVANVTLAFRRDQVPALPAGTGFLVPPVEDELVVGCSWLSQKWPQPADAGDYVLLKVMVGRSGDTRWLAMDDAELVRHVREALRRMLGVTADPVESLVQRWPRAMPQYVVGHAARLAALDTALAAAPGLLVTGAAYRGVGLAGCVAQADATATSLLATQGAPT

SEQ ID NO: 37843 - protein, 714 aa, Oryza sativa (japonica cultivar-group)
MNYRFHNLLGAPYRGGDAVFAGDSSVLLSAVGNRVASTDLSASSSLTLPFESSSNVTRLAVSPSGDFLLSVDDAGRALYANLGRRAVLHRIAFKSAPSAVRFSPDGNLIAVAVGKLVQIWRSPAFRKEFFPFHLLRTIPGFAAGVTAFDWSPDSSFLLASCKDLTARLLPVKKGLGGKPFLFVGHRAAVVGAFFATDKKTGRVTGAYTITKDGAIFTWNLVEGSDDSPPPSPGTPEQEAVQDGEAELDGDEPELDGGSRKRKSFGESEEPDTTPLHFTRWELQKKDFFMQSPAKLTACDYHRELDMVVVGFSNGVFGLYQMPDFVCLHLLSISREKITTAIFNSLGNWLVFGCAKLGQLLVWEWRSESYILKQQGHYFDVNCIAYSPDSQLLATGADDNKVKVWTVSSGFCFITFSEHTNAVTAVHFMANNHSLLSASLDGTIRAWDLFRYRNFKTFTTALPRQFVSLTADQSGEVICAGTLDSFEIFVWSMKTGRLLDILSGHQGPVHGLMFSPINAILASSSWDKTVRLWDVFESKGAVETFQHSHDVLTLAYRPDGRQIACSTLDGLIHFWDPFDGLLMYTIEGRRDIAGGRLMTDRRSAANTSIGKYFTTLCYSADGTYILAGGNSKYICMYDVGEQVLLRRFQITRNLSLDGVLDFLNSKKMTDAGVLFLVGSWMMCVHTLLKFCHPVLLKRSRKNISCITSMEYLWVS

SEQ ID NO: 37844 - protein, 281 aa, Thermosynechococcus elongatus BP-1
MRKKWITLFVLLLGMIPFIAISVMPLLTSAFTPPQATPSPMARPAAGDKIAELQAQEKGYQLVLEREPNNATALEGLVLARLQLIQLGKGEIASVIDPLRRLSAQRPEQTDYAILLGQAQQQTGDREGAAQTFQGVLAKSPGNLNALRALVDLYLKENRPQAAIGLIQDTLQGAEQANKVQPGSVDVTAVQLLLGDVYMTQKRYDEALTLFQNLGKENPNDFRPVLAQAMALTEQGKKTQAAALYAKAVELAPAKYKDAIQRAAQQMQQESPGTPEPSPQQ

SEQ ID NO: 37845 - protein, 231 aa, Triticum aestivum
  misc_feature (23)..(23): Xaa can be any naturally occurring amino acid
MDSGDAWGRSSSTSSAAAAAARXLQSRYDLYMGFDDADAGGDEVEARGAEAYNCPFCGEDFDFVGLCCHIDDEHAVEAKSGVCPICATRVGADLIGHLTMQHGSYFKMQRRRRVRKVSSGSHSLLSLLRKDLRDGSLQSFLGGSSYVSNPPAAAPDPFLQSLICSLPVAEPSKDFRSESSDKTFLLNKFPDEKIVERAETSLSDKDQKERAQRSAFARGLVLSTIFDDDTM

SEQ ID NO: 37846 - protein, 447 aa, Mycobacterium smegmatis str. MC2 155
MSSTAEVAEGHLKRALGLPSLVLFGLVYMVPLTVFTTYGIVTQTSGGRVPLSYLVTLAAMVFTARSYARMSVAYPVAGSAYTYTQKSFGAPVGFLAGWSLLLDYLFLPMINYLVIGLYLSAAIPAIPAWVFILIAIAIVTVLNIVGIVSVARANFVIIAVQAIFIVAFLILATSKVFSYGTVDLAAPFTGDGTAPGFSPVLAGAAILCLSFLGFDAVSTLSEEAKDPKRTVPRAIMIATLASGLIFVVLSYVAQVVFPSNEFSDVDSGSLDVMMTAGGNFLQVFFTAAYVAGATGSAITSQASVARILYAMGRDGVLPRPFFGHVSPRFSTPVYAILAVAVISLLAIVIDLGILASVISFGALVAFSAVNLSVIKHYFVDHRERAGAQAINSLVLPLIGFALTVWLWFSLDGLALIIGLCWLAIGFVWLAGVTRGFQRPTPVLDMKE

SEQ ID NO: 37847 - protein, 293 aa, Hordeum vulgare subsp. spontaneum
MSPTLSLKLKKSSHTPQSSVSSSTKLRLFKKEAACQSPSTLPVAMDMGLEVSSSSPSSSSASSSPEHAARRASPAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLAIAVAKEASSGAPSLSPSSGSDSAGSTGTSEPSANGVFEGPVVMDSEMFRLDLFPEMDLGSYYMSLAEALLMDPPPTATIIHAYEDNGDGGADVRLWSYSVDM

SEQ ID NO: 37848 - protein, 1885 aa, Cryptococcus neoformans var. neoformans JEC21
MPIDPDAYMAGAIPTLSRGGSWLQGERQLRDSTLPPSHLHEGSRYSSSPGSNYNPQIPPTPGPSQFGGNPFILPRSPFQRPLSISDWALPSIYNGGRPPPMPMLSQLQTDISGASFIQGLKSEQVFGPVQHHAWLKSSSEADQNSVTSRSFDVQSLVSGARSVTSSVSVPQNVKSIRRMQYSHHHFDEHSSPEQGRSWENRGGSPKPLAPEPGYGMKKSPYMKLDGHLRRTSDASNQPPPYRKLSSQQIFPPVSSHDDYFLSSPTSSRHDGQLAIAKHRYPHSPNFLSPRPRHKKLGDQDLFRSAQLNSRTARLSLAGRECRTPDPEPSPDLSGYTIAPHAALRPSGGDDKRPSMERRHTASHIPEPTHASSSLPISPPIHKTLHQLKRTRHNSSSRALSFESSSYDEQATSGSTIDFTMSSPMSSRSSAGSNQSTPVNKQFPHLKADTSSQDSERSWSSWRLAEAHYMYLDGGCVCRRNWKAVKPGVAVGNASDATDRTEKSGGKRIRIMSVLAAISSLPATSYYHPIAQVPAGASKLNPYLPLPQSSTPTVLFTNANLLHSLPTASLSRTVIHVFDAEEIVTPKGANAVSLISRSSQGAYDHALLSLRLAQDKDAVVYHFIPSGLEGEIQTLEDAQAWLSGPLDAPDLSNGDDAEPSAEAKLIAAYESISLSLLKLTRRPQRPFIHSKAESSRLVVNFLPSPVKSENTIDVVLAIPAPKEKLSSSLSGVQEVVVVEAGSGKYGPAWASVVDALEGADVTIRSVLVGASASSEEIAAAITGDTPITRIGKPLSYNIPSNAVTVPSPESTYTELLASSPSPLEVLNDPSHLAANESTSPLYAFGKAVAIRKERARLVELAKKVLKAPNTKPEVHEALSAWLLVRDEKKGAVEAGKKVEAAIGAGKGDEKEIVELGQKGHWEKRALWIVISNSWAVDLASSGLHHALASGLDINLLVYETAASPFSPNAPAQPPKERKKDLALYALNMGDVYVASVAVYADYAGVLNAMREAENYSGPGLVLAYLPWGEKEDGQAVSDSENAGPLERLRETKRAVSGGWWPMFRWNPSLPDEKRFSLDSSHIKAALSEFLDRQSHLSQLTLATPAIDSSVTSSAGTELLAARKEKARKAYDALLNSLDGPGLLVLYASDGGNAEKLAKRLVGRAKMRGVSASLRVLDEVAGSIVETLSQEQNVLIVSSTAGQGESPLNGREFTKALSKLSPSDEFKETKVAVFGMGDSHYWPRPEDAGYYNKPARDLFPKLISLGCQELLPLGLGDDSDPDGVQTGYKPFEASLWRALGVDSVEVTEEKEEVVANEHIKIASDYLRGTILEGLADKSTGAISASDAQLTKFHGTYMQDDRDIRESLKAQGLEPAYSFMIRVRMPGGICSAKQWLDMDRISDEHGNGTFKLTTRQTFQFHGIIKSHLKKAMQAINKSLLDTIAACGDVNRNVQCTVNPSLSKTHATVYEFSKAVSEHLLPATNAYHEIWLDKKKISGDAVQPFDSDSEPLYGPYYLPRKFKIAIAVPPDNAVDVFTNDVGFIAIVENDEVIGYNVSVGGGMGVTHGNKKTYPRLGDVIGFITPEDGKKVAESIMLVQRDHGNRQDRKNARLKYTVDRLGLPKFKAFVEERWGKKFAPARAYHFDSNLDHYGWSQGHDGKWHFTMFIENGRVEDNSRHQFKAGLREIASVHKGTFRLTANQHLILSDIASEDLDEMKRLLAKWGLDNLDHSGVRLSSSACVAFPTCGLAMAESERYLPVLIDKVEKICEEAGVKSDDLVMRMTGCPNGCARPWAAEVAFVGKAPGSYMMMLGGSHLGTRLNKPFLESASEPEILAVLKPMIKRWALERHEGERFGDWTIRAGYIKPTTHGTNFWEDAFPAQAGTTVTA

SEQ ID NO: 37849 - protein, 205 aa, Cryptococcus neoformans var. neoformans JEC21
MSAPEYDYLFKLLLIGDSGVGKSCLLLRFADDTYTESYISTIGVDFKIRTIELEGKTVKLQIWDTAGQERFRTITSSYYRGAHGIIVVYDVTDRDTYTNVKQWLQEIDRYAVEGVNKLLVGNKSDLATKKVVEYAEAKSFADELGIPFLETSAKNATNVEQAFLTMSKQIKDRMGSSTMASGPGAKSTIKGLGQNVEQKTAGGCC

SEQ ID NO: 37850 - protein, 1084 aa, Psychrobacter arcticus 273-4
MPKRTDIKSILIIGAGPIVIGQACEFDYSGAQACKALKEEGYRVILVNSNPATIMTDPAMADATYIEPITWQTVEQIIAKERPDAILPTMGGQTALNCALELDKHGVLTKYNCELIGATKDSIEMAEDRNLFDKAMKRIGLECPRAETAETMEEAFATQEKMGYPCIIRPSFTMGGSGGGIAYNRDEFIEICERGFDLSPNHQLLIDESLIGWKEYEMEVVRDKNDNCIIICAIENFDPMGVHTGDSITVAPAQTLTDKEYQIMRNASLAVLREIGVETGGSNVQFGINPDTGRMVVIEMNPRVSRSSALASKATGFPIAKIAAKLAIGYTLDELQNDITGGKTPASFEPALDYVVTKIPRFNFEKFPQADNVLSTQMKSVGEVMAIGRNFQESMQKALRGMETGNDGFDEQIDLSKVSIEKARSEITNRLTIPTPERIYYIADAFRIGMSVDDVFKLTKIDPWFLVQIEDIVKTEAQVKALGFGGLTEKNLRSFKRKGLSDLRLAKLLGVSQKQLRTKRWDLNIYPVYKRVDTCAAEFATSTAYMYSTYDSECEANPTNNKKIMVIGGGPNRIGQGIEFDYCCVHAALAMREDGYETIMVNCNPETVSTDYDTSDRLYFEPITLEDVLEIVRIENPDGVIVQFGGQTPLKLARALEAAGVKIIGTSPDAIDRAEDRERFQHMIQQLNLVQPTNALATSLEDGLVKAKDVGYPLVVRPSYVLGGRAMEIVYNEDELRHYLRTAVQASNEAPVLLDRFLDDAIEVDVDCVSDGTDVVIGGIMQHIEQAGVHSGDSACSLPPYSLSKELCDVMRAQTVAMAKELGVVGLMNVQFAVKGETVYILEVNPRAARTVPFVSKCIGTSLAQIAARCMAGTSLKDQGFTKEIVPAFFAVKEAVFPFAKFPGVDPILSPEMKSTGEVMGVGKTFGEAFYKAVIGSNERLPGLPTEGETKTVFISVRDSDKEQVAPIARQLIDFGFNIVATTGTQKVLSDNGIECKQINKVTEGRPHIVDALKNGNIDMIINTTEGKQAQEDSFSIRRSALQGKVFYVTTLGAADAVCKSYAIDLPFEVYKLQDLHEQAKSIV

SEQ ID NO: 37851 - protein, 594 aa, Oryza sativa (japonica cultivar-group)
MVLPETAAEGKALTDAWDYKGRPAGRAATGGWGCAAMILGAELFERMTTLGIAVNLVPYMTGTMHLGNAAAANTVTNFIGTSFMLCLLGGFVADTYLGRYLTIAIFEAVQATGVMILTISTAAPGLRPPACGDPKGASAECVAADGTQLGVLYLGLYLTALGTGGLKSSVSGFGSDQFDESDVDGERKKMMRFFNWFYFFVSLGALLAVTVLVYVQDNVGRRWGYGICAAGILAGLAVFLSGTRRYRFKKLVGSPLTQVAAVTAAAWSKRSLPLPSDPDMLYDVDDAAAAGHDVKGKQRMPHSKECRFLDHAAIIDRSAAESPATASKWRLCTRTDVEEVKQVVRMLPIWATTIMFWTIHAQMTTFAVAQAELMDRRLAGGFLIPAGSLTVFLIASILLTVPFYDRLVVPVARRATANPHGLTPLQRVFVGLSLSIAGMAVAAAVERHRATASASAAAAAPTVFLLMPQFLLVGAGEAFTYMGQLDFFLRECPKGMKTMSTGLFLSTCAIGFFFSTLLVTIVHKVTGHGARGGGWLADNLDDGRLDYFYWLLAVISAINLVLFTVAARGYVYKEKRLADAGIELADEETIAVGH

SEQ ID NO: 37852 - protein, 327 aa, Vibrio sp. Ex25
MAELTLVEAVNLALHHEMQQDQNVVVLGEDVGDNGGVFRATVGLKQEFGLKRVIDTPLAEALIGGVAVGMATQGLRPVAEFQFQGFVFPAMEHLMCHAARMRNRTRGRLTCPAVFRAPFGGGIHAPEHHSESVEALFAHTAGFKVVIPSSPQRAYGLLLAAIRSNDPVMFFEPKRIYRTVKSEVVDNGEALPLDTCFTLRKGRDITLVTWGACVVESLQAAQTLSSQGIEVEVIDLASIKPIDTATIFSSLEKTGRLLVVHEASKTCGVGSELLARTAEHAMCLLKAPPKRVTGMDTIMPYYRNEDYFMVQEEDIVTAARELVEDWK

SEQ ID NO: 37853 - protein, 478 aa, Bifidobacterium longum NCC2705
MTELKSKEDVEALINKEGIEYVSVRFTDLIGVQQHFTVPASEFLKDAFTDGMPFDGSSVQGFQAINESDMKLVPDVETSFVDPFRKHKTLDVAFSIVDPLTDEPYSRDPRQVAGKAEAYLKSTGIADTASFAPEAEFFIFDKVRFENGMNRSFYEVDSIEAPWNSGVDVEEDGTPNIGFKNRVKKGYFPVPPIDHTQDLRDDMVANLQKVGLILERSHHEVAGAGQQEINYRFNTLQHAGDDLMKYKYVVHETAALAGKAATFMPKPIADDNGTGMHCHQSLWKDGKPLFYDEKGYAGLSDLARWYIGGLIKHSSSVLAFTNPSLNSYHRLVPGFEAPVNLVYSARNRSAAIRIPLAGTSPAAKRIEFRAPDPSCNPFLAFSAQLMAGLDGILNHIEPPEPVDKDLYELPPEEHAGIKQVPSSLAEAMDALEEDHDFLTAGDVFTDDLIETWIGLKRDEIDQARLSPTPLEYELYFHI

SEQ ID NO: 37854 - protein, 398 aa, Vibrio sp. Ex25
MAFALISEFEYPYKLWFDMNSCSPKDTQRQKELEMNVQALPMHRFIDHHGDLVGQLPNWADTETLVGFYRDMVLTRTYDNKAVALQRTGKLGTYPSHLGAEAIGIAVGRALKADDVFVPYYRDMPAMWCRGIGMEKNLQYWGGDERGSDFAPEGSPIPSRDLPFCVPIATQCTHAVGVASALKIQGNHEAALVMCGDGGTSKGDFLESINCAGAWNIPLVFVVNNNQWAISVPRSLQCAADFLSEKAQGAGIPGITVDGNDVVAVYDATKTALERARKGKGATLIEAVSYRLSDHTTADDATRYRKEDDVQTAWQYEPIARLKTYLLNQGAWSDEQEQQWLEYCKEQVELAVERYLSLPSQAPETGFDYLYESLPQELHAQRDELINKAMRMQGGKHG

SEQ ID NO: 37855 - protein, 390 aa, Zea mays
MLVKLMNLLRACWRPSSNRHARTGSDVTGRQDGLLWYNDAGQHVNGEFSMAVVQANNLLEDQCQIESGPLSFLDFGPYGTFVGVYDGHGGPETACYINDHLFQNLKRFASEQNAMSADVLKKAYEATEDGFFSIVTKQWPVKPQIAAVGSCCLVGVICGGMLYVANVGDSRVVLGKHVKATGEVLAVQLSAEHNVSIASVRKELQSMHPEDRHIVVLKHNVWRVKGLIQVCRSIGDAYLKKQEFNREPLYAKFRLREPFHKPILSSEPSISVQPLQPHDQFLIFASDGLWEQLTNQEAVDIVRSSPRSGCARRLIRAALQEAAKKREMRYSDLKKIDRGVRRHFHDDITVIVVFLDSGLVSQASTHRGPTLSLRGGGGSAGLRSNTLAPT

SEQ ID NO: 37856 - protein, 240 aa, Oryza sativa (japonica cultivar-group)
MGETGLPVGVAVSAVIEQSRQRAKKQQAFSVAVAESRDSFNVLAHKSFPLENKKTGLTSANGKLCQLCEQYSTEALFYLQQNETQTEILSILHHACANVGPLKQQCITLVDYYIPLFFLEVSMVTPEKFCESVHLCRKGTMLRLPSRGDTCGICHHVLVEVLIMLKDPDMQLEIVEIFLKACSKADNYVQQCKKMVLEYTPLILVKSQKFLETTDVCSTIHACKTGTQASAETMLLSAAS

SEQ ID NO: 37857 - protein, 231 aa, Solanum lycopersicum
MVPEVDADHALMIEENYPNPMLIDPKRDRFPCCIVWSPLPVLSWFIPFIGHIGICREDGVILDFAGPNFVSVDNFTFGAPTCYFQLSREQCCCLSPYSAEPTGEYVENHDESGGNVDTWESAIRKSIQEFQHQSYSIFTCNCHSFVANGLNRLGFQSGGWNVVNLAIFIFLKGRWVNRTAMVKTYLPPLVVLGLGLIFGGGTFLTYLLIFMFVLIGWFLLGTYCFKKLIHV

SEQ ID NO: 37858 - protein, 243 aa, Solanum tuberosum
MPSGRLSLMDLEPAYKMESIRAVQDIQHEFWPLDEINLENAKFPCCLVWTPLPVVSWLAPFVGHVGICREDGSAVAFSGSNFINVDDFALGSVAKYLQLDRKQCCFPRNLAAHTCKHGYKHTEFGSAISWDDAIQSSVRHFEHKSYNLFTCNSYSFLANCLNKLCYGGSMDWNMINVGALLLFKGHWVDNMSILRSFSPFMLVVCFGIFMVGWPFLVALLAFSLLLLAWFIFGTYCLKNMLDS

SEQ ID NO: 37859 - protein, 307 aa, Glycine max
  misc_feature (195)..(195): Xaa can be any naturally occurring amino acid
MLAPKTHTCEALSLSLPQPSSPPPEPVNILFRRRQLLSATASTISFNFTVPFTTSLSMSEPVASAGGLFQMPPPRLINRYFLVRAGESEFESMGVINTNPVEKTSVDSGLSERGKKQSIKAAFDLKEMGACDKGCWIWSAITQRAYQTAEIIASVNGVTRSYIVPEYSFLDARGLGAFEGKKLEYVSEGIFKCSXVYASDGISPNIKPPPINDGTPNESVADVFVRVTQLMSILETQYSGDTVIIVSPDSDNLTILQAGLIGLDLRRHRELSFAPGEVRFVDPNDIPVYKQPASAIYKCSKNPPNCN

SEQ ID NO: 37860 - protein, 293 aa, Hordeum vulgare subsp. spontaneum
MSPTLSLKLKKSSHTPQSSVSSSTKLRLFKKEAACQSPSTLPVAMDMGLEVSSSSPFSSSVSSSPEHAARRASPAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLAIAVPKEASSGAPSLSPSSGSDSAGSTGTSEPSANGEFEGPVVMDSEMFRLDLFPEMDLGSYYMSLAEALLMDPPPTATIIHAYEDNGDGGADVRLWSYSVDM

SEQ ID NO: 37861 - protein, 309 aa, Mycobacterium smegmatis str. MC2 155
MRNAPVSEENPQRAPVGVFVGLATLDVIHRIAKPPAVNEKITSTAQFVAAGGPAANAAVTFAALGGEATLVTALGDDPVADLIRADLTAYGVSVIDAAAGSARPVPVSSVAVVESTGDRSVISSDAVTSDAAPPDAIAELVARADVVLVDGHHPLMARAAAQHANQRGTTVVVDAGRWKPVMADLVPHVSDMVCSGDFRTPGADTSNATAAGLVESGVRTVVITHGGDPVTWWSGGESGEVPVPPVTVVDTLGAGDAFHGAYAYYSTRSDSGVAERIDRSSRVAALRCSVVGPRAWLSKLPDQIRKRER

SEQ ID NO: 37862 - protein, 108 aa, Brassica napus
MVVLTLMALVKPVIFLTSFVFEAEDMVFGSPGGFVVVRVACFLVFFAGLLFGLTLGLMSLGLVRLEIFQQSGSSAEKKQAVVFLPGVKKQHQLFVTLFLCNAVALEAL

SEQ ID NO: 37863 - protein, 293 aa, Hordeum vulgare subsp. spontaneum
MSPTLSLKLKKSSHTPQSSVSSSTKLRLFKKEAACQSPSTLPVAMDMGLEVSSPSPFSSSVSSSPEHTARRASPAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLAIAVPKEASSGAPSLSPSSGSDSAGSTGTSEPSANGVFEGPVVMDSEMFRLDLFPEMDLGPYYMSLAEALLMDPPPTATIIHAYEDNGDGGADVRLWSYSVDM

SEQ ID NO: 37864 - protein, 377 aa, Mycobacterium smegmatis str. MC2 155
MRTRAAVTYGLNTRFEVKEVELDEPGPNEVLVHLVASGVCHSDMHHVTGDQIAALPMIFGHEGAGVVEKVGNNVTHVGPGDHVVMSYLPSCGTCRWCTDGQTNLCDLGAHTVEGPQLDGTYRFHDDDGVNLGQFCLVSTFSEWTVVPAQSVVKVDEHYRLERACLVACGVTTGVGTAIYRGGVEPGEDVMVYGVGGIGMNIVQGAKIAGAKRIIACDTNDWKLEQAKLFGATHTVNPNTTDPVEFATELTWGVGVDKAFEAIATPETIGQAVRSVRKSGTVAVVGLTRHDQPTIPVNPSDFVLWQKTLTGSLNGGCNPRNDIPKMLKLWDSGQINLDGLVTKEYRIEQINEAYDDLLAGKNLRGVIRYEWADNGVPQ

SEQ ID NO: 37865 - protein, 117 aa, Triticum aestivum
MAKKRKRSSDAPAPAAVEKPDDSAPERPERTLFGFKDSADDPASKDAGQFFRNKEKVLITCSRRIIYRYRHLMQNVVSLLPHAKKDSKVESKQSKGSALNELVELRSCSSCLFFECR

SEQ ID NO: 37866 - protein, 257 aa, Solibacter usitatus Ellin6076
MNTPELFSLKNRVAVVLGGTSGIGLAIARGFAQAGAITIASSRDQAKVDSTAAELEALGARTLRLTSDVQDRASLQRLCDETVLAYGQVDVLMVTSGALKKAPSAELTDEDWERVVDINLNGSFRANQVFGRQMLKQKRGSIINTCSMTTFVSFGEVAVYSASKAGVNMLTKSLACEWATQGVRVNAIAPGVFRTPLNTNALDIPERMAAIIGRTPMGRVGHVDELVGCAIFLASDASSFVTGQTIPVDGGFLAKGI

SEQ ID NO: 37867 - protein, 690 aa, Wolbachia endosymbiont of Drosophila melanogaster
MNHSHLKSMANAIRFLSIDAVQKANSGHPGMPLGMADVATVLFAKYLNHNPDDSKWFNRDRFVLSNGHGSMLLYSILYLTGYISVDELKNFRQMGSKTPGHPEFGLTSGVEATTGPLGQGFAAAVGMALAESILEKQFRINHYTYVMLGDGSLMEGISHEAASLAGHLKLNKLIALFDDNDISIDGATCLSCSDDVEKRFLAYGWNVDKIDGHDFDAISLAIEQAKKSDKPTMICCKTIIGKFSSRAGTSSAHSGAFSEEDIKQMREKLNWNYEPFHVPEDVKNAWKKTVERAKQNYTMSFQRVTLESRKEEKEWIPVSSTGMTRESTGMTEENAGMTGYHAELQRRLDKHLPDNIAGVLADLKKQICELMPNEATRSSFGRVMELLTESMPELIGGSADLTGSNCTKYEHMQVINSNNYSGSYVHYGVREHAMAACMNGMALHGAILPYGGTFLVFSDYCRPAIRLSALMKQQVMYVMTHDSIGVGEDGPTHQPIEHLASLRAIPNLYVFRPADAVETLECVSIALEKKESPALFALSRQNVSYMRKFYSDIDQSANLSKFGAYILCECSKELKVTIFATGSEVEIAVEAREKLQEKGIGTRIVSMPCWRLFDEQSDEYKAAILNNDSIKVAIEAGSEMGWHKYIGSNGIFIGMKSFGESAPYKTLYEHFNISADHVVKCVCEKLVYIQ

SEQ ID NO: 37868 - protein, 325 aa, Pseudoalteromonas tunicata D2
MAQMNMLQAINSALDISMAEHPNACIFGEDVGHFGGVFRATSGLQERYGRHRVFNTPLTEQGILGFANGLAAFGAPTIAEIQFADYIFPAFDQIVNETAKFRYRSGNEFNVGKLTIRTPYGGGIAGGLYHSQSPEAYFAHTPGIKIVVPRNPHQAKGLLRAAILDDNPVLFFEPKRLYRASIGEVPTEDYTIELGKAEVVKEGKDVTLLAWGAQMEIIEQAAKLAEQDGISCEIIDLRSILPWDRETVAQSVIKTGRLVVSHEAPITNGFGAEIAATIQQHCFLHLEAPILRVCGLDTPYPLALEKEYVPDALKVLSAIKQSVSF

SEQ ID NO: 37869 - protein, 528 aa, Ehrlichia ruminantium str. Welgevonden
MSKVAIIDFGSQFTQLLARRIRDLNIYSEIFLPNVAFDLIKGVDAFILSGGPRSVPNSDGIPKIVHDILQFNEKTSIPVLGICYGLQILSNYFESDVVSNCNKEFGKTILNIIKNSKIIENIWESGDQACVWMSHADSVYNIPRGFEVIAYSVLNNSIAMVANEQRRIYGMQFHPEVYHTPDGINLLANFLDIAGCQKDWTVTSFIDDQQDAIKKQIGNKKVIAALSGGVDSSVAAALTYKAIGDQLHCVFIDNGLLRYNEVEKVKQLFINELKIPVTIVDKSAVFLNRLKSITDPERKRKIIGETFIEIFEEEANKLEGVEFLMQGTIYPDVVESGGSGSIAKESVVIKSHHNVGGLPKTMKFKLVEPLKYLFKDEVRILGRNLGISTEILMRHPFPGPGLAVRIIGEITEEKVKMLQAADDIYINLIKKYELYDVMWQAFVVLLPVKTVGVMGDRRTYGHACVLRAVNSHDGMTAESFPFCMDEETQWKFFKCIQEASNAIINSVNGINRVAYDITSKPPATIEWE

SEQ ID NO: 37870 - protein, 415 aa, Ehrlichia ruminantium str. Welgevonden
MIKKAAVELDDQKITLPILYDTEGNEVLDITSLYKNTGVLTYDPGFMSTAACESKITFIDGNKGILRYRGYDIADLVYNNKSFIEVVYLLFYGVFPNAEQLQEFILHISQEYVLPQMVRDVITSFPQNSHPMAILIASFSSLAAYYCDQKTDGELECKLAVAKVASIVALIYRHITNQDFIQADVGLSYSKNFIHMMFDISSYKFTEIVDKALDVIFVLHADHEQNASTATVRMTGSSGPNLFACLAAGAATLWGPAHGGANEAVINMLMNIGKPENVKQFIQKVKDSNKSTKLMGFGHRVYKNYDPRARIMCTICKEILKDFGLNDPLLEVAVELENIALQDDYFIARNLYPNVDFYSGIVLKTIGIPVKMFTTLFALARTSGWSAQWYEMVSSKNYKISRPRQLYTGNPVQKV

SEQ ID NO: 37871 - protein, 3896 aa, Oryza sativa (indica cultivar-group)
MSRLRARIAERLLQSQSTKAILTTFNEVNMAPVMELRKKFQDSFTKEHGTKLGFMSFFVKAAVHALKKFPVLNASVDGNDIVYHGYFDIGIAVGSPRGLVVPILRNADQMSFADIEKKIAEFGKKAQEGKLGIEEMTGGTFSISNGGTFGSMLSTPIINPPQSAILGVHATKDRAVVENGQIVVRPMNYLAMSYDHRIIDGREAVLGLMPVLGVAMRLGILWLVCLGLVAGCGGGGSSSSNPASNPPSGNPSIPAPISNPAGLSFEPSSWTAESYQGDVLEFNVKVKLEKPLQGRVNVRIVDDQGVLYKAPTVKYLDQSTATANLTLSPKLAPKNYQGNFVVSFCLDDPSVCQQPYSEASWSYPYQLLVRPLPNLTVLSPLLKGSDWTTVQGNAAHNGYVPEKLDPSKFELRFRYAPERAQMHGPMITKDGFAVFTTRSSGAHEFMHALDENKGVLAWLKPLGVGNIPLTMGDGVLYYPGYTDSTGFGIVALDVITGAVRNSAPTTVDEGVYENGALYFSHIINYPKGDFSAEKLNGFDFAPVWNSIESKPESRPRSTRVPALDANFAYYYEGDTRFSSAPSSRLAKLDKQSGKTVASIYMPRVSAFDENRYVSPPVICNSQNILISDGSGPGSRIRMVDLEKNALRYELVGNYSSEAPVCDQGMFYIVGVSGLEAHRISDGSLAWILNPPAGEEMFNAFGTHLVSNLILFENIIFVSFGENLYGIELTKREPAWVGKRTGGRKLTVSKNGILYAAEGSSSKRYAMSSKQFDVIVIGWRPRRLHRRHPRGPAGLQRGLHRRVEEREGRPRTGRHLHERGLQSPPMRCCSPRSIFEHATKHFAEHGITATDVKIDVAKMIGRKDAVVKQNNDGILYLFKKNKVSFFHGRGSFVKAAEGGYEIQVAGAAQETLVGKQIIVATGSNPRALPGVPFDEEKVLSNDGALRIGATPKKLGLIGAGVIGLEMGSVWRRVGADVTVLEGLPTFLGAVDEQIAKEAKKAFDKQGLKVELGVKIGEVKTGGDGVTVAYTDAKGEARELAVDKLIVSIGRVPNTIGLNPEAVGLKLDERGAIVVDADCKTNLPGVWAVGDVVRGPMLAHKAEEEGVAVAERIAGQHGHVNFNTIPWVIYTSPEIAWVGRTEQQLKADGVQYKAGTFPFLANGRARALGDTTGMVKFLADAATDEILGVHIVGPMASELISEAVVAMEFKASAEDIARICHAHPSLSEATKEAALAAYEAELAAKGFRSDPAQLRAVEALQRCADDWAAYKEKRSNALKKLIHRPEVPRGVYMYGGVGRGKSFLMDCFFNAVPIRRKVRLHFHEFMREVHRELAGLQGTVNPLDVLGERIAKRYKLICFDEFHVADITDAMILHRLLAALFDNGVGFVTTSNFKPDDLYPGGLHRDRILPAIDLLNEKLEVVNVDNGTDYRRRTLEQVRLYHCPLGPQAEAEMEAAFDQLAESRDEDPVLHIEAREIRARRKAGGVVWFDFDVLCGGPRSQNDYLEIASQFHTVLLSNVPYMPVAMASPARRFTWLVDVLYDRRVKLILSAAVPPEQLYTEGPLAHEFPRTVSRLNEMQSKEFLALERRPGHQRVAGHQLRDGVDGHGRVALGAQAPHQDVGVRMGVGLGLGDLAAVHQRLDVGVVAGAVPELRTPEVIDARVARMRPVAVAAGMDEEGRHGTAVSAAFAEDGPLAIAQARFQPRAGQAAMAAAVAETIDRGGALVVEAGTGVGKTFAYLVPALLSGERVLISTATKALQDQLHSRDLPRLLQALALPARTALLKGRGSYLCLHRLGIARQHPSAADTAVARVLARAEVWAHATATGDLAELPGWDERSAATPLFTSTRDNCLSSSCPRFRECHVYQARREAMAADVVVINHHLFFADHAIRGSGVAELLPSVRVVVFDEAHQLNETGVQFMGTQMGSSHWLDLARDVLAAGLQFARGLADWQGAAAALERAARDWRMAAGARAPGTRLRWSGPVPDGVERAAWDDALGRLSAAAREALAALDTVSEIAPDFVRLHERCVELMERLALFLDPAPPDAVRWVEVGQHQVRACLVPLDIAQPLRRLWFPHEEAAGPSAAAADAGDGDGPAPGLPHDLPWSDEGGDPDPWAAAPVHGSALPAPGAAALPGAGSGEGGGRPRAWVFTSATLGDDASLKWFTAACGLEGARVLQVPSPFDYAAQAAVYVPRQLPSPSDPGHGAAVARWAGDAARVLGGRTLVLTTTLKALRTIGDALRERFPDGSGIEVLVQGDWPKRRLMERFREADAGGDRPGCVLVASASFWEGFDVPGDALQLVVIDKLPFPPPGDPVVEARSQRLEQEGKSAFRHFALPDAAIALKQGAGRLIRNEQDRGLLAVADARLVTMGYGKRLLAALPPMRRIQDEAEWDEALRGLAALGHAERVIGLDEDVERFLERGHVLVVGQGDLRAVDGGHVGAALVVVAGHVDLVLRQRVDDVRHALLRVARVARIGEAGDELAEGFERILGGLLVALGEILARQPGEQPEVVVEVDQPLQVERVVVGRARGVQLHEAVERGDRLGLLAALVLGVGLFQLGLLRERGAGGAALELLEQRDGLVVGVAVELVPRLGIDAVGAPARGLVFGGAGAAREHACGKQGGQERQGKTRHGSGFLTIGEGRPAHARRAPRRRPGMGRIPTIAPMFVHLRLHTEFSVVDGTARIDEVAKAASKDGQPALAITDLHNLFGAIKFYKEARGKGVKPVLGAEVSIEPETAGNPPGRILLLAQGRQGYLNLCELLARAWTRNVVKNVKKEGDKNNYALELEPMLYERVRKEEDVKTVIEMAQKLEGMTRNIGMHAGGVLIAPGKLTDFCPLYQQPGSESAVSQYDKDDVEAIGLVKFDFLGLATLTILEIAREFIMKRHKGQENFAFENIPLDDAPTYRLFSEGKTEAVFQFESRGMQGMLKEARPSRLEDLIALNALYRPGPMDLIPTFVNRKHGKEPVEYPHPLVEPVLAETYGIMVYQEQVMQTAQVLGGYSLGGADMLRRAMGKKKAEEMAEHREIFRKGAAEKGIGQDKADEVFDLMEKFAGYGFNKSHAAAYSLLAYHTGWLKVHYTAEFFCANMTVEMDDTDKLKVLYEDAMKMGLTFEPPDVNRGMYRFEPVTDKVIRYGLGAVKGTGQQAIEAIIAAREGRGVGPRGETKGPFASLFDFCARVDRTRLNKRTLEALIKAGAFDAIEMNRASLVASIDRAFDFANSLIANANQGGLFDMMGDDSHGSSTQDPALVEMLPWGVKERLTQEKTAVGFYLSGHLFDEVEKEVRRFIRTPIEELADSREPQIMAGIVSDFRVINGQRGRLALFKLDDKSAMIEASADENVINAHRDLLKEDEFVVLLGRLQLDHFSGGLRVKVMQGWDLASARAKFGRYLQVAVGDCAPDVQRLVREFPPKRQETPEGEVLVHGLRVRMGVRCRSEGQEAVAELQLGEGSRFFPSDAGLAAWSAEAGSGVVNVVMVRMATKPPSMTPTPPTGVPSRDDGGSVVLERRTQRTQPPQMYQVVMLNDDYTPMEFVIVVLQEFFGKDREAATQIMLKIHLDGKGVCGVYSRDVAATKVEQELEVSLHMAFVEARQQRHEFITVEHLLLALLDNPSAAEVLRACSANVEDLRSSLANFIKDNTPQVAGTDEVDTQPTLGFQRVIQRAIMHVQSTGNGKKEVTGANVLVAEWGEMTMCDAERRLLANALLDISNEWFVLVSESCIPIFNFNTTYRYLQNSSQSFVMAFDDPGPYGRGRYNWNMTPEVELTQWRKGSQWFEVNRELAIEIVRDTLYYPKFKEFCRPHCYVDEHYFPTMLTIEAPQSLANRSITWVDWSRGGAHPATFGRGDITEEFLRRVQEGRTCLYNGQNSTMCFLFARKFAPSALEPLLELAPTVLGFG

SEQ ID NO: 37872 - protein, 382 aa, Xanthomonas campestris pv. campestris str. ATCC 33913
MPVTTKLPKVGTTIFTVMSQLAAEHGAVNLGQGFPDFAVPQRLVDALGQAMAAGHNQYPPMTGVAALRQAIAGKAQRCYGAQVDADTEITVTSGATEAIFNAIHAVVRAGEEVIVLDPAYDCYEPAIDLAGARAVHVALDPQTFAVDWDALRAAITPKTRLLMINSPHNPSGAMLSAADMQTLTELLHGTDIFLLSDEVYEHIVFDGRRHESVLRWPELRARAFVISSFGKTYHCTGWKIGYAIAPPALSAEFRKVHQYNTFTSFGPAQHAFAAMLRDEPEHDEQLGAFYQAKRDRFREQLLTTRLVPLPVPGGYFQLVDYSAISDLPDTEFVKWLTVEKGVAAIPLSPFYETAPAGQRLARLCFAKNDATLDAAIARLQQL

SEQ ID NO: 37873 - protein, 518 aa, Oryza sativa (japonica cultivar-group)
MSMPSSRQAMGEINIEAMARPVSVDHRISIAYYFRIADNLLRQANIYREEKNLVDLYIILLRYSSLLCETIPKHRDYHAFKLREKEFLKKGPHNSDKLLNVVNELETLKPVVLRQIADLNRGVTQEPNSQSGTSAAISQMDHLTQSSCFTQPLVGSPTGLLKMPFSGGKHQVEPTQSGRPDSQLVKSYGNLPYPKEETLSRHSVLGPNGLHGKWTAPVTGIRIQYPSNAELTKSDVSSLVPSILNQDLLYGPSRSQDFPTNKNEDMQSVLSLDDGQLSLPVEEATSVSPGFEEEFSQLNIRQPSPPPVMAQVHPQHRAISTSTVADLGPGIASSSTGRYQNLHVPVTLMECFLRVAEANTANNLETCGILAGTLKKRTFYVTTLIIPKQRSTSDSCQATNEEEIFEVQDKGSLFTLGWIHTHPTQTCFLSSIDLHNHYSYQVMLPEAIAIVMAPTDTTRKHGIFHLTDPGGMGVIHDCQESGFHPHEEPLDGTSIYEHCSHVYMNPNVKFDMVDLREL

SEQ ID NO: 37874 - protein, 293 aa, Hordeum vulgare subsp. vulgare
MSPTLSLKLKKSSHPPQSSVSSSTMLRLFKKEAACQSPSTLPVAMDMGLEVSSSSPSSSSVSSSPEHAARRASPAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLAIAVAKEASSGAPSLSPSSGSDSAGSTGTSEPSANGVFEGPVVMDSEMFRLDLFPEMDLGSYYMSLAEALLMDPPPTATIIHAYEDNDDGGADVRLWSYSVDM

SEQ ID NO: 37875 - protein, 394 aa, Cryptococcus neoformans var. neoformans JEC21
MASTITRSIPRALRARTAPLSTAARLVARNALLTTAAPTVPRSPARFLLAEGQRRAASSDEGVTMMTVRDALNQAMEEEMIRDETVFIIGEEVARYNGAYKITKGLLDKFGEDRVIDTPITEAGFTGMAVGAALAGLRPVCEFMTWNFAMQSIDQIVNSGGKTHYMSGGNVPCPVVFRGPNGAAAGVGAQHSQDYCAWYGSVPGLKVISPWSASDCKGLLKSAIRDSNPVCFLENELLYGVQFPMTKEELSEDFLIPIGKAKIEKAGSDVTIVAHSKMVTHSLEAAELLEKEEGIKVEVINLRSIRPLDIETIITSVKKTKHLITVEGGFPAFGVGSEILAQICESTAFDFLDAPPERITGADVPTPYAESLETMAFPDTPLIAKVIRRHLYRQ

SEQ ID NO: 37876 - protein, 521 aa, Zea mays
MATQGQAAAGSASESGGSPAALAAAAAAAAAFPATSLYVGDLHESVQDAQLFDVFSQVGGVVSVRVCRDINSRKSLGYAYVNYNNQGDAARALELLNFTPINGKPIRIMYSNRDPSSRKSGTGNIFIKNLDKSIDNKALYDTFCAFGNILSCKIATDPSGESRGYGFVQFEKDESAQSAIDKLNGMLINDKKVFVGPFVRKQDRENVSSNIKFSNVYVKNLSDTVTDDELKEMFGKYGTITSAVVMRDSDGKSRCFGFVNFENADAAAQAVQELNGKIFNDKELYVGRAQQPMMPVNLYASKFVVFGDKVFSLEEISAMIFGKMKDTAEAYLGKKINDAIVFVPAYFNNAQRQTTKDAAFTEVDIFRDAAAIICHDQERCDEIFQLAASFLGFKIKNQRSILHLQWDPGGIGVMYRLEGKPNFKKGRMLGTVGPNSPFNLVEEANNRLDGVELAHRARALLSDVARRHMELDAAVEIAGEAAVLLWSRPFSVRIDSHITVDPVFLEVVEQENRSEMQLYLA

SEQ ID NO: 37877 - protein, 522 aa, Solibacter usitatus Ellin6076
MHVPLTPIRALYRAVDLFGRKIGVVSGDRRFTYAEFGERVERLAFGLLSEGVAPGDRVAFLSFNTHQLLEGYFGVPLVRAIVMPLNVRLTAAELTGILCHAEPRVVIYEADFAPVAKQLRAGCPGVQTWIEIGPAYDELLQRGRIARPDIFTFDERDIAELFYTSGSTGTPKGVTLSHRTLYMHMLSISATFYNDETMVELHTIPLFHANGWGRPQCATLHGLKQVMVRRFEPVHVLRLIQEEKATSMSLVPTMANALVHCAELANYDHSSLRQIHLGGAASSPELIERLEAAFHCPAMAGYGLTETSPAATSARDKSTLPEMSEPERIRRRAMTGWPLPGCEIRVVDLQMKDVPRDMESIGEIVMRGDIIMDGYFREPKATADVMTNGWLHTGDMAMWDEENYLHIVDRKKDIIISGGENISSIEVERAIASHPAVLECAVVSAPDPQWGEVPATFVTVKPGYALDECGLCEYLQGRIAKFKMPRRFHFSDTALPKTGTGKILKRELREKLWSNKDLRIQG

SEQ ID NO: 37878 - protein, 375 aa, Oryza sativa (japonica cultivar-group)
MPASDPAPAAAAAAYDRTAELRALDATLSGVRGLVASGATHLPRIFHNVVHGDQEPPEATAPSSAATTTTTVPVIDISGSRAAVVDAVRRAAAEWGFFQVTGHGVPLAAMDAAAGAARAFHESGGGEGSDKARLYSREPGRAVKYHCNFDLYQSPVANWRDTLYLRMAPDPPPAADLPEICRDALFEYAKQVKNLGNTLFELLSEGLGLKPSYLTDIECNQGQIILCHYYPPCPQPELAIGTSRHSDSGFLTILLQDDIGGLQILHEDRWVDVTPTPGAFIVNVADLLQLISNDNYKSVEHRVVAKNTEPRVSIACFFSTHFHPISTRMYGPIKELLSDENPPLYREALVRDYTARYYSVGLDGKFKTTLSEFRL

SEQ ID NO: 37879 - protein, 162 aa, Candida albicans SC5314
MSTVYFDVSADGQKLGKITFKLYDDVVPKTAENFRALCTGEKGFGYKGSIFHRVIPQFMLQGGDFTNFNGTGGKSIYGTKFADENFVKRHDRPGLLSMANAGPNTNGSQFFITTVPCPWLDGKHVVFGEVTDGLDIVKKIESFGSGSGATSKKIVIEESGQL

SEQ ID NO: 37880 - protein, 337 aa, Brassica napus
  misc_feature (90)..(90): Xaa can be any naturally occurring amino acid
  misc_feature (120)..(120): Xaa can be any naturally occurring amino acid
  misc_feature (149)..(149): Xaa can be any naturally occurring amino acid
MPKERKDRSVSHERLRSSPLYCESSRALKPSEKQVKEWEEARCPVCMEHPHNGILLICSSFDKGCRPYMCDTSHRHSNCFDQYRKAPKQXPTETEGGVASTDVNLRGEAASGVTVGEEKXEADQEKAKPKLTCPLCRGHIKEWVAVEAXARGFMNAKRRSCSSETCEFSGTYSDLRKHARLLHPGVRPSEADPERQRSWRRLERQRDLGDLLSTLQSSFAGGEGRSNNDDEIMSFDDGGWLTVFFLIRVFRPESSGGARSGSSSWSGTSRARSQVGVRRIRSSRLWGESYEGETGTSRRDGENNNNPSSDEQESGTQRRRVRRRFYIDDDDDDDEEA

SEQ ID NO: 37881 - protein, 202 aa, Triticum aestivum
GIPLASYAYASEEGKPSCSALIHKKNKKTSFIYRMNKLNLKTDSYMQGFKQHLTLGPKISETIKGKLSFGAKVLQAGSIEKIFRQYFVVEKDEKLLKAFQCYLSTTAGPIAGMLFISNEKIAFHSDRPLSLACPKGERTRVPYKVLIPAKRIKSASVRENLYNPDEKYIDLVTVDGFDFWFMGFISYEKSFRYLQHVISRFR

SEQ ID NO: 37882 - protein, 534 aa, Leptospira interrogans serovar Copenhageni str. Fiocruz L1-130
MRGKLGNGIGRMNEFTVGRAALGFISYLSKKNKKASIVIAYDSRRRSKEFAEVTAGIAAYLGVKVILFKEVTPTPILSYAIRYYKASGGVVITASHNPPEYNGFKAYLSDGGQLVPPDDQKIISKIESITDWKQIPILSTKDPIYKKMVKFAGKDCFTSYKKDLSKAGILSISLKPKDRTALKIVYSPLHGTGGKSMQELLNSFGYKNVFLVPEQKDPNGEFPTVKYPNPEEAEAMELSKKFAIQKNAHAFIATDPDADRLGIGVKNENGEYVLFNGNQIGSIMAAYLCEAYSAGKKKKKAVLVKTIVTTDLQENIAKKNKVKYKNVLTGFKFIAQVMAKIDKSKTDFFLFGGEESFGYLPVSFVRDKDSLSSALLLLEILTEKKDLFNYMDEIYLKYGLFQESLKSLTLEGSAGKEKIRKSLESLRTLDLLGKKIHHRKITGILDYKTQIAKGNASKSAFSGCPSSDVIQVILEGNAKLTIRPSGTEPKIKIYSSFQSLKAPKSKEEIKILTKDLLSEIKTSEEIFLQLAGLS

SEQ ID NO: 37883 - protein, 296 aa, Thermosynechococcus elongatus BP-1
MTDFGRVITAMITPFTADGAIAYDVAAKLAQHLVANGSDGIVVCGTTGESPTLTWEEEFQLFQTVQQAVAGKAKIIAGTGSNSTREAIDATAKAAELGLDGALLVVPYYNKPPQEGLYAHFQAIAKAVPDFPLMLYNIPGRTGQNLLPETVIRLAEYPNIVAIKEASGSLDQASTLRAALPPTFRIYAGDDSLTLPLLAVGGYGVVSVASHLVGLRIQEMIQAFVQGDTAKATAIHCQLLPLFKALFVTTNPIPIKAALSLQGWSVGEPRLPLTSASDAVISQLKAVLDDLGLLKS

SEQ ID NO: 37884 - protein, 255 aa, Prochlorococcus marinus str. MIT 9313
MDSSCSPKHGWFDSVAESYAQQRPYYPESLFTWISSKAASHQRCWDVACGSGQASLGLARHFDRVDASDLSPAQVAAAPAHSNIHYQVAAAEDSGFPNACMDAIVVAAAIHWLDVPRFNEEALKVARPGGLMVWVGYDPPQGAPPALQLWLDQLYSERLSSWWPPQRHHVDNHYQNLPFPTISKTLPQELCISLKWSCEQLIGYIGTWSALRKATQEGHDLLPQLSMELQRLWPADQKTIPLIFPLMGRWGYLAR

SEQ ID NO: 37885 - protein, 547 aa, Acinetobacter sp. ADP1
MVSAYDELPRTPANFVALSPLRYLERAAYIYPQQAAIIHGTRVITWQETYTRCRQFASQLKQLGIQKNDTVSVLLPNVPAMIEAHFAVPMSGAVLNTINTRLDAKTVAFMLEHAETKVLLVDQEFSELAKAALSLINQDIFVIDVDDAEYEKCFTPPIGAIEYEDWISEGDEYFEWILPNDEWDAISLNYTSGTTGNPKGVVYHHRGAYINAASNIIACGMTPRAKYLWTLPLFHCNGWCFAWTVAANGGTNICLRKVDPALVFKLIEQHKIDYFCGAPIVLSMLINAPKQHQIKFNHRVEVMVAGAAPPAAIIEGMRHLGVNVTHVYGLTETYGPSGLCAAQAGWSDLSIQEQAQLHARQGVPYPLQDSMRVLDPKTMQPVPADGQTLGEIMFRGNIVMKGYLKNPKATEEAFADGWFHSGDLAVCQPDGYAKITDRAKDVIISGGENISSLEVEEVLYRHPAVLTAAVVAKPDPQWQEVPCAFIELKAGVNITTEELIEHCKKDLARFKVPKDIVITEIPKTSTGKLQKFILRDWAKERATGQFT

SEQ ID NO: 37886 - protein, 342 aa, Yarrowia lipolytica CLIB122
MFRPTRLPRIQLLKPLFSRRFLSYTIAEAYSAKPRPPHQQSKPPAGENRPPTGEDAFFHVSLSKTDSPDSYTYSNTAFGVTDGVGGWAEMGVNSSDFSYYLCHESSNLAVEKAKEIEKEPAFAEKPLASLISPKQLLTNAYNKIVREKTVKAGGSTACIGVAGQDGQVAVANLGDSGFMVFRNGKLAGGSKAQTHAFNTPYQLAIIPDELKRSDERQGLRHIEDTPAMADQFSFTAEPGDVIVLATDGLTDNMSAQDTLKIVNETMLEHGSWIKDDKEGIKSSGEHKGAMDLARRIVLKAKSLSTNKQHLSPFAKEVQQVMKVHYMGGKPDDITVLVVIVNE

SEQ ID NO: 37887 - protein, 385 aa, Pseudomonas putida
MAIVIVGAGTAGVNAAFWLRQYGYKGGIRLLSRESVTPYQRPPLSKAFLTSETAESAIPLKPESFYTNNNISISLNTQIVSIDVGRKVVAAKDGEEYAYEKLILATGASARRLTCEGSELSGVCYLRSMEDAKNLRRKLVESASVVVLGGGVIGLEVASAAVGIGRRVTVIEAAPRVMARVVTPAAANLVRARLEAEGVGFKLNAKLTSIKGRNGHVNQCVLESGEKIQADLIIVGIGAIPELELATEAALEVSNGVVVDDQMRTSDTSIYAIGDCALARNLFFGTMVRLETIHNAVTQAQIVASSICGTSTPAPTPPRFWSDLKGMTLQGLGALKDYDKLVVAINNETVELEVLAYKQERLIATETINLPKRQGALGGSIKLPD

SEQ ID NO: 37888 - protein, 546 aa, Pseudomonas putida
MIGQMMRQPLIISSLIEHAARYHGNTEVVSVETSGEVTRAYWSGVALRARKLASALGKMGLTQSDRCATIAWNNVRHLEIYFGVSGAGMVCHTINPRLFIEQIAYVINHAEDKVIFFDETFLPIIAGLDGLLTTAKAFVLMGCANLKASAKIPGLLAYEDLIGQGDDDYVWPDVDEKEASSLCYTSGTTGNPKGVLYSHRSTVLHSMTTAMPDTLNLSARDTILPVVPMFHVNAWGIPHSAAMVGAKLVLPGPALDGASLAKLIDQERVSIALGVPVIWQGLLASLAESGSKAESLTRTVVGGSACPPSMIKEFNDLYGVEVIHAWGMTELSPFGTANTPLGHQVNLPWDEKLALRQSQGRPPYGVELKIVDDEGVTLSEDGVTKGNLMVRGHWVIKDYFRSTIGTTLSNGWFSTGDVATIDQDGFMTICDRAKDIIKSGGEWISTVELEGVAIAHPAIVDAAVIAVKHKKWDERPLLVAVRAPNSVLTDDELLSYFEGKVAKWQIPDAAIFIDELPRNGAGKILKNRLREKYADILSCNDSSALE

SEQ ID NO: 37889 - protein, 103 aa, Cryptococcus neoformans var. neoformans JEC21
MSGRGKGGKGLGKGGAKRHRKVLRDNIQGITKPAIRRLARRGGVKRISGLIYEETRGVLKIFLENVIRDSVTYTEHAKRKTVTSLDVVYALKRQGRTLYGFGA

SEQ ID NO: 37890 - protein, 359 aa, Arabidopsis thaliana; identical to SEQ ID NO: 1167

SEQ ID NO: 37891 - protein, 379 aa, Arabidopsis thaliana
MMSDLPLDLVEKILSRVPATSLKRLRSTCRRWNALLKDRRFTEKHFHKAPKESRVLMLKEYRVFPISVNLKVTPPSVDFKGALGYSHSNSEQVVITEVFHCDGLLLCTTNDDRLVVWNPCLGETKWIQLKVDYRRYVSIFALGYIQNNESCRSYKILWTWYSYDYNSSPPQRGLGFEIYEFSSDSSWRVLDDVNHDSVVNHNSIIRSGVSLKGNTYMLAYDIEENSKFLLMFDFTTERLKRLCLPHFQDVGEMDLSVREEQLSVLNWSRITSKMEIWITNNFDTEATLLWKRVHLDSQCNCVRIFSSLYFDEEKKVVLYCNVKDGETSKKVVYIIGEDDGHYIEIPFVKSIKIERLQLIHTTRWYSLIFNYVPSLFQIQ

SEQ ID NO: 37892 - protein, 180 aa, Nicotiana tabacum
MASSVLSSAAVATRTNVAQANMVAPFTGLKSAASFPVSRKQNLDITSIASNGGRVQCMQVWPPYGKKKYETLSYLPDLSEEQLLSEIEYLLKNGWVPCLEFETERGFVYRENNKSPGYYDGRYWTMWKLPMFGCTDATQVLAEVGEAKKAYPEAWIRIIGFDNVRQVQCISFIAYKPEGY

SEQ ID NO: 37893 - protein, 357 aa, Aspergillus nidulans FGSC A4
MPAQHRPLWWYGWNALRGGNPTFLTPDQVPVPDLSGKWIIITGSNSGIGLEAAKAFASAGANLILGCREPAAWETHPAAAAEECQTLARVNGHTESVIEWWKIDMADLSAVDAFAQRWLDTGRALDILCNNAGMGPTGSRKPILTKDGLEILHQVNFTSHVLLTLRVLDSLAKAPQPRIVCTTSCFHFRGYFDLDHFNGELGMAGDPYPNNKLYFQVWLTELHSRLLASPNYRHVTVNGINPGYVNSGIWNNPLSETKNTWIDTAYKFWKFVASILAISPQQGSLAIVYAATSAEFGPDPVTQGVGEIGGKGGGHYINRIWEGEAMPHCSDEECRKEVWEKVGKELGLEERGLGHWV

SEQ ID NO: 37894 - protein, 220 aa, Brassica napus
MGDTAEDQDDQTMVEAVGVPSFSELLMLSDGFLSSSEDHHREVNGGDGGEDSFGFVFSGTNGSKMLCFSGDCQNGDESLFQEPSLPSGVSVSDPSSCTINTCKNSNDTCTNEKSTKSSNKRTGSGNGQNMDHNQKPSKKCKKNQDKTTVGIAKVRKERLGERIAALQQLVSPYGKTDAASVLHEARGYIKFLQDQIQVLCSPYLINYSLDGGAVTGDVTA

SEQ ID NO: 37895 - protein, 416 aa, Cryptococcus neoformans var. neoformans JEC21
MAENYQKKELLALMNTGGNKVCVDCNAPSPQWASVSYGIFICLECSGVHRGFGVHISFVRSITMDKWSDEQLNKMKTGGNEKFKDFMENYGPEGGYTKGMGMQEKYNSWAAAQYREKLTAECAGQPWSASSPPANFGLPSRPASSQTTRKSRAAGGITGSSLNPSRTNSPSIPQGSDDFYGQKSANEAFFERMGNANATRPDHLPPSQGGKYSGFGSTLEPDVASSHPSYSLSSHAAPTLDEFQRNPLGALTKGWGLFSSAIVSAGREINNAVVQPGLDRAQALAAGENSEEWKRYVNQASAQAKDAGGWLGQRAHEGWEGLNDVAKTKGGVDLNESFGKLGLGKSSIPGSRGYGQVGALDRAEDGLLSPHGAGNDDEEDFFESWGATPTASTTSATTGAKSIADKGKKKDDEKNE

SEQ ID NO: 37896 - protein, 581 aa, Aspergillus nidulans FGSC A4
MSLARFKHLPRATQGPIKCPYKGAALLGNANYNKGSAHSERERREFNLHGLLPPNIQTLDEQVERAYQQYKSRPDDLAKNTFMASMKSQNQVLYYRLLQTHLKEMFSVIYTPTEADAIQNYSRLFRKPEGCYLSIRDHGEKEIDECFANFSGGDDVDYIVVSDGEQWQILGIGDQGVGAILISVAKLVITTACAGIHPSRQLPVVLDCGTNNEELLNDKLYLGLRQRRAQGEEYDKFVDKFVRMARKRFPNAYIHLCSEDFGLQNAKRILDRYRSQLPCFNDDIQGTGCVTLAALMAGLHVSNVKLKDVRVVCYGSGSAGTGIADQISDAIATEAGFSKSDALKQIWCIDKQGLLLKSQGDALTASQKYFAKEDNEWPEGQDIDLYSVIKHVKPHVLIGTSTKPGSFTEETIREMAKHVDRPIIFPLSNPTRLHEAQPQDITKWTDGKALIATGSPFPPVEYNGTKTEIVSAECNNSTAFPGIGLGAVLSRASRLSEKMVVAASKALAAKAPALEDPNKPLLPDVENVRELSLNVAKAVIQTAVKEGLAQEEGIPEDEKDLEDWIRAQMWEATYRDLEKAD

SEQ ID NO: 37897 - protein, 302 aa, Pseudoalteromonas tunicata D2
MRPNWHGVYPAVSTQFNQDSTIDFAQNAKMWENLIDEGVHGIIVCGTVGENCSLTADEKRQVMKAAVEVVAGRVPVLSGVAETTTAAAVAYAKDAQEIGIDGLMVLPGMVYRSTEAEAIVHYQQVARSTTLPIMIYNNPVAYGVDVSIAGMKELAAEPNIVSVKEATTDTRRITELFREFGDRFIIFGGVDDIALESLMLGATGWISGLTNVFPRESVAIFNLAQQGRYSEALEIWRWFLPLLRLDTIPTLVQCIKFAEELAGRGSERVRAPRLPLAGQERAYVERLYKEALENRIDLAKFN

SEQ ID NO: 37898 - protein, 359 aa, Solanum lycopersicum
MRPAANSTNAASSMPPPSSAGQRSRPRRRTDLTLPLPQRDVALAVPLPLPPTSSSSSSSPLPTPLHFSELERVNRIGSGTGGTVYKVLHRPTGRLYALKVIYGNHEDSVRLQMCREIEILRDVDNPNVVRCHDMFDHNGEIQVLLEFMDKGSLEGIHIPLEQPLSDLTRQVLSGLYYLHRRKIVHRDIKPSNLLINSRREVKIADFGVSRVLAQTMDPCNSSVGTIAYMSPERINTDLNHGQYDGYAGDIWSLGVSILEFYLGRFPFSVGRQGDWASLMCAICMSQPPEAPPSASREFREFIACCLQRDPARRWTAGQLLRHPFITQNSTGTTHTGPATTTTSLSHPLLPPPPHFSSSS

SEQ ID NO: 37899 - protein, 396 aa, Candida albicans SC5314
MQPVTSEESSGVSTRESFEIEDDSLQSDSNLNPLGVSLYGSKTIESIVYILGWYFFSLSISIYNKWMFGSGLDFKFPIIITSFHQLCLCILSCVVLYLKPNLRPLHTTNVSTPTSTNGISGQTIGKFLQSLLMDFPIYIRQIFPCSIASAGDIGLSNVSISLITLSLYTMLKTSSLMFVLLFGLLFKLEKFNWRLIYIVAIMTISVIMMTDKPESGSSSSSSSSVGIFMVLMASMLSGLRWSFTQILLKKNPYTPNSISTIFYISPGMCIILFSLGLIFEGWTNFINLEIWITKGLFTTIILLIIPGVLAFMMTLCEFKLLTVAQVITLSVAGIFKELLTIILSSIIFGDKLSLINILGLILTFMDILWYNYYRYYENEDHNNGNSKSVLREDLER

SEQ ID NO: 37900 - protein, 332 aa, Ehrlichia ruminantium str. Welgevonden
MKNLTVREALCAAIREEMERDHTVLIMGEEVGEYQGAYKVTQGLLEQFGPDRVIDTPITEHGFAGIGIGAAFSGLRPIVEFMTFNFAMQAIDQIINSAAKTSYMSGGQLSCPIVFRGPNGAAARVGAQHSQCYASWYAHIPGLKVIAPYFAADCKGLLKAAIRDPNPIIFLENEITYGHTHEVPDAVLTKDYISEIGKAAIVKEGTDITITAFSLQVKSALEAAELLEKEGINAEVIDLRTLRPLDVEQILNSIKKTNRIISIEEGWPYSGIGSEIAALTMEHAFDYLDAPMIRITAKDIPLPYAANLEKLALPQIQDILEAARTLCIRNYK

SEQ ID NO: 37901 - protein, 295 aa, Alkaliphilus metalliredigenes QYMF
MVNIHGIVPAMVTPMNEDETINEKELRAQVNRQIEAGVHGLFCLGTNGEFYILNQEEKLKVMEIVIHENAGRLPVFVGTGAIGTKETVQLSQKAQELGADVLSVITPYFAAASQNEIYEHFKTVANSVDIPILPYNIPMRTGANINVDTLKRLSQIPNITGVKDSSGNFDNILQYIESTDDSFAVLSGNDSLVLWTLQAGGKGAICGIANLFPHTMASIYELWKAGEFAEAKKVQDSIREIRNCFKLGNPNTIVKIATNLLGHPVGPCRKPFYTNSESIREEIQRVLHTYYKDFK

SEQ ID NO: 37902 - protein, 486 aa, Vibrio vulnificus CMCP6
MEVTAHYIGGKPFVGDTGESFATLNPATGEVLAHIEQADERVLGHAIESAKLGFSVWSSMSAAERSRCLLKAAQLIRDHNDELAELEVRDTGKPIQEASVVDIATGADVIEYFAGLVNGLGGEQQSLGSNQFFYTRREPLGICAGIGAWNYPIQIAMWKAAPALAAGNAMIFKPSEETPLSALKLAELFTQAGVPDGVFNVVQGDYRVGQMLTAHPEIDKVSFTGESGTGKKVMADSAATLKPVTMELGGKSPLIIFDDADLDDAVSAAMVANFYTQGEVCTHGTRVYVQRAMYDAFVEQLKERTEKLIVGDPMNMETQIGSLISKSHLEKVLGAISSAKESGATLLTGGFQVTERGLEKGCFVAPTVFVDCRDEMPHVQNEIFGPVMSVLVFDDEDEVIARANNTQYGLAAGVFTQNLSKAHRVIHQLQAGICWINTWGNSPAEMPVGGYKLSGIGRENGQETLLHYTQTKSVFVELGAFDSPYA

SEQ ID NO: 37903 - protein, 438 aa, Oryza sativa (indica cultivar-group)
MDLRVAAPASVAAAARCGTSLARPWPARAVPIGGAYRLIDVPMSNCINSGINKVYILTQFNSASLNRHLSRAYNFSNGVAFGDGFVEVLAATQTPGSEGKRWFQGTADAVRQFDWLFDDAKAKDIDDVLILSGDHLYRMDYMDFVQSHRQRGADISICCLPIDDSRASDFGLMKIDDTGRVIAFSEKPKGDDLKAMQVDTTVLGLPQDEAKEKPYIASMGVYIFKKEILLNLLRWRFPTANDFGSEIIPASAKEINVKAYLFNDYWEDIGTIKSFFEANLSLAEQPPRFSFYDANKPMYTSRRNLPPSMINNSKITDSIISHGCFLDSCRIEHSVVGIRSRIGSNVHLKDTVMLGADFYETDLERGELLAEGKVPIGIGENTKIQNCIIDKNARIGKNVTISNSEGVQEADRTSEGFYIRSGITIVLKNSIIADGLVI

SEQ ID NO: 37904 - protein, 768 aa, Acinetobacter sp. ADP1
MVTVREQLPERLSELAEETTVEHAEKTQLDLASWFKRVSEILDGAELKQLEKVAQLTLKKVLETTVNHPSNTFTTGIGMADILAHLHVDEDTLSAAVLYRSVREGIIPIEEVRDKFGEQVHSLVTGTLAMGKLSEMIEKNKRLEDHFNNNQREHLSGIYKMLIAVTEDVRVVLIKLAERTFTLRELAKSSRERQERVAREILTIYAPLAHRLGIAQLKWELEDLAFRYLAPERYKEIATLLNEKRLEREQYIQSVILKLKTELSEYGINAEITGRVKHIYSIYRKMKSKNLSFDQLYDIRALRVLVQNIPECYHSLGIVHQIWRHIPHQFDDYITNPKANGYRSLHTAVIAENKSLEVQIRTHEMHEEAELGVCSHFNYKEGSKTTDRSFNHRLHSLRSVLEHYQERNETTVHKNDDEAENFEELQNFEDFEKIYVFSRDGDIKELPRGSTVLDFAYHVHTEVGNKCYAARVNQRYVPLTYTLKTGEQVEILTKKDREPNRDWLVNSLGYIRTARARDKLRHWFRQQDRSKNLEIGKEILNKELSRLAIHPKSIDLSDYCAHFNVKSGDDVLIALVSGDVSLHSLINQINRQMHLDQDEPELVLKPTLNPRASHTLSAHGILIDGLDNVELHIAQCCQPVHGESIGGYITLNRGVSIHKVGCPDYQRMIKNEPERAVEADWEMQPTRGQSVQIVIDAYDRRGLLKDLTQVIFSDQINIRQVNTISEADGIANMKLLIEVKGLAQLSRLLARLEQQPGIISARRLIQGN

SEQ ID NO: 37905 - protein, 686 aa, Oryza sativa (japonica cultivar-group)
MDETAGAEQVRGRNGGGQSGPAERGGRSRAGRRWAAGGAERGRWSGGGRSGSGKKRGTAPSSRRQPAAAHLSAARRDALPGGGRRLASLLPRSSSLAARRLLPLSRRRSTPPLPRRPSPSPALPMLSSSPTAPVVASTSLAAPTTPPSFTPSLPCVPAHRRCPVTTPAPHRQKVERWKKRGVRVTCRSIRRASPPLSSSAAAHWSEKLPLPLPPIDAAAAVAEAPLPMPPLLWRTRMRTGTPWPWPRTTSTSTSASSATPRTPAPPPLPGGSSAWRTSSSSCHRHASQHGRIFSSSGDHRCTPPFLPAGHRPSPGRHCRILIAGTAPGGPAIARVDLFRPPPSPIPLYCPGFLLQLAALAGGRWSRRPSSSPLSPEEERKGERDEERETGRKEEEEERLYACTEETTFISNSTWKSEKIPKPLNPRLMIRNPPRSVPFRSQLAVPGVTGSTPSDLGDSANHFTFHPLPSVLPEKRNISVQALPSSMAVAIEAPFHVLAVDDSLPDRKLIERLLKTSSFQVTTVDSGSKALEFLGLHDHEDSPISTQSDQQEVGVNLIITDYCMPGMTGYDLLKKIKESSYLRDIPVVIMSSDNIPSRINRCLEEGADEFFLKPVRLSDMSKLKPHILKSRCKEHYQQEQHLQSNSESNNSSNPTSENSSSSTSTNSHKRKAVDEEILPHTIRPRHS

SEQ ID NO: 37906 - protein, 356 aa, Matthiola incana
MVAVERVESLAESGIKSIPKEYIRPKEELESINDVFQEEKKEDGPQVPTIDLQNIESEDEETREKCVEELKKAALDWGVMHLINHGIPVDLMERVKKSGQEFFGLPVEEKEKYANDQASGKIQGYGSKLANNASGQLEWEDYFFHLVYPQDKRDLSLWPKTPTDYIEATSEYAKCLRSLATKVFKALSIGLGLEPHRLEKQVGGFEDLLLQMKINYYPKCPQPELALGVEAHTDVSALTFILHNMVPGLQLFYEGKWVTAKCVPDSIIMHIGDTLEILSNGKFKSILHRGLVNKEKVRVSWAVFCEPPKDKIVLKPLPEMVSVESPAKFPPRTFAQHIEHKLFRKEQEELVSEKKA

SEQ ID NO: 37907 - protein, 413 aa, Nicotiana tabacum
MPEKPLFGKYELGKLLGCGASAKVYHAREINNGQSVAIKMINKNNKDNIPNENIEREISILRQLRHPYIVKLYEVLATKSKIYFVMEYVKGGELFTKIADHGRFSEDLSRKYFQQLISALNYCHSRGIYHRDLKPENILIDENGDLKISDFGLSATTDQIQKFDGLLHTVCGSPAYVAPEILTIKGYDGAKTDIWSCGIILYVMIAGYLPFYDQNLMLMYKKIYKGEFKCPKWMSPDVIRILSRLLDTNPATRITIDEIIKDPWFRKGLKFIKFAGEEEDKYSLSSNCLNAFDLISFSQGLDISGLFKSNNPANDLERTVVEQSPESVIERVEEMAKKENFRLRKKKEWGIEMKVQNGKLTMSVDIYRLTERFVIVEVKREAGNGDLYTDLWRNKLKAVILGQQIAEIQDSGS

SEQ ID NO: 37908 - protein, 516 aa, Glycine max
  misc_feature (182)..(182): Xaa can be any naturally occurring amino acid
MDSAFARTRSMFFAASLLLYIFAVTTTTFASIHIYDHEPFRELGNSYLLAGGSEGIVTSQPYSVHDDGRSYIRFENITFRRTKASAKARGSVPVHIIIFEAADRNDIGGSAYGGQRAICCTPDLAKMGVCKQGEIIRRPSATDINWPVILDVQFKGRSKTASLDSQKVFITKTGMYNLFFCXCEPKLKGIVMSGKTVWKNPDGYLPGRMAPLKKFYVFMTLAYVCLSIIWFFQYVRFWDDVLQLQHCITAVIALGLFEMILWYFEYVNFNNTGMRPIVLTTWVVTVGAIRKSISRLLILSVSMGYGVVRPTLGGLTSKVLLLGITYFLASELLNITEYVGTINDVSGRARLLLVLPDAFLDAFLILWIFTSLSRTLEQLQAKRSSVKLDIYRKFSNALAVTVISSVAWIGYEVYFKATDPFNERWQSAWIITAFWDILAFALLCVICYLWAPSQSSQRYAYSEEVGEDSDDEEAQSLTKGKQEGQGELSLVRQEKNGGTDGSFDQEDESEEEDKRE

SEQ ID NO: 37909 - protein, 779 aa, Wolbachia endosymbiont of Drosophila melanogaster
MKFTLSWLLEYLETNASLEEITDKLTHIGLEVEDVIDNSRLTGFIVAEVLEVVPHPNADKLKLCKVDDGSKILQIVCGANNVREGMKTVLASLGSTLPESDFTIKPTKIRGVLSEGMLCSASELALVQEESEGIIELSDDYKVGDKFFNCDPVIDINVTPNRGDCLGIYGIARDLAATGIGTLKTLSIPQLTSSINSPIDVEVTDGESFISGIYIANVKNQESPKWLKDRLESIGMRSISAIVDITNYIMISFSRPMHAYDAKKIEGELTVRKANDGEKFAGLNGKEYLLNKDISVIAGDKNIHGIAGIIGGKCSECTLETTDIFLESAWFDPISITKSSRQLGISTDASYRFARSVDPEFTFDGLNLAAKMILDLCGGETSSVVSAGSLDSADTKVSFDYQDVNKFGSVSVSPDEVLDILTKLGFSIDKKTEGNWNVQVPSWRPDVTIPADLIEEVTRIYGYDKIKEEPLPNNVEEVDSTYDNLRILMTNRGFHEVLTWSFMSESTAEKFGYSNKLFIIDNPFNNSFNIMRPSIMPNLLQVTADNIAHGISDLAIFEIGPIYDGEAQSKYVLSGIRSGNNLPRNHYNTDRKVDVFDAKADCIAALEFFNVNCDNLTIEKAEKEHYHPGKSGTLSFKNKVAGYFGELHPNILDLFDIKQKVVGFEVILENIENLPVSRKKFIDYKYQSVKRDFAFIVNKDVEVGNIINVIKKSSELITEVLIFDVYHGNNIEPNKMSIALSVTFCSPIHTLTEKEIQKESSAIVNLVCENTGGTLRTYR

SEQ ID NO: 37910 - protein, 151 aa, Solanum palustre
  misc_feature (7)..(7): Xaa can be any naturally occurring amino acid
RKSFYYXAENNVVFEGILLNPSMVTPGAEHKEKATPDTIAKYTLTMLKRRVPPAVPGIMFLSGGQSEVEATLNLHAMNQSPNPWHVSFSYARALQNTVLKTWQGRPENVDAAQRALLIRAKANSLAQLGKYSAEGESEEAKKGMFVKGYTY

SEQ ID NO: 37911 - protein, 353 aa, Zea mays
MDPPKPPSSVASSSGPETPNPHAFTCELPHSIYALAFSPVAPVLASGSFLEDLHNRVSLLSFDPVRPSAASFRALPALSFDHPYPPTKLQFNPRAAAPSLLASSADTLRIWHTPLDDLSDTAPAPELRSVLDNRKASSEFCAPLTSFDWNEVEPRRIGTASIDTTCTVWDIDRGVVETQLIAHDKAVHDIAWGEAGVFASVSADGSVRVFDLRDKEHSTIVYESPRPDTPLLRLAWNRSDLRYMAALLMDSSAVVVLDIRAPGVPVAELHRHRACANAVAWAPQATRHLCSAGDDGQALIWELPETAAAVPAEGIDPVLVYDAGAEINQLQWAAAHPDWMAIAFENKVQLLRV

SEQ ID NO: 37912 - protein, 295 aa, Vibrio pommerensis
MKLTGIIAYPITPFTKDGTQPDLNKLAHNIELLLQNGCDAIAPLGSTGESAYLSFAEWQQVAQHSVQVVAGCVPVIIGISELTTEQAIHKARFAEEIGADAIMVIPVSYWKLTDDEICGYYKAIAAEVSLPVMIYNNPATSGVDMSPELIVKMFRGIPQITMVKESTGDIQRMHKIHQLSSGELPFYNGSNPLALEALCAGASGWCTAAPNLLGMLPKELFSHIQAGDLQAAKENFYRQLPLLSFIVSGGLPKTVKAGLALKGVEVGQPPRKPLTAANEQEIATLSRLLKQILPE

SEQ ID NO: 37913 - protein, 76 aa, Arabidopsis thaliana
  misc_feature (26)..(28): Xaa can be any naturally occurring amino acid
  misc_feature (31)..(31): Xaa can be any naturally occurring amino acid
  misc_feature (59)..(59): Xaa can be any naturally occurring amino acid
MASSMFSSTAVFTCGGQSTIVAPFTXXXSSXSFPVTRKANNYITWITSNLLIVICIKKXPPIRNNNFHTLSYLPDL

SEQ ID NO: 37914 - protein, 157 aa, Blastopirellula marina DSM 3645
MRRDDIRNIVIIAHVDHGKTTLVDCLLKQSGQFRDSQLSSERILDSNDQEKERGITILAKNIALPFKGVKVNIIDTPGHADFGGEVERVLSMADGALVLVDAAEGPMPQTRFVLSKALECKLQPIVVINKVDKPDARPMKWSTKCSISSGSGATTRD

SEQ ID NO: 37915 - protein, 420 aa, Blastopirellula marina DSM 3645
MEPLLDLVLKHIPGPEVEPEEPLQILCTTLAWSEFVGRIAIGRIKAGRIKKGQNVAVTKVGDKLQRAKISSVQVFENLGRVDVDSAEAGDVVALCGIEDIDIGDTICDLEKPNGLPRLLVDEPTLEMVFTINTSPFVGKDGKYVTSRNLRDRLYKELERNVALRVRDTASADAFAVAGRGVLHLAVLVETMRREGFELAVSKPQVIMREVDGRKEEPFENLVVEVPSIKMGPVMEMVGERRGEMVEMSPRGDFTQVVFSIPARGLIGIRTKMLNATQGEAIINHRFESYRPISGDVPRRPNGVLISNSTGKAVGFSLFNLQDRSELFIRPGEELYEGMIVGENARNEDMVVNPIREKKLTNMRASGSDENIVLKPPRQMSLEAALEYIEDDELVEVTPNFIRLRKMTLKEADRRRTGRKG

SEQ ID NO: 37916 - protein, 404 aa, Leptospira interrogans serovar Copenhageni str. Fiocruz L1-130
MDLSAKRLNVIEPSPTLVITAKANELKKKGEDIVSFGAGEPDFETPSHIRDAAKNAIDRGMTRYTAVSGTVELKEAIVHKFKRDNGLDYDKSQVIVGTGGKQVIYNYFLATLNAGDEVIIPAPYWVSYADIVRLAEGVPVIVNTTPEANFQITPEQLKKVITPKTKCLILNSPSNPTGAGYTKKDIEALGEVVLSTGIQVMSDDIYEKIVYDGFVFSNLAMLSPELKKQTFVINGVSKTYSMTGWRIGYGAGDLNIVKNMETIQSQSTSNPSSISQAAAQAAIAGDQSCVEEMRKAFQVRRDLIVSLLNAIPGVKCNNPQGAFYVFPYLTDVYKTTGFIKLKQGSSETSLSKIFCSTLLEKYKVAAVPGIAFGEDQALRLSYAMGENDIRRGVERIAEMIRDLN

SEQ ID NO: 37917 - protein, 334 aa, Lachancea kluyveri
MAPHVNKKQKLSNSLEQLKATGTVVVSDTGDFESIAKYTPQDATTNPSLILAAAKKENYAKLIDTAVEYGKKQGKTLEDKVDQAVDMLLVEFGKAILNIVPGRVSTEVDARLSFDKDATVAKALHIIKLYEDAGISRERVLIKIASTWEGIQAAKELEEKHGIHVNLTLLFSFSQAVAAAEAKVTLISPFVGRILDWYKASTGKDYTAETDPGVKSVRKIFNYYKKYGYDTIVMGASFRNVGEIKALAGVDFLTISPGLLDELMSSEDPVPQVLDAEAAKSEDLAKVSFISDEAKFRFELNEDAMATEKLSEGIRKFSADIVTLFELIEKKIKA

SEQ ID NO: 37918 - protein, 297 aa, Haemophilus ducreyi 35000HP
MIMSVPLFHGSIVALLTPMTHGEVNYQEIKNLVEYHIQAGSHGIVAMGTTGESTTLSIDEHVKVIKKTVEFADGRIPIIAGSGSNATSEAVTITKLLNGVGVVGCLSVVPYYNKPTQEGLYLHYKAIAESTELPQILYNVPSRTGCDLKPETIGRLSEIPNIIGVKEATGDLTRLPLIKTLAGEDFIFLSGDDATGLESMKLGGQGVISVTNNLAAADMAKMCELVLAGNFAEAEAINQRLIDLHHDLFIEANPIPVKWAAYKLGLISEPSLRLPLTPLSETAQPTILKALQKAGLI

SEQ ID NO: 37919 - protein, 905 aa, Acidovorax sp. JS42
MNRHPISVCGAYSGAMNAPTPLATLATLAAAASPDTDPQETAEWRDALQALVATAGPERARFLLDELNRLAGQLRVDWRPGLNTPYVNTVSVQEQGVFPGDLAIEERLASIMRWNALAMVVRANQAYGELGGHIASYASAADLFESGFNHFFRAREGLGEGQHRGDLVFFQPHSAPGVYARAFLEGRLSEQDLMHYRQEITAPAQGARGLSSYPHPWLMPDFWQFPTGSMGIGPISSIYHARFMRYLTHRNLLDCSARKVWGVFGDGEMDEPESMSALTLAAREGLDNLVWVVNCNLQRLDGPVRGNGRIIDELERLFAGAGWNVVKLVWGSDWDGLFARDLTGALVRTLEGTVDGQMQTFAAKDGRYNRDHFFGQTPELAALAQGMTDEQIDRLKRGGHDLVKIHAAYAAAARHRGQPTVILAHTKKGYGMGQAGQGKMTTHSQKKLDDADLIEFRNRFNLPLSDAQATGLAFYKPGDDSPEMQYLRRQRQALGGYLPRRETVCDVLPVPPLASYAQFALAADGKEMSTTMAFVRMLGTLLKDVTLGPRIVPIVADEARTFGMANLFKQVGIYSSVGQRYAPEDIGSVLSYREALDGQILEEGISEAGAIASWTAAATSYSVHGLAMLPFYIYYSMFGFQRVGDAIWAAADQRARGFLLGATSGRTTLGGEGLQHQDGSSHLAAATIPNCKAYDPAFAGELAVIVDAGMREMVAEQRDVFYYVTLMNENYAQPDLPAEAHAGVLRGCYVFNSYQRLLDGRGGANSSQENVTLLGSGAILTEVIKAAQRLADEGIAATVVSVTSWSELARDGMACEAGRDRGDAGDAKPWLTQVLEGTSGPVIAATDYVRAVPESVRAYVPAGRRYRALGTDGFGRSDTRAALRAYFGVDAASIAQAARAALTGG

SEQ ID NO: 37920 - protein, 233 aa, Oryza sativa (indica cultivar-group)
MTISLVIQHILHPDFQSSSQAHDFVGVKMQRAIQAIGSHGSLLKSAVLRHISAPKPSILPAVYSRSMSVSSAQIEESGFETATVADILKSKGKSADGSWLWCTTDDSVYDAVKSMTQHNVGALVVVKPGQDKSIAGIVTERDYLRKIIVQGRSSKSTKVGDIMTEENQLITVKPDTRVLQAMQLMTEKRIRHIPVIDGTGMVGMVSIGDIVRAVVSEHREELNRLNAYIQGGY

SEQ ID NO: 37921 - protein, 504 aa, Solanum tuberosum
MAISTLARRKATTFLSSRLLYSTSKYSFSLTRGFASGSDENDVVVIGGGPGGYVAAIKAAQLGLKTTCIEKRGTLGGTCLNVGCIPSKALLHSSHMFHEAQHSFANHGVKFSSVEVDLPAMMGQKDKAVSNLTRGIEGLFKKNKVNYVKGYGKFLSPSEISVDTVEGGNSVVKGKNIIIATGSDVKGLPGITIDEKKIVSSTGALALTEIPKRLVVIGAGYIGLEMGSVWGRLGSEVTVVEFASDIVPTMDGEVRKQFQRALEKQKMKFMLNTKVVSVDATGDGVKLTLEPSAGGDQTILEADVVLVSAGRVPFTSGLGLDTIGVETDKAGRILVNERFATNVPGVHAIGDVIPGPMLAHKAEEDGVACVEFIAGKEGHVDYDMVPGVVYTHPEVAYVGKTEEQVKSLGVDYRVGKFPFLANSRAKAIDDAEGIVKVIAEKESDKILGVHIMSPNAGELIHEAVLALQYGASSEDIARTCHAHPTMSEALKEAAMATYDKPIHM

SEQ ID NO: 37922 - protein, 278 aa, Desulfitobacterium hafniense Y51
MDSEKVVNMVPKMKMSKSFITFGLVIVLLVILALDAFVIVNAGQRGIVLQLGAVRPIVLTEGLHFKIPFVQSVVPMEVRVQKSQSEQTAASKDLQIVTTTVAVNFHLDPIQVNKLYQNVGLSYGERIVDPAIGEAVKAITAQYTAEELISKRSEVSAKIKETLASKLATYYMVLDEINITEFKFSQEFNNAIEQKQIAEQQALKANLDLQRIEIEAKQKVEQAKAEAESLRLQKQEVTPELVQLREIEAKIKAIEKWDGKLPNVTGGAVPFIDVNSGQ

SEQ ID NO: 37923 - protein, 412 aa, Shewanella sp. MR-7
MKRLAIPLQGAQMLFVAFGALVLMPLLTGLDTSVALFTAGIGTLLFQLITKRQVPIFLASSFAFIAPILYGVQTWGIPSTMGGIIAAGLVYILLGALVKVRGTDFIHRLLPPVVVGPVIIIIGLGLAPVAVNMALGKSGDGSLTLVPTNTALIISLASLCTTIAVAIFAKGLLKVMPILAGIVVGYGLSLAFGIVDFAVVAAASWIAIPKFVAPEFNWHAIAFMIPVAIAPAVEHIGDILAISNVTGKDFMKKPGLHRTLTGDGVATIAAAAFGGPPNTTYSEVTGAVTLTRNFDPKIMTWTAITAITLAFVGKLGALMQTIPVPVMGGIMCLLFGSIAAVGLNTLIRNHVDLSEPRNLSIVGVTLVFGIGGMAFGIGSFSLTGISLCGIVAITMNLLLPASKHHERDAASH

SEQ ID NO: 37924 - protein, 317 aa, Haemophilus influenzae R2846
MTTQLDSLRNMTVVVADTGDIDAIKKYQPQDATTNPSLILSASALPQYAPLIDEAVAYAKAQSNDKAQQLIDAEDKLAVNIGLEILKIVPGRISTEVDARLSYNTQATVEKARKLIALYNAAGISNDRILIKIASTWQGIRAAEILEKEGINCNLTLLFSEAQARACAEAGVYLISPFVGRILDWYKANSDKKEYAPAEDPGVISVTKIYNYYKEYGYNTVVMGASFRNVGEITELAGCDRLTIAPALLKELQENSTALIRKLEYKGEVKAKPQPLTEAEFYWQHNSDAMAVEKLAEGIRKFAIDQEKLETMLSAKL

SEQ ID NO: 37925 - protein, 394 aa, Nicotiana tabacum
MSCAVAISNSPAFSPASRVPVTKSLCKSASFSSSSPNSSKTLTKFPSFTSSSSSSSSSSSSSPSSPSLQFQILRLQKPLQASASTNRIRNSTECSTSAPVLKRKRPAKLDIPVVSTTFGNFPATPAAATADFVEVEGDGYYVCCKRGRRGPMEDRYSALVDLQGDSKEGIFGIFDGHGGAKAAEFAAENLNKNIMDELVNRKDDDVVEALKNGYLKTDSEFLNQEFRGGSCCVTALVRNGDLVVSNAGDCRAVVSRGGIAETLTSDHKPSRKDEKDRIKTSGGYVDCCNGVWRIQGSLAVSRGIGDRYLKQWIIAEPETKVVGLHPELEFLVLASDGLWDKVSNQEAVDAARPLCTGISKPQPLSASKSLIDLAVSRGSVDDISVMIIQLQRFC

SEQ ID NO: 37926 - protein, 174 aa, Codonopsis lanceolata
MSNPKVFFDIVIGKMKAGRIVMELFADSTPKTAENFRALCTGEKGIGLSGKPLHYKGSIFHRIIPNFMCQGGDFTRFNGTGGESIYGAKFADENFKNKHTGPGILSMANSGPNTNGSQFFICTEKTSWLDGKHVVFGKVVDGYSVVKEMEKVGSDGGNSKSTVEIEECGQIQEN

SEQ ID NO: 37927 - protein, 168 aa, Burkholderia thailandensis E264
MIVMGVSGAGKSHIGEMLAKRLSCSYTDGDAFHSAANKAKMRQGTPLIDEDRWPWLRSVRSAIEDKRRSNDTAVFACSSLKRAYREMLRSGDTDVCFVYLKGSPEVLRARLNRRANHFFDPSLLESQFKTLEEPGPREAIEVSIELTPDQIIDHVLRKISARLRCAQN

SEQ ID NO: 37928 - protein, 539 aa, Clostridium acetobutylicum ATCC 824
MIKKGISASKGYAIGHVFIKADNEVKIVEKKISDIESEKARLQGAVEKAREQLTKIKEKAEKDLGADKAAVFESHMMFLDDPDFIGSAENIISDEMINAEKALENVMKNYVAIFEGIEDEYVKERIADVKDVGNRVLQNLAGNDMTSLADVDNNTVVVAHDLTPSDTAQLDKNRVIGFLTNIGGRTSHSAIMARTLEIPAVVGLQDIVESVKNGDTIVVDGAEGIAIINPDEATLKEYEAKKAEYEKKQEKLRELINVETRTKEGKRVEVCGNIGKAKDVEAVLQNGGDGVGLFRTEFLYMDRDQMPTEDEQFEAYKAVVEKMGEKPVVIRTLDIGGDKKLPYLPLPEEMNPFLGYRAIRLCLGRKDIFKIQLRALLRASVYGNLKIMFPMISSLEEFLSAKEVLKECMGELDKEGKKYNAKLETGIMVEIPAAAVNSEELAKYVDFFSIGTNDLIQYTLAADRMNEKVSYLYNPMHPAVLKLIKMTIQSAHKEGKWCGMCGEMAGDEKAIPTLVEYGLDEFSMSASSILTAKELIMKA

SEQ ID NO: 37929 - protein, 411 aa, Desulfitobacterium hafniense DCB-2
MSLRENALKLHADHRGKIKIALKVPCRDYNDLSLAYSPGVAEPCMEIAQDPELVNTYTNRANCVAVVSNGTAVLGLGDIGARAAMPVMEGKSLLFKNFAGVDSFPICLDTKNIDKIVEVVKLLEPTFGGINLEDIKAPECFEIEEKLKAVYDGPVFHDDQHGTAVVTLAAMFNALKIVNKELKDVKIVTSGAGAAGMAIVKLLMDCGLQNVIMCDTKGTIYKGRAEGMNKYKEEIALRTNPAMVKGSLGEALKGADVFIGISVGNTVTQEMIRTMAKDAIVFAQANPVPEIMPEEAKEAGAAVIGTGRSDYPNQINNILSFPGIFRGTFDVEAREINGPMKIAAAEAIASIVSPEELSAEYIIPKAFDKRVAPAVAAAVAKAAMESGVAKRKVDPEQVALNLTSLLAQEGK

SEQ ID NO: 37930 - protein, 1023 aa, Burkholderia thailandensis E264
  misc_feature (197)..(197): Xaa can be any naturally occurring amino acid
MLQLSRRQFLKLSATTLAGSSLALLGFSPAEALAEVRQYKLARTVETRNTCPYCSVGCGILMYGLGDGAKNATSSIIHIEGDPDHPVNRGTLCPKGASLIDFIHSPSRLTQPEYRAAGSDKWQPISWSDALDRIAKLMKADRDANFVETTDDGKKVNRWLTTGMLAASAGSNEVGYLTHKTVRSMGMLAFDNQARVXHGPTVAGLAPTFGRGAMTNHWVDIKNADVILVMGGNAAEAHPCGFKWVTEAKAHRNARLVVVDPRFTRTASVADYYAPIRTGTDIAFLGGVINYLLTNDKIQHEYVKNYTDFPFIVREDFAFNDGIYSGYDADKHAYPDKSTWEYERGDDGFVKVDDTLAHPRCVYNLLKQHYSRYTPEMVEKICGTPKDKFLKVCEMLATTAVPGRAGTVLYALGWTHHSVGAQMIRTGAMVQLLLGNIGIAGGGMNALRGHSNIQGLTDLGLMSNLLPGYMTLPMQAEQDFDAYIQKRAQQPLRPNQLSYWKNYRAFHVSFMKAWWGDAVSAENNWGYDYLPKLDKPYDLLQTIELMHAGKMNGYICQGFNPLAAAPSKRKTSEALAKLKWLVIMDPLATETSEFWKNHGEHNDVDSSKIQTEVFRLPTSCFAEERGSLVNSGRVLQWHWQGAEPPGQAKSDLEIMSGIFLRMRDMYRKDGGKYPDPIVNLSWPYANPESPTPEELAMEFNGRALADLPDPKDPTKTLVKKGEQLAGFAQLKDDGTTASGCWIFCGAWTQAGNQMARRDNSDPTGIGQTLNWAWAWPANRRILYNRASCDVAGKPFDPTRKLIGWNGKTWTGADVPDYKIDEPPETGMGPFIMNPEGVARFFARAAMNEGPFPEHYEPFETPLAANPLHPNNPQALNNPAARVFPDDRAAFGKVDQFPHVATTYRLTEHFHYWTKHARLNAIIQPEQFVEIGEELAKEVGVAHGDRVKVSSNRGHIVAVALVTKRIKPLTVDGRKVQTVGIPLHWGFKGLTKPGYLANTLTPSVGDGNSQTPEFKSFLVKVEKA

SEQ ID NO: 37931 - protein, 437 aa, Thiobacillus denitrificans ATCC 25259
MTEKHEIVIVGGGAGGLELATRLGDKLGGKKRANITLIDASPSHLWKPLLYEVAAGSLDSYAERLEYLAQGHWHGFTFRLGRMDGLDRARQEVSVAPTFDEEGREIIPRRSFRYDTLVIAVGSVGNDFGVPGVKEHCIMLDTPEQAREFHRRHINACLRANTQTEAVAPGQLTVGIVGAGATGVELAAELHDTTRELSSYGMDQIEPDKSLKLLIVEASDRILPGLPPRLSAAAAERLAELGVEMHTRERIVEVRENGMVTADGKLIPASMMVWSAGIKAPDFLKDIDGLETNRINQLVVRPTLQTTRDDNIFAFGDCAACPLPDGSGFVPPRAQAAHQQASMLVKSICRRFRGKSLPEYVYRDYGSLVALGRFSTVGNLMGGLTGGSIMIEGALARLVYWSLHKMHQVALHGWFKTSLTTYAHFISTPTRARIKLH

SEQ ID NO: 37932 - protein, 205 aa, Haemophilus influenzae R2846
MSEIKLNYHKTHFLTSAPNIRSIPEDTGIEIAFAGRSNAGKSTALNALTNQKNLARTSKTPGRTQLINLFEVEPNYKLVDLPGYGYAAVPEQMKIQWQKSLGEYLQKRECLSGLVVLMDIRHPLKDLDQQMIEWAVSADLPILLLLTKADKLSQSARSKQVKMVREAILPFQGDIQVEAFSAQNKIGIDKLAAKLDFWFSPLFAK

SEQ ID NO: 37933 - protein, 870 aa, Oryza sativa (indica cultivar-group)
MLGGIIGGLTGNKNARLKGSLVLMRKNALDINDFGATVIDGISEFLGRGVTCQLVSSSLVDPNNGNRGRVGTEASLEQWLTSLPSLTTGESKFGVTFEWEVEKMGIPGAIIVKNNHAAEFFLKTITLDNVPGHGAVVFVANSWIYPASKYRYNRVFFSNDTSLPSKMPAALKPYRDDELRNLRGDDQQGPYQEHDRVYRYDVYNDLGEPDSGNPRPVLGGSPDRPYPRRGRTGRKPTKTDPTAESRLSLLENIYVPRDERFGHLKMADFLGYSIKALVDGIVPAIRTYVDLTPGEFDSFKDILKLYEGGLKLPSIPALEELRKRFPLQLVKDLIPAGGDYLLKLPMPHVIREDKKAWMTDDEFAREILAGVNPMVIARLTEFPPRSRLDPARYGDQTSTITAAHVERGLEGLTVQQAIDGNRLYVVDHHDHFMPYLLDINSLDDNFIYATRTLLFLRGDGTLAPLAIELSLPHLQDDGLITARSTVYTPAARGGTGAGAVEWWVWQLAKAYVNVNDYCWHQLISHWLNTHAVMEPFVIATNRQLSVAHPVHKLLLPHYRDTMTINALARQTLINGGGIFEMTVFPRKHALAMSSAFYKDWSFADQALPDDLVKRGVAVPDPASPYKVRLLIEDYPYANDGLAVWHAIEQWATEYLAIYYPNDGVLQGDAELQAWWKEVREVGHGDIKDATWWPEMKTVAELVKACATIIWIGSALHAAVNFGQYPYAGYLPNRPSVSRRPMPEPGTKEYDELARDPEKVFVRTITKQMQAIVGISLLEILSKHSSDEVYLGQRDTPEWTSDAKALEAFKRFGARLTEIESRVVAMNKDPHRKNRVGPTNFPYTLLYPNTSDLKGDAAGLSARGIPNSISI

SEQ ID NO: 37934 - protein, 1154 aa, Bradyrhizobium japonicum USDA 110
MPKRTDITTILIIGAGPIVIGQACEFDYSGTQAVKTLKEEGYRIVLVNSNPATIMTDPELADATYIEPITPEIVAKIIEKERHVIPGGFALLPTMGGQTALNCALSLRRQGTLEKFHVEMIGATADAIDKAEDRQLFREAMTKIGLETPKSRLANASALKKSFRDKYLAEREKLSGAALEELERQWTLGESDRRKRYQEYAFGQAMMALSEIGLPAIIRPSFTMGGTGGGIAYNKEEFLDIIERGLDASPTNEVLIEESVLGWKEYEMEVVRDKKDNCIIVCSIENLDPMGVHTGDSITVAPALTLTDKEYQIMRDASLAVLREIGVETGGSNVQFGVNPDDGRMVVIEMNPRVSRSSALASKATGFPIAKVAAKLAVGYTLDEIANDITGGATPASFEPTIDYVVTKVPRFAFEKFPGASTTLTTSMKSVGEVMAIGRTFQESLQKALRGLETGLTGLDEIEIEGLGQHDDKNAIRAALGTPTPNRLLQVAQAMRLGWSNEDIFNSCKIDPWFLGEMRGIVDMEEKVRKNGLPGNAFGMRTLKAMGFSDARLAVLADTTEAEVTAKRHALDVRPVYKRIDTCAAEFASPTAYMYSTYEAPFAGAPADESTPSDKKKVIILGGGPNRIGQGIEFDYCCCHACFALHDAGYESIMVNCNPETVSTDYDTADRLYFEPLTAEDVLEIIAKERTNGTLHGVIVQFGGQTPLKLARALEAAEVPILGTSPDAIDLAEDRDRFKRVLDKLRLKQPKNGIAYSVEQARLVSADLGLPLVVRPSYVLGGRAMQIIREENQLNDYLLGTLPELVPADVKARYPNDKTGQINTVLGKNPLLFDRYLSDATEIDVDCLSDGKDTFIVGIMEHIEEAGIHSGDSACSLPPHSLDAKMIEELERQTRELALGLDVVGLMNVQYAIKDGEIYVLEVNPRASRTVPFVAKVVGTPVAKIAARIMAGEKLADFGLKKAQLKHVGVKESVFPFARFPGVDTVLGPEMRSTGEVMGIDRSFAVAFAKSQLGGGTRVPRKGTVFVSVRESDKTRIAEAVRELHSLGFKVLATSGTQRFLTDQGIPTEKVNKVLEGRPHIVDAITNGDVQLVFNTTEGPQALADSRSLRRAALLHKVPYYTTLSGAVAAAQGIRAYLGGDLEVRTLQSYFSET

SEQ ID NO: 37935 - protein, 522 aa, Oryza sativa (japonica cultivar-group)
MANRRKFSQAGGGGGGGVFDPFGTKQAVSSLRKGGRLPVYVAGVFFVIFVIIMYGEDIRSLTLDPIARAGTTPARIVEPVVTEERHVARVNPPRREVSSAEKAAALPLDVDERPKLATPTPTEAAKEVPKVEKIRKPKKPKTTKKKPRKPRPAKKTVAAAAGGLLGVPETCDLSKGEWVFDNTSYPLYREEQCEFLTSQVTCMRNGRRDDTYQKWRWQPKDCSMPRFDAKLFMERLRGKRFMFVGDSLNRNQWESMVCLVQSAMSPGKKYVTWEDQRVVFHAVEYNATVEFYWAPFLVESNSDDPKIHSIQHRIIKADAIAAHAQNWRGVDYLVFNTYIWWMNTLNMKIMRPGGQSWEEHDEVVRIEAYRKVLTTWASWVNDNIDPARTSVFFMSISPLHISPEVWGNPGGIRCAKETMPLLNWHGPIWLGTDWDMFHAAANVSRTAATRVPITFVDVTTMSERRKDGHTSVHTIRQGKVLTPEQQADPGTYADCIHWCLPGVPDIWNLILYTRIMSRPQLV

SEQ ID NO: 37936 - protein, 273 aa, Actinobacillus pleuropneumoniae serovar 1 str. 4074
MQNLRYPVDSKPPFGLTLLLAAQHLLAALGGIIAVPLVIGNVLKLPTPDTIVLVNAALLVSGIVTIIQCQGIGPIGLRLPSVMGTSFTFVAAALAIGFSEHGVAGIMGASLVGSLVMIIGSFFMPYVRKLFPPVVTGVVVMMIGLSLIPVAVDWFAGGQKGDPHYADPANLAMATFVLVLVVILVQWGKGIFSAAAIVIGMMVGYVVALALGWITFDAVKNSDAFAIPQPLHFGLAFPISGIIGMSIAYLVTIVESSGNLFAPGYPTQTENYR

SEQ ID NO: 37937 - protein, 594 aa, Arabidopsis thaliana
MDRISNLPNEIICHIVSFLSAKEAAFASILSKRWRNLFTIVIKLQFDDSVKNEGSLKDFVDGVLALPTSSRVRSCSLECRREFDPTHYDDFNRCICALLKRGILDLKLDICAGRRYSLPLEVFTCKTLVKLELGSDFGGFVVDLVPEDAFLPALETLLLNYIRFKDLRRCAFEKLLSACLVLKELVIHNMEWERWKWSGNISSPTLERLTISHVDLYECEFTRINLDTPNLTYLELSDAVPDDYPIVNLDSLVEVKLDLTLMVDHKYHGYVDDNDTISSNPTNLINGLRNVEIMNLQSPNTFQAFSYFHEAIPVFKNLYHLTITNNDTVIGFCWEFLPFVIKKCPNLKTLVIDGPLHYNEDRPKSVCHCLSGYSFLLSCPLEVLQITDYSGTPGEVEQLKHFLEKLSGLKLVKLHSLTRFGSDKKKLLMLPRASSKCKIKHYDSLENALLPSLKTLILDSVKFYDRCGCCAFQKLLSACPVLVESVMRNLEWEDWEWSGCASSQTLERLTIDHRYWAEHNLESFTFDTPSLTYLDYNAHVPGSYPTVNLDSLVEAKLNLGFTTDLVEDDDDPFTSDPTNLIKGLRNVEILRLWM

SEQ ID NO: 37938 - protein, 295 aa, Bacillus cereus ATCC 10987
MTNVTGTERVKRGMAEMQKGGVIMDVINAEQAKIAEEAGAVAVMALERVPADIRAAGGVSRMADPTIVEEVMGAVSIPVMAKCRIGHLVEARVLESLGVDYIDESEVLTPADEVYHLNKRDYTVPFVCGCRDIGEAARRIAEGASMLRTKGEPGTGNIVEAVRHMRQVNAEIRQVASLREDELMTYAKNTGAPYEVLLEIKRLGRLPVVNFAAGGVATPADAALMMQLGADGVFVGSGIFKSENPAKFARAIVEATTHYEDYELIASLSKGLGNAMKGIEISTLLPEQRMQERGW

SEQ ID NO: 37939 - protein, 173 aa, Triticum aestivum
MALQFPDELLKDAPAVARALRAELGGGAKLFVMADTAYNSCCVDEVGASNIDAQCVVHYGHSCMSPTSNLPAFFVFGKAPLDISLCCRSLLDCSRESSKPVLVLCGLEYAHALDDLKRATMELCKSDCQNSEIHYAEVLCSEMSPSSSSTGEEQCPQCNGSTHNDGLPADNDD

SEQ ID NO: 37940 - protein, 755 aa, Ehrlichia ruminantium str. Welgevonden
MGDLENNGFDAKKREALEFHCKGLKPGKVSLMPTKPLLTQRDLSLAYSPGVAVPCLEIAENPDLVYKYTARGNYVAVISNGTAVLGLGNIGPLASKPVMEGKAVLFKRFADIDAIDLEVDTSDVDEFVNAIKYLGLSWGGINLEDIRAPECFIIEEKLSKIMDIPVFHDDQHGTAIIVSAGLINALDITGKNIKDIKIVVNGAGAAGIACLEMIKLIGVPAENITLCDQNGVIYKDRQLGMNEWKAKHAIDTKNRSLKDALVMADVFLGLSVKDVLSENMLLSMNKDPIIFALANPDPEINPDIARKIRPDAIIATGRSDYNNQINNVMGFPYIFRGALDVQARCVNSAMKVAAANAIAMLAREYVSDEVSDAYGGRKMNYGKDYIIPTPFDPRLITVVAPAVAKSAIESGVARRNIENWDEYVKQLESRLSSTSNVLNMMYSSVKRDPKKVIFSEGEEEKIIQAAVQWRNQGYGVPILVGRIDKVHEGFERLGIKDMKGIEIANAAISENNNKYTDYLYKQLQREGYLYRSCVRDVKTDRNVFAACMLACGDGDILITGLTRGYTVSIHDVQKVIKPKGVMFGLSIIVMKERTIFIADTAIHESPTPEQVAEIAIQASMQARKMGHEPRVAFISSSNFGSHSQKDARRMRKAIEILDNCNVNFEYDGEMSIDVALNPELLTLYPFCRLTSSANVLIMPTLHSASISSKLLREATGVPVIGPILVGMEKPVQIVQMSSSVSEILNLTVLAPSINN

SEQ ID NO: 37941 - protein, 525 aa, Corynebacterium diphtheriae NCTC 13129
MTTSNVVFDPQKSELLAGCFSDSNKPATLYINGTWQPADSGEVRTITNPADGSVVGVVSEAGEHDTERAIAVARETFDRGEWLAVPAVERGKILLKVGALLREHKDEFARAESADTGKRLAESELDMDDIANAFDYFGTLAQHEAGRVVDPGDPNVRSRIDVEPVGVCGLITPWNYPLLQVSWKVAPALAAGNTFVLKQAELTPHTAMMLMTLFERAGVPAGVANLITGAGANCGNPLSTSPLVDMVSFTGGLVTGRLIARNAAETVKRVALELGGKNPNVIFADADFDAAVDNALNGAFVHSGQVCSAGSRIVVEESIHDRFVEELTRRAAQIKLGGPLDTAAETGPLISLEHRDKVDAYVVAAKEQGATITTGGRVADASDNEGSHATGNTDLAAGAFYLPTIIDNCTRDMDCVHDEAFGPTVTVETFRTEEEAIAIANDTEYGLAGAVWTQDAGKAERVARKLRHGTIWINDFHPYLPQAEWGGMKQSGNGRELGPTGLAEYQEHKHVYQNIAPAVTGWFAG

SEQ ID NO: 37942 - protein, 1327 aa, Mycobacterium bovis AF2122/97
MRCGIVVNVTGPPPTIDRRYHDAVIVGLDNVVDKATRVHAAAWTKFLDDYLTRRPQRTGEDHCPLTHDDYRRFLAGKPDSVADFLAARGIRLPPGSPTDLTDDTVYGLQNLERQTFLQLLNTGVPEGKSIASFARRLQVAGVRVAAHTSHRNYGHTLDATGLAEVFAVFVDGAVTAELGLPAEPNPAGLIETAKRLGANPGRCVVIDSCQTGLRAGRNGGFALVIAVDAHGDAENLLSSGADAVVADLAAVTVGSGDAAISTIPDALQVYSQLKRLLTGRRPAVFLDFDGTLSDIVERPEAATLVDGAAEALRALAAQCPVAVISGRDLADVRNRVKVDGLWLAGSHGFELVAPDGSHHQNAAATAAIDGLAEAAAQLADALREIAGAVVEHKRFAVAVHYRNVADDSVDNLIAAVRRLGHAAGLRVTTGRKVVELRPDIAWDKGKALDWIGERLGPAEVGPDLRLPIYIGDDLTDEDAFDAVRFTGVGIVVRHNEHGDRRSAATFRLECPYTVCQFLSQLACDLQEAVQHDDPWTLVFHGYDPGQERLREALCAVGNGYLGSRGCAPESAESEAHYPGTYVAGVYNQLTDHIEGCTVDNESLVNLPNWLSLTFRIDGGAWFNVDTVELLSYRQTFDLRRATLTRSLRFRDAGGRVTTMTQERFASMNRPNLVALQTRIESENWSGTVDFRSLVDGGVHNTLVDRYRQLSSQHLTTAEIEVLADSVLLRTQTSQSGIAIAVAARSTLWRDGQRVDAQYRVARDTNRGGHDIQVTLSAGQSVTLEKVATIFTSRDAATLTAAISAQRCLGEAGRYAELCQQHVRAWARLWERCAIDLTGNTEELRLVRLHLLHLLQTISPHTAELDAGVPARGLNGEAYRGHVFWDALFVAPVLSLRMPKVARSLLDYRYRRLPAARRAAHRAGHLGAMYPWQSGSDGSEVSQQLHLNPRSGRWTPDPSDRAHHVGLAVAYNAWHYYQVTGDRQYLVDCGAELLVEIARFWVGLAKLDDSRGRYLIRGVIGPDEFHSGYPGNEYDGIDNNAYTNVMAVWVILRAMEALDLLPLTDRRHLIEKLGLTTQERDQWDDVSRRMFVPFHDGVISQFEGYSELAELDWDHYRHRYGNIQRLDRILEAEGDSVNNYQASKQADALMLLYLLSSDELIGLLARLGYRFAPTQIPGTVDYYLARTSDGSTLSAVVHAWVLARANRSNAMEYFRQVLRSDIADVQGGTTQEGIHLAAMAGSIDLPQRCYSGLELRDDRLVLSPQWPEALGPLEFPFVYRRHQLSLRISGRSATLTAESGDAEPIEVECRGHVQRLRCGHTIEVGCSR

SEQ ID NO: 37943 - protein, 227 aa, Thiobacillus denitrificans ATCC 25259
MKSFPLPIKAVVIDLDGTLLNTAPDLAHAAELMMAELGRPCPSLETISTYIGNGVSRLVKRVLTGEMDAEPDPALFAQAIASYQKHYGEHVSLHSRPFDGVVEGLQAFKAMGLHMACITNKAEQFTVPLLKGTGLYDYFELILSGDTLPKRKPDPLPLLHACEVFGVAPAELLLIGDSLNDTQAARAAGCPVFCVPYGYNRGRPVTELDLDAVVPSLAEAALMVTKA

SEQ ID NO: 37944 - protein, 568 aa, Debaryomyces hansenii CBS767
MFSRIGSRRLLSTKSRLLNTIKTVEVKGGSAVPPPPPPPPPKKRRSIWKTTKRVTLFSILAAVGTLSYKIYSESHPGEQQKQVPYFENGQKKKTLVILGSGWGSISLLKNLDTTLYNVVVVSPRNYFLFTPLLPSCPTGTVELRSIIEPVRAITRKSPGEVLYLEAEATDIDPVNNKITIKQSTTIQSGHSGKDTSSSKSTVSEYTGIEEITTSLNYDYLVVGVGAQPSTFGIPGVAEHSTFLKEVSDSMSIRKRLMDVIEAANILPKGDEDRKRLLSIVVCGGGPTGVEVAGELQDYIDQDLKKWMPEVASELKVILVEALPNVLNMFNKKLVDYTKQVFQDTNIDLKTNTMVKNVSDKHVTCLVKDPKDGSTEIQEIPYGMLIWATGNAPRAITHNLTSKIDEQRNARRGLLVDERLLVDGTDNIYALGDCTFTKYAPTAQVAFQEGTFLAKHFEKVHELEATKFTIQNPTATDNIDRLKKKFSILQDKLPVFEYVNQGALAYIGSEKAVADLVWGDWSNVTTGGTLTFLFWRSAYVYMCLSVKNQVLVCLDWAKVSIFGRDCSKE

SEQ ID NO: 37945 - protein, 1016 aa, Kluyveromyces lactis NRRL Y-1140
MSSSSTSGTNNVTSLFKRKEIIGRGKFGVVYKAFHVKTQQVYAIKVLNLDNTEDEVEDIRKEIQFLSSLKQTPNITHYYGSYLIDTKLWVIMEYCAGGSLRTLLRPGIIEEKYIGVIMREILVALISIHRDNVIHRDIKAANILIANNGSVKLCDFGVAAQLSQSMLKRQTMAGTPYWMAPEVIMEGVYYDTKVDIWSLGITAYEIATGNPPYCHMEAIRAMQMITKSKPPRLEGREYSQPLKEFIALCLDEDPKERPYAEELFKSKLIKQEKGTSTVILKELITRYLLFREKNEQYKHEEESHTSSKQNPNSSIEGNASQDAGSFTEKEPEDIDIKWDFDSLSSREYILENDINVEAIPEEADWIKYSPQEVNYAYPEEEYYNSNKPYFPYYQGSTIGRTFNNNPNTAHLSTIQANNNNSANLNATAPTNQHNTHFNKHYQHTTTGTANHLSRHTGTTTHGTSKRSETKASKQLLQLFEDKPEEVYDFPKLSKTVSSFNIQPNGTPHVDHDNDSRPDMRNLHSQSTPALSILQTNFKSNLAGPGSSSVLPTPIEIEIPEELPVSKESVLTMNTKPRSSTVSSMSQKATPVLQRRPTVSGQPSSQLTSLRSDIMNGINTNSKTPGNDDTNGINVPSTSSNNAPNVGAKNLFGSNLTQARSPSPTRALADVSPEKKLLDSVLHQSAVYSNTPPVMKQMHTPNDVLLQSMNTPAEKKETEGEPSRINRDFKKQHPHLKLQMPSPTTLVGSNKLLDSTTQLDDASHQHQPNSASTAPGAVTAQTVNQFGINTSNAQISVAMTPVGEKRFGDFTKPRKRSTSASTSSRNSSITNDHVYNPANAILASNGNNSASATNGPTNNGASGTAATTTTTTASMLATTVSSTNPGTSNGAISIPSASTSAGPLPSVSMTPLSIPPGTSNTASTAGSSTVVGGSAGGNISTMSALSSTTPSSLGFIMDPPPKSLSMDMFIDVHDDHRIDKKPIALSELDSLLKMFEDGLTVIEQTLRSSLPQDSPEE

SEQ ID NO: 37946 - protein, 316 aa, Bradyrhizobium japonicum USDA 110
MPSVSGFFPRRRLDMTDLRTHLHGLWLPLVTPFRDGKLDETSLRRLTRHYCGQAVDGFILGATSGEGMTLRDAELERLVAIVRDEMAAGRRTLPICLGMSGADTSRLKERLDETADWPIDGYLIASPYYVRPSQRGLLAHFEALADHAAWPLALYNIPYRCAVNITNQTMLRLAEHPNIVGLKDCGASREQSIALLRDRPDGFRVLTGEDANYLEALTDGADGGIVLSAHVETATFAAVYAELKRGNRDAAQARWQEVAELTRLLFTEPSPAPAKHWLWRSGLIDSPEVRLPMVEVSSELAATIDREIERRMKVAA

SEQ ID NO: 37947 - protein, 260 aa, Brassica napus
  misc_feature (251)..(251): Xaa can be any naturally occurring amino acid
TRELGREVGIIMKQTETSLHVRMLTSKIRTPLDRHTILYTTLVELSKTLGLKNCAVWIPNEIKTEMNLTHELRPGHRDDNAGGGGGYGGGFSIPITESDVVRIKRSEEVNMLNPGSALASVTSRGKPDSQTVGIRVPMLRVCNFKGGTPEAIHMCYAILVCVLPSRSWTYQELEIVKVVADQVAVAISHAVILEESQLMREKLAEQNRALQVARENALRANQAKAAFEEMMGDAMRRPVRSTLGLLPMILXDGGLQENQR

SEQ ID NO: 37948 - protein, 478 aa, Bacillus anthracis str. Sterne
MRKTMSQVNNTNNELKRTMKSRHLFMIALGGVIGTELFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFMINALSARSYAETEFWFSSIKVSAIIAFIILGGAAMFGLIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNISIPYAADIMNFVILTAVLSVANSGLYAATRMLWSLSKNEMAPAFLKKLSSRGIPLNALILTISISAFSLLTSVVAAETVYLWLISISGVITIIVWMSICVSQFFFRKHYVADGGRLEDLKFKTPLYPLVPILGFGLYGIILVSLIFIPDQRLGIYCTVPFIIFCYTYYHFKVKKRISTNTSSENKISETI

SEQ ID NO: 37949 - protein, 560 aa, Coccidioides immitis RS
MASAVSWKNRVWSRREIEGLIADGRKIIIFGDQVLKADAWIPYHPGGNKSILHMVGRDATDEITALHSDEAQAHMQKYVIGRVHGRWENFLPPIQGGTFRTLVSKHVDDEALYAEDDASSSGESTPPSPVFDTEETGKEVYLKRAGNDTPISRASSISSSEPELGPLRSAEASTAHAISSDLSKYPRLDKRSQDEVVSKYRQLDEKLRSEGLYQCPYVSYAVEFVRYSILFVLFLTFLHYSYYTLSAVFLGLLWHLLAFTVHDAGHLSITHGFHTDSCIGIFVADFLGGLSVGWWKRNHNVHHIATNSPEHDPDIQHVPFFAISPRFFTSLRSSYYDRDMKFDAIARFFVKHQHYLYYPILLMGRFNLYRLAWSYLLDPAQAPRKGSAWWHRYLEMTGQVFFWYWFGYRTLYLSIPTWSSRIAFLLISHMVTAPLHVQLTLSHFAMSSADVGIHESFAQKMVRTTMDVDCPPWLDFVHGGLQFQVVHHLFPRLPRHNLRRAQKYVKEFCDDVGIPYVIFGFTQGNKEVISRLGEVARQLRVLDECRKVAAKNLIEGRHGH

SEQ ID NO: 37950 - protein, 411 aa, Deinococcus radiodurans R1
MARQHRLRAGRPVAAEACMSGGETGRTLRALFMSVSLGAGHDQAQQAVKQAFAERGVELLGAEHDSVEYLSTFERSFTVDLYEFELRYAPWLYRGFYWLTDQDQPWNIISRMFTWLGMGAFKDELRELRPEVVINSFWAPAAVCDTLRAQTGQRFLNCLIVTDYRAHLHWARRETDLLMVASEETRRQMLERGVRPEQVEVTGIPISPAFREVLAADRWALRAELFSEMSLRPGVPLLLLSGGGRGHYAAAADVLTELGNLGRAVQVLVPASRQGEGTETIGGATVHHLGFRRDLPRLLAASDLVVGKAGGLTVAEATALGVPLVIYAPIPGQEEHNADFLERHGAGLWARARHDVRPLVLRALDPAEHARLSAGARAVGIPDAADRVAGAILRRLGDGLGDELGDSRGPA

SEQ ID NO: 37951 - protein, 570 aa, Salmonella enterica subsp. enterica serovar Paratyphi A str.
MSEKHPGPLVVEGKLSDAERMKRESNFLRGTIAEDLNDGLTGGFHGDNFLLIRFHGMYQQDDRDIRAERAAQKLEPRHAMLLRCRLPGGVITTTQWKAIDKFAADNTIYGSIRLTNRQTFQFHGILKKNVKPVHQMLHSVGLDALATANDMNRNVLCTSNPYESQLHAEAYEWAKKISEHLLPRTRAYAEIWLDQEKVATTDEEPILGQTYLPRKFKTTVVIPPQNDIDLHANDMNLVAIAENGKLVGFNLLVGGGLSIEHGNKKTYARTASEFGYLPLEHTLAVAEAVVTTQRDWGNRTDRKNAKTKYTLERVGVDTFKEEVERRAGIKFEPIRPYEFTGRGDRIGWVKGIDNNWHLTLFIENGRILDYSGRPLKTGLLEIAKIHQGEFRITANQNLIIASVPESQKAKIETLARDHGLMNAVKPQRENSMACVSFPTCPLAMAEAERFLPSFTDKVEAILEKHGIPDEHIVMRVTGCPNGCGRAMLAEIGLVGKAPGRYNLHLGGNRIGTRIPRMYKENITEPDILASLGELIGRWAKEREAGEGFGDFTVRAGIIRPVLDPARDFWE

SEQ ID NO: 37952 - protein, 509 aa, Arabidopsis thaliana
MFIVFSFSHTRKTCEFCDRIQLSISQGFENPNLSMEANKKAKPSYGDVISNLPNDLLCRILSYLSTKEAALTSILSKRWSNLLLSIPILDFDDSVLLKPQKGQRKNVFFKAFVDRLLSQRVETSSHVQRVSLKCRQGGVEPDCVIKWILTTVRDLGVLDLSLCIDFGIFHLPFNVFRSKTLVKLRIGTMIRLSQFPSDVVSPTLNSLVLDLVEFRDGDKVEFRQILLAFPSLQSLRVHESNKWKFWNGSASSRTLKSLVYRSDDDSSAPKPCVSFDTPSLVYLDYSDMVADKYENLKFDSLVEARLDLHLTAFQIMRKPNNIGIVSGDVTTLFKGIRNVKILCLSPDALEALYYRGEKIPMFNNLITLSLGSDKPHGSPFIFWKLLPSLLNNSLKLETLIIKGLVHYVAEGWEGLSPMTPMSRLCFSWDTVSDSLSSSAMKVLEISGYKGTWQELNQMKRFLGNLSRLEVVRVYHKAMDDKERINVMFDLFLLPKVSSECDIQVMKETA

SEQ ID NO: 37953 - protein, 114 aa, Brassica napus
HKTTLGSQILRSCKARDFAKAGLGKGLKIDDLVISDEEMEMYVDLHPITNTSPYTVLETLSLAKAAILFRQLGLRHLCVVPKTPGRPPIVGILTRHDFMPEHVLGLYPHIDPLK

SEQ ID NO: 37954 - protein, 584 aa, Zea mays
  misc_feature (301)..(301): Xaa can be any naturally occurring amino acid
  misc_feature (319)..(319): Xaa can be any naturally occurring amino acid
MDVKRSRSPRAPPDDDRKRAGGGGGWRGSGGVRPEMVLVGFLLTLPLLFLVFGGRWGSGSFPSSSSSSSSATSSPPVVPKPTARRVDVGGGDRGATPRQGQKPVGLNNVSVSTATSVSQDKLLGGLLSAAFDESSCQSRYKSNLYRKPSPFPLSPYLVQKLRKYEARHKKCGPRTKRYRRAVKLLKAGRNTDDSECKYVVWFPCNGLGNRMLTIASTFLYALLTDRVLLVHVPAEQEGLFCEPFPVSSWVLPGSFPQNNPHKLHIGAPESYANMLKNNIVRNDDGPGAPASSSLPPYVYLXLKQVQLKLSDNVFCDEDXDSYFAVALFLMPMYRAELDLMFPAKGSVFHHLGRYLLHPTNRVWGIVRRYYEAYLARVDEKIGFQIRIFPEKPIKFENMYEQLMRCVREQRLLPELGPAEPPTNATADAGDGKVKAVLIASLYSGYYEKIRGMYYESPTKSGEIVAVFQPSHEEQQQYTSNDHNQKALAEIYLLSYCDKITMSAWSTFGYVAYSFAGVKPWILIRPDWNRETSDVACVRSTSVEPCLHSPPILGCRAKTDVDVAAVKPYVRHCEDVGFGLKLFDS

SEQ ID NO: 37955 - protein, 388 aa, Arabidopsis thaliana
MSSKRMDSGSKDIISNLPDALLCHVLSFLPTTEAASTSVLAKRWRFLLAFVPNLDLDNMIYDRPKMGRRKRLELRKSFKLFVDRVMALQGNAPLKKFSLRCKIGSDPSRVNGWVLKVLDRGVEELDLYIASEYEYPLPPKVLMTKTLVSLKVSGTDEFTIDVGEFFLPKLKTLHLSAISFGDEGGPPFAKLISACHALEELVMIKMMWDYWEFCSVSSPSLKRVSIDCENIDENPKSVSFDTPNLVYLEFTDTVAVKYPKVNFDSLVEASIGLRMTPDQVFDARDLVNRHHGYKRCKGANAADFMMGVCNVKTMYLSSEALEVLTFCCKKAIPVFNNLIHLTVETDERVDWESLPILLKNCPNLETLIFEVPSHILFLHDLTHFFSNT

SEQ ID NO: 37956 - protein, 344 aa, Shewanella sp. MR-7
MAVFNHVSFDEHEQVVFCHDKESGLKAIVAIHNTNLGPAVGGCRMWNYQSDDEALTDVLRLSRGMTYKNALAGLTMGGGKSVIIADPKRPDREALFRAFGRFINSLGGRYYSAEDVGTTTADIMIAHQETPYMAGLEGKSGDPSPFTALGTYLGIKAAVKHKLGLDSLKGLKIAVQGVGHVGYYLCKHLHEEGAELVVTDIHQASLDKVATDFGAIVVAPQDIYAQDVDVYAPCALGATLNDVTLPQLKAKIVAGCANNQLAEVRHGEQLKEMGILYAPDYVINAGGIINVSFEKDYDAAKSEAKVREIYNTLLKIFTKADAENRTTAAVADEMARAIYQAAKA

SEQ ID NO: 37957 - protein, 379 aa, Coprinopsis cinerea okayama7#130
MLRTTVLRTASNTLQSRQPFSATRTLPRVTPILGNRTMHSSSCARASIKAGATTKPSDGTATSKETSQGRKSPGSPLTTESAVSTVPTMVRGDWVLFHPVYSPAELKAVEVLHQEPKTVADKAAKALVIISRKLFDVFSLYKAKPLPPNYKELSVQYLRDNGYILDEKGWLRRILFLETIAGVPGMVAATIRHLQSLRLMRRDNGWIHTCLEEAENERMHLMTFMTLRRPSLPFRAIILAAQGVFYNLFFLSYIISPKTCHRFVGYLEEEAVYTYTKCINELEAGLIPEWTSKPAPEISIDYWRLSPDAKMLDLLYAVRSDETTHRFVNHSLANLNPETDVNPFALREPDMHTKGKKISFERDEAEAYVKNSHDLIEKK

SEQ ID NO: 37958 - protein, 162 aa, Oryza sativa
  misc_feature (13)..(13): Xaa can be any naturally occurring amino acid
  misc_feature (40)..(40): Xaa can be any naturally occurring amino acid
  misc_feature (48)..(49): Xaa can be any naturally occurring amino acid
  misc_feature (52)..(52): Xaa can be any naturally occurring amino acid
  misc_feature (54)..(54): Xaa can be any naturally occurring amino acid
  misc_feature (56)..(56): Xaa can be any naturally occurring amino acid
  misc_feature (69)..(69): Xaa can be any naturally occurring amino acid
  misc_feature (71)..(71): Xaa can be any naturally occurring amino acid
  misc_feature (75)..(76): Xaa can be any naturally occurring amino acid
  misc_feature (78)..(79): Xaa can be any naturally occurring amino acid
  misc_feature (82)..(82): Xaa can be any naturally occurring amino acid
  misc_feature (84)..(84): Xaa can be any naturally occurring amino acid
  misc_feature (92)..(93): Xaa can be any naturally occurring amino acid
  misc_feature (97)..(97): Xaa can be any naturally occurring amino acid
  misc_feature (106)..(107): Xaa can be any naturally occurring amino acid
  misc_feature (109)..(110): Xaa can be any naturally occurring amino acid
  misc_feature (112)..(112): Xaa can be any naturally occurring amino acid
  misc_feature (115)..(117): Xaa can be any naturally occurring amino acid
  misc_feature (120)..(120): Xaa can be any naturally occurring amino acid
  misc_feature (126)..(126): Xaa can be any naturally occurring amino acid
  misc_feature (128)..(128): Xaa can be any naturally occurring amino acid
  misc_feature (131)..(132): Xaa can be any naturally occurring amino acid
  misc_feature (137)..(137): Xaa can be any naturally occurring amino acid
  misc_feature (139)..(139): Xaa can be any naturally occurring amino acid
  misc_feature (142)..(142): Xaa can be any naturally occurring amino acid
  misc_feature (149)..(149): Xaa can be any naturally occurring amino acid
  misc_feature (153)..(153): Xaa can be any naturally occurring amino acid
  misc_feature (155)..(155): Xaa can be any naturally occurring amino acid
  misc_feature (157)..(157): Xaa can be any naturally occurring amino acid
  misc_feature (159)..(159): Xaa can be any naturally occurring amino acid
MAPTVMASSATSXAPFQGLKSTAGLPVSRRSTNSGFGNVXNGGRIKCXXVWXIXGXKKFETLSYLPPLXVXDLLXXIXXLLXSXWVPCLQFXXVGFXYRENHRSPXXYXXRXWTXXXLPXFGCTDXTXVLXXLQEAXKXYPXAFVRIIXFHNXRXVXLXNFI

SEQ ID NO: 37959 - protein, 346 aa, Methanopyrus kandleri AV19
MICVGIESTAEKLGVGVVTDDGEILVNVKAQYIPPPGSGILPREAAEHHSRELPELLERALKNAGVEPEDIDLVAYSQGPGLGPCLRVGATAARTLALTLEVPLAPVNHCVAHVEIGKLAARQDGFDFDEPVTLYVSGGNTQVLALKAGRYRVFGETLDLPVGNMLDTFARKVGLPHPGGPEIERLAEEGEPVELPYTVRGTDVSFSGLLTAALRRYEQGDRLEDVCAGLQETAFAMLVEITERAAAQLGRDEILLTGGVAANRRLSEMMHEMAEDRGAEAYTVPPELAGDNGAMIAWTGILVHEHGLSIPPDEIPEKAIVKQRYRVDEAPVPWAARPSRSADSQG

SEQ ID NO: 37960 - protein, 326 aa, Pseudomonas aeruginosa UCBPP-PA14
MNMSQNLDFIHSAQRTIGLERDAVDSLLARIGDDFVKACELLLAGKGRVVVVGMGKSGHIGKKIAATLASTGTPSFFVHPAEASHGDMGMITKDDVVLALSNSGSTAEIVTLLPLIKRLGITLISMTGNPESPLAKAAEVNLDASVGQEACPLNLAPTSSTTVTLVLGDALAIALLEARGFTAEDFAFSHPGGALGRRLLLKVEDVMHVGEGLPQVLLGTSLTGALMEMTRKGLGMTVVLDEHGKLAGIFTDGDLRRALDRGIDVRQVTIDQVMTVHGKTVRAEILAAEALKIMEDNKIGALVVVDADDRPVGALNMHDLLRAGVM

SEQ ID NO: 37961 - protein, 166 aa, Prochlorococcus marinus str. MIT 9313
MKQSTAGWRSRGKHQHNQLQQREQVLRLPLMVDLAFVAMTSEMELLDMRSKKRAAQAMRCLRFDTRFYTDAQATGLNAESVWQQARQYCLPGCSWFQRADAVEADFRWLITVGVLRREVDGQGLTAKIRLTPLGRQLLEQSPGLPTQQAGIFERLQHNLRRLWPRQ

SEQ ID NO: 37962 - protein, 634 aa, Leptospira interrogans serovar Copenhageni str. Fiocruz L1-130
MKDRNFSDSISELEFVKTELEREKKEEDSIFSKDWLSRPIPDRVRQGITLYPIVYEEQTLGREGNWILTFRFSNQEEYPIKFQTGAPVQFGKNEDRAKAILVSLHKEKIKISIEEVPEWAEEGKCFLDLLPDETSYKEMFNALDAVRLATKGTRLYVNRELLLGYGKPDLISTRDSDRSRILGRISTSLNESQKNAVIHSVLSEDVMIIHGPPGTGKTTTLTEIVSQLVAEEKKILVSAPTNSACDLLVESISARGILVLRLGHPARINEIAIHSTLDYKLFHHPDGKLLNEYRKDVIEISKQAKKFKRNFGEKEREERKKLFTEVKELKKTIRSMEIGLIDSLVSSHPVIVSTPVASARGILENRTFDFCVLDESSQALEPAFWIPILKSDRVILAGDHKQLPPTLFSEKNYLETTLFEKAVENLELYGRVFLLDTQYRMKDEISAFPSKEFYSGLLKSGRSEKERKSNFPKTFPFLNAFQWIDTSGTDSEEVILDDSISNPFEADLQVRLCFLLKENDWPEDEITILSPYRAQVRLISEKLRDVGLTKINVSTIDSFQGRENRCILLGFVRSNLEGRSGFLKESRRINVGMARARDLLLCIGDSSTLSQDPFLSKLIRFAEEKEVFRTAWEF

SEQ ID NO: 37963 - protein, 269 aa, Oryza sativa (indica cultivar-group)
MDAPLLRSLPSLGRALLSLSPAPARMLSTAASNALVEIKPGEISMVSGIPKEHLRRKVLLWTYSELCSVDRFSSPRRSVWESLEMSRFELGRNVLVCARPRRSAGSSPRNTLFASVRPRNDVMLKKLGGISPVRLFCDKANMRSAGRRDKPSGMELSIRFWSNSSYTIFVRFASDGGMWLESELWLNRSTVRFDNASSHRGTPPTIEVVVVEVRDVEGGAIAERVRLGVGVSDRQLITVALLFANWPLLKWNMSIETTALFAYRVGKMK

SEQ ID NO: 37964 - protein, 448 aa, Yarrowia lipolytica CLIB122
MPGTQIFGTLPAEGMTNTEVITEMSKYHDMKRTFWEKGRVSGAVYHGGKELTDLQSEAFSQFTVANQLHPDVFPGVRKMESEVVAMVLALFHGPEGSCGTSTSGGTESLLLTSLAAKMKAYNERGVTHPEIIAPITVHAGFDKAAYYFGMKLRHAPVDPKTMKVDLKAVRRMVTRNTVLLVGSAPNFPHGIIDDIEGLSDIALKHKIPLHVDACLGSFIVPYLERAGFDKILFDFRVPGVTSISCDTHKYGFAPKGSSIIMYRTPELRHYQYFVAPDWTGGIYGSPTLAGSRPGAIMVGCWATMLSVGDNGYLESCKEIVGAARKFRKAVDEEIPDLQIIGDPRASVIAFGSDSVNIYDLSDAMSKKGWHLSTLQNPPAAHVAFTKPAVAAVDDLVSDLKSCIIEMKKAGNTKVEDGTAAFYGVAGSIKTAGVADRLVCGFLDGLYKL

SEQ ID NO: 37965 - protein, 905 aa, Arabidopsis thaliana
MRLRHQGGQYLARGMEPVYWSNKVDSTHDLYDNYTLGSYQNNSYNILAHTGFGYDHEFQIYEINSNSWRIIDATLDFKLGYIGRGVSLKGKTYWIASGEEEKRLGKFLISFDYTTERFERLCLPNKYPCYATLALSVVREEKLSMLSQRGIKSKAEIWVTNKIGETQVVSWSMVLALDLQPKRCIGESGSFLVDEKKRVVVCCDNIRDQGKTTFDSNLPRYHRQKKKGRMIIVFDVESMRLPVTVKATKPSFLVIWIRYSSAASSPTVSLNPSGRLQQTLAGSVEVKGKSLHSGKFSTVKLNPEIAGAGRFFEFRSRFIPASIEFAQESPLCTTLLKDELKIRTVEHLLSALEAKGVDNCRIQIESESSDDREVEVPIFDGSAKEWVDAIQGVGINAAQNHDGESVEKMVAHVNKPVDSDHLWYRLPTGCQWFSWRPIHESSFAKDIASSRTFCVYEEVERMREAGLIKGGSLDNAIVCSAEHGWMNPPLRMRRRRCDLQPKRTRMCDLQPKRTSMCDLPPKLVGEKILTRIPITSLRAVRSTCKLWNALTKDRVLVRFHLRRSKEEEEDTMDLSIKQVDLLNQVEISRVYHCDGLLLCVAKDNSRVVVWNPYLGQTRWIRPRTESNIGDSYALGYDINRNHKILRMVQTRNVSVYRYEIYDLRSNSWRVLEVTPNGEMDPNHPLYGVSVKGNTYFFAHEDSSSGEIDEDGDIIDLEDFLLCFDFTTETFGLRLPLPFHSTIDATVTLSCVRDQQLAVLYHNEGLHSDDRFTTVEFWVTTSIEPNSVSWSKFLTVDMRPLALTGVRFDNDMGATFFIDEDEKVAVVFDLDGYLSTESARYHTAFISGKDGFFKPVTLGVAPNVGEPCPRTGHIPTTYRPPLVCSSTYLPSLVQVNQQRKRKERHV

SEQ ID NO: 37966 - protein, 133 aa, Zea mays
MSYYGDRRAESSIVEAFTLSPLPYPVILVLLMVTLLLGASWFFTYDDFIEEASQQLSWALLGVPIALVLLIRWISSVDSFEGYLGFYPTESRWKGRYERGPAEGSSPWGVALLVLLLLVLASFHSTIHDMWGP

SEQ ID NO: 37967 - protein, 445 aa, Actinobacillus pleuropneumoniae serovar 1 str. 4074
MTFAYQQKEPEKFATFLKRQKMIFIVAFLGYVCAYLVRNNFKLMSKSIMVTNGWEKADIAMLLSCLTISYGLAKFYMGALGDRVDLRKLFAICLGASAVICITIGFYHTSILTLAVLLVLCGVVQGALAPASQNMIANYYPNKTRGAAIAGWNISQNMGSALLPMMIAMMTTMGFIVPSTGNVLMAFLVPAVLVLLFAVFCWKFGGDAPEKEGLDSLRTMYGDAGESNVASEEEKHNLGYWQLIGKYVFLNPALLLVAAVNVALYFVRLGIEDWMPIYLHEVAKMGDAESHMAISILEWVAIPGSLVFAWLAVKYPNKMAKMGAIGLFIMAGIVFAYEYVTASGAPNYPLLLVICGILGALIYGPQLIVNILTINFVPLNVAGTAIGFVGVTAYLIGNMGANWIMPIMADNFGWFWSYVVIAALSAFSAVGYLILAKHEEKTIKA

SEQ ID NO: 37968 - protein, 682 aa, Kluyveromyces lactis NRRL Y-1140
MSSVAASQNKINDLLEAIRQEFANVSQEANSYRLQNQKDYDFKINQQLAEMQQVRNTVYELELTHRKMKDAYEEEISRLKLELEQKDRQLASIAHGSTVGNVPGQVPQLSRNSGAQGNANIAPPNIPQPMVSQTVGTGMAPQMAPLNTQHPTQQTKSNAGEQAAANLAPVIQQQQQPQQQLPPQQQQQQQQQQQSNIPVTTAAPVQPAGGNLDQTVPNSISPQQQPTEQQQPASTATTAPATASTAPPTSAPSDQVGQDHYLVPADQRAVHAKPIPPFLLDLDSQLVPSHLKKQNNDYYVLHNPALPTDLDVELHKSLEHSSVVCCVRFSSDGEFLATGCNKTTQVYKVSTGELVARLSDDSASQPQPQPQNQTVTAETSTSNSNGSSAEDGTGNQNSAASTASSDLYIRSVCFSPDGKFLATGAEDKLIRIWDLETKKIVMTLKGHEQDIYSLDYFPSGNKLVSGSGDRTVRIWDLTTGTCSLTLSIEDGVTTVAVSPGEGKFIAAGSLDRTVRVWDSDTGFLVERLDSENELGTGHRDSVYSVVFTRDGKGVVSGSLDRSVKLWNLNGLSGQKSHAECEVTYTGHKDFVLSVATTQNDEYILSGSKDRGVLFWDTKSGNPLLMLQGHRNSVISVTVANGHPLGPEYGVFATGSGDCKARIWKYSKKNSQQNSTQIKEIKE

SEQ ID NO: 37969 - protein, 475 aa, Alteromonadales bacterium TW-7
MSNLIFCDSFIDGEFYKTNEHFSVNDPATQQSIIEVSDIDEQGVNSAITAAQGAFVKLKNTNATERSETLMRWYELVIKHKKTLAELMTKEQGKPLKESLGEIDYGAGFIKWFAEEAKRSYGDVIPPTDNNHRLTSFKQPVGVVAGITPWNFPVAMVTRKVAPAYAAGCSFILKPSEHTPLCAIALAYLADQAGFVKGAFNVLVSQDAKTVGKMLTDSHIVRKFTFTGSTGVGSQLLKQCADTVKRTSMELGGNAPFIIFDNADLDDAIDGLMAAKFRNSGQACVAANRIFIQRSILDEVLSKITPKVASLKVANGFEEDVDIGPLIYPKAKEKVQQLVQDALDKGADLIGDNSSLGGSFQNPLIVTNVTTEMDIYHEEVFGPVLTVIPFDEEAEVLSLANDVPYGLAAYFYSQDLKQVYRISEGLEFGMIGVNEGVISNPVAPFGGVKQSGLGREGGHQGLNEYLEEKYVCIKI

SEQ ID NO: 37970 - protein, 469 aa, Ehrlichia ruminantium str. Welgevonden
MNKHEFLIIGSGPGGYIAAIRAAQLGYNVAIIEKENTLGGVCLNWGCIPTKSLLHSALIYHNIKKADVFGINVTNVTCNFTKIIERSRNVVEKLSNGISGLMKKNNIKVYSGTAKLLGEGTVEVLDNNNDKINITSKHIIIATGSHPRNLPNINFDNNIIWNAKNAMTPNILPKSLAIIGTGAIGIEFASFYNTFGTQVTMIELRDNILPLEDHEVSKSMHQILNQKGIKIYTKSSVTKLEKSNNNARIQISNTIDLEVDKVILAVGIQPNTDNLGLDNTKIQIDQAGFIITDKYCCTSESGVYAIGDVAGPPCLAHKASHEAILCVENIAAQEKKITDRNIHHINKENIPSCIFSIPQIASIGLTEHQAKSMGYDIKIGKFNANCSGKAIAIDETEGFVKVIINKTTGELLGAHMIGAEVTEMINGYIIGKQLEATDRDIISSIFPHPTLSEMIHEAVLASNNESLNS

SEQ ID NO: 37971 - protein, 465 aa, Glossomastix chrysoplasta
MGKGGRDAGAVGGEAEKTLPKFTLEEIQKHRTPQDAWMVHHNKVYDVSNYMDHPGGLVIFSHAGDDMTDVFAAFHPPSAFNFMDKFLIGVVDSKGSSPQLQKDASQASFEKAYRNLRVQLKKAGMFKASSLFYTYKVLSTLALCLVSWGLVLGSDHFGVHLVGALFLALFWQQCGWLAHDFLHHQVFQNRAHGDLAGIMIGNVWQGFSVAWWKNKHNTHHSVPNLYESQPDAADGDPDIDTMPLLAWSLRMAKNADNALSRWFVSHQAFCYFPILGLARLSWLEGSFSFVFSNPLAWKTKNLDVAKQLVTNPLLEQAGLLVHYAWVFALCACTGSLVRALAFFFVATCTSGLLLAIVFGLGHNGMALYEANARPDFWKLQVTTTRNITGSPFVHWFCGGLQFQVEHHLFPSLPRHNLPRAHEIVTAFCKEQGVKYHEADLLTGTKEILSCLSEVTTEFLDEFPAM

SEQ ID NO: 37972 - protein, 357 aa, Arabidopsis thaliana
MMSDISQDLLEEILSRVPITSLRAVKSTCKRWKDLLNDPSFSKKYGGKRDNEFLAIMTSGSRASLMSVNLHGPRDNKDLEDPFIKQIGELNQDQIFKVFHCDGLLLCITNEDNTRLVVWNPYLAQTRCIQPIDKFYIYDWYCLGYDKDKNHKILVVYSPMFGRIEYEIYSFLSKSWIVLSFPTDWQISRDECLSLKGNTYFIAYKKMEVEEVGFQEFLLCFDFTNERFGPLLPLPFQCYNQTSLVLSTVQEEQLAVLCKRCDAYETKIWITTKIEPNAVSWSYFLKFDFKVDISGGSFFVDVEEKVAVLFCINREKEKGINNKTYMIGEDGYYKEVDLGESNWCPSMCSYVPSCVQV

SEQ ID NO: 37973 - protein, 142 aa, Prochlorococcus marinus str. MIT 9313
MMQHSCSEQTMNAPSVQAITTASAPAPVGPYNQAVLAGGWLYCSGQIALDPTNGVMVGQGDVEAETRQVLSNLMAVLTAAGAEPRQVIRTTVYLTDLADFQRVNALYGEIFGDGISPARACVQVAALPKGGRVEIDCVAWLG

SEQ ID NO: 37974 - protein, 603 aa, Leptospira interrogans serovar Copenhageni str. Fiocruz L1-130
MVIHKKIAVVDFGGQYAHLIASRIRRLGAYTEILSNEEPISNYQKYSGIILSGGPESVYEPNSPTVTTRIFDLGIPILGICYGHQLIMKLLGGVVERSGTGEYGPASLQLHGTNGNSILKNFVGGEQVWMNHADEVVKLPEGFSKIAFSKDCGYAVVANSSKKIFGIQFHAEVSHSEKGSVLLDNFIQICGVSKTWGIDQFLKEKIKEIQETVKQEQKIFMLVSGGVDSTVSYLLLCKALGAERVLGFLIDTGFMRKDEVVSLQKKLTFQNIHLTVRDESSLFYKSLKDKSDPEEKRKIVGNLFLEARDRAVKDLDLEYGDWLLGQGTIYPDTIESGGTKHSHTIKTHHNRVEAIQKLIEQGKVIEPIRDLYKDEVRDLGVLLGLESEWVGRHPFPGPGLVVRMLAVEKKGTDKDQLEIDSYLSTQDGLSGKILPIASVGVKGDRRSYANCVVLNDIETDWNTLDRVATHLSNRFSFINRVVLLPFESDLKKWNFQFTGMQLDKKCSDLLREADFTVESVIRKLGLYNKIWQMPVVLLPIGEKENEKSIVLRPVESQEAMTANFFRMERSVLQEIKIEVLKIPEIRYLFFDLTNKPPGTIEWE

SEQ ID NO: 37975 - protein, 738 aa, Schizosaccharomyces pombe
  misc_feature (133)..(137): Xaa can be any naturally occurring amino acid
  misc_feature (227)..(227): Xaa can be any naturally occurring amino acid
  misc_feature (242)..(242): Xaa can be any naturally occurring amino acid
  misc_feature (260)..(260): Xaa can be any naturally occurring amino acid
  misc_feature (273)..(273): Xaa can be any naturally occurring amino acid
  misc_feature (348)..(348): Xaa can be any naturally occurring amino acid
  misc_feature (360)..(360): Xaa can be any naturally occurring amino acid
  misc_feature (375)..(377): Xaa can be any naturally occurring amino acid
  misc_feature (610)..(610): Xaa can be any naturally occurring amino acid
  misc_feature (656)..(657): Xaa can be any naturally occurring amino acid
  misc_feature (664)..(664): Xaa can be any naturally occurring amino acid
  misc_feature (687)..(687): Xaa can be any naturally occurring amino acid
  misc_feature (691)..(693): Xaa can be any naturally occurring amino acid
  misc_feature (701)..(701): Xaa can be any naturally occurring amino acid
  misc_feature (711)..(711): Xaa can be any naturally occurring amino acid
  misc_feature (726)..(726): Xaa can be any naturally occurring amino acid
MVHELNYPLIEQFPVYGSYALQAAQFPHCSLFLHLDDPSMPCNTIRMWTIGLIYSTVGAAVNMFFSLRNPTVTLSVLISELLAYPALQIWDLIFPDREFRIGRLKFNFKPGPFNVKEHALIVVMSSVSFGNAXXXXXILAQRVHYKQRFGFGYEICLTLATQLIGYGLAGLSRRLLVRPASMLWPVNLVQCTLNKTLHRKDLRNAVANGWRIPPFRFFLYGFIASFXWNWFPSYIFQALSLXAWVTWIRPNSPTVNQIFXESTGISILPMTFXWNQISAYILSPLMAPADALMNILVGVILFLWIVTPALNFTNTWYGDYLPISSSGIIDHFGNSYNVTRILTKDATXDLDAYQNYSPIXMSTTYALAFGLSFAXXXSVIFHVILYHGKEIYDRLRDPPAPDIHEKLMKAYDEVPFYWYLSVFLAFFGMMMGTIYGWKTETPWWVIIVGVIFSAVWFIPIGIAQAITNIQLGLNVFTEFIVGYMYPGRPLAMMIYKTVGYITMTQGLAFAADLKFGHYMKLPPRIMFYTQMIATIWSCFVQIGVLDWALGNIDNVCQADQPDNYTCPNATVFFNSSVIWGVIGPKRMFSGKNTYTGLQYFWLAGVLGTIXFWALWKKWPQKWWGQLNGPLICGGTGYIPPATPVNYLAWSGIGLFXXYYLKKIXADWWQKYNFTLSAALDTGTQLSXIILXXXLQLPMVNXPDWWGNDGAXNTLDATGAAVRKLVXESAGEFFGPAEW

SEQ ID NO: 37976 - protein, 392 aa, Arabidopsis thaliana
MVVGSDGDRCGGCCGGSGRRWWWPVVMVTGGGGGRWCWPELMVISVGGGRNRWWPAVVVAAESIEATMANLSEPVRFLFSKIFLRLIMESRKTFDSIPDDLFVEIALRLSSKSIARCRCVSKLWASILYRQDFTELFITKSSARPRLLFAVLKASGLIFYSSPQSQNPSLEVDFHNHMKFHEDMNLYMCSYVSGLFHIPVHDIWTSKASVCVIFNPITGRYVSLPEQMATKRTENLKWRKMICPLTHEPYYGRALSINGVLYYFARTSCFLVVSFNVRSEKFKFLDGKDFSNFHREFINYKGKLGVTKLECDAGDGHPRELCVWVLEDVEKQEWSQYIYSLPKIKDLSIDDSKQLKSKPQQRRHVKNKQAILLQNKYDLLGYLRVSFITLLA

SEQ ID NO: 37977 - protein, 547 aa, Kluyveromyces lactis NRRL Y-1140
MFASKSVVASSRALNAGASSARFARGARFFSSTKSISNIGQKAVVPVKPSLARRVVSTTLKVSLAALLAGTGYVSYELYREANPPPQIPQAATFANGSPRKTLVVLGTGWGSVSLLKHLDTSLYNVIVVSPRNYFLFTPLLPSTPVGTVELKSIVEPVRSITRSSPGEVHYYEAEAKDIDPVAKTVRIKSATKDHDYELDLNYDYLVVGVGAQPTTFGIPGVFENASFLKEIPDAQDIRTKIMNNIEKAATLSANDPERKRLLSFVVVGGGPTGVEFAAELQDYVDQDLSKWIPEISKEIKVTLVEALPNILNMFDKSLWQYAQDLFAMEKIDVKLKTMVKNVNSTTITAQCGDATEDIPYGLLVWATGNAPREVSKNLMAKLEQQNSRRGLLINDKMQLLGAEDSIWAIGDCTFFPGLFPTAQVAHQEAEYLTETLKQQYKIDQLKWEISKTTNATETSKLHSKLDRIVKQQKPFKYNHQGTLAYIGSEQAIADVAVGESKYQMAGSFTFLFWKSAYLGMCLSFRNRILVAMDWAKVYFLGRDSSV

SEQ ID NO: 37978 - protein, 463 aa, Listeria innocua Clip11262
MNSLFRRKPIEDLMHNKSGSTHLKQTLGPLDLTLLGVGAIVGTGIFILPGTVAAKNAGPAIIFSFVIAAIVCAIAAMCYSEFASSVPVAGSAYTYGYVVFGELIGWLLGWALILEYGLAVASVASGWSSYLNALLSGFHISIPEAVSGPFNPEVGTFINLPAIIIVLVIAFLLTLGIKESTRVNTIMVAIKVGVILLFLVVGVFYVKPDNWQPFMPFGISGVMNGAALVFFAYLGFDAVSSAAEEVKNPQRTMPIGIIGSLLICTILYVAVSAVLTGMVPYTDLNVTDPVAYALQVINQDWVAGIVSLGAVVGMITVILVMSYGATRLIFAMGRDGLLPKVLAEINQKYQTPVKNTWIFAFIVAIISGLVPLDRLAELVNIGTLLAFMMVSIGIIFLRKNKSIQQSGFKVPFYPVLPIISFLLCAFLISRLSVHTWILCGIWFVIGLIVYFAYGRKNSELLKK

SEQ ID NO: 37979 - protein, 374 aa, Streptomyces noursei ATCC 11455
MRRDIGAPRRRFNGDPDGTRLSSATKGTEVMSTVHTGVTQSGLTAELASLHAELVRRNPGEAEFHQAALEVLETLAPVLTARPEFADAKVLERIVEPERQIMFRVPWQDDSGTIRVNRGFRVEFNSALGPYKGGLRFHASVNLGIVKFLGFEQIFKNALTGLNIGGGKGGSDFDPHGRSDAEVMRFCQSFMTELHRHLGEHTDVPAGDIGVGGREIGYLFGQYRRITNRWEAGVLTGKGLAWGGSKARTEATGYGNVLFTEEMLKQRGEELDGQQVVVSGSGNVAIYTIEKAQALGANVLTVSDSGGYVVDEKGIDLALLKQVKEVERGRVGDYAQRRGSSAKYVAGGSVWDVACDVALPSATQNELDADAARI

SEQ ID NO: 37980 - protein, 139 aa, Kluyveromyces lactis NRRL Y-1140
MISRTALRTATASRATFVRPLAFSQVRFQSTAGGNTIKHLTNLHEFEVAMKADNLSLVDFFATWCGPCKAVAPHVQKLSEKYNNVKFYKVDVDESPDIAGALGISSMPTFVLFKNGKGLGKVVGADPRGVEEAIKHFNK

SEQ ID NO: 37981 - protein, 390 aa, Agrobacterium tumefaciens str. C58
MSGKPSLIGLTREEMGEALAEIGVPQKQVKMRVSQLWNWLYVRGVSDFDNMTNVAKELREKLKAAFTIARPEIVEEQISNDGTRKWLMRFPPRGAGRPVEIETVYIPEEGRGTLCISSQVGCSLTCSFCHTGTQRLVRNLTAEEILSQLLLARDRLGDFPDGSTPVGAYVPSEGRKVSNIVMMGMGEPLYNFEHVKTALLIATDGDGLSLSKRRVTLSTSGVVPEIFRTGDEIGVMLAISLHAVRDDLRDMLVPINKKYPLKELIEACRNYPGVSNARRITFEYVMLKDVNDSLEDAKMLVQLLKGVPAKINLIPFNPWPGTNYQCSEWAQIEKFADFINQAGYASPIRTPRGRDILAACGQLKSESERMRKTERLAFEAMMIANHGADD

SEQ ID NO: 37982 - protein, 277 aa, Desulfovibrio vulgaris subsp. vulgaris str. Hildenborough
MIDDGNVLLAFGLTLFAGLATGVGSAIAFFARRTDTRFLAVALGFSAGVMIYVSFVEIFRKAYEVLATQTTEVLASWYTVAAFFSGALLIAVIDKLVPGYENPHEMHTVEEMDMGRAALPQDTKHDFVRLKRAGVLAAVAIGIHNFPEGLAAFSAALSDPALGVAIAVAIAIHNIPEGMAVSVPIYYATGDRRKAFLYSFLSGVSEPIGALVGYVVLRPFFTPMVFGLLFASVAGIMVYISLDQLLPSAEEYGEHHLCILGVFSGMGVMALSLLLFL

SEQ ID NO: 37983 - protein, 311 aa, Haemophilus ducreyi 35000HP
MNYLTQATETLSLYSQAIDRLQHNLDQHFNQAVEMILNCAGRVVVAGIGKSGLVGKKMVATFASTGTPSFYLHPTEAFHGDLGMLKAIDIVLLISNSGETDDVIKLLPSLKNFGNQIIAMTGNRHSTLAQHADLVLDISVEREACPNNLAPTTSTLVTMALGDALAIALIKARDFKAHDFARFHPGGSLGRKLLNRVKDVMQTKLPITSPTADFSTILSVMNEGRMGLALIMQGEQLCGIITDGDIRRTLAQFGATSLSKTAEQIMTKKPKTILDSVYLAKAEEMMKALHIHSLIAVNDIGQVSGILEFSN

SEQ ID NO: 37984 - protein, 116 aa, Actinobacillus pleuropneumoniae serovar 1 str. 4074
MSNIIKQIEQEQLKQNVPSFRPGDTLEVKVWVVEGSKRRLQAFEGVVIAIRNRGLHSAFTLRKVSNGVGVERVFQTHSPVVDSISVKRKGAVRKAKLYYLRERSGKSARIKERLGE

SEQ ID NO: 37985 - protein, 231 aa, Zea mays
  misc_feature (175)..(175): Xaa can be any naturally occurring amino acid
  misc_feature (179)..(179): Xaa can be any naturally occurring amino acid
  misc_feature (181)..(183): Xaa can be any naturally occurring amino acid
  misc_feature (185)..(186): Xaa can be any naturally occurring amino acid
  misc_feature (189)..(189): Xaa can be any naturally occurring amino acid
  misc_feature (193)..(193): Xaa can be any naturally occurring amino acid
  misc_feature (195)..(195): Xaa can be any naturally occurring amino acid
  misc_feature (197)..(197): Xaa can be any naturally occurring amino acid
  misc_feature (201)..(201): Xaa can be any naturally occurring amino acid
  misc_feature (214)..(214): Xaa can be any naturally occurring amino acid
  misc_feature (218)..(218): Xaa can be any naturally occurring amino acid
  misc_feature (223)..(223): Xaa can be any naturally occurring amino acid
  misc_feature (225)..(225): Xaa can be any naturally occurring amino acid
  misc_feature (227)..(227): Xaa can be any naturally occurring amino acid
MSSAVEPVSCSKVDVPAAGPDPEDAAAPAGHGEAAPCCHEEEEEEEEEKAPQAIDLGPMVSIKEQLEKDKDDESLRRWKEQLLGGVDLNSVGETLEPDVRITSLSILSPGRRDIVLPLPVDATKGVWFTLKEGSPYRLKFTFSVSSNIVSGLRYTNTVWKTGLKVDRAKEMLGTXSPQXEXXXYXXPEXTTPXGXFXRGSXSARTKFLDDDRKXYLEXNYAFXIXRXWPSA

SEQ ID NO: 37986 - protein, 624 aa, Coccidioides immitis RS
MTSRKTQQEIDRTFKKVAEGIQSFEGIYEKIKTTTNLAQRDKLEDNLKREIKKLQRFRDQIKTWASGNEVKDKGPLLEQRRAIETCMEQFKAVEKEMKTKAYSKEGLSAAARLDPKEKERVETCEFLSSMVDILQQKIEAMEAEEEMLQATMKKGKKDASKATRLADISRISERHKWHVAKLELLLRSLQNGNVETGQVIDIKEAIKYYAEDGHNADFCGEDETIYDDIELGDDEAQFGMGLDNDRVSSQDTQSIQEDDQSEVRRGKADTGPPRRSSTQTKSPLSALATLNLNGQSSTPAPTMKPAPPPTRLPGETLKYASAAAAAAASDKNGVGIAPLPPPPGASPAISNAQPVSKPPSSASPQVAPAQPVQRLISNAANSDDLSNQSKSPTLSSVAASRPGTVPPTPAITKAETTTQKQQQPQQQPQPQPRPSKDRPIANGEKKEESNAEESVYHLPPGLQDLIHSFEATKSRATAPQSGSTQRLLVASHNTCPEPSDAEKPRHYKPQTPYNTPLYYPQDVLPIFDDPRLYENGRIETDTLFYLFYYRQATYQQYLAAKALKNQSWRFHKQYQTWFQRHEEPKTITEEFEQGTYRFFDYESTWMNRRKADFKFVYKFLEDDL

SEQ ID NO: 37987 - protein, 128 aa, Triticum aestivum
  misc_feature (47)..(47): Xaa can be any naturally occurring amino acid
  misc_feature (67)..(67): Xaa can be any naturally occurring amino acid
  misc_feature (114)..(114): Xaa can be any naturally occurring amino acid
VTILNKFVQKSRLLPVRNSRDIVDPRVREFEVEEAVAMESQTIRHMXIEDDCADNGIPLPNVNSKIXLILAANYLNIKGLLDLTCQTVADMIKGKTPEEIRKTFNIKNDFTPEXEEEEIRRENQWAFE

SEQ ID NO: 37988 - protein, 318 aa, Betula pendula
EVAPPQVGEVRLKILYTALCHTDVFFWEAKGQNPLFPRILGHEAGGIVESVGEGVTDLKAGDHVLPVFTGECKECRHCKSEGSNLCELLRINTDRGVMLSDGKSRFSIKGKPIFHFVGTSTFSEYTVVHRGCAVKINPLAPLDKVCILSCGISTGLGATLNVAKPKKGSSVAVFGLGAVGLAAAEGARIAGASRIIGVDLHPDRIKEGRKFGVTELVNPKDHKKPIQEVIADMTDGGVDRSVECTGNVDCMISAFECVHDGWGVAVIVGVPQKDAVFKTNPMNFLNGRTLKGTFFGNYKPRSDLPGVVEQYMNKELEV

SEQ ID NO: 37989 - protein, 419 aa, Bacillus cereus G9241
MIEIKVPELAESITEGTISQWLINVGDKVEKGGSVVELETDKVNVEIIAEDSGIVSKLLGEPGDTVEVGATIAILDANGAPVAVSTPAPAAEQPKQETAEAPKAAAPSAEQAATLQGLPNTNRPIASPAARKMARELGIDLNDVRSTDPLGRVRPHDVQAHAAAPKEAPAAPKSPAPASVAKTEFEKPVERVKMSRRRQTIAKRLVEVQQTSAMLTTFNEVDMTAIMELRKERKDAFEKKHDVRLGFMSFFTKAVVAALKQFPLLNAEIQGDELIIKKFYDIGIAVAAPDGLVVPVVRDANQLNFAEIESEIRELGKKARDNKLSLKELQGGTFTITNGGVFGSLMSTPILNSPQVGILGMHKIQVRPVAIDNERMENRPMMYIALSYDHRIVDGKEAVSFLVAVKDMLEDPKSLLLEG

SEQ ID NO: 37990 - protein, 912 aa, Acidobacteria bacterium Ellin345
MATTLEPIEASMATPETSVKYVYSFGGGKAEGNGKMKDVLGGKGAGLAEMTNVGLPVPPGFTIQTEACREYMKGGKTSTAVQKEMLAALKQLEELRGKKLGAPSDPLLVSVRSGAKFSMPGMMDTILNLGLNDQSVKGLAERSHNERFAYDSYRRLIQMFGNVVLDIEKSEFEEVFDGKKHQRKVKLDTDLTAKDLQEVIEGYKKLVKKHTKRDFPQDAVEQLSMARDAVFRSWNNDRAKHYRRMNNIDDAIGTAVNVQSMVFGNLGDTSGTGVGFTRNPATGAKEFYGEFLMNAQGEDVVSGIRTPVPIIGLQEIMPHVYEQLRAITTKMENHYRDMQDFEFTIEDGQLFMLQTRNGKRTGRAAVRVAIQMVEEGLISKEDAVMRVEAIQLNDFLVPSLEEKGVKIEVLSKGLPASPGAAVGQIVFSADEAVAKVQKDKAAQVILVRGETTPEDIHGMEVAAGILTSRGGMTSHAAVVTRGMGKCCVAGAGEIEVDEKKREMRVKGKVLKAGDWISLDGISGRVINGKLNTNPARTDDPELMKFMSWAEPFRKMGVRANADIPRDAKQAAAFGAEGIGLCRTEHMFFAEDRIGHMREMILADNEKDRRAALKKLLPMQRSDFAGLFTALDGYPITIRTIDPPLHEFLPKREDLMVQIAQLEITKPKSPKLKELRHLLSRVEQLHEQNPMLGHRGCRLGITYPEITEMQARAIFEAAVQVTKKGIKAKPEVMIPLTTSLKEMKNQADIVRRVAAEVFEEKGVKVEYMVGTMIELPRAAVVADEIAKEAEFFSFGTNDLTQTTFGFSRDDVGKILPTYFELGILKQDPFAQLDQEGVGQLVKMACEKGRSTRPKLKLGICGEHGGDPSSVEFCARVGLNYVSCSPFRVLIARLAAAQAGLAEKTGSAEAGRSK

SEQ ID NO: 37991 - protein, 491 aa, Musa acuminata
GTRRDRERERERERERERERERERERERERERERERVHLLGSSSLHRSLWELSKKHGPLMHLKFGRVPVVVVSSPEMAKEVLKTHDLECCSRPSLLSFSKFSYGLSDVAFIPYGERWRQLRKLCTVELLSTRKINSFRDIRKEEMERVTKLICSHVRASSMVNLSELLLSLSCNMTCRSAFGSGFDDGGDIQLHDMLREAQEELSGLFLSDYLPLLGWVDRLSGMRSRLERAFLKLDSIYQRRIDYHQDRLRQQGKEDGDVLDALLRMQKDEEGLTEDHIKGVLMDIFIAGTDTSSATVEWAMAELIRQPELMKRAQDEVRRCVGSKGEVEESDLHQLHFFKCVIKETMRLHPPAPLLLPRETMQHFKLNGYDILPKTWMYVNAWAIGRDPNSWGRPHVFDPERFMHDSTEASGQDFKLIPFGEGRRICPGKNLGMLMVELVLANLLYSFDWHLPPGMVKEDISMEEAPGVPVHREYALCLMATKYDATTA

SEQ ID NO: 37992 - protein, 127 aa, Shewanella violacea
MAEKIIIATDKAPQAIGTYSQAVKVGSTVYLSGQIPLDPATMQMVSDEFSAQVVQVFDNLTAVCEAAGGSLSDIVKLNIFMTDLSNFATVNEIMERYFSQPYPARAAIGVKQLPKGSLVEMDGVMEI

SEQ ID NO: 37993 - protein, 507 aa, Musa acuminata
MALPPLLLSPLPSLLVVLALLSSLLLAGRKARGGSATWKLPPGPPKLPVIGHLHLLGSSLLHRSLWELSKKHGPLMHLKFGRVPVVVVSSPEMAKEVLKTHDLECCSRPSLLSFSKFSYGLSDVAFIPYGERWRQLRKLCTVELLSTRKINSFRDIRKEEMERVTKLICSHVRASSMVNLSELLLSLSCNMTCRSAFGSGFDDGGDIQLHDMLREAQEELSGLFLSDYLPLLGWVDRLSGMRSRLERAFLKLDSIYQRRIDYHQDRLRQQGKEDGDVLDALLRMQKDEEGLTEDHIKGVLMDIFIAGTDTSSATVEWAMAELIRQPELMKRAQDEVRRCVGSKGEVEESDLHQLHFFKCVIKETMRLHPPAPLLLPRETMQHFKLNGYDILPKTWMYVNAWAIGRDPNSWGRPHVFDPERFMHDSTEASGQDFKLIPFGEGRRICPGKNLGMLMVELVLANLLYSFDWHLPPGMVKEDISMEEAPGVTVHREYALCLMATKYDATTA

SEQ ID NO: 37994 - protein, 383 aa, Kluyveromyces lactis NRRL Y-1140
MLINFKDFKKEKLPIELADDATISHAKELIAEQKQCDASQIKLIYAGKILQDPKTVSGCNLKEGDQVIFMISKTKKKADVKVTESTTEPQDESQATASAETSAVANAPAEATTTGTRTGTTAVTQEEGTTDASFVTGSQRNETVNRIMEMGYDREQVERALRAAFNNPDRAVEYLLMGIPEASEPSQQQAEAVTSEAGANANSEVATDVPSQFTEHEDNLFAQAEANNGEQGHESAAGLGGEEMGTIGLTMEDITQLRDVVSGRPEALMPLFESLSTRYPHLRETMLQDPQRFISLLLEAVGGSLTDSLGENLGDDIAEGDLGDFGGQTQGAPPNVTISAEDEEAINRLCELGFERTLVVQIYFACDKNEEIAANMLFNNYAD

SEQ ID NO: 37995 - protein, 454 aa, Prochlorococcus marinus str. NATL1A
MHGSKAYEPNVDIDSPNRNIAPITSEINESKKLVVGGCQLSELAKKYGTPLYVLDEFSLRTACKTYISSLNKHYPGKSLPLFASKANSSLAICAVIASEGFGLDAVSEGELLTAINGGVKEKDIVFHGNNKSQDELNFAYSNNVTIVLDNYHDIELLKNIASDNKPAKLMLRFTPGIECHTHEYIRTGHLDSKFGFDPDDLKSILEELKTYKWANLTGLHAHIGSQIFEVQPHIDLAGVMADALKLAKEIGHPVVDLNLGGGLGIKYVQEDNPPSIEKWVEIISKAVVKACRERNLDLPRLMCEPGRSLVANSGLTIYKIGAKKVVPGVRTYLSVDGGMSDNPRPITYQSLYSACLVDKPMNTNFEKVTIAGKHCESGDVLLKDFLLPSCESGDFLAVFGTGAYNYSMSSNYNRIPRPATIMVGKGSAELTQRRELPEDLLQLDVLPDRFIPKN

SEQ ID NO: 37996 - protein, 275 aa, Musa acuminata
HEVDWLRGMRSRLERAYVKLDSIYQRLIDYHQDRFRLQGKEDEDILDALLRMQKDEEGVTEDHIKGVLMNIIIAGTDTSTATVLWTMAELIRQPELMKRAQDEVRGCVRSKGEVEESDLDQLHFLKCVIKETMRLHPPVPLLLPRETMQHFKLNGYDILPKTWMYVNAWAIGRDPNSWARPHVFDPERFMHDSTEASGQDFKLIPFGEGRRICPGKNLGMLMVELVLANLIYSFDWHLPPGMVKEDISMEEAAGFTMNREYALCLMATKYDSPTA

SEQ ID NO: 37997 - protein, 294 aa, Listeria innocua Clip11262
MMNKENPLNKYHTGKFEKQRQDYPGLQSKMTPVPDTGESSYQGANKLTGKKAFVTGGDSGIGRAAVIAYAREGADVAINYHPDEEVDAQEVKAIVEEAGQKCVLLPGDLRKKGLAKELVKKAYNELGGLDILVLNAGLQQYQLDIQKLPAEQLRDTFEVNVFSVVFAIQEALNYLKAGASIILTSSIQGVKPSAHLVDYAMTKSSLISLTKSLAAQLGEKGIRINAVAPGPIWTALQISGGQPQDSIPEFGQDQPLGRAGQPAELASAYVLLASDEASYTTGQVYGITGGAPIN

SEQ ID NO: 37998 - protein, 351 aa, Aspergillus nidulans FGSC A4
MHKIASIPGDGIGPEVVSATIQVVNKLASKLGFQIEFTHLPWGTKYYKEHGQFMSDDALDILRKFDAGLFGAVGDPDVPDHISLWGLLLKIRSPLQLYANVRPVRTFPGTKSPLTTAKNGIDWVLVRENSEGEYCGQGGRSHIGHPWEAATEVAVFTRVAIERIMRFAFETARSRPRKKLTVVTKSNAMRHGMVLWDEVAAEVAKDFPDVDWDKMLVDAITIRMVAEPDSLDTIVGTNLHMDILSDLAAGLAGSIGVAPSSNLDPTRKNPSLFEPVHGSAFDITGKGVANPVATFWSSAEMLSWLGEKDAADKLMGCVERVCEAGILTADLGGNAKTQDVVDAVCAEIDRL

SEQ ID NO: 37999 - protein, 230 aa, Oryza sativa (japonica cultivar-group)
MAPPPISSSLSLMASNPIPSPPVAKPGRPLTVAACSNSSSSSSSSSPSSTSCSAAWSLPVATSAGRRGLLALGAGFLASPGLLCPAGDAGATRIEYYATVGDKLCDMNVVKSGLGYCDVEVGTGAQPPRGQLINVHYTARFTDGIVFDSTYKRGRPLTMRLGAGKILRGLEQGISGGGGVPPMLVGGKRKLMIPATLAYGPEPAGCFSGDCNIPGNTTLLYDIFLVGFYK

SEQ ID NO: 38000 - protein, 1045 aa, Arabidopsis thaliana
MYYHSLSSYSILFFLFSLFHHLPCASSNQGLGWCESLFQCGNITADFPFWGGNRHKPCGHPLLELHCNNNNITSLYISNQEFYVRQINQTSNTLTLARSDLLGSFCSSYAYNTTTLPPEIFELSPTYKSLTVLYHCDPKLSYRSSYTCPALGTFSMSQSVDYQYSCQNSFTVNVPTSFHPEERGLNLTNLESALRKGFEVKLVIDEIPCQQCSSTRGICSFNGTTQSCCNATSPSGGVSCVPYQHSADEVYRRCSESFSCGSQRDLNYPLWKPGREECGHPNFKLNCSGGFAEINIASVKFRILDSYRSLIRLARSDYIGDLCPANPLTAPFIEKFLPVLELTGETELLTLYYGCRFNSSDIPANIYVGELGCDEGRSYYVTRNLSSPLLDSSRGVLNNLREMCKRNVSVPASGPALFDLQTRPNQDNLKMALDQGFRMLITSDCERCRGSGGACGYNQTSSGFGCYCKDGKCGYEYDALGALTGVVIVFLVLLCPCFRVQIFRKRKTSDEVRLQKLKALIPLKHYTYAEVKKMTKSFTEVVGRGGFGIVYSGTLSDSSMVAVKVLKDSKGTDGEDFINEVASMSQTSHVNIVSLLGFCCEGSRRAIIYEFLGNGSLDKFISDKSSVNLDLKTLYGIALGVARGLEYLHYGCKTRIVHFDIKPQNVLLDDNLCPKVSDFGLAKLCEKKESILSLLDTRGTIGYIAPEMISRLYGSVSHKSDVYSYGMLVLEMIGARKKERFDQNSRSDGSSIYFPEWIYKDLEKANIKDIEKTENGGLIENGISSEEEEIARKMTLVGLWCIQSSPSDRPPMNKVVEMMEGSLDALEVPPRPVLQQISASSVSDSFWNSEESSSASDILVFSTNSKLESSSLYFSPVITLPTLNSTNNILQREETVKTENKSQESIPEVFSCKTRIVHFDIKPQNVLLDDSFCPKVSEFGLAKLCEEKESILSMLDTRGTVGYIAPEMISRVYGNVSDKSDAYSYGMLVLEIIGARNKEKANQACASNTIQCTFLNGYIGILNHASLEGILRMELTAKKMSLQRR

SEQ ID NO: 38001 - protein, 145 aa, Glycine max
MASLATVAAVKPSAAVNGLGGSSLAGAKLSFKPSRLSIKPKSVRSGAVVAKYGDKSVYFDLEDLGNTTGQWDLYGSDAPSPYNPLQSKFFETFAAPFTKRGLLLKFLILGGGSLLTYVSASSTGDVLPIKRGPQEKPKLGPRGKL

SEQ ID NO: 38002 - protein, 505 aa, Arabidopsis thaliana
  misc_feature (500)..(500): Xaa can be any naturally occurring amino acid
MVVINSLRRLARTTQVHLHSKYATCMSGNSTSRRIFTTEAAPEKKNTVGSKGHDMLAPFTAGWQSADLDPLVIAKSEGSYVYDDTGKKYLDSLAGLWCTALGGNEPRLVSAAVEQLNTLPFYHSFWNRTTKPSLDLAKVLLEMFTANKMAKAFFTSGGSDANDTQVKLVWYYNNALGRPEKKKFIARKKSYHGSTLISASLSGLPPLHQNFDLPAPFVLHTDCPHYWRFHLPGETEEEFSTRLAKNLEDLIIKEGPETIGAFIAEPVMGAGGVIPPPATYFEKVQAVVKKYDILFIADEVICAFGRLGTMFGCDKYNIKPDLVTLAKALSSAYMPIGAILMSQEVADVINSHSSKLGVFSHGFTYSGHPVSCAVAIEALKIYKERNIPEYVAKVAPRFQDGVKAFASGSPIIGETRGTGLILGTEFVDNKSPNEPFPPEWGVGAFFGAECQKHGMLVRVAGDGILMSPPLIISPEEIDELISIYGKALKATEEKVKELKXAQHKK

SEQ ID NO: 38003 - protein, 763 aa, Arabidopsis thaliana
MQKSGVNRNPSLKVAIPQAQQSLRRLGFCSQIATGGSQQSSPIVFPEKRNKKVKASSRRGEVTNDPQVKPKPDEHRIDIGGGDEKSDLLGSLVYAGKLVLDKRKSASGKDATEIQQPAATDISIKKAVDAKLTSSALVWGSDMLQLNDVVSVTYNVGLRHFTVHAYPIGKGSCGLSCFTKPKRSRKDFRFVAPTVEEAVQWVASFGDQQCFINCLPHPLVAKKQASSELFSVPIDTPPELVFRCKSAPKMLVILNPRSGHGRSIKVFHNVVEPIFKLAGIKMEVVKTTKAGHARELASTVDINLCSDGIICVGGDGIINEVLNGLLTRSNPKEGVSIPIGIVPAGSDNSLVWTVLGVRDPISAALSIVKGGLTATDVFAVEWIHTGIIHFGMTVSYYGFVSDVLELSEKYQKRFGPLRYFVAGFLKFMCLPKYSYEVEYLPAQKEDAEGKIRLEKEAVDMQDLYTDVMRRSSREGFPRASSLSSIDSIMTPSVGELDTCSSTHASTEPSEYVRGIDPKMKRLSSGRRDVTAEPEVIHPQAQSTTPNWPRTRSKSRMDKGWMGLTSVQDPPTRCSWGNTGGQDREDISSTVSDPGPIWDAGPKWDTEPSAWDVENSIELPGPPEDIETGLRKQSITPIFEDKWVSRKGHFLGIMVCNHACRTVQSSQVVAPNSEHDDGTMDMLLVHGCGRLRLLRFFILLQTGRHLSLPYVECVKVKSVKIKAGKNTHDSCGIDGELFALHGEVISTMLPEQCRLIGNAPGRHS

SEQ ID NO: 38004 - protein, 934 aa, Campylobacter jejuni subsp. jejuni NCTC 11168
  misc_feature (181)..(181): Xaa can be any naturally occurring amino acid
MSSVGENIKLTRRSFLKMAALSSLATPLLARSETLREASADELKEAYEGSKKVKTVCTACSVGCGIIAEVQNGVWVRQEIAQDHPVSSGGHCCKGSDMIDMVRSHVRLKYPMKKENGEWKRISYEQALSEIGEKLAAYRKENPESVMFLGSAKLNNEQAYYIRKFAAFFGTNNVDHQARIXHSATVAGVANTFGYGAMTNHLGDIQRSKCIIIIGANPAVNHPVGFRHFLKAKEKGAKLIVVDPRFTKSAAKADIYARIRPGTDIAFMYGMLKIIFDEGLEDTKYLDERVFGIDKIREEAAKWTVEEVENVTGISKELLVQITHEVAKNKPTTLIWAMGLTQHTVGTSNTRLAPIVQMVLGNIGKFGGGVNILRGHDNVQGASDMACLSENLPGYYPLNEATWRYYAKIWGVDYEWLLGNFVSKDWMHKTGLSLARWWAAALNGKDGNDAIDNAGTPLKALVVMGNGITSTAQQVKVKEGLEALELLVLADPFVNEAGIIAERKDGIYLLPAATQFETSGSVTATNRSGQWRFKVVDPLYESMEDQEILFELAKKLGFYEDFTKTLRDEKGEIVWPENATREIAKAVRSIGLNGWSPERLKKHTLYWDKFDEVTLEGKDEVAGEYYGLPWPCWSDKHPGSPVLYNTDIEVAKGGMGFRNNFGLEYEGESLLAKNAPLNSPIDTGYPQITKDNIEKVLGITLSAQEKEKMGSTWSYDDSNIIATKCIEKGIVPYGNAKARAVVWTFKDKIPLHREPLHSPRNDLVQKYPSFEDQKALYRVDTKFVSVQQAKDYSKEFPLNLVTARLVNLNGAGMENRASMYLTRLTPEMFCEINPELAKEQDIKAGDMIWVHSPEGTKIHVRVKVNPGVAKDMIFLPFHFTGVMQGVDLTHNFPEGTKPYASGESANTVTNYGYDIMCQIPETKGGLCRISKDGK

SEQ ID NO: 38005 - protein, 386 aa, Rhodospirillum rubrum ATCC 11170
MTETTFKPKKSVALSGIAAGNTALCTVGRSGNDLHYRGYNILDIAETCEFEEIAHLLIHGGLPTAAQYASYKAKLKVSRGLPRSVKEALETIPAAAHPMDVMRSGVSALGCALPEAYDHHPVDARDIADRLIASLGSMLLYWYHYAHHGRRIEVETDEDSIGGHFLRLLHGKPPSDDFVQAMHTSLILYAEHEFNASTFTARVIAGTGSDMYSCISGAIGALRGPKHGGANEVAFGIQKRYASLQHAEEDIRRRVEAKEVVIGFGHPVYTTADPRNAVIKRVAKGLADEVRSHLQYDVAERIEQVMWDTKAMFPNLDWYSAVSYHLMGVPTSMFTPLFVIARTCGWAAHVIEQRQDNKIIRPSANYTGPENLAFVPMSARSDHVSM

SEQ ID NO: 38006 - protein, 931 aa, Kluyveromyces lactis NRRL Y-1140
MSDAMNQTSDAVFTDRMRRFQEFLDTHSHYTREIRSILEFNSNVVKEKKTDDDYLNTADKDTMDHDTNQLPLRITVSLDDLREFDKTFWTGLLQVPSFFLPPAERAVSETAMALDDSPLGFRGFQNDPSRQWRLSFKGSFGPNSLSPRTLNSTHLNKLISVEGIVTRTSLVRPKLLRSVHYAQTTGHHHYRDYRDATTTLTTSVPTPAIYPEEDQEGNKLVTEYGFCHYMDHQRITVQEMPEKAPPGQLPRSIDVILDDDLVDKTKPGDRINIVGVYKSLGAGGLTGGSNNNDKGNGALSGFRTVVIGNTVYPLHARSTGVSAVETLSDNDIRNINKLSMHDNIFDTLSQSLAPSIYGHEHIKKAILLMLMGGVEKNLPNGSHLRGDINILMVGDPSTAKSQMLRFVLNTAALAIATTGRGSSGVGLTAAVTTDKETGERRLEAGAMVLADRGIVCIDEFDKMSDVDRVAIHEVMEQQTVTIAKAGIHTTLNARCSVIAAANPVFGQYDVNKDPHKNIALPDSLLSRFDLLFVVTDDINDIRDRAISEHVLRTHRYLPPGYLEGEPVREQINLSLAVGEDIENEEEDDDEDVVFEKFNPLLHAGAKLAKNRGDSNGSELPQIVAIPFIRKYIQYAKERIIPQLTQEAVDVIIKSYSNLRNDQNTKKSPITARTLETLIRLSSAHAKVRLSKKVELEDAKVATQLLRFALLGEDGANFDEQEFAEGRTTEKSPRKKPRASPRKKRGAVYKEVDSEDAEEDQEMAETQPDPADGLESTMVRLAPEQEEDLQRRLEQNLRVSPRRQLSVERRVLSQSDHQQQVLHHSSQSSTGPLETGSQLEPSHMTLDFMSIEEMDQGSISTGRLSSLSGIVARLMQSDIFEEESYPVAALFERINEQVPEEEKFTVDEYVAGLRIMSDRNNLMVADGKVWRV

SEQ ID NO: 38007 - protein, 266 aa, Zea mays
VPRGRPGATALLRSAYAFPLKTLHSPLLRRAANFPSRQLRLPTEQEAENYTVEDLVALNPYNPDILNDLEKFVNEQVASQTYNLDANLSLLRLYQFEPGRMSIHIVAHILIKALMAMPAPDFSLCLFLIPEHVQMEEQFKALIVLSHYLETARFRQFWDDAANNRHILEAVPGFEQAIQSYAIHVLSLTYQKVPRHILAEAINIEGLALDKFLEYHAANSGWVIEKGGQSQVIVLPRNEFNHPQLKKNTADTVPFEHLTRIFPVLS

SEQ ID NO: 38008 - protein, 358 aa, Haemophilus influenzae R2846
MQSYNIAVLAGDGIGPEVMAEAIKVLNKVQEKFGFKLNFNEFFVGGAAIDHCGYPLPAETLKGCDEADAILFGSVGGPKWTNLPPDQQPERGALLPLRKHFKLFCNLRLATLYKGLEKFCPLRADIAAKGFDMVVVRELTGGIYFGQPKGREGESSQTKAFDTEVYYKYEIERIARAAFEAAMKRNKKVTSVDKANVLQSSILWRETVTEIAKDYPEVTLEHIYIDNATMQLIKAPESFDVLLCSNIFGDIISDEAAMITGSMGMLPSASLNEEGFGLYEPAGGSAPDIAGKGIANPIAQILSAAMMLRYSFNLNEAADAIESAVQKVLANGHRTADLADDSTPVSTSEMGTLIAQAI

SEQ ID NO: 38009 - protein, 261 aa, Oryza sativa
  misc_feature (79)..(79): Xaa can be any naturally occurring amino acid
  misc_feature (139)..(139): Xaa can be any naturally occurring amino acid
MLNLHTIRMSIPSLHRSSPYRCALLKRKRSCIRACSSEDGSDASSSLGGDKRQQEVLAKIAMLQAQKVRITSFLDERSXAYLTKFAKDADTEFDLIGQNAMKELDEVGDQIMERLDSKMQAFEETAEVQRQEIEMNERXVLEDFEDWIEKEKNEGMFFKSLGKVKPRNKKKLTVKPIPKLEAQKVKDIAKESAGSKTRMNIYLGLMAILGLTIANAVFATPEVEWRKVAALGLIFIGLVAQVIYEQDISSPEAEKKGGKEE

SEQ ID NO: 38010 - protein, 185 aa, Pharus virescens
EMRRIENKINRQVTFAMRRNGLLKKAYELSVLCDAEVALIIFSNRGKLYEFCSGQSMTKTLERYQKCSYGGPETAIQNKENELVQSSRNEYLKLKARVENLQRTQRNLLGEDLGSLGIKELEQLEKQLDSSLRHIRSTRTQQMLDQLTDLQRREQMLCEANKCLRRKLEESNQVHGQQVWEHGAN

SEQ ID NO: 38011 - protein, 474 aa, Aspergillus niger
MASTLRLGTSALRSTSIAAKPVVQSAAFNGLRCYSTGKAKSLKETFAEKLPAEIEKVKKLRKEHGSKVIGEVTLDQAYGGARGVKCLVWEGSVLDSEEGIRFRGRTIPECQELLPKAPGGQEPLPEGLFWLLLTGEIPTEQQVRDLSAEWAARSDLPKFIEELIDRCPSTLHPMSQFSLAVTALEHESAFAKAYAKGINKKDYWNYTFEDSMDLIAKLPTIAAKIYRNVFKDGKVAPIQKDKDYSYNLANQLGYGDNNDFVELMRLYLTIHSDHEGGNVSAHTTHLVGSALSSPMLSLAAGLNGLAGPLHGLANQEVLNWLTKMKAAIGNDLSDEAIKNYLWSTLNAGQVVPGYGHAVLRKTDPRYVSQREFALRKLPDDPMFKLVSQVYKIAPGVLTEHGKTKNPYPNVDAHSGVLLQYYGLTEANYYTVLFGVSRALGVLPQLIIDRALGAPIERPKSYSTEAFAKLVGAKL

SEQ ID NO: 38012 - protein, 367 aa, Oryza sativa (japonica cultivar-group)
MTNQDVVVSEMGIAAGAALPGGPAGPAGGLFACRSAAASMRQTYLDLAAAAVAARSASCTSWADAMRASSPTRSSRSASDVDEFTAWVRKHPSALSKFEEIAAKSRGKKIVMFMDYDGTLSPIVADPDTAYMSDAMRAAVREVAKTFPTAIVSGRCRDKVRNFVGLSDLYYAGSHGMDIKGPSSNPESALCQPASEFLPMIDEVYKTLVEKTKSTPGAKVENNKFCLSVHFRCVDEKRWNALGEQVKAVIKEYPKLKLTQGRKVLEIRPSIEWDKGKALEFLLESLGFANCGDVMPVYIGDDRTDEDAFKVLRKRGQGLGILVSKCPKDTNASYSLQDPTEVMEFLLRLVEWKRKSSSSSLMIRPRV

SEQ ID NO: 38013 - protein, 214 aa, Hordeum vulgare subsp. vulgare
MDHCGVGLYGEYATVTSAPPKRPAGRTKFRETRHPVYRGVRRRGAAGRWVCEVREPNKKSRIWLGTFATPEAAARAHDVAALALRGRAACLNFADSAALLRVDPATLRTPEDIRAAAMALAQAACPHDAASSSAPALKAASAPAPAMVMVQEAAAAPYDSYATALYGDLTDLDMHSYYCYDGMSGGGDWQSISRMDGADEDGIYGAGDVALWSY

SEQ ID NO: 38014 - protein, 447 aa, Lactobacillus reuteri
MGKHVFTKDEVRQMVKDEDIHFLRVMFTDLLGTIKSVDLPVSQLDKLMDNKIMFDGSSIDGFVRIEESDMYLYPDMSTWLAFPWGAEHGKVARVICSVYKTDGTPFEGDPRNNLKRVLEGMRKMGFKDFNIGPEPEFFLFKTDEKGNPTTNLNDKENYFDMEPADPGEDCRRDIVLALEKMGFDVEAAHHEVAPGQHEVDFKYSDALEAADNIQTFKFVVKTIAKKYGFHATFMPKPLSGINGSGMHLNMSLFSQDGTNAFFDENDKDKLSATAYHFLGGLMKHARSYTAICNPIVNSYKRLVPGYEAPVYVAWSTSNRSPLVRIPSDRGMGTRLELRSADPSANPYLAIAAVLEAGLDGLRNNLPPIHNVDENIYTMTKAERAEKDIHDLPDTLHNALKSLANDEVIKSSMGEHLYNSFMEAKTREYASYRQHVSDWERQHYMEQY

SEQ ID NO: 38015 - protein, 218 aa, Oryza sativa
  misc_feature (91)..(91): Xaa can be any naturally occurring amino acid
MATKAGVIATLLRAIRFLQLNWEQLADDIESGELTPRVTDPSVREAVAAIDLNLLFFTFSDACGCQCGSCPSPGGGGGGGGGGRGGGWGGXSGGGGGGGGGSGGGGSGGGGSGGGGSGGGGGGGSGGGGGGGRCPIDTLKLGVCANVLNGLINVQLGTPPRQPCCSLIQGLADLEAAVCLCTALRANILGINLNLPINLSLLVNYCGRSVPSGFQCSN

SEQ ID NO: 38016 - protein, 141 aa, Triticum aestivum
  misc_feature (57)..(57): Xaa can be any naturally occurring amino acid
  misc_feature (85)..(86): Xaa can be any naturally occurring amino acid
  misc_feature (89)..(89): Xaa can be any naturally occurring amino acid
  misc_feature (102)..(102): Xaa can be any naturally occurring amino acid
  misc_feature (107)..(107): Xaa can be any naturally occurring amino acid
  misc_feature (118)..(119): Xaa can be any naturally occurring amino acid
  misc_feature (124)..(125): Xaa can be any naturally occurring amino acid
  misc_feature (132)..(132): Xaa can be any naturally occurring amino acid
  misc_feature (135)..(135): Xaa can be any naturally occurring amino acid
MAPAVMASSATTVAPFQGLKSTAGLPVGRRSSGSLSSVSNGGRIRCMQVWPIEGIKXFETLSYLPPLSTGGLLKQVDYLDSLKVXXCSXLTRLVPLPLSTTXPPGYXDGRYWDKLELXXFRVEXXTQGAEQXEEXKKDTLP

SEQ ID NO: 38017 - protein, 291 aa, Hordeum vulgare subsp. vulgare
MSNPIQTDVAGIASPSGQQEQQGHRTVSSEPPKRPAGRTKFHETRHPLYRGVRRRGRVGQWVCEVRVPGIKGSRLWLGTFNTAEMAARAHDAAALALSGRAACLNFADSAWRMLPVLAAGSFGFGSAREVKAAVAVAVVAFQRRQIIPVAVAVVALQKQQVPVAVAVVTLQQKQQQVPVAVAVSALQQQQVPVAVAVVALQQLQVPVAVAVVALQEQQIILPVACLAPEFYMSSGDLLELDEEQWFGGMDAGSYYASLAQGMLVAPPDERARPEHGEQTGVQTPLWSCLFN

SEQ ID NO: 38018 - protein, 432 aa, Triticum aestivum
  misc_feature (166)..(166): Xaa can be any naturally occurring amino acid
  misc_feature (184)..(184): Xaa can be any naturally occurring amino acid
  misc_feature (201)..(201): Xaa can be any naturally occurring amino acid
  misc_feature (227)..(227): Xaa can be any naturally occurring amino acid
  misc_feature (232)..(232): Xaa can be any naturally occurring amino acid
  misc_feature (249)..(249): Xaa can be any naturally occurring amino acid
  misc_feature (285)..(285): Xaa can be any naturally occurring amino acid
MSGHPAHGCDLDFPTPIPIPEITKMRNQKSRVQECKVEHIDLIPGMPDDVAVDCLARVPHASFRSMRGVCRGWNTAAAAPDFALARAEAGANEDLVYLLQFGNPAAADADGVAPENAQAYGVSVYNVTTGEWRREGAAPPVPMFAQCAAVGSRLAVLGGWDPKTFXPVADVHVLDASTGVWRRXGAPMRSARSFFGLRRGXGGKIYVAGGHDKLKNALKTAEAYDAXADAWXPLPDMSEERDECDGMAXSPGERFLAVSGYRTGRQGGFERDAEVVDPASREWRXPGARARATPSAAHVVVRGRVWCIEGTGPDGIPRGTRPLWPRCRPSPPGSKGRHGPPGSPSAAASALLVTGAIESEGGGTGHALWVFDVKSKNWTMVRPAAADSPASSSPLDPCACDVSDRSPVQGDFLLAMSCVRETSGRGKAQRCE

SEQ ID NO: 38019 - protein, 235 aa, Streptochaeta angustifolia
EMRRIENKISRQVTFAERRNGLPKKAYELSLLCDAEVALIIFSSGRLFEFSSASCMYRTLERYRTCNYRSHEAAAPIETESNYQEYLKLKTRVEFLQTTQRNLPGEDLGPLNMKELEQLENQIESSLKNIRSTKNQTLLDQLFDLRHKQQQLQDLNKDLRRKLQEVGGHDNALQVWEDGGPSGSAGHEHLQGLLQPSEIDPSLQIGYHQAYLDQLNNGQIAQYPNGHLPSSAPWI

SEQ ID NO: 38020 - protein, 219 aa, Sorghum bicolor
EMRRIENKISRQVTFAKRRNGLLKKAYELSVLCDAEVALIIFSSRGRLFEFSTSSCTYKTLERYRSCNFASEASAPLEAELNNYQEYLKLKTKVEFLQTTQRNLLGEDLGPLNVKELEQLENQIEISLKHIRSSKNRQMLDQLFDLKRKEQQLQDANKDLRRKGPETSEENVLRLSCQDIGCSGSSGHPGEANQERLHLALDPSLHIGYQAYRDHMNNN

SEQ ID NO: 38021 - protein, 222 aa, Chasmanthium latifolium
ELRRIENKISRQETFAKRRNGLLKKAYELSVLCDAEVAHIIFSSRGRLYEFSTSSCIYKTLERYRSCSYASEASAPMEAELSNYQGYLKLKTRVEFLLTTQRNLLGEDLGPLSAKELEQFENQVEISLKHIRSTKSRQLLDQLFELKRKEQQLQDANKDLRRKIQDTSGENMLRMTCKDIGSSGSSSGHARDAKHQELPHSGVCDPSLRIGYQAYMDQLNNE

SEQ ID NO: 38022 - protein, 221 aa, Pennisetum glaucum
  misc_feature (12)..(12): Xaa can be any naturally occurring amino acid
  misc_feature (202)..(202): Xaa can be any naturally occurring amino acid
EMRRLENKISRXVTSAKRRNGLLKKAYEVAVLCDAEVALIIFSSRGRLFEFSTSSCMYETLEQYRSCNFTSEASSAPIEAELSNYEEYLKLKTRIEFLQTTQRNLLGEDLGPLSTKELEQLENQIEISLKHIRSSKNQQMLDQLFELKRKEQQLQDSNKDLRKKIQETSEENVLRPTFQDLGACGSSGHPRDANQEYLRQLXCDPTLRIGYQSYIDHLSNE

SEQ ID NO: 38023 - protein, 425 aa, Agrobacterium tumefaciens str. C58
MVSEKALISKITWRLMPFLGLLYLIAYIDRQNVSYAKLQMVDALSLSEYAYGLGASLFFIGYFLFEVPSNLFLNRFGASKWFARILVSWGAVTIALAYTQNATMFYILRFLLGLCEAGFFPGVLFLMTLWFPRDYRGRMIGLFMIFSALANAVGAPLGGMLLDLDGFLGYAGWEWVFLATGIPAVIAGIVTFFYLDDTPDKAKFLTQDEKDWLKNRLAEENKGMEEHAEDGFKALVNPRVLFMALCYVGFPLAAYGLSYWLPTIVKSFGVSNTTNGFINIIPWIIVAIALFVVPSAADKAKNKTPYIVGPAFVGAFCLLMSALLSDPVLQFAFLCVAAAGIFAGQPVFWSLPGRFLKGAGAAAGIAAINSVGNLGGFVAQNVVPWIKDQTGSTIAPMFFLAFCLALAGVLVIIATRKMGNQVKAA

SEQ ID NO: 38024 - protein, 887 aa, Desulfotalea psychrophila LSv54
  misc_feature (346)..(346): Xaa can be any naturally occurring amino acid
MKKVTLTINGRSVTAPEGSYVLQAALQKGIYIPHLCYHNDLEPVGACRLCTVRVNGRWDALSCKTPVEEGMVIETETETIAKTRKIAIELLIADHDMDCLACARNTTCKLQQAADYIGVNKKHLARLKKPEVLLPIDDSNPFFDFDPNRCVLCGICIRTCDELQNINAIDFAYRGLTTKVAGFGDKARILSNCESCGECVARCPVGALTEKDYVKPSHWVKTVCAYCGCGCGLDLGVRDNKIVSARGEHGNPANRGRLCVKGRFGFNYVNSKERLTTPMVRRPEGFVPVSWDEALDLIADNFAKNKGDSFAAVSSAKCTNEENYLLQKFTRTVMKTNNIDHCARLXHAPTVAGLATAFGSGAMTNSIAEIGDAQVILAIGTNTTAAHPIIALQIKDAVRRGAKLIVINPKRIDLCKHAHIFLQNTPGSDIPLLMTMMRIIVEEDLIDKEFIEERCENYPAFLASLQQFELEDVAELTGIPAETIREAALCYATESPATILYCMGITQHVHGTDNVLATSNLALLTGNVGKESTGVNPLRGQNNVQGSCDMGALPDVYPGYQKVVNNTAAFEEKWQTSLSAVPGKTHTEIFDGLYDGSIKSVYLIGENPVLSEANASHAIEAMNRAKFLVVQDIFFSETAELADVILPASSFAEKDGTFTNTERRVQRVRQAIEPVGDSRPDWWIIKEIATRMGAKGFDHEGPEQIMEEISATIPNYAGINYDRLQHGTLQWPCPSTDHPGTKFLHAERFATANGRARFMPLKTRKTTEQVDKKYPLLLNTDRSLFHFHGTMTRRVFGLNVLDRGENLIIHPEDAEKFSLTDGEIVEVRSRRGAVKVAVEINDSCRPGSVSMSFHFSETPTNMLTSGALDPVAKTPGTKICAVQINKL

SEQ ID NO: 38025 - protein, 452 aa, Arabidopsis thaliana
  misc_feature (69)..(69): Xaa can be any naturally occurring amino acid
MVRRQEEEKKAEKGMRLGKYELGRTLGEGNFGKVKFAKDTVSGHSFAVKIIDKSRIADLNFSLQIQFLXSVQIKREIRTLKMLKHPHIVRLHEVLASKTKINMVMELVTGGELFDRIVSNGKLTETDGRKMFQQLIDGISYCHSKGVFHRDLKLENVLLDAKGHIKITDFGLSALPQHFRDDGLLHTTCGSPNYVAPEVLANRGYDGAASDIWSCGVILYVILTGCLPFDDRNLAVLYQKICKGDPPIPRWLSPGARTMIKRMLDPNPVTRITVVGIKASEWFKLEYIPSIPDDDDEEEVDTDDDAFSIQELGSEEGKGSDSPTIINAFQLIGMSSFLDLSGFFEQENVSERRIRFTSNSSAKDLLEKIETAVTEMGFSVQKKHAKLRVKQEERNQKGQVGLSVTAEVFEIKPSLNVVELRKSYGDSCLYRQLYERLLKDVGTSSPEQEIVT

SEQ ID NO: 38026 - protein, 331 aa, Saccharum officinarum
MMSSRAGSVLLRRAGSRLFTAAAVSPAAASRPLLAGGNNVVQAVMVRLMSTSSPAAVSEATKDEAAKASKEGGDKKAVVINSYWGIEQNNKLVRDDGTEWKWTCFRPWETYTADTSIDLTRHHELKTLMDKIAYWTVKSLRFPTDIFFQRRYGCRAMMLETVAAVPGMVGGMLLHLRSLRRFEQSGGWIRALLEEAENERMHLMTFMEVAKPRWYERALVITVQGVFFNAYFLGYLLSPKFAHRVVGYLEEEAIHSYTEYLKDVEAGKIENVPAPAIAIDYWRLPANATLKDVVTVVRADEAHHRDVNHFASDIHCQGMQLKQSPAPIGYH

SEQ ID NO: 38027 - protein, 249 aa, Sorghum bicolor
MEYGVADDYGYGYGGYDDQQDLPSSSSVDGDEYATVLSAPPKRPAGRTKFRETRHPVYRGVRRRGPAGRWVCEVREPNKKSRIWLGTFATAEAAARAHDVAALALRGRAACLNFADSARLLRVDPATLATPDDIRRAAIQLAEDSSSSTPDASAAAAAVAVASSASVGQATPSSSAYQAGDDATGAAMYGAEYAAAAMYGAGMDFDHSYYYDGMVGGNEWQSAGSSGWHSNVDAGDDEGAGDMSLWSYY

SEQ ID NO: 38028 - protein, 379 aa, Brassica napus
MMVSSVSILASLSPYILISALLLYLLLEQLTYLRKKGNLPGPLFVPPIIGNAVSVVRDPTSFWYKQSALAGNSPGLSANYLVGRFIVYIRDTELSHQIFTNVRPDAFHFVGHPFGKKLFGDHNFIYMFGDDHKSVRRQIAPNFTPKALSTYSELMQVIILRHLRLWEESCNGPMSLRNLVRDLNLETSQTVFVGPYLDEEDKNRFRTDYNIFNLGTMTLPFDLPGSAFHKARMAVKRLANILAVCAGKSKARMAAGEEPTCLIDFWMQPIVAEAASGNPPPPHSRDEEIGGFLFDFLFAAQDASTSSLLWAVTQLESKPDVLRRVREEVGSIWSPDSNALITVDQLAEMKYTLNVAREVVRYRPPATMVPHVAAVDFPL

SEQ ID NO: 38029 - protein, 285 aa, Saccharum officinarum
MSSTAVEAAKEAAAPEEQRQKLEAPAPEGQDKKAVVSYWGIQPRKLVKEDGTEWRWFCFRPWDTYRADTSIDMKKHHEPKALLDKLAYWLVKSLVVPKQLFFQRRHASHALLLETVAAVPGMVGGMLLHLRSLRRFEHSDGWIRALLEEAENERMHLMTFLEVAQPKWWERALVLAAQGVYFNAYFVAYLASPKFAHRFVGYLEEEAVHSYTEYLKDLEAGIIDNTPVPAIAIDYWRLPADAKLKDVVTIVRADEAHHRDVNHFASDIHYQGMKLKDTPAPLGYH

SEQ ID NO: 38030 - protein, 225 aa, Triticum aestivum
MDTNAAWPQFDGQEYRTVWPEEQEYRTVWSEPPKRRAGRNKLQETRHPVYRGVRRRGREGQWVCELRVPAGSRSYSRIWLGTFASAQMAARAHDSAALALSGRDACLNFADSAWRMMPVHAAGSFKLAAAQEIKDAVAVALKEFQEQQRPADESTAPSSTAEESALSIIPSDLSGLDNEHWIGGMEAGSYYASLAQGMLMEPPADGAWQEDREHDDGFDTSLWSY

SEQ ID NO: 38031 - protein, 239 aa, Saccharum officinarum
MSKDGVEWRWSCFRPWEAYKPDTSIDLTRHHEPKVLLDKIAYWTVKLLRVPTDIFFQRRYGCRAMMLETVAAVPGMVGGMLLHLRSLRRFEPSGGWIRALLEEAENERMHLMTFMEVAKPKWYERALVLAVQGVFFNAYFLGYLISPKFAHRVVGYLEEEAIHSYTEYLKDLEAGKIENVPAPAIAIDYWQLPADATLKDVVIVVRSDEAHHRDVNHFASDIHFQGMQLKETPAPLGYH

SEQ ID NO: 38032 - protein, 540 aa, Oceanicola granulosus HTCC2516
MSVEVRVPALGESVTEATVATWFKKPGDAVEADEMLCELETDKVTVEVPSPAAGKLDEIVAAEGETVGVDALLANIAEAGHAGSSTDIKPREGKSANPEPAEPDAGTEGKSGADGSGDGGGGGEEIEITVPALGESVTEATVSTWFKKPGDSFEADEMLCELETDKVSVEVPAPAAGTLSKLLAEEGATVEAGGKLALMTTGKAAASAKAEGTPATTTSQTPEGDRGGYGDRGTPDTPPTTESRGDIEDAPSAKKMMAEKNLSADAVTGTGKGGRIMKEDVLNALNKPQQAEAPKPQAARAPSTPADADREERVKMTRLRQTIARRLKEAQNNAAMLTTYNEVDMGGIMDLRNEYKDLFLKKHGVKLGFMSFFVKACCHALNEVPDVNAEIDGTDVVYKNYVNMGIAVGTPNGLVVPVVRDAHEKGFAQIEKEIAELGAKGRDGKLSMADMQGGSFTISNGGVYGSLMSSPILNPPQSGILGMHKIQERPMVVKGQIVARPMMYLALSYDHRIVDGKGAVTFLVRVKEALEDPRRLLMDL

SEQ ID NO: 38033 - protein, 489 aa, Frankia sp. EAN1pec
MSETGQAQLPPRGGPGLPQVRRLVTAIPGPRSVELAKRRSQAVARGVGETLPVYIAAAGGGVLVDVDGNSLIDFGSGIAVVSVGNAADAVVENVREQAGLFTHTCFMVTPYEGYVTVCEELARLTPGRHEKRSALFNSGAEAVENAVKIARAHTGRSAVVAFAHAYHGRTNLTMALTAKSMPYKHHFGPFAPEIYRMPMAYPYRWPGGPAACGEQAAAQVVETITTEIGAENVAALVIEPIQGEGGFIVPGTGFLTRLAEFCAQTGIVFVADEVQTGFARTGDMFACEHEGIVPDLIVTAKGIAGGLPLAAVTGRAEIMDSPHVGGLGGTYGGNPVACAAALGAIATIERGDLTARARRIERIAMPRLLALRDRYPFIGDVRGRGAMLALELVADPTEGTPPNQPAPAPDRMVTVAAAAEAHRRGLVLLTAGTWGNVLRLLPPLVIPDDLLLEGLDILDEAFADIARHRPRPRPRLQPQPQPDSLPPTH

SEQ ID NO: 38034 - protein, 226 aa, Triticum aestivum
NLGPWDHTVVEKRLNENTVSLTTKGSPQLCQLCEQFAAETLFYLKENETRIEIIDTLHQACLKFHSLKLECTKLVDYYAALFFAQIDSLSPEEFCVSASLCEEVTYIRLPGHEHACTLCHEVVDEIRTGLEDPEMELKIIEILLKGCNNTESFVQKCKKMIIQNTPVILEDIKKFLKKRDFCDSIRVCGGKIVRPSRRRPKRHVYCLSFSLLNTHDNCVSFHEEHA

SEQ ID NO: 38035 - protein, 488 aa, Glycine max
MDQATTFNKYAFACAAVASMVSIISGYDTGVMSGAMIFIKDDIGISDTQQEVLAGILNLCALGGSLAAGRTSDYIGRRYTILLASLLFMVGAILMGYGPNYAILMLGRCIGGVGVGFALMIAPVYSAEISSASSRGFLTSLPELCIGIGILLGYISNYFLGKLTLRLGWRLMLGVAAFPSLALALGILGMPESPRWLTMQGRLGDAKKVLLRVSNTEHEAKLRFREIKVAMRINDCDGDDNNVKPSYKSQGEGVWKELLVRPTPEVRWMLIAAVGIHFFEHATGIEAVMLYSPRIFKKAGVTSKDKLLLATVGIGLTKIIFLVMALFLLDKVGRRRLLQISTGGMVCGLTLLGFSLTMVDRSSEKLLWALSLSIVAIYAYVAFFNVGLGPVTWVYASEIFPLKLRAQGASIGVAVNRTMNAVVSMSFISVYKAITIGGSFFMFAGISIVAWVFFYFFLPETKGVPLEEMEMVFSKKYSGKNVAIETGP

SEQ ID NO: 38036 - protein, 339 aa, Mycobacterium avium subsp. paratuberculosis K-10
MPDLPNRQILLRRRPSGLVRPDDTELVTTPAPEPAEGEALLRTTYVGIDAAARTWLDDQPSYLPPVQLGEVIRAAGIGEVVASRCDAFAVGDVVTTLTGFQEYAIIRDDLFSTPIPGEHDQLAIMSVYGPTGATAYFGMTDIGRPQPGETVVVSAAAGATGSIAGQIAKIAGARVVGIAGGPEKCRAVVADFGFDACIDYKNDDVAAALKQHCPRRVDVYFDNVGGPILDAVLGRLAPQARVVLCGVISSYLTGDHPGPANYVNLLSKTALMQGFNALDQWGRFDEAFAALRKWEAEGRLHHRQTIFEGIESCVDALNGLFTGVNIGKTLVKLSEPGAG

SEQ ID NO: 38037 - protein, 395 aa, Glycine max
MRTRRGACYSGVVSRMCSDARVSKKKNKDLHMHMHMHMHVPAGDSIIYSRKRQKKTPEKTAAGHYDFFESLPDDLVISIFCKLSSTATKPSDFVNVLITSKRLNRLALHSLVLSKASPRTFTIKAKYWCDSAHKFLKHCADAGNVEACYTLGMIRFYCLQNRGSGASFMAKAAINSHARALYALAVIQFNGSGGTKSDKDLRAGVALCARAAFLGHVDAMRELGHCLQDGYGVRQNIAEGRRFLVQANARELAAVLSTGAAARTWLSWNLQPQQLRQGSGCPLLSDFGCNVPAPEVHPASLFMAEWFAARGGSPGPGLRLCSNAGCGRPETRKHEFRRCSVCGEVNYCSRACQALDWKFRHKAECAPVERWLDEDGEDVGNDDGDGEVEVVMVDS

SEQ ID NO: 38038 - protein, 235 aa, Triticum aestivum
FVGRESQQDLFNLLGATYAAVFFLGASNCITVQPVVAIERTVFYRERAAGMYSPLSYALAQTGVEIIYNILQGCLYTIIIYSMIGYEWKADKFFYFLFFIIASFNYFSLFGMMLVALTPSALLANIIISFVLPLWNLFAGFLIVRPAIPIWWRWYYWANPVSWTIYGVVASQFGENNNSLSIPGGSPIVVKKFLEDNLGINHDFLGYVVLAHFSYAIGFYFIFAYSIKVLNFQKR

SEQ ID NO: 38039 - protein, 357 aa, Oryza sativa (japonica cultivar-group)
MVVTIDLREVTIDLREEDEAAAAAAMKAIAGRSDEEVLAAVLARKGGPVPFLQAAIDAAAAAATKAIAGRSDEEVLAAVLARKGGPVPFLQAAIDVAQRRSDLFLDPSAPGVVAEMAVEAQAKAEAEERRKRAKGEPRKAEEMLKEEEPMKAEEMLKEEEPMKAEEMLKEEPRTPMREAGRDKVERAAVVERVRDPKPNAGNGLDLEKYSWTQERPEVTITIPVPQGTKSSLVTYEIMKNHLKVGLKGCSFIIDGELFEPVKVNDCLWTIEDGNTLSILLTKENQKEWWTSVIKGDPELDPRDMKVPELRDCDVEAKETIVRILSHGLPKRAMDPATSDDIQQEELLKNAQYSHMDS

SEQ ID NO: 38040 - protein, 199 aa, Cryptococcus neoformans var. neoformans JEC21
MQTIKCVVVGDGAVGKTCLLISYTTNKFPSEYVPTVFDNYAVTVMIGDSPYTLGLFDTAGQEDYDRLRPLSYPQTDVFLICFSIASPASFENVREKWFHEISHHCPGAPCLIVGTQVDLRDDPKQVERMMSGSGRGGGGGRGGLITQEQGERLARELGGRKYVECSALTQKGLKNVFDEAIVAALEPPVVKKTKKCLIL

SEQ ID NO: 38041 - protein, 235 aa, Sorghum bicolor
MCPIKKEMTGESSSPCSSASTSSEHHQTVWTSRPKRPAGRTKFRETRHPVFRGVRRRGNAGRWVCEVRVPGRRGCRLWLGTFDTADAAARAHDAAMLAIAGAGACLNFADSAWLLAVPASYASLAEVRHAVAEAVEEFLLREVVQEDDALSATSSTPPSSPSSSDDGSTSDGGESSESDSSPAATGASPFELDVFNDMSWDLYYASLAQGMLVEPPSAVTAFMDEGFADVPLWSY

SEQ ID NO: 38042 - protein, 324 aa, Glycine max
SKIRIIKRGTQTCCVDYVGPPPPQEITAPLRYWVDNERKRVVMAEASGHFVDVLFSFLTLPLGTIIRLGNTFGQPIEIGCINNLFKSVEALNPDVFWNDICKRMLLSPRNPLEFSYQRLKLKVDDTQPTKYFVCHICSKGSDFSLSTFDEVKCHCGNLMKRQLDMLVEPAGGNGVFVKGDAMFLIFDDLTVLRSSPSVSFKPPLQLGHKEFRKVEEKSLDVDTNKVFSILKQALTSKSALSVTLENGKCEPSSSFLPDIGPSRWKDSIKIKVIESKSQNKILFVEADGDFVDFLVSFLTMPLGSIMYLVNGQYLWESMISCTQV

SEQ ID NO: 38043 - protein, 443 aa, Roseovarius nubinhibens ISM
MTRDLAKYAKEKGIKYYMISFTDLFGAQRAKLVPAQAIADMQEDGAGFAGFATWLDLTPAHPDMLAVPDPEAVIQLPWNPELAWVPGNCVMGGKDLAQAPRNVLRRLIKEAADEGLHIKTGIEAEYFIMTPDGHAISDEYDTAEKPCYDQQAIMRRLHVVQEICDYMLDLGWGPYQNDHEDANGQYEMNWEFDDALATADKHSFFKFMTKSVAEKHGLRATFMPKPVEGLTGNGCHAHISVWDAPGDKAKRNVFATDKGEGPTGELGLSEQGKYFLGGIMKHASALAAITNPTVNSYKRINAPRTTSGATWAPNTVTWTGNNRTHMVRVPGPGRFELRLPDGAVNPYLLQAVIIAAGLDGIRTKADPGKRHDIDMYAEGHKVRGAPKLPLNMLDALREYDKDKQLKSMMGEEFSAAFLKLKHQEWNAYCRHFSEWERANTLDI

SEQ ID NO: 38044 - protein, 717 aa, Arabidopsis thaliana
MAPNLHIKKAFMAMRAMGIEDARVKPVLKNLLALYEKNWELIAEDNYRVLADAIFDSHEDQAIQESEEKKADEVKEDEGCAAEVDRGKKKLHESIEDDEDVMAESDRPLKRLRRRGEGGSALASPSLGSPTLEGPSINDEENAPILLPYHPVPIENDHDAGELILTKVEPITNMPLSSIPDSVDRGDSSMLEIDKSNGHVEEKAGETVSTADGTTNDISPTTVARFSDHKLAATIEEPPALELASSASGEVKINLSFAPATGGSNPHLPSMEELRRAMEEKCLRSYKILDPNFSVLGFMNDICSCYLDLATNGRDSANQLPKNLPFVTTNIDALKKSAARMAYTSQASNDVVEICSNEHMRDAENGAVGDSMALVVVPECQLSADEWRLISSVGDISLGKETVEIPWVNEVNDKVPPVFHYIAQSLVYQDAAVKFSLGNIRDDQCCSSCCGDCLAPSMACRCATAFNGFAYTVDGLLQEDFLEQCISEARDPRKQMLLYCKECPLEKAKKEVILEPCKGHLKRKAIKECWSKCGCMKNCGNRVVQQGIHNKLQVFFTPNGRGWGLRTLEKLPKGAFVCELAGEILTIPELFQRISDRPTSPVILDAYWGSEDISGDDKALSLEGTHYGNISRFINHRCLDANLIEIPVHAETTDSHYYHLAFFTTREIDAMEELTWDYGVPFNQDVFPTSPFHCQCGSDFCRVRKQISKGKNVKKRA

SEQ ID NO: 38045 - protein, 461 aa, Oceanicola granulosus HTCC2516
MADYDVIVIGSGPGGYVCAIRCAQLGLKTACVEARDTLGGTCLNIGCIPSKALLHATEMLHEAEHNFAEMGLKGKSPSVDWKQMLAYKDKTISQNTGGIEFLFKKNKIDWLKGWGSIPEAGKVKVGDETHNARHIVIASGSEPSALKGVEVDEKTVVTSTGALELGKVPRKMVVIGAGVIGLELGSVYRRLGAEVTVVEFLDQITPTMDGEVAKQFKRMLGKQGFEFVLGAAVQSVETKGGKATVHYKLRKDDSDASLEADTVLVSTGRRPFTDKLGLDALGVELERGMIKTDDHFRTNVAGIYAIGDAIKGPMLAHKAEDEGMACAEGIAGQHPHVNYGVIPSVIYTHPEVAAVGFTEEELKEQGRAYKVGKFPFMGNARAKANFAGEGFVKLLADAETDRILGAHIIGPMAGDLIHEICVAMEFGAAAEDIARTCHAHPTYSEAVREAALACGDGAIHV

SEQ ID NO: 38046 - protein, 188 aa, Brassica napus
MDSSNSGINCPSVFSSSSSASRQCQQSQSNLYIGGGYKDLKGKNNLKSEFICPFCAKVFNIVGLCCHIDKKHPVKAKNGMSLMNPIFGIWKSVCPVCTKRGGLNIVGHITTQHANFFKVHRRKRLKKGGGYSSAYLTLKKKLREANLQSLLGGSSSFASSTNINSDPLLSSFMFNPPSAANKSATPVT

SEQ ID NO: 38047 - protein, 591 aa, Sinorhizobium meliloti 1021
MCGICGEVRFDGGSPSVTAVSIMADVLAPRGPDASGVVVRGNVGLGHRRLRILDLSDKSQQPMVDSDLGLSLVFNGCIYNFRELRLELEEKGYRFFSSGDTEVILKAWHAWGEECVSRFHGMFAFVIHERDSGRVVMARDRFGIKPLYIAEVQGALRFASALPALVKAGGVDTSIDVAALHNYMTFHAVVPPPRTILNGVRKLPPATLRVYERDGSFEDRRYWDPPYRRQAGDAAISREEWQEQLLDALRIAVKRRMVADVPVGVLLSGGVDSSLIVGLLAEAGQRGLMSFSVGFEEANGEKGDEFVYSDLIAGHFGTDHRKIFVPSADLMGALPGTIAAMSEPMVSYDNVGFYLLSKEVSKHVKVVQSGQGADEVFGGYHWYPPLMNSNDVVADYGKAFRDRSHAVLTTQLSDAWIADHDVSGDLLNEHLLREGAATPVDQALRLDSNVMLVDDPVKRVDNMTMAWGLEARVPFLDHELVELAARMPPEEKLRDGGKGILKDVARRVIPSEVIDRKKGYFPVPQLKYIAGPYLDLIRDTLRSQKARERGLFQDAYLDRLFQEPSDHITPLRGSELWQVGLLEMWLEAQGV

SEQ ID NO: 38048 - protein, 238 aa, Zea mays
  misc_feature (176)..(176): Xaa can be any naturally occurring amino acid
MCPTKKEMSAESSGSASSWTSASASASTSTSPEHQTVWTSPPKRPAGRTKFRETRHPVFRGVRRRGSAGRWVCEVRVPGRRGCRLWLGTFDAAEAAARAHDAAMLAIAGASACLNFADSAWLLAVPASYASLADVRRAVAEAVEDFQRREAAAGDDARSATSPTPSTSGTDDDAAXDGEESSPATEVSSFQLDVFDNMSWDLYYASMAQGMLMELPSAVPAFGDDGYTNVADVPLWSY

SEQ ID NO: 38049 - protein, 568 aa, Oryza sativa
  misc_feature (87)..(87): Xaa can be any naturally occurring amino acid
AAEAFGCAPTPAKALEKKLLDLELPPFPAPAKKAAAKVVAAAPKKKLAGGAGGYVLEDVPHLTDYLPNLPSFPNPLQNHPAYSVVKXASLPSSSSPTPAIFFPFSDYSRFVTVRSFCRQYFVNADDTVAKKIVVHKGSARGTHFRRAGPRQRVFFQPDEVSAAIVTCGGLCPGLNTVIRELVCGLHDMYGVTSVVGIEGGYRGFYARNTVELTPRSVNGIHKRGGTVLGTSRGGQDTGKIVDSIQDRGINQVYIIGGDGTQKGAATIHAEVQRRGLKCAVVGVPKTIDNDIAVIDRSFGFDTAVEEAQRAINAAHVEAESAENGVGVVKLMGRNSGFIAMYATLASRDVDLCLIPESPFYLEGKGGLLEFAEKRLRENGHMVIVVAEGAGQDVIARSMRLADAHDASGNKVLLDVGLWLCAKIKDHFKKKANFPITLKYIDPTYMIRAVPSNASDNVYCSLLAHSAIHGAMAGYTGFTVAPVNGRHAYIPFYRITEKQNKVVITDRMWARVLCSTNQPCFLSTEDVEKAGQDDEEPIVPLVEGENSLVKAPPLLANAGDRAALCNGAA

SEQ ID NO: 38050 - protein, 336 aa, Flavobacteria bacterium BBFL7
MARKNQTLGEFIIENQSEFQYSSGELSRLINSIRLAAKMVNHEVNKAGLVDITGSAGEINTQGEDQQKLDVLANDTFIRTLTNREIVCGIASEENDDFITIEGHKENHSNKYVVLMDPLDGSSNIDVNVSVGTIFSIYRRVTPVGTPVQLEDFLQPGNLQVAAGYIVYGTSTMLVYTTGHGVNGFTLNPALGTYYLSHPNMTFSEDGNIYSVNEGNYNHFPQGVKDYIKYCQQEEGDRPYTSRYIGSLVSDIHRNMIKGGIYMYPQSAKASNGKLRLLYECNPMAFIAEQAGGTASDGHTRIMDLKPTELHQRVPFFCGSKNMVAKLEEFIQKHDK

SEQ ID NO: 38051 - protein, 454 aa, Roseovarius nubinhibens ISM
MSLWRYARLFRQDILSAQPARLYRAWMAEFRTPFFRSYLCNQPDLVDLILKGRPDDFPKSDRIREGLTPLLGQSVFVTNGETWKRQRRIIDPAFEGGRLRDTFPAMYAAGEAAVARLAPQADGAPKDIEFHTSHAAADVIFRTLFSLPIEDETASEVFAAFRDHQRTQPVLNLGAFLPLPRWFPRFHRRRTRETARHIRALITDLTARRRAEIEAGTAPDDLATKIMTTPDPVTGKRFETEEMVDQVAIFFLAGHETSASALAWALYLLALYPDWQERLAEEATGAMTGTSTGAFGMSDMAKLRLSRDVFREALRLYPPVPMMVREASGTEVFRDREVRKGSQIVLSAWHLHRHERLWERPDAFDPDRFATDNGRSCLREAFMPFSAGQRVCPGAGFAMIEGPLLLSMLLRNYRFEVVADRPAMPVAHLTVRGRDGIWLRITPRGDAAPDVATN

SEQ ID NO: 38052 - protein, 624 aa, Yarrowia lipolytica CLIB122
MMILRLARVQPGVSLLRGPTTRIFSPGRLPVRQLVARTQTPLTLTSSCLISRQLSTTRLLAFSARKPVAEKKFDDYKKVSLNDVKNNPIYKFVYLSKPWYQSTGFRILAVTMGLATLLYLFSDGAHKVLRHTGHAIERIWVVMKATSRCVWLYRKTLKKEYPSEEEYKTALSKCHKKAAEITLQAIRKNSGVYIKLGQHIAALTYIFPPEWTETMIPLQDQCPESSMESIRAMIRKDTGKNLDDLFLEFNEVPMGVASLAQVHKAVTIDGREVAVKVQHPSLAEFVPLDVYMTRTIFTIVDHFFPDYPLSWLSDEMQRSIFTELDFTEEANNAVKTREYFKDTYKTTALRIPEVYWSKRRILVMEFVGGSRLDNRPYLEDNNISPDEVSACLSHIFDTMIFRPGAGLHCDPHGGNLAIRTRDNSRGGHNFEIVLYDHGLYRFVPTNIQRDYAHFWLALIDSNEAEMRKYAKRFANIDEDKFPLFAAAITGRDFKHATSDLKSKRSRAEIENMVSTIASDGLLSDIMTLLHSVPRVVLLIFKTNDLTRHLDETLNSSLGIERTFLIMATYCAKTVLEERRENLIKKYSRLDIRRWIGEGFAWASYLRRLLQLKAYDFGLMVSNLF

SEQ ID NO: 38053 - protein, 215 aa, Triticum aestivum
  misc_feature (161)..(161): Xaa can be any naturally occurring amino acid
MEPSRRLLLSDYDGAIMSPLPSPSTSSAAPFKPGVAVVVGILTSVFSITFLLLLYAKHCKRSAAESSGPYGSGGGSGGGAAGERRNSGVERAVVESLPVFRFGALRGQKAGLECAVCLGRFEPTEALRLLPKCRHGFHVECVDTWLDAHSTCPLCRSRVDXPEDVLLLPEPPKPSTTGPPERRSRKLALPLLRSGQEQDATLGSWAWTLFGVAKD

SEQ ID NO: 38054 - protein, 823 aa, Hyphomonas neptunium ATCC 15444
MPEVPYPLPKRHRLVIVGNGMAPGRMLEHLFEHGGKDFDVKIFNAEPRVNYDRIMLSPVLSGEKTFDDIVIHGDGWYIEHGITLYKGHRVVAIDRQLKTVTSDQGEVARYDTLVLATGSDPLILPVPGASLSGVLSYRDLDDVTAMMLAAQPGHKAVVIGGGLLGLEAAAGLQARGMEVTVVHLMPTLMERQLDASAGYLLQKELEARGIRVLCGAKTRAVLGETRAEGLELEDGTTLDASLVVMAVGIRPNAALARGAGLNVGRGIRVDAQMGTSDPDILALGECAEVDGRVYGLVAPLYEMAKAAAARLAGDETITFRHADTATKLKVTGINLYSLGDFASESDREDIVLRDAARGIYKRVVLRENRVIGAVLYGDTRDGPWLSDLKKRDVDIGDIRETLIFGQNAQGAALDPLATVAALPDDAEICGCNGVCKGKIVTTIRTKNLTTLDAVRAHTKASASCGSCTGLVENLMSLVLGDGYQAGAAKTMCPCTPLGHGEVRRLIKVKTLTSIPAVMQELGWSTPDGCAKCRPALNYYLLCDWPDTYTDDPQSRFINERAHANIQKDGTFSVVPRAWGGVTSSKELRAIADVVDRFEIPMVKYTGGQRIDLLGVKKEDLPAVWADLNAAGMVSGHAYAKGLRTVKTCVGSEWCRFGTQDSTGLGIRLEKFLWGSWTPAKVKLAVSGCPRNCAEATCKDIGVICVDSGYEIHFAGAAGLEIRGTEKLGLVRTEDEAVEVIAALLQMYREQGFYLERIYKWAARIGTPVISEQILADPERRRDYFERFIVSQKKAQIDPWAERVAGLERQEFVSLTPQLPGGVS

SEQ ID NO: 38055 - protein, 1504 aa, Magnaporthe grisea 70-15
MSSQRGRQDAEDTGRRTIRLEIDRDLEIQRATMSQPASPTSTRRQRRHYPGSKGPSRGTSMSRQPDERSPLLSGPPAQYSHLRLPSSHGTPRSPHLSREQSYTFATRHHHRGNSFTTRLFHALADRQESSMADSKGASGADERVWYDQFTSTDWVRDNIADAYRVKALMSRKDFWGRIYVLFDGAQGWILSAVVGVTVAILAYIINVSEVTLFDLKYGYCARAWYLSEKQCCPHGDCIDFRLWDEIMQGYPFGYLGTDYAVYICAVVFFAVLACLLTLQTKTVVPSAYRLTTLDEDLGVDPAHASEPPHDPHDDSGSANLTPPPALAKEKNLNPPMIYYSAAGSGVAEVRVILSGFVLHGFLGAKTLLIKSAGLILSVASGLSLGKEGPYVHIATCVGNIACRLFAKYDYNDAKRREVLSAAAAAGVAVAFGAPLSGVLFGLEEVAYFFPAKTLFRTFFCCITAALTLKFLNPYGTHKIVMFQVHYKQDWEYFEIFSFILIGVLGGAAGAMFIKASRRWAQSFRRVPVVKQHPLLEVVLVALITGLIGYWNVLTKLPVAKLLYNLAAPCDDTDNNLEELGICPDNRDDIGATITRLFGAFLVKGFLTIVTFGIKVPAGIYVPSMVVGGLMGRIIGHCVQWFVLTTHTWTIWGTCSQVGDASCIQPGVYALIAAGATMCGVTRLSVTLAVILFELTGSLDYVLPFSLSVLVAKWTADAIEPLSVYDLLTNMNSYPYLNNKHKPIFTSDLGDIVPRIRRERIIDITNSPLVAAVSLRDKLNVLHQRGELDGGLPIVRDGTLVGLIPAPDLEFALDNLEDEESAMCLMADVPSVDDDDDGEPDPSDLTRYIDPAPVALDIRSPLDLVYECFVKLGLRYICVLRDGKFAGIHVASSHALATHTAYRPVASLEVVEIKQEVADGDQSARYRFDAISNAVNNNNVILDNIAGTAIVLTFGDDNNTQLPGDLNYERRLPLRLDRMGDQHQLIAHMAHGALPAPPSFPDRSKSSLPGSSGRSSSPDLPISPDRPTSFNRLTSPGALTPPNPFTFPPGVRRIKETFQVMRQRPPWLWLGTMLRLTAEMLYSTTTTKKCGSIGYEDIASRSTKGVNAREEEYSYRAAPAALRNEVIRHLLTVSDETVWTQHSVRKKATAYTTERFVYSPSLHKEPNILLNELEPSLSKIGSLHILCMVLGKFRTERSWLNPHFPEASPCVVATTFAKCYKTSLKVARIFAIYSRVLCVYTQYKVYQYIKPLAECYLFQMWSHEVVSGNFNDLALCDYRKEINHAIRTCLDAGLGGEMIDPTGITTMPLCQITLGSPTPRASQPSWLFPEDADPSGGNPIDVRKLDVVDTDDEARHSSSGSWTDSESDDEGPSTNCFYKLRSIQELQLPPRDPPPTETIELCRRVPDLVGDWNTQAAALHSSEHRLEVTEEKLRRMTSLAQAERDKAASLELMVKDLENKTDDVARIQDALNLITGKRKARSHLPEERPPRRARFDEAGGNGSLR

SEQ ID NO: 38056 - protein, 143 aa, Zea mays
  misc_feature (66)..(66): Xaa can be any naturally occurring amino acid
  misc_feature (131)..(131): Xaa can be any naturally occurring amino acid
TQEATTTSPISTQQAWRSREANDGSVVFGEEQEALVLKSWALMKNDIRNLCLRFLLKVFEIAPTAXRCPCCCADSDVPLEKNPKLKTHAMYDFVMTCEATAQLRKACKVTMRETTLNRLCATHLRLSVSDXHFEDTDFALLDT

SEQ ID NO: 38057 - protein, 464 aa, Oryza sativa (japonica cultivar-group)
MAKASVVVPEQVGAAAAAQVGCPCPGTTLFPYPPPRAGIAVRRKCLQAAQQLELGAGLRGGWVESMRASSPTHAKAAAALAAGVDEEHAAWMVRFRSPIDRCSSRSWRARADTDMNRAFPFVFVQARHPSALGEFEKVVAASKGKQIVMFLDYDGTLSPIVDDPDAAFMSETVSLSSPPLSPTLLLHSSSSHTSLLPHQMRMAVRSVAKHFPTAIVSGRCRDKVFEFVKLAELYYAGSHGMDIKGPASRHAAAKSPPHNKGVLFQPASEFLPMIEQVHQRLEQATSSIPGAKVENNKFCVSVHFRCVDEKSWGALAETVRRVVREFPRLRLSQGRMVFEVRPTIKWDKGKALEFLLDSLGFADCSDVLPVYIGDDRTDEDAFKVLRRRGQGVGILVSKHPKETSASFSLQEPAELKKSSVHYPLPAQRSNRLNRILVNWWGEGLKDKLCALEPSHEREGCMAPH

SEQ ID NO: 38058 - protein, 425 aa, Hyphomonas neptunium ATCC 15444
MADPKDWFTAGLEHIWLPYAQMRTLPAPVAIARTEGSRLYLADGRELVDGVGSWWTSIHGYNRPELLDAARDQMAKMPHIMLGGLAHEPAYRLATRLAEITPGDLSRVFFTESGSVAVEVAMKIAIQYFRNTAGVTRTKFVSFLGGYHGDTLATMSVCDPDEGMHHMFRGALAEQYVVALPETRDQIRALETLLSTDKKIAAVMIEPLIQGAGGMRMHSPQVLKTLRRLCDQAGVLLIFDEIFTGFGRTGEMFAAARAGVTPDIMCLGKAITGGITPLAATLASSKVYAAFHSENPDHALMHGPTYTGHALACAVANAGLDLFADGSLIKRVKKLEASLTSALAPAKDMDSVVDVRVLGAVAAVELADPFPIEAARKWFIDEGTFIRPLGRTVYLSPAYGISDDDLARLTGAILKFAKTGISDIG

SEQ ID NO: 38059 - protein, 466 aa, Synechococcus sp. WH 5701
MASKPDLQSERHSSDDDIYASGDLSTGMPKRTFPAKEKDPRAVYAAIHDELMLDGNSRQNLATFCQTWLEPEVHQLMNECINKNMEDKDEYPQTAEIESRCARMLADLWNAPSIDGAIGCTTLGSSEAAMLGGMAMKRRWEASRRQQGKPTDRPNLVTGPVQICWHKFTRYWDIEHREIPMESGCLMMTPEQVLKHCDENTIGVVPTLGVTFTGQYEPVQQVAEALDAYEQQTGLDIPIHVDGASGGFLAPFCSPDLIWDFRLPRVKSINASGHKFGLAPLGVGWVLWREAKDLPEEMVFWVNYLGGNMRDITLNFSKPGGQVVCQYYNFIRLGKEGYRKVHNACYATAQHLAKEIETLGPFEIIYGGDPDTGIPALCWRIKDGVDPGFNLFDLADRLRVRGWQVPAYTLPAHCSDQAIQRILVRHGVSRDLADLLLEDIRSAIDHLQLHPVSTSLSSREASGFHH

SEQ ID NO: 38060 - protein, 122 aa, Azospirillum brasilense
MAKTYDPNNVFARILRGEIPCKKVLETEHALAFHDINPQAPTHILVIPKGAYVDMDDFSARATEAEIAGLFRAVGEVARGAGAAEPGYRILSNCGEDANQEVPHLHIHVFAGRRLGPMITKG

SEQ ID NO: 38061 - protein, 722 aa, Oryza sativa (japonica cultivar-group)
MDTLNHIGAGDKLYGDNGTLAVVLHHGGASCKKNSSIPQTGTLSHIGAGSGVSSDESMLYDAVIAKPGAGSGDELYGDNSALAVVLHHGGASCKKNSSIPQTATLSHIGAGSGVSSDESMLYDAVIAKPGAGLDDELYHDNGTLAVVLHHIGAGHEKNKAYDVIDHTATINHIGADGKDSMVNDHVGAGGDQNKVFDNIGALGMPAAQQAPPSTGKVNHYQSSDHLGNNYHHDESSVRQLLHTRGRLCTRPGRILVPGGRGAHLYAAPSYTLAAADQIHNLQLFGVNNFAATGIIDYFGAGADDLGTASSVFDAADDITLAHYLAMATVQSVWQENCMEQFKLVLEALHQPHRNLYIAVDMEFTADAATNMSHRPVTSTSCYQHVRRYVNGGDIVQMGLTFAFVGDVEGEQAPSPPIALEINFDFNVNSPKYHGESIHFLSSQGHDLTQHSKRGVTPEFVYEGLLRHLPFGDGSVTWVAYHGDYDLAFLLRLLQGGDHGSDALLTLSCFFKIVSLSGHQMHRMDARRGLLAGLEEWNMAIKCARHIDDHTGSIYVVKMLPHKLDEEARRIEELDSDSYEIIVTFMNAEGMLAYSRAWKFCISSRADNGCVHPQQFAKFMASCGALGDPNISWVTFHGAHGIARMIRSFDIVTIPWIECKGGLFDVAQALNLKEIEADMEAARVLLTLRCYMRLAERPDFPGTKMAVQGLLKESCCWKCLANC

SEQ ID NO: 38062 - protein, 323 aa, Prochlorococcus marinus str. MIT 9312
MNTVTELLQPVENDLDDLIFELKNLIGAGHPILQAAAEHLFSAGGKRLRPGIVLLISKAISSEFCLTNKHKRLAEITEMIHTASLVHDDVVDEASTRRGVDTVHSRFNTRVAVLAGDFLFAQASWHLANLDNVNVVKLLSRVIMDLAEGEIKQNLNRFDSAQSFSKYINKSYCKTASLIANSCKAAGVLSDLSDEKLNSLYDFGKNIGLAFQVVDDILDFTGNDKQLGKPAVSDLASGYLTAPVLYALEENKKLSVLINRELAEKDDLDEALNIIMNSKSIESSRKLAEDFAMLSKEAIIWLPDSEYKRALLALPEFVLSRIY

SEQ ID NO: 38063 - protein, 240 aa, Prochlorococcus marinus str. MIT 9312
MTFTKYQFNNFCYWPSKPKKIVEFIGGSYLASKPDLTYRRFIESLIHKNYAVHAYKYTPQFDHQQLAIKAWKDFKNCRMSLYKRIGSSIPSIRIGHSLGCKLHLISPDGGRNCEKFISISFNNFSANKSIPLLKQIAQKLEFSSEFSPSPERTLRIIEKTYNQKNNFLIKFNSDELDQTDKLFSCLKARKEDNSKGIILKGTHTIIASAGLRENFLGDWADDDFKRNTIKRISNLIDNPD

SEQ ID NO: 38064 - protein, 157 aa, Arabidopsis thaliana
MVVTSFSSAPPIFFLPGADAQFSSSNGRFAIPSSSLVKGLRRHQDAKLVGNRTRVGVVRVLANPNVSPPPPPGKAKVKKEVIMVDPLEAKRLASKQMEEIKGREKQQRRREIEAINGAWAIIGLMIGLVIEAQTGKGILAQLAGYWSAVVHLFTPST

SEQ ID NO: 38065 - protein, 604 aa, Nicotiana attenuata
MDVRRRSDKPAYPTKEFTAGEKPLKPHKQQQEQDNSLLIASDALPLPLYLTNGLFFTMFFSVMYYLLSRWREKIRNSTPLHVVTFSELVAIISLIASVIYLLGFFGIGFVQSFVSRDNNDDSWDVEDENDEQFLLEEDSRRGPATTLGCTAVPPPPARQFVPMVPPQPAKIAAMSEKPAPLVTPAASEEDEEIIKSVVQGKMPSYSLESKLGDCKRAASIRKEALQRITGKSLEGLPLEGFDYESILGQCCEMPIGYVQIPVGIAGPLLLDGREYSVPMATTEGCLVASTNRGCKAIYASGGANSVLLRDGMTRAPCVRFGTAKRAAELKFFVEDPVKFETLAAVFNQSSRFARLQRIQCAIAGKNLYMRFVCSTGDAMGMNMVSKGVQNVLDYLQNEYPDMDVIGISGNFCSDKKPAAVNWIEGRGKSVVCEAIITEEVVKKVLKTEVAALVELNMLKNLTGSAMAGALGGFNAHASNIVSAVFIATGQDPAQNIESSHCITMMEAVNDGKDLHVSVTMPSIEVGTVGGGTQLASQSACLNLLGVKGANREAPGSNARLLATIVAGSVLAGELSLMSAISAGQLVKSHMKYNRSTKDVTKASS

SEQ ID NO: 38066 - protein, 140 aa, Roseovarius nubinhibens ISM
MAVERTLSIIKPDATKRNLTGKINAKFEDAGLRIVAQKRIQLTPAQAGKFYEVHAERPFYGELCDFMASEPVVVQVLEGEGAIAKNREVMGATNPADAAPGTIRAEFAESVGENSVHGSDAPETAAQEIAFFFSGLELVG

SEQ ID NO: 38067 - protein, 526 aa, Yarrowia lipolytica CLIB122
MIQSVFLALAILIAYLGFAEWFSRFQHRRISKKKGCGMPPMANGGFLGWYGLYKTYQITSERTYPHSMRMGLEAFGHTFVYPVPGTDMLQTIHPDNIKAILATQFKDFSLGTRHKIMLPTLGDGIFTLDGEGWTHSRALLRPQFARDQVSHVASLERHIQVLFKTIKKENKECDPAKGFDIQELFFMLTLDTATEFLCGDSVDSLTDYLADPTAPQLDHSGIDENVRRAFPEAFNTAQWFCSIRAKLMKLYFFAGTVFYRKKYADANKIVHDFTDFYVSKALAARKEKFQELDQEGKYIFLYELAKETRNPKVLRDQMLNILLAGRDTTASLLSWVMFRMARQPETWKKLRQAVINDFGDTPDELSFESLKRCEYLRYVLNEGLRLYPSVPMNFRVATRDTTLPKGGGPDLDQPIFIPKGGIVVYSVYHTHRAEEYWGKDTEEFIPERWDPAEGYQIARGWEYLPFNGGPRICLGQQFALTEAGYVLARLAQEFETVTSCDDKPLPPKYNTHLTMSHDDGVWLKME

SEQ ID NO: 38068 - protein, 278 aa, Citrus aurantium
EACEKWGFFELVNHGIEPEFMDTVERLTKAHYRKCMEQRFKELVASRALEGIQTEVNDMDWESTFYVRHLPQSTINEVPDLDEEYRKVMKEFALKLEKLAEELLDLLCENLGLEKGYLKKVFHGANGPTFGTKVSNYPPCPKPGLIKGLRAHTDAGGIILLFQDDKVSGLQLLKDGQWIDVPPLRHSIVVNLGDQIEVITNGKYKSVEHRVISQTDGEGRMSLASFYNPGGDAVIYPAPALLEKEAEKKQVYPKFVFEEYMKLYVPLKFQAKEPRFEA

SEQ ID NO: 38069 - protein, 213 aa, Campylobacter jejuni subsp. jejuni NCTC 11168
MKNYYLVDEKRKTPVSTWEKISQALRRSVKLELFVGLFVMMRELLKRNNSATIKYPFEKVKLDNRYRAVHRLMRFIESENERCIGCGLCEKICISNCIRMETSLDENGRKKVENYSINLGRCIYCGFCAEVCPELAIVHGTEYENAAEQRSYFGYKQDFLTPIDKLKNQVEFEGAGSLRKDANLWVKKTPNYYDVMIERALENQNTQEQGENK

SEQ ID NO: 38070 - protein, 216 aa, Schizosaccharomyces pombe 972h-
MRRAFVERNTNETKISVAIALDKAPLPEESNFIDELITSKHANQKGEQVIQVDTGIGFLDHMYHALAKHAGWSLRLYSRGDLIIDDHHTAEDTAIALGIAFKQAMGNFAGVKRFGHAYCPLDEALSRSVVDLSGRPYAVIDLGLKREKVGELSCEMIPHLLYSFSVAAGITLHVTCLYGSNDHHRAESAFKSLAVAMRAATSLTGSSEVPSTKGVL

SEQ ID NO: 38071 - protein, 498 aa, Zea mays
MALAGTGVFAEILDSEVYRYYADGEWRSSASGKSVAIVNPTTRKTQYRVQACTQEEVNKAMDAAKVAQKAWARTPLWKRAELLHKAAAILKEHKAPIAECLVKEIAKPAKDAVSEVVRSGDLVSYTAEEGVRILGEGKLLVSDSFPGNERNKYCLSSKIPLGVVLAIPPFNYPVNLAVSKIGPALIAGNALVLKPPTQGAVAALHMVHCFHLAGFPKGLISCVTGKGSEIGDFLTMHPGVNCISFTGGDTGIAISKKAGMVPLQMELGGKDACIVLEDADLDLVSANIVKGGFSYSGQRCTAVKVVLIMESIADAVVQKVNAKLAKLKVGPPEDDSDITPVVTESSANFIEGLVMDAKEKGATFCQEYRREGNLIWPLLLDHVRPDMRIAWEEPFGPVLPVIRINSVEEGIHHCNASNFGLQGCIFTRDINKAILISDAMETGTVQINSAPARGPDHFPFQGLKDSGIGSQGITNSINMMTKVKSTVINLPSPSYTMG

SEQ ID NO: 38072 - protein, 198 aa, Saccharomyces cerevisiae
MFHLVKGLYNNWNKKEQYSILILGLDNAGKTTFLETLKKEYSLAFKALEKIQPTVGQNVATIPVDSKQILKFWDVGGQESLRSMWSEYYSLCHGIIFIVDSSDRERLDECSTTLQSVVMDEEIEGVPILMLANKQDRQDRMEVQDIKEVFNKIAEHISARDSRVLPISALTGEGVKDAIEWMIVRLERNKKSRPPIYK

SEQ ID NO: 38073 - protein, 567 aa, Streptococcus pneumoniae TIGR4
MALEVIMPKAGVDMTEGQIVQWNKKVGEFVKEGEILLEIMTDKVSMELEAEEDGYLIAILKGDGETVPVTEVIGYLGEERENIPTAGAASPEASPVPVASTSNDDGKSDDAFDIVVIGGGPAGYVAAIKAAQFGGKVALVEKSELGGTCLNRGCIPTKTYLHNAEIIENIGHAANRGIVIENPNFTVDMEKLLETKSKVVNTLVGGVAGLLRSYGVTVHKGIGTITKDKNVLVNGSELLETKKIILAGGSKVNKINVPGMESPLVMTSDDILEMNEVPESLVIIGGGVVGIELGQAFMTFGSKVTVIEMMDRIVPAMDVEVSKNLRLILERKGMTILTGTKLQEIIEENGQLRIKVEGKDDIIASKALLSIGRMPDLEGIGEVEFELDRGCIKVTEYMETSVPGIYAPGDINGTKMLAHAAFRMGEVSAENALKGNHAVAKLNLTPAAIYTLPEVAAVGLTEEQAREKYDVAIGKFNFAANGRAIASDAAQGFVKVIADKKYGEILGVHIIGPAAAELINEASSIIEMEITVEEMLKTIHGHPTYSEVMYEAFADVLGMAIHSPKKK

SEQ ID NO: 38074 - protein, 160 aa, Medicago truncatula
MNRGKTYECASYKKRPHDSQYGASTPIDEWCSSTYCYYCEPILGYFDRGMEKIVENRTIIQYLPYETRWDYLATMFTEAITINGPEQLGNIQVPKRANYIRVIMLELSRIASHLLWLGPFMADIGAQTPFFYIFRERELIYDLFEVTSVMRMMHNYFRIG

SEQ ID NO: 38075 - protein, 502 aa, Thermotoga maritima MSB8
  misc_feature (1)..(1): Xaa can be any naturally occurring amino acid
  misc_feature (13)..(13): Xaa can be any naturally occurring amino acid
  misc_feature (32)..(32): Xaa can be any naturally occurring amino acid
  misc_feature (43)..(43): Xaa can be any naturally occurring amino acid
  misc_feature (227)..(227): Xaa can be any naturally occurring amino acid
  misc_feature (265)..(265): Xaa can be any naturally occurring amino acid
  misc_feature (382)..(382): Xaa can be any naturally occurring amino acid
  misc_feature (448)..(448): Xaa can be any naturally occurring amino acid
XGSDKIHHHHHHXKEIDELTIKEYGVDSRILXERAGISVVLAXEEELGNLSDYRFLVLCGGGNNGGDGFVVARNLLGVVKDVLVVFLGKKKTPDCEYNYGLYKKFGGKVVEQFEPSILNEFDVVVDAIFGTGLRGEITGEYAEIINLVNKSGKVVVSVDVPSGIDSNTGKVLRTAVKADLTVTFGVPKIGHILFPGRDLTGKLKVANIGHPVHLINSINRYVITREXVRSLLPERPRDSHKGTYGKVLIIAGSRLYSGAPVLSGXGSLKVGTGLVKLAVPFPQNLIATSRFPELISVPIDTEKGFFSLQNLQECLELSKDVDVVAIGPGLGNNEHVREFVNEFLKTLEKPAVIDADAINVLDTSVLKERKSPAVLTPHPGEXARLVKKTVGDVKYNYELAEEFAKENDCVLVLKSATTIVTDGEKTLFNITGNTGLSKGGSGDVLTGXIAGFIAQGLSPLEASTVSVYLHGFAAELFEQDERGLTASELLRLIPEAIRRLKE

SEQ ID NO: 38076 - protein, 301 aa, Roseovarius nubinhibens ISM
MTLEGIYTPVVTPLHDDFSVDYDALADVVDHLVASGVHGLISGGSTGENYTQTVEERLEIARFTQDRLKGRLPLFVGTGMMRTEDSLAMATGAREMGADGILHGTPPYSVPTEHENALNTLAVDRAADLPMILYNYPGRMGVNMGEEFLDRVGRSRNVIGIKESSGDINRVHLLARDYPHIQLSCGMDDQALEFFAWGARSWICAGSNFLPEEHVFLYETCVVQGDFTKGRRIMSAMMPLMRVLEQGGKFIQCVKHGTTFMGHPTGTVRPPLRPLNKDDKRQLEQVIRTLKRTISDIKAEN

SEQ ID NO: 38077 - protein, 476 aa, Mycobacterium avium subsp. paratuberculosis K-10
MRDDDSANRWSGVREAPTAPSRQLTGAVVIIALVAAISGMLYGYDTGVISWALLQLTQDFNITEGWQQVIAASILLGAVAGALTCSWLSDLRGRRGTLLMLAVVFIVGALWCADAADSVMLSLGRLVLGFAVGGATQTAPMYVAELAPPAYRGRLVLCFQIAIGVGILTATLVGAGGSISWRGPIGLACVPAAIMLWLLLRLPESPRWLVKKDNRDAARAVLEHVRPEGYDVAAELDEATELARVERTAATRGWRGLRDAWVRPALVLGCGIAVFTQLSGIEMIIYYSPTILTDDGVYRSVALQVSVCLGAAYLIAQLVGLAIIDRVGRRRLTLIMVPGAAVSLFALGLLFITSDSGRDVIPYIMICLIAFMLFNGGGLQLMGWLTGSETYPLAVRPAATALQSATLWGTNLVITLTMLSLIKAIGVGPLMWLYALFNVAAWIFVFFRMPDLTGKTLEEIEYQLSEGKFRPSDFGR

SEQ ID NO: 38078 - protein, 502 aa, Roseovarius nubinhibens ISM
MSDLLTREEYGAIAKGLTLPVNAFIDGSFRPARSGATFETVNPATGAKLADVAACDTKDVDFAVEKARDAFEDGRWSRLHPSARKDVLIRLCKLLTRNAHELAVMESLDSGKTIYDCETVDIPETIHCLKWHAELIDKIYDQVSPASDDHIAMVLREPVGVVGLVLPWNFPLLMLAWKIGPALAAGCSVVVKPAEETPLTALRLAELAHEAGVPAGVLNIVTGDGPGVGEPLGRHPDVDMVSFTGSTETGRRFLHYSADSNLKEVVLEMGGKNPCVVLDDAENLDSVAAHVVNGAFWNMGENCSASSRLIVHASVKDDLLARVEAHAREWITGDPLDPQVRVGALVSRAHFDKVCSYLDEVQKGRVVIGGTHSGGAFVDPTVVEISGNDARLAREEIFGPVLSVITVTSTEEAISIANDTPYGLAASVFSANGKRAIRAARAIKAGTVTVNSFGEGDITTPFGGYKHSGFGGRDNGIHAHDQYTQLKTIWIDLSDDSDDQIG

SEQ ID NO: 38079 - protein, 306 aa, Rhodobacter sphaeroides 2.4.1
MILCCGEALIDMLPRETTAGEAAFAPYAGGAVFNTAIALGRLGAPAGFFSGLSTDLFGVQLAETLAASQVETDLCARSDRPTTLAFVRLTNGQASYAFYDENTAGRLLAPADLPALPDRVSTLFFGGISLVNEPAAATYEALMAREAPRRVTMLDPNIRPGFIADAAAYRARIGRMIALADILKLSDEDLHWLEGPGQILSLARGLLARGPKLVLVTEGAVGARAVTATEDRFCAATPVQVADTVGAGDTFNAGVLAALHEAGALSRSAVASLSPETLAAALALGTRAAAVTVSRPGANPPWVDEL

SEQ ID NO: 38080 - protein, 285 aa, Brassica napus
  misc_feature (141)..(141): Xaa can be any naturally occurring amino acid
MAIISEVEDESSTRPRILPFRATLDSSNPSSFLEKVFDFLAEQSDFLKKPSAEEEISAAVRAAKEKLGKAEKKAEKESVEKKKPVEKESVKPATAASSSEPIQVEEKKQEASPIAPNKGNGYDLENYSWVQTLQEVTVNIXPVPTGTKARSVVYEIKKNRLKLGLKGQDPIIDGELYRSVKPDDCYWNIEDQKMISILLTKQDQMEWWKCCVKGEPEIDTQKVEPENSKLADLDPETRSTVEKMMFDQRQKQMGLPTSDELQKQDILKKFMSQHPEMDFSNAKIN

SEQ ID NO: 38081 - protein, 408 aa, Campylobacter jejuni subsp. jejuni NCTC 11168
MQIPSKLKPYYENIAFEQEDSKMIINLGPQHPSAHGNLRLILELDGEQVVKARPCIGYMHRGMEKMAENMIYQEFIPTTDRMDYIAASANNYAYCAAVEKLCGLEIPRRAAVIRMILLELNRITSHLLWLATHALDIGAMSVFLYCFREREYVLDLIEKYCGARLTHSSMRIGGVMLDLPENYLEEMLAFCDKFPNDLKDYEDLLDDNRIWRLRTENVGVVTKEQALNWGCTGVMLRGSGIKYDIRKEEPYLLYNEVEFGVPYATQGDSYARYKVYMQEFRESLKILRQCAMLYKDTSPEILATHPEYVSASKEQILTQNYSLMQHFVLITQGLKPPKGEVYVPTESPKGELGFFIHSDGTGRPYRLKARTPSYWHCAFFEEMLVGTYLADVVAIMGNVNIVLGEIDR

SEQ ID NO: 38082 - protein, 170 aa, Arabidopsis thaliana
MQSSNVTDCTMRKRGTKRKIEIEKRMTKQQRSVACSKRRPTLFSKAADLCLLSGANIAVFVTSPDENSDVVYSFSGYSHASEIVDCYLNNKSPPKTTINPESAKFWWEEPDLYRDCDDLSELRIIEDRLMRTKKHLMDYLEKKEKSHSVSKSDQNPNNDTSHHLINLVTW

SEQ ID NO: 38083 - protein, 431 aa, Escherichia coli
SKIVKIIGREIIDSRGNPTVEAEVHLEGGFVGMAAAPSGASTGSREALELRDGDKSRFLGKGVTKAVAAVNGPIAQALIGKDAKDQAGIDKIMIDLDGTENKSKFGANAILAVSLANAKAAAAAKGMPLYEHIAELNGTPGKYSMPVPMMNIINGGEHADNNVDIQEFMIQPVGAKTVKEAIRMGSEVFHHLAKVLKAKGMNTAVGDEGGYAPNLGSNAEALAVIAEAVKAAGYELGKDITLAMDCAASEFYKDGKYVLAGEGNKAFTSEEFTHFLEELTKQYPIVSIEDGLDESDWDGFAYQTKVLGDKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGEKAPYNGRKEIKGQA

SEQ ID NO: 38084 - protein, 555 aa, Saccharomyces cerevisiae
MYNGKDRAQNSYQPMYQRPMQVQGQQQAQSFVGKKNTIGSVHGKAPMLMANNDVFTIGPYRARKDRMRVSVLEKYEVIGYIAAGTYGKVYKAKRQINSGTNSANGSSLNGTNAKIPQFDSTQPKSSSSMDMQANTNALRRNLLKDEGVTPGRIRTTREDVSPHYNSQKQTLIKKPLTVFYAIKKFKTEKDGVEQLHYTGISQSACREMALCRELHNKHLTTLVEIFLERKCVHMVYEYAEHDLLQIIHFHSHPEKRMIPPRMVRSIMWQLLDGVSYLHQNWVLHRDLKPANIMVTIDGCVKIGDLGLARKFHNMLQTLYTGDKVVVTIWYRAPELLLGARHYTPAVDLWSVGCIFAELIGLQPIFKGEEAKLDSKKTVPFQVNQLQRILEVLGTPDQKIWPYLEKYPEYDQITKFPKYRDNLATWYHSAGGRDKHALSLLYHLLNYDPIKRIDAFNALEHKYFTESDIPVSENVFEGLTYKYPARRIHTNDNDIMNLGSRTKNNTQASGITAGAAANALGGLGVNRRILAAAAAAAAAVSGNNASDEPSRKKNRR

SEQ ID NO: 38085 - protein, 171 aa, Cryptomeria japonica
MANPRVFFEMAVGGAPAGRIVMELYADVTPKTAENFRALCTGEKGTGKSGKPLHFKGSSFHRVIPGFMCQGGDFTAGNGTGGESIYGSKFPDENFQKRHTGPGILSMANAGKNTNGSQFFICTAKTEWLDGKHVVFGQIVDGMDVVRAIERVGSSSGRTSKPVVIQDCGQL

SEQ ID NO: 38086 - protein, 942 aa, Schizosaccharomyces pombe 972h-
MSGETVHGISCYSVVANTEDTYNQTLDFYQKLGFKKVASFGTSDSDNARVCNESLREDWMHVAGNNSAESVTIKFRLVPGELSLSPAAEDSEWRGQKSSLVFYYPNLLDLLKQLSADAIKYQAFPNEKKPDEVYVEDPLGNLIGFSDRYNPFAHANLKKSEESGAASNLESGLATPVVETLKKATTSDKPAGVKKKIAVMTSGGDSPGMNAVVRAVARIAIHRGCDAFAIYEGYEGLVQGGDMIKQLQWGDVRGWLAEGGTLIGTARCMAFRERPGRLRAAKNLISAGIDSIIVCGGDGSLTGADIFRSDWPGLVKELEDTKAITPEQAKLYRHLTIVGLVGSIDNDMSSTDVTIGAFSSLHRICEAVDSISSTAISHSRAFIVEVMGRHCGWLAVLAALATGADFVFIPERPAEVGKWQDELCNSLSSVRKLGKRKSIVIVAEGAIDSELNHISPEDIKNLLVERLHLDTRVTTLGHVQRGGIPCAYDRMLATLQGVDAVDAVLASTPDTPSPMIAINGNKINRKPLMEAVKLTHEVADAIEKKQFAHAMELRDPEFADYLHTWEGTTFIEDESHFVPKDERMRVAIIHVGAPAGGMNSATRAAVRYCLNRGHTPLAIDNGFSGFLRHDSIHELSWIDVDEWCIRGGSEIGTNRDTPDLDMGFTAFKFQQHKIDALIIIGGFEAFTALSQLESARVNYPSFRIPMAIIPATISNNVPGTEFSLGCDTCLNAVMEYCDTIKQSASASRRRVFVCEVQGGRSGYIATVGGLITGASAIYTPEDGISLDMLRKDIDHLKATFALEAGRNRAGQLILRNECASKVYTTEVIGNIISEEAHKRFSARTAVPGHVQQGGNPTPMDRARAARLAMRAIRFFETCRANDLGNDPSSAVVIGIRGTGVSFSSVADVENNETEIEMRRPKNAWWRDMHNLVNILAGKTFAD

SEQ ID NO: 38087 - protein, 367 aa, Triticum aestivum
  misc_feature (130)..(130): Xaa can be any naturally occurring amino acid
  misc_feature (147)..(147): Xaa can be any naturally occurring amino acid
  misc_feature (173)..(173): Xaa can be any naturally occurring amino acid
  misc_feature (181)..(181): Xaa can be any naturally occurring amino acid
  misc_feature (313)..(313): Xaa can be any naturally occurring amino acid
  misc_feature (347)..(347): Xaa can be any naturally occurring amino acid
MIADPAVTPLTSPHLPSVSLPYPEHQFPLSGPAPLSLSPDNMGSDFKAIPLIDIGPLVEKIDDPAMADDKALLDVVQMLDDACREAGFFYVKGHGISESLMTEVRDVIRKFFQLPREEKLKIKMPPRGGXRGYSEEGGENVPQGETXDMHEAIGCYTPNRTRANFGVLAKPMXGSNLWPDXPSNFDPLLGDYITLLRDLSRKIMRGIALALGAPLDAFEAGVAGDAFWVLRLIGYPVSDDIPQEDRTDIGCGAHTDYGLLTLVNQDDDICALEVRNQSGEWIYAKPVPGTFVCNIGDMLKVWSNGIYQPTLHXRVVNNSPRYRVSCRLLLTSSNFEPCGGNLVEFCXRRKTGGVAKFVERGVFWESP

SEQ ID NO: 38088 - protein, 136 aa, Glycine max
MMVTRRRTRVLVSGESAKNVRATYHLYNPEQIGWNLVTASAYCAAWDANKPLAWRKKYAWTAFCGPVGPRGRESCGKCLRVTNTGTGTEATVRIVDQCANGGLDLDVNVFRQLDTNGVGNQQGHLTLNYRFVNCAD

SEQ ID NO: 38089 - protein, 169 aa, Capsicum annuum
GCVPKKILVYGAAYGPELEDARNYGWEVNERVDFNWKKLLHKKTEEIVRLNGIYKRLLSNAGVKLFEGEGRVIGPNEVELIQLDGTKMSYSAKHILISTGSRAHRPGIPGQELAITSDEALSLEELPKRAVILGGGYIAVEFASIWRGMGVTVDLCFRKQLPLRGFDDE

SEQ ID NO: 38090 - protein, 119 aa, Brassica rapa subsp. pekinensis
LMWYFLNVIFNILNKKIYNYFPYPYFVSVIHLFVGVVYCLVSWSVGLPKRAPINSDILKVLIPVAVCHAIGHVTSNVSFAAVAVSFTHTIKALEPFFNASASQFLLGQPIPITLWVSLA

SEQ ID NO: 38091 - protein, 1269 aa, Streptococcus pneumoniae TIGR4
MVYSIRSLKNGTGSVLIGASLVLLAMATPTISSDESTPTTNEPNNRNTTTLAQPLTDTAAGSGKNESDISSPGNANASLEKTEEKPAASPADPAPQTGQDRSSEPTTSTSPVTTETKAEEPIEDNYFRIHVKKLPEENKDAQGLWTWDDVEKPSENWPNGALSFKDAKKDDYGYYLDVKLKGEQAKKISFLINNTAGKNLTGDKSVEKLVPKMNEAWLDQDYKVFSYEPQPAGTVRVNYYRTDGNYDKKSLWYWGDVKNPSSAQWPDGTDFTATGKYGRYIDIPLNEAAREFGFLLLDESKQGDDVKIRKENYKFTDLKNHSQIFLKDDDESIYTNPYYVHDIRMTGAQHVGTSSIESSFSTLVGAKKEDILKHSNITNHLGNKVTITDVAIDEAGKKVTYSGDFSDTKHPYTVSYNSDQFTTKTSWRLKDETYSYDGKLGADLKEEGKQVDLTLWSPSADKVSVVVYDKNDPDKVVGTVALEKGERGTWKQTLDSTNKLGITDFTGYYYQYQIERQGKTVLALDPYAKSLAAWNSDDSKIDDAHKVAKAAFVDPAKLGPQDLTYGKIHNFKTREDAVIYEAHVRDFTSDPAIAKDLTKPFGTFEAFIEKLDYLKDLGVTHIQLLPVLSYYFVNELKNHERLSDYASSNSNYNWGYDPQNYFSLTGMYSSDPKNPEKRIAEFKNLINEIHKRGMGAILDVVYNHTAKVDLFEDLEPNYYHFMDADGTPRTSFGGGRLGTTHHMTKRLLIDSIKYLVDTYKVDGFRFDMMGDHDAASIEEAYKAARALNPNLIMLGEGWRTYAGDENMPTKAADQDWMKHTDTVAVFSDDIRNNLKSGYPNEGQPAFITGGKRDVNTIFKNLIAQPTNFEADSPGDVIQYIAAHDNLTLFDIIAQSIKKDPSKAENYAEIHRRLRLGNLMVLTAQGTPFIHSGQEYGRTKQFRDPAYKTPVAEDKVPNKSHLLRDKDGNPFDYPYFIHDSYDSSDAVNKFDWTKATDGKAYPENVKSRDYMKGLIALRQSTDAFRLKSLQDIKDRVHLITVPGQNGVEKEDVVIGYQITAPNGDIYAVFVNADEKAREFNLGTAFAHLRNAEVLADENQAGPVGIANPKGLEWTEKGLKLNALTATVLRVSQNGTSHESTAEEKPDSTPSKPEHQNEASHPAHQDPAPEARPDSTKPDAKVADAENKPSQATADSQAEQPAQEAQASSVKEAVRNESVENSSKENIPATPDKQAELPNTGIKNENKLLFAGISLLALLGLGFLLKNKKEN

SEQ ID NO: 38092 - protein, 392 aa, Mycobacterium avium subsp. paratuberculosis K-10
MAQREWVEKDFYKELGVSSDASPEEIKRAYRKLARDLHPDANPDNPAAGERFKAVSEAHNVLSDPAKRKEYDETRRLFAGGGFGGRRFDTGGFGGFNVGGDGAEFNLNDLFDAAGRSGGTNIGDLFGGLFGRASGGRPSRPRRGNDLETETQLDFVEAAKGVAMPLRLTSPAPCTNCHGSGARPGTSPKVCPTCNGSGVISRNQGAFGFSEPCTDCRGSGSIIEHPCDECKGTGVTTRTRTINVRIPPGVEDGQRIRLPGQGEAGLRGAPSGDLYVTVHVRPHKVFGRDGDDLTVTVPVSFTELALGSTISVPTLDGKVGVRVPKGTADGRILRVRGRGVPKRSGGHGDLLVTVKVAVPPNLDGAAQEALEAYAAAERASGFDPRAGWAGNR

SEQ ID NO: 38093 - protein, 279 aa, Oryza sativa (japonica cultivar-group)
MNQERNTNNDVGHEKQLNLQMSLNYFPVENLDRLARIGNPSAVSTGLRLSYENNEHTSITSGSGNMSSLPIMASFVDEVMAELDKENKEFNCYFGLQVEQLVKCMKDVKQRQMVEFLASLERGVGKKLKEKELEVEAMNRKSKELNEQIRQVALEVQSWQSVALHNQSVANSMKSKLMQMVAHSSNLTREGSGDSEVDNTASSQNVNAVPGVFFQSGLLGINSMADGGLGACRLCRMKEAAVLVMPCRHLCLCADCEKNADVCPVCRFPKSCSVEINMS

SEQ ID NO: 38094 - protein, 424 aa, Treponema denticola ATCC 35405
MSKVLSIILGGGKGTRLYPLTMHRSKPAVPFGGKHRIIDIPLSNCINSGFRNIYIVTQFNSASLHIHIAKAYTFDTFSNGFVEILAAEQTFDNTGWYEGTADSIRKNLHHFRHQNPSHYLILAGDQLYRMDLKKFLNFHKESESDITVACTPVTREDASGFGIMKVNSDSLITEFMEKPGADKNIDDWKIPEKSLIKPNDPNKQYLASMGIYIFSAKIMEECLDSDHTDFGKEVIPAAINGKYKVSAFPHNGYWSDIGTIKSFYDATLDLTEITPKFDFYDAERPIYTHNRNLPPSKVNYAHLSRSICSEGCVITNSTINHSVIGVRSIIETGSFVEDSICMGADYYETHEEKETRLKEGSPGLGIGNHCRIRSAIIDKNVRIGNNVSIGMDQTPPDGDYGFYHVVGGIYVIVKNSVIPDNTSI

SEQ ID NO: 38095 - protein, 387 aa, Ostreococcus tauri
  misc_feature (1)..(1): Xaa can be any naturally occurring amino acid
XGHFSTCWLVEDVGSGREMNGKVTYRALKIQKSSGSYTEAAKDEIEILTQCKDQAASAEERELGSDNVVRLHDHFTHQGPNGTHVCMVFDVLGDNLLTLIKRYEYLGVPLLGVKALTRAMLRGLRYLHDVKNIIHTDLKPENVLLTLALPEKKRGRKSKNKVVDPRKDVKAGTPTLVDQIERLDVASSKRESGQVENDTSKETNSEDDIDCVDLLPYSLLKRLDAKICDLGNACWVDRQFTQDIQTRQYRAPEVILGAKYDTSADIWSLACIVFELATGDVLFDPRSGKDYDRDEDHLALMMELVGRMPKHLALSGKYSKEFFNRSGELRHIRSLKFWPCERVLIEKYNMPEKDAKDLSDFLVPMLDFNPSKRATAEKMLEHRWLQF

SEQ ID NO: 38096 - protein, 331 aa, Flavobacteria bacterium BBFL7
MSKAIVLKQRPNGTPQTDDFEIIKEEQPSVKSGEVLLKAKYVSVDPYLRGRMRDEESYIEPFKINKPIASTVVAEVVESKNEKYKEGDFLTGMLDWKEYQVHTGDTLRKISSDHIALSAYLGVLGLTGLTAYFGLNRIGEPKKGQTLLVSGAAGAVGSIVGQIGKIEGLSVIGIAGSDEKVSLLTDQLGFDAAINYNTTDDLAAAIKEHAPDGIDIYFDNVGSYTLDAAMKNINRFGRVINCGAISLYNETEQPTGPRLETTLVKKSVKMQGFIVRNFEEDFPEGVQQLSKWLQEGKLKHEETIVNGFDSIPQAFIDLFKGKNKGKMVVKI

SEQ ID NO: 38097 - protein, 586 aa, Bacillus anthracis str. Ames
MKQSVSAEQIELKSSLPGSKKVYVDGPREGMKVPMREIEQSDTNGVPNPPIRVYDTSGPYTDPAYKVELEKGIPTPRHSWILERGDVEAYEGREVKPEDDGVKVASKHTPVFPQMDRKPLRAKQGANVTQMHYARNGIIKSEMEYVAIREGVDPEFVRKEIAEGRAILPANINHPEAEPMIIGRNFHVKVNANIGNSAVSSSIAEEVEKMTWATRWGADTIMDLSTGKNIHTTREWIIRNAPVPVGTVPIYQALEKVNGIAEDLTWEVYRDTLIEQAEQGVDYFTIHAGVLLRYIPITAKRTTGIVSRGGSIMAQWCLFHHKENFLYTHFEEICEIMKQYDVSFSLGDGLRPGSIADANDEAQFSELETLGELTKIAWKHDVQVMIEGPGHVPMHLIKENMEKELDICQGAPFYTLGPLTTDIAPGYDHITSAIGAAMIGWFGTAMLCYVTPKEHLGLPNKDDVREGVITYKIAAHAADLAKGHKTAHQRDDALSKARFEFRWRDQFNLSLDPERAMEYHDETLPAEGAKTAHFCSMCGPKFCSMRISHDIREYAKENDLETTEAIEKGMKEKAKEFKETGSHLYQ

SEQ ID NO: 38098 - protein, 698 aa, Flavobacteria bacterium BBFL7
MTDVIDVFVPATTQTQVQPAGLKNGINENADGSITFLLAAPGKTDAAVIGDFTNWNLDTNFQMYKDGDYFWVTIPSTYFTTGQTFQYQYIVDYTIKVADPYSGLILDPDSDQYIKPGNFPNLPVYPTGLTTGDVSLYTYQATPYNWTVNNFQKPDKENLVIYELLVRDFSEADSFQEVINRIDYLETLGINTLQLMPINEFEGTDSWGYNPKFHGALDKAYGTPEKFKELVDLCHSKGIAVVIDVVYNHAFSQSPLCQMWWDENNFRPAANNPYLNSSPTHDFNVGYDFNHESQWTRDYVKQTLQYWIDEYRIDGFRFDLSKGFTQNFTLGNIGAWSAYDQSRVDILNDYKNTIWNANSNDIYMILEHLGDNSEETALANAGFMLWGKMTDEFNQNSMGYSSNHDVFRSYYLARGWNDQHLVAYAESHDEQRLMYKNLNFGNAANSSHNVRSLPVALDRQEAIAAILYSIPGPKMLWQFGELGYEIDIDQNGRTGRKPIPWTLNYDTDQDRMDLYDVTATMIGFKTQYPDTWNTTNNNLDVSGVTKRINLDGPVFDVVVVANYGVTAQNVNPNFSQTGTWYEYFSNASMNVTNPTAMINLQPGEYRVYSTQQLQDPLSNIEITDHTESDIKLFPNPAQNSFRLSQDIEHISIVNMNGQQVLEYNENLSTYSIENLNTGVYIINVKTEKGNRRIKLIKQ

SEQ ID NO: 38099 - protein, 168 aa, Rumex obtusifolius
MDAEVEYRCFVGGLAWATDDQSLERAFSNYGQVLESKIINDRETGRSRGFGFVTFSSEQAMRDAIEGMNGQDLDGRNITVNEAQSRGSGGGGGGYRGGGGGGYGGRREGGYNRGGGGGYGGGGGGYGGGGGGYGGGGGGYGGGRREGGYGGGGGDRYARGNSDSDWRN

SEQ ID NO: 38100 - protein, 263 aa, Amycolatopsis mediterranei
MPISGTTRLYVVLGDPVAQVRSPGLLNPLFADLDVDAVLVPVHAPPPHLERIVAGLQAVANLDGIFVTVPHKVAVAGLADRRSPMVEITGSANALRREADGRWYAENFDGTGFVAGLVEAGHDPKARRVSLVGAGGAGSAIAAAVLAAGADRLALCDPDTAKLAALKGRLDVHWPGRTSVSAEPDTAGADLVVNATPLGLRPGDPLPFRPDRLAPGRVVADIIMKPRETRLLREAAALGHDVHYGSHMLAGQLDSYRDFFGLG

SEQ ID NO: 38101 - protein, 882 aa, Yarrowia lipolytica CLIB122
MKLNVIDAAKHAKDLWMKQDPRDEEDESDVQAEVVEIEEQLIEWMANKLGIPPSDKDGGYPLEVHFMAEKLAEMPIDKALELVKTNYAYHDHDNNFRHEYRMEVKSVLEAFGEGEDPEKEDPDNLILLRYWAVIFHWWSPYPEVRSVTDPYDETDTTVETWRVWVLGTIWVAISAFVNQFFSVRLPAISLDASVCQLLLYPCGRFLQYVLPDWGFSFRGRRYTLNPGVWSQKEQLLATIMVSCAAGTPYITSNIITQALPSFYNQDWAANYGYQFVFMLVTQMMGFGMAGLLKRVAVYPVKAMWPSLLPTLAVNKALLAPNRKESINGWKISRYTFFMIMFVVSFLYFWVPNYLMNFLQTFNWMTWIAPNNADLAIVTGSIGGLGFNPIPTFDWNQATANLAPITLPLYTSITGFCGSLFGGLVILALYYSNNSWTGYIPINSNRLFDNKGKAFNVTRILTNYRFDREKYLAYSTPYYSAGNLVLYSAFFAVYTFSFVYTTLMDWRAMRDAIVDTAKAIRYIHRSNYHGRVDPYSRYMKKHKEVPDWWFYLTMLIMFVLAIVLVEVWPVDTPVWSIVFVMGLVAVFIVPFTVFVSYTATSLSLNVLAELIIGYALPGRFMALNLIKALSVQIAQQAENYTSDQKLTHYAHLPPRSIFWLQIWATLVNGVVCLGVIQFQLGLENLCDADNKLKFTCPSETTFFTASVAWGVIGPKKMFNKYPVMKWMFLFGAGAGLFFYVVQVTLPKFLAKWWPKHAEKIDYYRRKCLYFNPLIFVVGIIDGWAPYNLTYKVGGLYLAILFNGYIKGRYLAWWRKYAYVMEAAIVTGIALSGIIIFFSVQYNPKDLDWWGNNVIGDGVDGSGIPPNKKIPEDPGFFGPDSSQW

SEQ ID NO: 38102 - protein, 905 aa, Hyphomonas neptunium ATCC 15444
MGNAAVKNADETWVYAFGGGTSDGDASMRNLLGGKGANLAEMAKLGLPVPPGFTISTAVCVAYYDTGRVYPATLDAQVSDALAALEGKTGKGFGDPENPLLVSVRSGARASMPGMMDTVLNLGLNEAVAAGLAGKAGDRFAYDSYRRFIQMYSNVVLGMGHDEFEHILDDYKEREGLDLDTELTADNWKQVIVRYKEAVQKELGRPFPEDPREQLWGAISAVFDSWMSDRAIIYRKLNDIPANWGTAVNVQSMVFGNLGDTSATGVAFTRDPSNGSPIFYGEYLINAQGEDVVAGIRTPAPISRERANTLGSSDAPLEEAMPPVYKQLVDVANTLERHYKDMQDIEFTVEDGTLYMLQTRNGKRTAAAAVKIAVDMVREGLITEEEALLRIDPTALDQLLHPRIPSDDENKKAGNAAYDVAFKGLPASPGAAVGRVVFDSEEAFALAAKGEDVILVRVETSPDDIKGMHAARAIVTARGGMTSHAAVVARGMGRPCVCGASDLRINTAKGEFTARGRTFKKGDMITVDGVNGRVIAGAVSLINPDLSGDFGEFMGWADKRRTLKVRANAETPLDTRTAVEFGAEGVGLCRTEHMFFDEERIPAVRTMILSNDETGRREALAKLLPMQRSDFEEIFRILGDRPATIRLLDPPLHEFLPHTDEDIAGVAKASGLSAEELRRRAADLHESNPMLGHRGCRLGITYPEIYEMQARAIFEAAVNIFKEGKLKPVPEVMIPLVATHRELDILKKLVDETAQKVFAETGVTLDYMVGTMIELPRAALAAGEIAQAAEFFSFGTNDLTQTTLGISRDDAGKFLPIYSEKGIYEKDPFVTLDQEGVGELVKIAAERGRKTRPDIKLGICGEHGGDPASVEFCHRAGLDYVSCSPYRVPIARLAAAQAAIRGAKK

SEQ ID NO: 38103 - protein, 392 aa, Bacillus cereus ATCC 14579
MKLFQPSEIVTSLPTQFFASLVAKVNKVVAAGHDVINLGQGNPDQPTPQHIVKALQDAAEKTIHHKYPPFRGHESLKEAVATFYKREYGVELNPKTEVAILFGGKAGLVELPICFTNPGDTILVPDPGYPDYLSGVALAKAHFERMPLIAENNFLPDYTNIDASIAERAKLMFLNYPNNPTGATASKDFFDETIYFANKHNILVVHDFAYGAIGFDGQKPVSFLQADGAKDIGIEIYTLSKTFNMAGWRIAFAVGNESVIETINLLQDHMYVSIFGAVQDAAREALLSSQSCVIDLVNSYESRRNALISACHSIGWNVDIPTGSFFAWLPVPKGYTSEQFSDILLEKAHVAVAPGVGFGEHGEGYVRVGLLHTEDRLREAINRIDKLNFFKK

SEQ ID NO: 38104 - protein, 577 aa, Ostreococcus tauri
MCNRARVATVVRALEEPETFTDDDLDNIVFADLSEEAAISNKSGAGETMAAPDWMTQLNRLWGGASEIPVADAKLEDITGLLGGGLFQPLFKWMLEAGPVYLLPTGPVTSYVVVSDAACIKQVLFNYGSKYIKGTIAEAGEFLFGLGVALQELEPWKVRRKAVAPSLHRKYVEAMVDRCFALCADRMTTILEEEAANGAVGSVNLESRFSKTALDIIGISVFNYDFKALTTAAPVIQATYTALKEVETRSMDLLPTWRLPEQFLRIVSPRQRNAQDAVTVIRDVTQRLVDDCKRMVEEEEKVGGAEEWARDYLNESNPSVLRYLIAAREEVSSTQLRDDLLSLLVAGHETTASVLTWGTYELLKPENAEQLRLLRAELDEVLGTRPYPTFADLAKMPYLERCFHESMRLYPQPPVYTRRAVVEDVLPNGMTVPKNQDLLVSIYNLHRSPANWGPTSQQFEPMRFGPLANGQPNELNTDYRYVPFSAGPRRCPGDKFAVRLDLELKAGHDVIMTSGATIHTKSGLLATVKKREVREVPEAERVDWANLMPAKELGGDEWYAPWNQPAPAASGKCPMGH

SEQ ID NO: 38105 - protein, 664 aa, Coccidioides immitis RS
MSVTTVLHPVQHPSIGSLKQQPQMNLPSSDGTLDKFPALDDESHRTPADADVPLSASNFRYSPEPFWLPRKNGTLSHGFPSSRKQRPRKSISEAIGSFKKRSASVSVNAQELAEALKAPVSYRLIGLCIVWYMTSALTNTSSKEILNALPKPITLTIVQFGFVSTCCLLLSYLASVFPTLRSTVPALKNGIRYPTLEVISTALPLALFQLAGHILSSMATSQIPVSLVHTIKGLSPLFTVLAYRVLFRIRYARATYLSLVPLTMGVMLACSAGFSTNFFGILCAFCAALVFVSQNIFSKKLFNESSRIEAEGQALTGRKLDKLNLLCYCSGLAFFLTAPIWFFSEGYPLLMDLLQDGAIDLTEKKGSLDHGPLILEFIFNGMSHFAQNILAFVLLSMISPVSYSVASLIKRVFVVVVAIVWFGNATTPIQAFGIGLTFVGLYLYDRNSHEDAADRRANADHFHIKKTILPLSVRNTNNNNKGWSSNGYAFPPIKEGSPENTKGYISASTGNFKKDDSGPNGRPRKSSAVRPWMPPGTKQESTWQPGDSAKTHPHNYVDGRLLKCILKSEDVATVDWKFQRKPIENNTNRRNDVVLVTRNPPSLPIIPFSSLSPFSSLSYFSPCDIFSSLQDAAAIVPCGGPLEEMVQTQLLPHIRNDCPSSSGG

SEQ ID NO: 38106 - protein, 372 aa, Sesbania rostrata
MDSGLCLVSGLNHKDVQTRFFGPSWLQMQSHVPMNFIWPKECLVNAHEELQAPLVDLDGFLRGDEEATHRAAELISKACLTHGFFQVINHGVDQRLIGEAYNQMDGFFKLPIDRKLSVRKIPGSMWGYSGAHADRFSSKLPWKETLSFPFHDNNSEPVVTNYFNSTLGKTFEQTGVTFQKYCEAMKGLGMKLMELLAISLDVDRFHYKDLFEDGCSIMRCNYYPSCQQPSLALGTGPHCDPTTLTILHQDQVGGLDVFADKKWQTVRPLPHALVVNIGDTFTALSNGRYKSCLHRAVVNQYKERRSLAFFVCPKEDKVVRPPEDIVRRDGTKQYPDFTWSKLLEFTQKYYRADEDTLQNFTKWLLSSKPQTL

SEQ ID NO: 38107 - protein, 305 aa, Saccharomyces cerevisiae
MSSSSQFKQLEKLGNGTYATVYKGLNKTTGVYVALKEVKLDSEEGTPSTAIREISLMKELKHENIVRLYDVIHTENKLTLVFEFMDNDLKKYMDSRTVGNTPRGLELNLVKYFQWQLLQGLAFCHENKILHRDLKPQNLLINKRGQLKLGDFGLARAFGIPVNTFSSEVVTLWYRAPDVLMGSRTYSTSIDIWSCGCILAEMITGKPLFPGTNDEEQLKLIFDIMGTPNESLWPSVTKLPKYNPNIQQRPPRDLRQVLQPHTKEPLDGNLMDFLHGLLQLNPDMRLSAKQALHHPWFAEYYHHAS

SEQ ID NO: 38108 - protein, 228 aa, Schizosaccharomyces pombe 972h-
MAANYWASSQLTQLFLSTDLESLEPTCLSKDTIYQWKVVQTFGDRLRLRQRVLATAIVLLRRYMLKKNEEKGFSLEALVATCIYLSCKVEECPVHIRTICNEANDLWSLKVKLSRSNISEIEFEIISVLDAFLIVHHPYTSLEQAFHDGIINQKQLEFAWSIVNDSYASSLCLMAHPHQLAYAALLISCCNDENTIPKLLDLIKSTDAFKVILCVQRIISIYYFEDIE

SEQ ID NO: 38109 - protein, 81 aa, Triticum aestivum
MPATPTIIGALLGLGTQMYSNALRKLPYMRHPWEHVLGMGLGVVFVNQLVKFDEKVKVDLDKMLERAKHANEQRYFDQDDD

SEQ ID NO: 38110 - protein, 992 aa, Kluyveromyces lactis NRRL Y-1140
MNNSVYGVAFRSLSTGDEKLYKEATRFYHSLGFQTVKLYDNFKNHDDSNLIVGTSKNSVKECWLESFKLSELDSQGFRVPQQEASNQLQTDGVMIKLRLVDTEPLNQTADTVVYYTVSLDEVSKIGERVDDHNVKLVDPLGNVVLVTDSHDGKELNASEFIAPKDSSVEQKITVELVDKDSKKKKIAVMTSGGDSQGMNAAVRAVVRSSIYYGCDVYAVYEGYEGLVKGGDYLRKMEWKDVRGWLSEGGTLIGTARSKEFRERWGRKQACSNLIDQGIDALVVIGGDGSLTGADLFRSEWPSLVEELVKDGKFTEDEVALYQNLTIVGMVGSIDNDMSGTDSTIGAYSALERICEMVDYIDATAKSHSRAFVVEVMGRHCGWLGLMSGIATAADYIFIPERAAPHGKWQDELKRVCQRHREKGRRNNTVIVAEGALDDQLNPITAEQVKDVLVELGLDTKITTLGHVQRGGTAVAHDRWLATLQGVDAVKAILNMTPETPSPLIGILENKVIRMPLVESVKLTKQVAAAIEAKDFDKAISLRDTEFIELYSNFMSTTVNDDGSQLLPEADRLNIAIVHVGAPSAALNAATRAATLYCLAHGHRPYAITNGFSGLIQTGQVKELSWIDVEDWHNLGGSEIGTNRSVAAEDMGTIAYHFQKNKFDGVIILGGFEGFKSLKQLRDGRDQYPIFNIPMCLIPATVSNNVPGTEYSLGSDTCLNALVKYTDAIKQSASSTRRRVFVVEVQGGHSGYVASFTGLVTGAVSVYTPENAINLKTIQEDLALLKESFKHEQGETRNGKLVIRNEMASDVYTTELLADIITEQSNDRFGVRTAIPGHVQQGGVPSSKDRVIASRFAVKCVKFIEQWNKKNTAADNEDFKILRFNYVNGVKQYTVLDEDLSAAVICVNGSKISFKPIAHIWENETNIELRKGQEIHWEEYNEIGDILSGRSMLRRKIQKEQQEESSLPSVADTPLSSVTVSTSAAKEDSALYV

SEQ ID NO: 38111 - protein, 330 aa, Rubrobacter xylanophilus DSM 9941
MPGTISYTEALREALDEELGRDERTFFMGEDVGAFGGIFGEAAGLQQKYGKERVFDTPISETFIVGGGVGAAITGLRPIVELQFADFVSVAMDEIYNKAAKWRYMHGGLFKVPLVIIAPEGAMGGAGPEHSQCPEALFWSAAGLYVLTPATPADAKGLLKSAIRDDNPVLFLPHKALGNTTGEVPEGEHLVPLGEAVVRRQGGDVTLVAWSAMVLKALEAADRLAEEGIEVEVIDPRGIRPFDFETVLRSVEKTGRVVLAHEAPLPGGPGSEVAAVIAERAIASLEAPVRRVGAPDVPVPQSAHLERFVVPQTEDIVNAVREVAGSAVTV

SEQ ID NO: 38112 - protein, 396 aa, Rubrobacter xylanophilus DSM 9941
MHKLHLPRLGQTMERGTILRWARREGEPFEVGDILYEVESEKAVNEIEAKLPGTLARITVEEGQECPVGTLLAVVADPGETLSEEEIEAAIAEEGGREAPAASGGGTGVRAPSSARAQRRVRAMPKARALARELGVELAAVEGTGQGGAITVEDVRRAAGAAPGEGPRVRERRPLGDVGRTMARVVTRSWHEVPQFVQMVQLDASALVGRRRELAGQIKRSHGVDLSYTDLLLEAVAGAAGEEPLANSSLVDGEILLYEDVNVSVAVATGSGLLVPVVRWAQALELGELAARLREVLERARSGRLSAEDTAGGTITLSNLGMYGIEGGTPLVTHPQAAVVFAGAIVERPWAVSGRVEVRPTLTLSVGFDHRILDGVAAARFTTALRRRLESPNQEG

SEQ ID NO: 38113 - protein, 195 aa, Pediococcus pentosaceus ATCC 25745
MEVHNVELQISAVRPDQYPEQGYPEIALVGRSNVGKSSLTNTLINRKSYARTSSQPGKTQTLNFYRVEDQLFFVDVPGYGYAKVSQKEREKWGKMIEKYITSRKELKGVISLVDARHEPTDDDITMYQYLRYYDIPVLVVATKSDKIARGKWNQHESKIKKALDFDGSSAFQMFSAQTKMGKEEVWKWIEDRMGE

SEQ ID NO: 38114 - protein, 357 aa, Rubrobacter xylanophilus DSM 9941
MPEKKMMRAAVYRGPRELRVEPVPVPEIGPSDVLVRVHSCGICGSDLHSYKAGMYIRPGQIMGHEFMGTVAAAGEDVEGVEEGDRVTGFSIGVCGSCYWCSRQQYILCPELFRNSTGYGLPGGFAEYVPIRNAVVGQSIHPVPSELDDETAATTEPVSVGVGAIEAAGVRPGDRVVVLGAGMIGNACMQAARAAGAGQVAVIDVSPVRLEAARSLGADAVFDARTGDALSWVKELWGVGRYHFNEGGMADVVVEAAGAPVTVQQAFEMVRSGGAIVFVGLPEEPAPIDVTKIVHKQPRIVGSLGGDFARAIELMASGSIRTKELITHRFPLEDAAEAFETQLRTGEAMKVMIQPREG

SEQ ID NO: 38115 - protein, 358 aa, Bacillus halodurans C-125
MIDTGLRIERSSNPKQKPDPEQLSFGKVFTDHMFVMDYTEEKGWHDPRIVPYGSITLDPAAMVFHYGQTVFEGLKAYRTNDDRILLFRPEKNIQRLNRSCHRISIPQIPEEAAIDYLVKLLQVDRDWVPSAEGTSLYIRPFVFANEINLSAVPSTEYTFMIILSPVGSYYKEGIQPVNIYVEDEFTRAVRGGTGTAKTGGNYSASYIAQEKAAEKGYAQVMWLDGIEKKYIEEVGSMNVFFKIDGEIVTPILNGSILEGVTRMSIIELLRDWGYPVAERKISMEELFAAYEKGKLEEAFGTGTAAVVSPIGQLNWKEHQMVINDKRIGELSKKLYDTLTGIQRGQLPDPFNWNREVNE

SEQ ID NO: 38116 - protein, 680 aa, Mycobacterium leprae TN
MDFYNSYSQGFVRVAACTHHASIGDPTTNAASVLRLARQCHDDGVAVAVFPELTLSGYSIEDILLQDLLLEAVEDTVLDIVVASADLLPVLVIGAPLRYRHRIYNTAVIIHRGVVLGVAPKSYLPTYREFYERRQLAPGDDEHGTIGIGDLRAPFGPDLLFAAADLLGLVLHVEICEDMFVPVPPSAEAALAGATVLANLSGSPITIGRAEDRRLLARSASLRCLAAYVYAAAGEGESTTDLAWDGQTMIWENGVLLAESERFPKGEHRSVADVDTELLRSERLRMGTFNDNRRRHRALVEPFRRIEFRLEPPVGNIGLLREVERFPFVPADPQRLQQDCYEAYNIQVSGLEQRLRALDYPKVVIGVSGGLDSTHALIVAARAMDREGRPRSDILAFTLPGFVTGDRTKSNATELCRALGVTFTEIDIRDTATLMLKKIGHPFSRGEVSYDVTFENVQAGVRTDYLFRLANQHGGIVLGTGDLSELGLGWSTYGVGDQMSHYNINAGVPKTLVQHLIRWVIASSQFEEQVDKVLQSVLDTEITPELIPSDGEEKLQSTEAKVGPFALQDFSLFQVLRYGFRPSKIAFLTWHAWSDPNCGKWPPGFPEDKRLSYSLKEIRHWLQIFVQRFYSFSQFKRSALPNGPKVSHGGALSPRGDWRAPSDMSARIWLDEIEREVPEE

SEQ ID NO: 38117 - protein, 543 aa, Candida tropicalis
MSSSPSIAQEFLATITPYVEYCQENYTKWYYFIPLVILSLNLISMLHTKYLERKFKAKPLAVYVQDYTFGLITPLVLIYYKSKGTVMQFACDLWDKKLIVSDPKAKTIGLKILGIPLIETKDPENVKAILATQFNDFSLGTRHDFLYSLLGDGIFTLDGAGWKHSRTMLRPQFAREQVSHVKLLEPHMQVLFKHIRKHHGQTFDIQELFFRLTVDSATEFLLGESAESLRDESVGLTPTTKDFDGRNEFADAFNYSQTNQAYRFLLQQMYWILNGSEFRKSIAIVHKFADHYVQKALELTDEDLEKKEGYVFLFELAKQTRDPKVLRDQLLNILVAGRDTTAGLLSFLFFELSRNPEIFAKLREEIENKFGLGQDARVEEISFETLKSCEYLKAVINETLRIYPSVPHNFRVATRNTTLPRGGGEGGLSPIAIKKGQVVMYTILATHRDKDIYGEDAYVFRPERWFEPETRKLGWAYVPFNGGPRICLGQQFALTEASYVTVRLLQEFGNLKQDPNTEYPPKLQNTLTLSLFEGAEVQMYLIL

SEQ ID NO: 38118 - protein, 333 aa, Triticum aestivum
  misc_feature (255)..(255): Xaa can be any naturally occurring amino acid
  misc_feature (271)..(271): Xaa can be any naturally occurring amino acid
MSLSTASRRALSRIGGALRRSFSSSSVPDASGYHVSGGPSFMRAAVFWEPGRPLTMEEFRMPRPKAGEVLVKTKACGVCHSDLHVMKGELPFASPCVVGHEITGEVVDHGMHTPAEIVNRFPVGSHVVGAFIMPCGNCFYCVKGQEDLCESFFAYNRAKGTLYDGETRLFLRSNGKPVYMYSMGGLAEYCVVPANALAILPNSLPYTESAILGCAVFTAYGALRHAAEMRAGDSLAVIGVGGVGSSCLQIARHLXSSRIIAVDVLDDKPQXAKTLGATHTVNAAKEDAVERIKGITGGRGVDVAVEALGKALTFSQCTQCLPRPRPPVYRLRL

SEQ ID NO: 38119 - protein, 468 aa, Pseudomonas syringae pv. syringae B728a
MGLNDQWMQRDLKVLWHPCTQMKDHENLPLIPIKRGEGVWLEDFEGKRYLDAVSSWWVNVFGHANPRINQRIKDQVDQLEHVILAGFSHQPVIELSERLVKLTPDGLTRCFYADNGSSCIEVALKMSFHYWLNRGQPDKKRFVTLTNSYHGETMAAMSVGDVPLFTETYKALLLDTIKVPSPDCYHRPDGMSWEEHSRNMFVAMEQTLAEHHASVAAVIVEPLIQGAGGMRMYHPIYLKLLRDACDRYGVHLIHDEIAVGFGRTGTMFACEQAGIRPDFLCLSKALTGGYLPLAACLTTDDVYDAFYDDYPTLRAFLHSHSYTGNPLACAAALATLDIFEQDNVIENNKALAQRMATATAHLVDHPHVAEVRQTGMAIAIEMVQDKATKTAYPWQERRGMKVFQHALERGALLRPLGSVVYFLPPYVITPEQIDFLAEVASEGIDIATRSSVSVAVRENFHPDFRDPG

SEQ ID NO: 38120 - protein, 479 aa, Oryza sativa (japonica cultivar-group)
MAHRLLLPTNPLLPPGTGTATPRRRPVAATVRAALATSAEEARAATGAEVVRSIRARQIVDSRGNPTVEVDLVAGDGRLHRSAVPSGASTGIYEALELRDGDGAAYGGKGVLNAVRNINEVIAPKLVGVDVRNQSDVDAIMLDIDGTPNKSKLGANAILGVSLSVCRAGAGAKEVPLYKHIQELAGTKELVMPVPAFNVINGGSHAGNNLAMQEFMLLPVGASSFSEALRMGSEVYHALKGIIKAKYGQDACNVGDEGGFAPNVQDNREGLVLLMDAIEKAGYSGKIKIGMDVAASEFLTKDGSYDLNFKNQPNDGAHVLSAQRLCDLYKEFVKDFPIVSIEDPFDQDDWSSWASLQSSVNIQIVGDDLLVTNPKRIAEAIGKKACNALLLKVNQIGTVTESIQAALDSKAAGWGVMVSHRSGETEDNFIADLAVGLASGQIKTGAPCRSERLAKYNQLLRIEMELGNVRYAGEAFRSP

SEQ ID NO: 38121 - protein, 570 aa, Bacillus cereus ATCC 14579
MTLNIQGIAASSGIAIAKAFRLENPEFNIEKKSITNEAAEIARLDAALEKAKTELEAIKDHAFAELGADKAAIFEAHLLVLNDPELVNPVKDKVNSEKVNAEFAMDEVASMFISMFENMDNEYMKERAADIRDVTKRVLAHLLGINFSNPGTISEEVIIIAEDLTPSDTAQLNRKYAKGFTTDIGGRTSHSAIMARSMEIPAVVGTKVVMEKIQNGDIVIIDGLDGEVIVNPSEETLRSFEEKKAKFEEQKAEWAKLKDQATVTSDGHHVELVANIGTPNDVQGIIDNGGEGVGLYRTEFLYMGRDNLPTEEEQFEAYKAVLEGVKEGQPVVVRTLDIGGDKELPYLHLPKEMNPFLGYRAIRLCLDEQDVFRTQLRALLRASVYGNLKIMFPMIATLDEFRQAKAILLEEKAKLVEAGTTVSDSIEVGMMVEIPASAVLADQFAKEVDFFSIGTNDLIQYTMAADRMNEQVSYLYQPYNPSILRLVKMVIDAAHKEGKWAGMCGEMAGDSLAIPLLLGLGLDEFSMSATSILPARTQLSKLSKAEMETLAEKALMMSTAEEVVELVKSI

SEQ ID NO: 38122 - protein, 629 aa, Pseudomonas syringae pv. syringae B728a
MSFASLGLSEALVRAIEAAGYTQPTPVQQRAIPAVLQGRDLMVAAQTGTGKTGGFALPILERLFPNGVPDKSQRHGPRQPRVLVLTPTRELAAQVHESFKLYARDLKFVSACIFGGVGMNPQVQAMSRGVDVLVACPGRLLDLAGQGSVDLSHVEILVLDEADRMLDMGFVHDVKKVLARLPAKRQNLLFSATFSNDITSLAGKLLHNPERIEVTPPNTTVERIEQRVFRLAANHKRSLLAHLITVGAWEQVLVFTRTKHGANRLAEYLDKHGLAAVAIHGNKSQNARTKALADFKAGDVRIMVATDIAARGLDIDQLPHVVNFELPNVDEDYVHRIGRTGRAGRSGEAISLVAPDEEKLLKSIERMTKQKIADGDLMGFDITAVEAEKPEVRERPDVRNSRGARPARGDGDKNNGGRRDKGKDKGKEKPAAASATGERPARQPREKKPREGTPRSEQRASQPATPRPAADRAPDEFRDDEVDNFGNRADYVSPYQGKGQNRGRRPAAAPGAAAPAAGGAARPANPGRPAGGARNGSGSGAPKRNGSGSSAPRSRDGQPRGRRPAREDQPLPREGQEPAARAPRDGQPQPKIVHKESKIDRFPSAEQLDQLPSRPRGEKPALLTRNRDS

SEQ ID NO: 38123 - protein, 238 aa, Synechococcus sp. WH 7805
MSELQNQMKQAVADAAVEQFQDGMVVGLGSGSTAALMIKGLGERLAAGQLNDIVGVTTSFQGEVLAAELGIPLRSLNAVDRIDLAIDGADEVDPSFQLIKGGGACHVQEKLVAARADRFIVVVDSTKLVERLNLGFLLPVEVLPGAWVQIRQQLNAMGGEAELRMATRKAGPVVTDQGNLVLDVRFEGGIADPVSLEKDINNIPGVLENGLFVNLADEVLVGQVDDGVASARSLERAR

SEQ ID NO: 38124 - protein, 548 aa, Schizosaccharomyces pombe 972h-
MSQFAEFKLPAIKNEPPKHYGPNSADREGIVKAYKELEAELPVTIPVIIDGKEVETNTIGEQRCPFEHKKVVARYHRAGAKHVEDAIEAALRGKKVWESLPFADRSAIFLKAAHLISTKYRYKLMAATMIGQGKNIWQAEIDAGMEIIDFLRFNTKYASELYASQPPENTPGVWNRMEYRPLEGFVYAITPFNFTAIAGNLAAAPLLMGNVVLMKPSDHAVLSSYIVYQIFREAGLPAGALQFIPGDAVEVSKVCFNHPEFAGLHFTGSTAVFRSLWGTIGENVANGKYRTYPKIVGETGGKNFHLVHSSAEIKSAVVNAVRAAFEYQGQKCSALSRLYVSKYAWENGFRDELTKQVKSLKVGAPLTDFANFVGPVIHQASFNKLKKVLESAASDSEIEVLAGGKADDSEGFFVEPTVLLSKNPKHDIFVNELFGPVLSVYVYEDDNLDAVCDLIDTTTPYGLTGSIFAQDRVVVRKLTDRLRNAAGNFYINDKCTGAVVGEQPFGGARASGTNDKAGSGMILSRFVSPRSIKDTFAYADSVLYPSNF

SEQ ID NO: 38125 - protein, 190 aa, Arabidopsis thaliana
MVLVLALGDLHVPHRAADLPPKFKSMLVPGKIQHIICTGNLCIKEIHDYLKTICPDLHIVRGEFDEDARYPENKTLTIGQFKLGLCHGHQVIPWGDLDSLAMLQRQLGVDILVTGHTHQFTAYKHEGGVVINPGSATGAYSSINQDVNPSFVLMDIDGFRAVVYVYELIDGEVKVDKIEFKKPPTTSSGP

SEQ ID NO: 38126 - protein, 245 aa, Triticum aestivum
  misc_feature (93)..(93): Xaa can be any naturally occurring amino acid
  misc_feature (109)..(109): Xaa can be any naturally occurring amino acid
  misc_feature (123)..(123): Xaa can be any naturally occurring amino acid
  misc_feature (135)..(135): Xaa can be any naturally occurring amino acid
HIPRALTQRRPRIPSQAGWRGRPRISLPVSKEKPQNPEFCPILTFSRAIESLSPPVFFGRFPGNSPRGAPSWGLYFGRVSGLFKKKGFKGSFXNGGQFAKNLGIYSGVXSLVVCLPKKLRGKXEAINVGIAGCCXTGLALSYPGAPQAMPQSGVTFGAFSFFLEGLNKRQTALAHSVSSRHDQTRSLKDDFPLSLALPIQEEIKGAFSSFCKSLTKPKKLAFPSSRGSKFFLYPTTSFCRCKKNR

SEQ ID NO: 38127 - protein, 212 aa, Kluyveromyces lactis NRRL Y-1140
MCQEKNTMTTMDTSSKGTLISDKTAKVQTRQRVFSFSHLNVFDGKHPYSDPGNHDPDHFKPHMSKFRFECRQSLLKVIELTHTEAIILWIQAHLRSKPMDVFFAFTAIMGSHTFYVVMLPIPRWTGFSVVTRDLVYILGYSIYLSGHFKDYWCLPRPKSPPVHRITLSDYTTKEYGAPSSHTANATGVSLLTVWYISQLSVSHEYLRIIFIL

SEQ ID NO: 38128 - protein, 218 aa, Kluyveromyces lactis NRRL Y-1140
MALIVDNFRRTLGDIPHYSQCGVKGRSAQYHLKIVVVGDGAVGKTSLLISYTQGKFPEDYVPTIFENYVTNLEGPNGKIVELALWDTAGQEEYSRLRPLSYTDVDVLMICYAINSKVSFYNIEEMWLPEVKHFCPDVPIMIVGLKSDLYAEDNISDFVDAFKAEETAKRIGAFVHLQCSSKSQQKVREVFDTAITAALYDELKPKKKKLNSRRKCVII

SEQ ID NO: 38129 - protein, 391 aa, Staphylococcus aureus subsp. aureus Mu50
MVTQNKKILIITGSFGNGHMQVTQSIVNQLNDMNLDHLSVIEHDLFMEAHPILTSICKKWYINSFKYFRNMYKGFYYSRPDKLDKCFYKYYGLNKLINLLIKEKPDLILLTFPTPVMSVLTEQFNINIPVATVMTDYRLHKNWITPYSTRYYVATKETKQDFIDVGIDPSTVKVTGIPIDNKFETPINQKQWLIDNNLDPDKQTILMSAGAFGVSKGFDTMITDILAKSANAQVVMICGKSKELKRSLIAKFKSNENVLILGYTKHMNEWMASSQLMITKPGGITITEGFARCIPMIFLNPAPGQELENALYFEEKGFGKIADTPEEAIKIVASLTNGNEQLTNMISTMEQDKIKYATQTICRDLLDLIGHSSQPQEIYGKVPLYARFFVK

SEQ ID NO: 38130 - protein, 535 aa, Magnaporthe grisea 70-15
MVRGFKRPENEAGAAWPAILVGAFVSFGGVLFGYDTGTISGILAMKYWKELFSTGYTDATGQLGISPSEEAAVVSILSAGTFFGALASVFLADSIGRRWALIASCWVFNLGVIFQTAAVALPLFLAGRFFAGFGVGLISAMIPLYQSETAPKWIRGAIVGAYQLSITIGLLLAAIVNNSTHERDDTGSYRIPIAVQFAWSIILIVGMLILPETPRFLVKKGKMDQAARSLGKLRRLPADHEAIVAEVAEIKANNDYEMSQGTAGYIDCFRGPMLKRQLTGMGLQALQQLTGVNFIFYYGTKYFENSGISQPFVIQMITSVINVVSTIPGLIAVDRWGRRPMLLWGAIGMTISQFLVAMLGTLTTGQRADGSIIVYNVEAQKAGVAFVCIYIFFFASTWGPLAWVVTGEIFPLKQRARGLSLTTATNWLLNWAIAYMTPYLVNFGPGYANLQSKIFFVWFGACFLCIAFVYFFIYETKGLSLEEVDELYAQVSSARHSSAWQPSVSFTQRTGVDSATVEKIEGDASDHAVDQANRV

SEQ ID NO: 38131 - protein, 448 aa, Camellia sinensis
MAEPTKRFITFESLKAHNKPGDLWISIQGKVYDVSDWAKEHPGGYLPLLSLAGQDVTDAFVAYHPNTAWQYLDKFFNGYFIEDYSVSEVSKDYRMLVSEFSQMGLFEKKGHLALISFCFMALLFSVSVWGVLCCSSIWVHLVCGGLMGGLWIQSGWAGHDSGHYQIMPSKKLNRFVQILTGNCLAGISIAWWKWNHNAHHISCNSLDFDPDLQHMPFFVVSSKLFNSLTSCFYERKMPFDSVTRLFVSYQHWTFYPVMCFARLNLFAPSFMLLCSKRKVPNRVQEILGISVFWYLDPLLVSCLPNLGERLMFVLASFAVSGIQHVQFCLNHFSSIVYVGPPSGTDWCGKQTRGTLDITCPSWVDWFHGGLQFQIEHHLFPRLPRSQLRKVSPFVRELCKKHNLPYDTASFWKANALTVRTLRNAALQARDVANPVQKNLVWEAVNTHG

SEQ ID NO: 38132 - protein, 533 aa, Triticum aestivum
MDLELLWSGPPALSVLPWICGGLVASVLLWQAARLLDQLWWRPRRLERALRSQGLRGTRYRFLLGDVNDYARQTKEASSGPPMPLRCHDVGPRAMPFLYSTIKEHGTPCISWFGPVPKVSITDPALVREVMSSKLARDVEKFKFPALTRLLADGVGNYEGDRWAKHRRILNPAFHAEKLKLMFPAFTACCEELVGRWEQSLGPDGSWEVDVCPELQSLTGDVISQTAFGSSYLEGRRIFQLQTEQIARFMAAVSKIMIPGYMSFPTKNNRRMHQINNEIESILRGIIAKRMHAIHEGESTKDDLLGLLLESNMSDTDENGQSTLGMSADEVMEECKLFYFAGMETTSILLTWTMIVLSMHPEWQDRAREEVLGLFGKHKLEYEGVNRLKIVTMILYEVLRLYPPATVFTRKTYKKIEIGGIMYPAGVMFEMPVLYIHHDTDIWGEDVHEFNPDRFAEGISKASKDPGAFFPFGWGPRICIGQNFALLEAKMALCMILQRFEFELAPSYTHTPHSVMMLRPMHGAQIRLHTISS

SEQ ID NO: 38133 - protein, 145 aa, Triticum aestivum
  misc_feature (73)..(73): Xaa can be any naturally occurring amino acid
  misc_feature (76)..(76): Xaa can be any naturally occurring amino acid
MASTATCEAPMQGLKYTDGLPVSRRSNSASLGSDSNGGRIRSMQEWPIEGIKKFETLSYLPPISTEALLKQVXDYXRSSSKWERCLDDSKAGHMTREHNASRGYYKRRNWTMWKLPMIGSTDATQVINEDEEGKKENPDANVRII

SEQ ID NO: 38134 - protein, 136 aa, Mycobacterium leprae TN
MTERTLVLIKPDAVERQLIGEIISRIERKGLTIAALELRQVGEELASQHYAEHESKPFFGSLLEFITSGPVMAAIVEGPRAVAAVRQLTGGTDPVEKAAPGTIRGDLALETQFNLVHGSDSTASAQREIALWFPGI

SEQ ID NO: 38135 - protein, 434 aa, Physcomitrella patens
MAAILRKYIVVGGGVAGGYAAREFVKLGLQPGELTIFSKEAAAPYERPALSKAYLFPDAPARLPGFHVCVGSGGEKQLPDWYAEKGIELKLETEIVKADVENKTLTTNKGDIYEYGTLILATGSTFLNLADFKTPGADAKGIYYLRDIGDADKIVEAIKASKGDEAVVVGGGYIGLELAACLTMNKIKVNMVFPEPCLMPRLFTPELASFYERYYEGKGVNIIKGTTVTAFEKDDNGHVSKVLLKNGSSVNSTFVVVGVGARPLLAPLKGLIEEEKGGFKVDASFKTSNPNVYAVGDIATFPMKMYGDSRRVEHVDHARKSAMQAVQAIKAAEKGEVVDEYDYLPFFYSRSFNLSWQFYGDNVGETVLWGRNGAAASESKFGAYWVKDNKVMGAFLEGGSPDENKLIAKVAREQPTVNSTDELVSGGLGFASKI

SEQ ID NO: 38136 - protein, 352 aa, Pyrenophora teres
MPPAGSGSSRKISFNVSEQYDIQDVVGEGAYGVVCSALHKPSGQKVAIKKITPFDHSMFCLRTLREMKLLRYFNHENIISILDIQKPRNYETFTEVYLIQELMETDMHRVIRTQELSDDHCQYFIYQTLRALKAMHSANVLHRDLKPSNLLLNANCDLKVCDFGLARSAASTEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPWKAMFPKTNDLALDLLERLLAFNPVKRITVEEALKHPYLEPYHDPDDEPTADPIPEEFFDFDKNKDNLTKEQLKLLIYQEIMR

SEQ ID NO: 38137 - protein, 479 aa, Agrobacterium tumefaciens str. C58
MPAKKTMLRPKKQATMAKKSPPLDLSSTRGVSSWREAAQWLRVRGIEDIECITPDLAGVARGKMMPTAKFTGDTSLALPSALYRHTISGEYPDETANFRYEPRDSDLKLVPDLSTLSVVPWESDPTAQVICDVVDAEGNFVPYTPRNVLKNVLSLYTEKGWKPVVAPEIEFYLVAMNDDPDYPLHPPKGRSGRSIVGGQSYSIAGINEFDELIDDIYHFSEKQGLEIDTLIHEEGPAQLEINLRHGDPIELADQVFLFKRTIREAALKHGIYATFMAKPMQGQPGSAMHIHQSVVEIDGGRNIFSNADGSPSKVFFSFVGGMQRYVPNALVMLAPYVNSYRRLTPDMACPVNNAWGYDNRTTAFRVPISSPQARRVENRLPSSDANPYLALAASLGCGWLGIVNNIEPTEPTADTANEGSIELPRGLLEAVALLEGEEQFDRVFGHEFVGLYAGLKRGEFETFMQVISPWEREFLLLNV

SEQ ID NO: 38138 - protein, 212 aa, Arabidopsis thaliana
MKIDPRRDRFPCCIVWTPLPFISWLVPFIGHVGICREDGVILDFAGPNFVCVDNFAFGAVSRYIQINKEMESSRSSSSGMFNGERRYEQEEDSHEKEPTWDDALRKSTQEYQHHSYNILTCNCHSFVANNLNRLSIKSGGWNVVNLATLVLFKGRWVNKTAIVKSLLPPLIVYTIGILLGGWTFIASCSILVVLLTGWFIIGTYCFKKLIQL

SEQ ID NO: 38139 - protein, 229 aa, Arabidopsis thaliana
MVSPSFSTKLVFFACFVLFTFSHKLVTGESDKVELNLYYESLCPGCQSFIVDELVKVFDSDLDTITDVKLVPFGYAKVSNNLTVICQHGEEECKLNALEACVINTLPNPKSQYKFIRCVENNTDNWESSCLKGYGNEKAINDCYNSDLSKKLILGYAKQTSSLKPKHEFVPWVTINSKPLYTKLDDLVGQVCKAYKGKTPLPIDCSSAALSERKMSNVEFSYVDEIISH

SEQ ID NO: 38140 - protein, 298 aa, Salmonella enterica subsp. enterica serovar Typhi str. CT18
MVRIACVGITVMDRIYYVEGLPTEGGKYVAKRYTEVGGGPAATAAVAAAKLGAQVDFIGRVGDDDTGNSLLAELESLGVNTRYTRRYTQAMSSQSAIMVDAKGERIIVNYPSPDLLPDADWLNDIDFSQWDVVLADVRWHDGAKQAFTLARQAGVMTVLDGDITPQDISELVALSDHAAFSEPGLARLTGMSEAIDALKKAQMLTNGHVYVTRGSEGCNWLEKAAVRHQPGFTVEVVDTTGAGDVFHGALAFGLASGYAIEEAVRFASGVAALKCTRPGGRAGIPDCEQTRSFLSLFV

SEQ ID NO: 38141 - protein, 317 aa, Zea mays
MASDGSGVVTVYGSNGAELLEPSKQPKSATFSVKVGLAQMLRGGVIMDVVTPEQARLAEEAGACAVMALERVPADIRAQGGVARMSDPGLIRDIKRAVTIPVMAKARIGHFVEAQILEAVGVDYVDESEVLTPADDAHHINKHNFRVPFVCGCRDLGEALRRVREGAAMIRTKGEAGTGNVVEAVRHVRSVMGDVRALRSMDDDEVFAYAKRIAAPYDLVMQTKQLGRLPVVQFAAGGVATPADAALMMQLGCDGVFVGSGIFKSGDPARRARAIVQAVTHYSDPTILADVSTGLGEAMVGINLNDPKVERYAARSE

SEQ ID NO: 38142 - protein, 351 aa, Synechococcus sp. WH 7805
MISTAQSKTLLGLGSSELERWAVTQGQSAFRGRQLHDWLYAKGARDLQEITVLPKSWRASLQDSGVSIGRLKEQDRKVAADATTKLLLATDDGETLETVGIPTDQRLTVCVSSQVGCPMACRFCATGKGGLQRSLYTHEIVAQVLSVREVMQRRPSHVVFMGMGEPLLNIEAVLDSIRCLNDDLGIGQRRITVSTVGVPRTLPKLAELAMERLGRAQFTLAVSLHAPNQTLREELIPTAHAYPYDALLDDCRHYLAITGRRVSFEYILLGGLNDHAAHAEELADRVGGFQSHVNLIAYNPIEEEEFQRPTRDRIEGFRRVLEGRGVAVSLRASRGLDQDAACGQLRRSRQQ

SEQ ID NO: 38143 - protein, 402 aa, Pseudomonas syringae pv. syringae B728a
MADQGSPRRFARIDRLPPYVFNITAELKMAARRRGEDIIDLSMGNPDGATPPHIVDKLITVAQREDTHGYSTSRGIPRLRRAISNWYKKRYEVDIDPESEAIVTIGSKEGLAHLMLATLDQGDTVLVPNPSYPIHIYGAVIAGAQVRSVPLVPGVDFFDELEKAIRGSIPKPKMMILGFPSNPTAQCVELDFFERVVALAKQYDVLVVHDLAYADIVYDGWKAPSIMQVPGAKDIAVEFFTLSKSYNMAGWRIGFMVGNPELVNALARIKSYHDYGTFTPLQVAAIAALEGDQQCVLDIAEQYRQRRNVLVKGLHELGWMVENPKASMYVWAKIPQAYAHLGSLEFAKKLLAEAKVCVSPGIGFGEYGDDHVRFALIENQDRIRQAVRGIRSMFRADDKLKS

SEQ ID NO: 38144 - protein, 357 aa, Saccharomyces cerevisiae
MSVSTASTEMSVRKIAAHMKSNPNAKVIFMVGAGISTSCGIPDFRSPGTGLYHNLARLKLPYPEAVFDVDFFQSDPLPFYTLAKELYPGNFRPSKFHYLLKLFQDKDVLKRVYTQNIDTLERQAGVKDDLIIEAHGSFAHCHCIGCGKVYPPQVFKSKLAEHPIKDFVKCDVCGELVKPAIVFFGEDLPDSFSETWLNDSEWLREKITTSGKHPQQPLVIVVGTSLAVYPFASLPEEIPRKVKRVLCNLETVGDFKANKRPTDLIVHQYSDEFAEQLVEELGWQEDFEKILTAQGGMGDNSKEQLLEIVHDLENLSLDQSEHESADKKDKKLQRLNGHDSDEDGASNSSSSQKAAKE

SEQ ID NO: 38145 - protein, 883 aa, Oryza sativa (japonica cultivar-group)
MAEHKPLPGRPKREGEGASKRKAKSGGFESMGLCEEVYRGVRHKGYRVPTPIQRKAMPLILAGHDIAAMARTGSGKTAAFLVPMIQRLRRHDAGAGIRALILSPTRDLATQTLKFAQQLGKFTDLKISLIVGGDSMESQFEELAENPDIIIATPGRLVHHLAEVEDLNLRTVEYVVFDEADSLFSLGLIQQLHDILHKLSDTRQTLLFSATLPQALADFAKAGLRDPQIVRLDLDKKISPDLKLAFFTLRQEEKLAALLYLVRERISSEEQTIIFVSTKHHVEFLNILFREEGLEPSLSYGAMDQEARNIHISKFRARKTMILIVTDVAARGLDIPLLDNVVNWDFPAKPKLFVHRVGRVARQGRSGTAYTFVTSEDMAYLLDLHLFLSKPLRPAPTEEELLKDMEGMNLKIDRALANGETVYGRFPQTIIDLVSDGIKEVINGCTDLIALEKPCTNAFHLYLKTRPMPSTESIRRVKDLPREGLHPIFRDVLGSDELSALAFSERLKSFRPKQTILEAEGEAARGSNQWLDVMKKKREVHEGIINLVHQKNNVDHEPKEELVENISNWERKDVCGNKRKLQSFRDEEYYISSVPQNQHLEAGLSVRANEGFVENRLDAAVLDLVDDETSGMQAQKTRYHWKKNKFVKLNSGDRVTATGKIKTESGAKLKPTKTGIYKKWQQKTHRSIDTGRKFGGFAEEGASTTGSHQRGNRKHTAVGRGRRYIPNADVPSEIRNPEQIQKSRQQKAMDIARMKNRSTKESKFQKFQKNNRRHDGPLKDGKFQKNRRPDGNGKNRRPDGNGKGRGKGKGNANGFGKGKGKMKGKGTRSESFDPFAPSDAWTSGCRECQQPFDNPDFADLFFFRTQQLAVPLRWLVDAIQRKD

SEQ ID NO: 38146 - protein, 415 aa, Zea mays
MMAEGPNFAGMIGGHDNGGDFCDMAYYRKLGEGSNMSVDNLNSMQTSTHGGSIAMSVDNSSVGSCDSHTRMLNHPGLKGPVVGNYSVGGHSIFRHGRVSHALSDDALAQALMDPRYPTETLKDYEEWTIDLAKLHMGMPFAQGAFGKLYRGTYNGEDVAIKLLERPEADPERAGLMEQQFVQEVMMLATLRHQNIVKFIGACRKPVVWCIVTEYAKGGSVRQFLAKRQNRSVPLKLAVKQALDVARGMAYVHGLGFIHRDLKSDNLLISGDKSIKIADFGVARIEVKTEGMTPETGTYRWMAPEMIQHRPYDQKVDVYSFGIVLWELITGMLPFANMTAVQAAFAVVNKGVRPAIPQDCLPTLAEIMTRCWDPNPDVRPPFTEVVRMLEHAEMEILSTVRKARFRCCMSQPMTTD

SEQ ID NO: 38147 - protein, 433 aa, Physcomitrella patens
MATIDRKYIVVGGGVAGGYAAREFVKLGLQPGELTIFSKEAAAPYERPALSKAYMFPEAAARLPGFHVCVGSGGERQLPDWYAEKGIELKLESEIVKADLENKTLTTDKGDVYSYGTLVIATGSTFLNLADFKTAGADAKGIYYLREVHEADKLVDAIKANKGGEAVVVGGGYIGLELAACLTINKIKVTMVFPDPCFMPRLFTPELASFYEGYYENKGVNIIKGTSVTAFEKDDNGHVSKVILKDGRTLDSTLVVVGVGAKPLLGPFKGLLEEEKGGIKVDASFKTSDPNVYAVGDIATFPMKMYGDTRRVEHVDHARKSAMQAVQAIKAAEKGEVVDEYDYLPFFYSRSFDLSWQFYGDNVGETVHWGREAGTPDSKFGAYWVKDNRVMGAFLEGGSPDENKLIAKVAREQPSVNSTQDLVSAGLGFASKV

SEQ ID NO: 38148 - protein, 118 aa, Medicago truncatula
MASQNTQVQFQDSLPLMANKLGGDGLIDELCNGFNLLMDSTKGVITFESLKKNSALLGLQDLTDVELQSMIVEGDFDGDGALNQMEFCVLMFRLSPELMDGSKMWLEQMLQQEVQDSF

SEQ ID NO: 38149 - protein, 434 aa, Physcomitrella patens
MDAAMLKYVLVGGGVAGGYAAREFVKLGVNPGELAIFSKEPVAPYERPALSKAYLFPESPARLPGFHTCVGSGGERQAPEWYADNGIDLHLSSEIAKADTKSKTITTAQGKTFEYGSLLIATGSTFINLADFKTPGADAGGIHYLREKDDADKLVEEIGANKGGEAVVVGGGYIGVELAACLALNSIRVTMVFPDPHFMPRLFTPEIASFYESYYKAKGINIIKGTSVTAFEKDDQGNVVKVILGDGRSLSTNLVVVGIGARPNLGPFKGLLEEEKGGFKVDSSFRSSAEDVYAVGDIATFPLKMYGDRRRVEHVDHARKSAIQAVQAIKAAEKGETVDDYDYLPFFYSRSFDLSWQFYGDNTGDSVVWGLDGASASGSKFGAYWINDGKVVGAFLEGGSPDENKLLARVARQRPSVSSKKDLISGGLDFAAKI

SEQ ID NO: 38150 - protein, 381 aa, Glycine max
MSSSTAGQVIKCKAAVSWEAGKPLVIEEVEVAPPQAGEVRLKILYTSLCHTDVYFWEAKGQTPLFPRIFGHEAGGIVESVGEGVTHLKPGDHALPVFTGECGECPHCKSEESNMCDLLRINTDRGVMIHDSQTRFSIKGQPIYHFVGTSTFSEYTVVHAGCVAKVNPAAPLDKICVLSCGICTGLGATINVAKPKPGSSVAIFGLGAVGLAAAEGARISGASRIIGVDLVSSRFEEAKKFGVNEFVNPKDHDKPVQEVIAAMTNGGVDRAVECTGSIQAMISAFECVHDGWGVAVLVGVPNKDDAFKTHPVNFLNERTLKGTFYGNYKPRTDLPSVVEKYMNGELELEKFITHTVPFSEINKAFDYMLKGESIRCIIRMGE

SEQ ID NO: 38151 - protein, 464 aa, Pseudomonas aeruginosa PAO1
MASERNNGILIGGKRPEYVHSAQGTGLRRILGLPALVFFGLVYMVPLTMFTTYGVVTEITGGRTASAYLITLAAMLFTAFSYSFMVKKYPIAGSAYSYTSLSFGPCVGFLAGWSLLLDYLFLPMINYLLIGLFLNIAFPMVPAWVFVLAAIGLVTVLNVIGISSVAGMSNVIVGAQFVFAVVFVAMAVKHLAGIPSLDLSLPFVGDGSQPGFAPLMAGAAVLCLSFLGFDAVSTLAEETRDPQRDIPRAIVITTVGAGLLFTVLAVFSQLVFPGSVFQDAESAANEVMLAAGGKFLASFFTAAYVAGAAGSALASQASVSRILYSMGRDGILPRRVFGSLSERFKTPVIAILVVSVISLLAVVIDLTTLASMISFGALVAFSAVNLAVIRSYLLLDGRRAPRDLLRYGLVPAIGLGLTLWLWTSLSALTLVIGLTWFAAGLAYLALHTGGFRRKAPTVTFSEQN

SEQ ID NO: 38152 - protein, 349 aa, Streptococcus pneumoniae TIGR4
MQEWVLEQGEKKFRADQIWEWLYRKRVQSFEEMTNLSKDLIAKLNDQFVVNPLKQRIVQESADGTVKYLFELPDGMLIETVLMRQHYGLSVCVTTQVGCNIGCTFCASGLIKKQRDLNNGEIVAQIMLVQKYFDERGQDERISHIVVMGIGEPFDNYNNVLNFFRTINDDKGMAIGARHITVSTSGLAHKIRDFADEGVQVNLAVSLHAPNNELRSSIMKINRAFPIEKLFAAIEYYIETTNRRVTFEYIMLNEVNDGVEQALELTELLKNIKKLSYVNLIPYNPVSEHDQYSRSPKECVLAFYDTLKKKGVNCVVRQEHGTDIDAACGQLRSNTMKRDRQKAVAAVNP

SEQ ID NO: 38153 - protein, 273 aa, Magnaporthe grisea 70-15
MWPGQAMTLKVEKVLHHERSKYQDVLIFQSTDYGKVLVLDNVIQCTERDEFSYQEMITHLAMNSHPNPKKVLVIGGGDGGVLREVVKHDCVEEAILCDIDEAVIRLSKEYLPNMSAGFNHPKVKVHVGDGFKFLADYQNTFDVIITDSSDPEGPAESLFQKPYFQLLFNALTEGGVITTQAENQWLHLPLITKLRKDCKEIFPVAEYAYTTIPTYPSGQIGFMVCSKDPKANLKEPLRSWTQEEELEKCRYYSSDIHKASFVLPNFARKALQD

SEQ ID NO: 38154 - protein, 855 aa, Oryza sativa (indica cultivar-group)
MSLSHHLPPPPGDPYYVYAPHPYPDTQRQGVLTLFVAGLPDDVKPREIHKLFSSRPGFDHCLLEYTGRGNQVVAFVSFVNHQAALSAMSALNGTVFDPDTGDRLHIELAKSSSRKRHGDGGVYRVVDKRLKRKERAADHENAGDGGNDDDAWGEDDNGGNDVVVIDDWCFLSCTVVVNQGLSSIGGNLFQIYYLLEQDQPDKLSSDIPPCSTLFVANLGHSCTEEELKEVLSKQPGFHLLKMRRRGGMPVAFADFTQFVLSGKWKPRLSHNCSTSLLKGSLFPLTPAAGVVFSVTSILRFQSHDNSIATCITACRRIIIVLFCFFRFRNLKKEIVAEAFSVRIQVVFCVSIFLAVLFALARAPALLRVLRRVAARAMPPPPPPPLGRFGVEVTARTLVRASDPPPGFPAVLPVSNLDLILGSFNVSLIVVYPAPARGFAAVAAAVRAALPAFLSRFFPFAGRVVADAATGIPEVACDNAGAELVLADAGVALADVDFADADRSLGTIQLPYEQGIALSLQLVRFKCGGFSMSWGTNHLLVDGHGLTALPTAWAEMLRTGGLSWEPHHDRRSLFRPRSPPRHGASLDAEFTRYAPGSLVNPLLAAALVRRNYVVGADDLDRLRAAASTASRRATRLEALSAHVWKLLAAATHGSDARCRLAWLVDGRRRLDPAKYDPTLVSSYLGNVVTYASRESPVEAITSSPLADVAAMAGAAIGEVFRQERYEELVDWMELRKAAAFKNGEKWTETVGIGTGSPAVVVSAFVPFRVDGDFGFGSPALVMPWVRPGRLGSAAMTVARSPREDGSWVVSARLWPRLADAIEADPDAVLKPATAARLGLARRAPAAADVARHASRL

SEQ ID NO: 38155 - protein, 544 aa, Rubrobacter xylanophilus DSM 9941
METRRPWLGVYEGRISYGTIETSLTRFLEGAAARYRDRPVMTSAGGRRVTYGELLEQSERFAAALAGLGVGKGDRLALMLPNSIEYVISFFAAARLGAVVVQLNPLYAGRELRHILQDSGARAAVVHEGAYGRLREVREGLPLERAVVVGEEPAKPDVSFGELLSSGSGPLPEAPLDPASDLAVLQYTGGTTGVSKGAMLTHRSLLVNIEANISLAMENPRDLDGGKTVAVAPFFHIFGNVVILLTSIHYGMNLLLVPRFQVDEMMQLIKRERPAMLGGVATIFTALHNYPRMEDYGLGEVLLYISGGASVPAELLRSFQRRTGRPIWEGYGLSEAGTVTINTYLRGPVPGSVGVPMPTLDVRVVDPETGEREMPVGEPGELVVKGPQVMKGYWNMPEETEKALREGWFYTGDIARMDEEGYLYIVDRKKDMINVSGYKVYPREVEEVIYSHPEVVEAVVVGSPDPYRGEVPKAFVVRRRRRGEGTSVSEEELIEHCRRELAPYKVPREVEFREELPKSAVGKLLRRVLAQEERSRGQEQGSAG

SEQ ID NO: 38156 - protein, 231 aa, Zea mays
  misc_feature (211)..(211): Xaa can be any naturally occurring amino acid
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDCLMKILTERGYSFTPPPEREIXRDIKEKLAYVALDYEQELEM

SEQ ID NO: 38157 - protein, 208 aa, Zea mays
  misc_feature (205)..(205): Xaa can be any naturally occurring amino acid
MDAFLSCLDDGPTASPPRAAPPPSPALSARDLYSFICSGPLVDRIGYTKEKVADSIGRWLRCGVDVARLLRLDELQLSEAEKARVYQFYIPVFLWCEDQVIEHRAKYSEGDDIPPLVIGVSAPQGSGKTTLVFALDYLFQNELRDRYPGNALLELRGNAGSHNLQFSVETLESLMKLTKEGIKMKVPRYDKSAFGGRGDRADPSXWPE

SEQ ID NO: 38158 - protein, 390 aa, Arabidopsis thaliana
MRKRKQQVYNDNLIVSRSNKRSSTSGKETCYFDPIPVDLVINILSRLSLECIARCRCVSKLWSSIIRRPNYNQLFPVKSSATPRLLFVFKVARELFFNSSPQHFNPNNSSLVATSLQKTSSTRFSQLCRPVHGLICSQHIEENYLFALISNPTTGEYIALPKQRMEEMNSETIIEKVRYSFGYDPIDKQFKVLRITWLHRGSHEWSSEYQVLTLGFGNISWRNTQCCVVHYLLEDSGICINGVLYYPARLDNRKYTIVCFDVMTEKFSFTSIDKDMTIMTNLSFSLIDYKENAEEHKWSKNIYNMPYSRSRLEETSYLKCAGMIASGEILLYPISSANTSTDARYPFIYYYNLERNIITRVTLQVPILKQFTYARLFYTFSNFLENVTLI

SEQ ID NO: 38159 - protein, 496 aa, Mentha spicata
MELQISSAIIILVATFVASLLIKQWRKSESRQNLPPGPPKLPLVGHLHLLWGKLPQHAMADMAKKYGPVTHVQLGEVFSVVLSSREATKEAMKLLDPACADRFESIGTRIMWYDNDDIIFSPYSDHWRQMRKICVSELLSARNVRSFGFIRQDEMSRLLRHLQSSAGETVDMTERIATLTCSIICRAAFGAIINDHEELVELVKDSLSMASGFELADLFPSSKLLNLLCWNKSKLWRMRRRVDTILEAIVDEHKLKKSGEFGGEDIIDVLFRMQKDSQIKVPITTNAIKAFIFDTFSAGTETSSTTTLWVMAELMRNPAVMAKAQAEVRAALKGKTSVDVDDVQELKYMKSVVKETMRMHPPIPLIPRSCREECEVNGYKIPNKARIMINVWSMGRNPLYWEKPETFWPERFDQVSRDFMGSDFEFIPFGAGRRICPGLNFGLANVEVPLAQLLYHFDWKLAEGMKPSDMDMSEAEGLTGIRKNNLLLVPTLYKSP

SEQ ID NO: 38160 - protein, 367 aa, Mycobacterium leprae TN
MSPFGRVSATLPVFPWDTLADAKAVAESHPDGIVDLSVGTPVDPVAPLIQEALAAASSVAGYPTTAGTARLREAAVAALDRRYGITGLTEAAVLPVIGTKELIAWLPTLLGLRAGDVVVVPELAYPTYNVGARLAGARVLRADSLTQLGLQSPALFYLNSPSNPTGQVLAVNHLRKMVGWARNRGVVVVSDECYLGLGWDAEPFSVLHPLVCDGNHTGLLAVHSLSKSSSLAGYRAGFVAGDPDLVAELLAVRKHAGMMVPTPVQAAMVAALGDDAHEREQRDRYARRRDVLLPAVVSAGFTVDHSEAGLYLWASRGEPCRDSVEWFAQRGILVALGEFYGPGGCQHVRVALTASDERIAAVVARLS

SEQ ID NO: 38161 - protein, 542 aa, Oryza sativa (indica cultivar-group)
MASPPTASASASEAAESGRRSAPGPIDVPSPRDHLHHLLDRRDTPRVVHVEGTTMQRQRGEAAGDAGAAAAAAKPEVKLVTGDGGYVLEDVPHVCDYLPDLPTYSNPLQDNPAYSVVKQYFVNPDDTVCQKAIVHKDGPRGNHFRRAGPRQRVFFESDEVHACIVTCGGLCPGLNTVIREIGGYRGFYACNTIDLSPKSVNDIHKRGGTVLGTSRGGHDTMKIVDSIQDRGINQVYVIGGDGTQRGAGVIFEEIRRRGLKVAVAGIPKTIDNDIPVIDRSFGFDTAVEEAQRAINAAHVEAGSAENGIGLVKLMGRHSGFIAHYATLASRDVDCCLIPESPFYLEGEGGLFRYLEKRLKENGHMVIVVAEGAGQKLINETKESMGKDASGNSILLDVGLWLSQKIKEHFKKIKTTINLKYIDPTYMIRAIPSNASDNVYCTLLAHSVVHGAMAGYTGFTVGQVNGRHCYIPFYRITEKQNKVSITDRMWARLLSSTNQPSFLSKKDVEDAKMEEERASKFFDGPPPNPKVEDKVASNGKAVK

SEQ ID NO: 38162 - protein, 175 aa, Arabidopsis thaliana
MGNTSSMLTQYDIEEVQSHCHDLFEQQEILSLYQRFCQLDRNAKGFISADEFLSVPEFAMNPLSQRLLKMVDGLNFKDFVAFLSAFSAKASLRQKVQLIFKVYDSDCNGKVSFKDIMEVLRDLSGSFMSDEQGEQVLSQVLKESGYTSDSFLTLEDFIKIFGSSRPEMDVEIPVD

SEQ ID NO: 38163 - protein, 408 aa, Mycobacterium avium subsp. paratuberculosis K-10
MSQAGDDSVRTPPALPDGVSQATIGVRGGLLRSEFDETAEALYLTSGYVYESAAVAEQSFTGELDHFVYSRYGNPTVTMFEERLRLLEGAPAAFATASGMAAVFTSLGALLAAGDRLVAARSLFGSCFVVCNEILPRWGVQTVFVDGDDLAQWEEALSVPTAAVFFETPSNPMQSLVDIAAVTELAHAAGAKVVLDNVFATPLLQQGIPLGVDVVVYSGTKHIDGQGRVLGGAILGDRDYIDGPVQKLMRHTGPAMSAFNAWVLLKGLETMAIRVEHSNSSAHRIAEFLETHPAVRWVRYPYLPSHPQYDLAKRQMSGGGTVITFALDCPDDKAKQRAFEVLDKLTLIDISNNLGDAKSLVTHPATTTHRAMGPEGRAAIGLGDGVVRISVGLEGTDDLIADIDRALG

SEQ ID NO: 38164 - protein, 480 aa, Mycobacterium avium subsp. paratuberculosis K-10
MELRWADRPPGTAEGTGMSRHRVVIIGSGFGGLTAAKALKRVPEGTQVDITLISKTTTHLFQPLLYQVATGILSEGDIAPTTRLILRKQKNVRVLWGDVSAIDLTARTVTSHLMGMDTVTPYDSLIVAAGAQQSYFGHDEYAAFAPGMKSVDDALELRGRILGAFEAAEVATDPAERRRRLTFVVVGAGPTGVELAGEIVQLAERTLAGAFRTITPSECRVILLDAAPAVLPPMGPKLGLKAQRRLQKMDVEVQLNAMVTAVDYMGITVKEKDGAERRIECACKVWAAGVQASALGAMIAEQSDGTETDRAGRVIVEPDLTVKGHPYVFVVGDLMSVPGVPGMAQGAIQGAKYAAGIIKQAVKGQDNPAERKPFRYVNKGSMALISRYSAVAQVGRVEFAGFIAWLAWLLLHLYYLIGHRNRLAAMFAWGISFLGRTRGQMAITSQMIYARPVVEWLERQAQDGTLAAAEHVDSAEKQAG

SEQ ID NO: 38165 - protein, 416 aa, Oryza sativa (japonica cultivar-group)
MAAAAAAASSAKRALLPWARDAHHALARALQGCGGGGGLGLRGALPTAGGRWSLLQCRWRSSLPQLDSADRSDEESGGEIDWDNLGFGLTPTDYMYVMRCSLEDGVFSRGELSRYGNIELSPSSGVINYGQGLFEGLKAYRAANQQGSYMLFRPEENARRMQHGAERMCMPSPSVEQFVHAVKQTVLANRRWVPPQGKGALYIRPLLIGSGPILGLAPAPEYTFLIYAAPVGTYFKEGLAPINLVVEDSIHRAMPGGTGGVKTITNYAPVLKAQMDAKSRGFTDVLYLDAVHKTYLEEASSCNLFIVKDGVVATPATVGTILPGITRKSVIELARDRGYQQVEERLVSIDDLVGADEVFCTGTAVVVAPVSSVTYHGQRYEFRTGHDTLSQTLHTTLTSIQMGLAEDKKGWTVAID

SEQ ID NO: 38166 - protein, 628 aa, Mycobacterium leprae TN
MPFRNVAIVAHVDHGKTTLVDAMLRQSGALHERGQVQERVMDTGDLEREKGITILAKNTAVHCHNSDGTVTVINVIDTPGHADFGGEVERGLSMVDGVLLLVDASEGPLPQTRFVLRKTLAAHLPVILVVNKTDRPDARIAEVVEASHDLLLDVASDLDEEAAAAAERALGLPTLYASGRAGIASTEQPADGAVPTGDNLDPLFDVLMEHIPSPKGDPEAPLQALVTNLDASAFLGRLALVRIYNGKLRKGQQVAWMREVDGLPVTTDAKITELLVTKGVERSTTEEATAGDIVAVAGLPEIMIGDTLADPEHAHALPRITVDEPAISVTIGTNTSPLAGKVSGHKLTARMVRGRLDAELVGNISIRVVDIGRPDAWEVQGRGELALAVLVETMRREGFELTVGKPQVVTRTIDGKLHEPFEVMTIDCPEEFVGAITQLMAGRKGRMEEMANHAVGWVRMDFIVPSRGLIGFRTDFLTLTRGTGIANAVFDSYRPWAGEIRARDTGSLVSDRPGTITPFALLQLADRGQFFVSPGQDTYQGMVVGINPRPEDLDINVTREKKLTNMRSSTANVIETLTKPLELDLERAMEFCSFDECVEVTPEIVRVRKIELESNARARGRARAKVRG

SEQ ID NO: 38167 - protein, 444 aa, Bacillus anthracis str. Ames
MFKWLKPAPAIERLPADMIDRVYRLLRIRVLIGISVGYAAYYLVRSNFTLSSTYLVQEYGFSTAEIGLLGSVMAIVYGFSKFFMGNLSDKAFAQRFIAVGLFLSGLVNICFGFASSFGMIVTLLVVNGIVQGMGAPPCSIVMTKWFSKKERGTKTGIWNISHNVGGMLVPPLVGIGVGIFGENHWQGGVFIFPAIIAMVIAVLVWINAKDTPESEGLPPIDEYRNDYENLEKADNANKMSPKEILMKYVVKNKFVWFLCIANAFVYLIRFGVINWVPLYLTTVKGFSKNEAHAAYAIFEGMAIPSSLIVGLLSDKLFKGKRMPLCIISMVGVVIGTFVYWQATSILVVSIAVSIIGCLIYVPQFLIGLSAMELVPKFAVGTTVGMCGLFGYVGGSLVANAAIGVIVDRSGWDGCFILLLTGAILSTIFLFIVQRGHESKAPKAA

SEQ ID NO: 38168 - protein, 321 aa, Oryza sativa (japonica cultivar-group)
MYVMRCSLEDGVFSRGELSRYGNIELSPSSGVINYGQGLFEGLKAYRAANQQGSYMLFRPEENARRMQHGAERMCMPSPSVEQFVHAVKQTVLANRRWVPPQGKGALYIRPLLIGSGPILGLAPAPEYTFLIYAAPVGTYFKEGLAPINLVVEDSIHRAMPGGTGGVKTITNYAPVLKAQMDAKSRGFTDVLYLDAVHKTYLEEASSCNLFIVKDGVVATPATVGTILPGITRKSVIELARDRGYQVEERLVSIDDLVGADEVFCTGTAVVVAPVSSVTYHGQRYEFRTGHDTLSQTLHTTLTSIQMGLAEDKKGWTVAID

SEQ ID NO: 38169 - protein, 142 aa, Triticum aestivum
MAEPPPPPSQSPAPTQQQTPAATARDEMMACVAALEAALLPCLPARELQAVDRSLQSSHQIDVERHARDFMEAAKKLQSCFIDMQREDQPTNEELLRKEITTMEEELKTRSELIAKHKSLIEGWQKELKDQLGKHNTELERV

SEQ ID NO: 38170 - protein, 400 aa, Oryza sativa
DALLLLLLLPPPPPPRDEEEEAARIQETAMPARAAAAAAAVALLLAVCAQAAALPRFAEAPEYRNGEGCPAAATAAAGVCDAGLVHISMTLDAHYLRGSMAAVYSLLKHASCPESLFFHFLAEEEEVGGGGDRRRAVAASFPSLRFEIYAFRAEAVAGLISASVRAALESPLNYARNHLADLLPRCVPRAIYLDSDVLAVDDVRRLWETRLPAAAVVAAPEYCHANFSRYFTPAFWSDPGLGRRVFAGRRRPPCYFNTGVMVIDLRRWRAGNYRHRIERWMEIQKEKRIYELGSLPPFLLVFAGEVEAVDHRWNQHGLGGDNVRGSCRPLHDGPVSLMHWSGKGKPWDRLDAGNPCPLDHTWKSYDLYVAGDDGAAASSPASGPALSSTSTTWPALVFSW

SEQ ID NO: 38171 - protein, 125 aa, Treponema denticola ATCC 35405
MKEIIATNKAPSAIGPYSQGIKANGFVFTSGQIPLDPATGAFPEGIKAQTRQSLLNVKAILEQAGTSIDKVIKTTVFLSDMNNFAAMNEVYAEIFGSSNHPSRSAVQVARLPKDALVEIEVIALA

SEQ ID NO: 38172 - protein, 815 aa, Yarrowia lipolytica CLIB122
GNVVFQTTTLAMSSESIQEHEKSDDKFRSEKEIHEIEFEATEVSDGSFIDYVGEKLNFVPDENGIHTKNIRLMANFVAELSDSEAEEILLKFIPVHEDDYNLRLEYKEYLKALVSGEKDAPNPDTYSLDLRIEAAAIKYWSPYIEVRAVTDCYDDMDEPCETIRAYAIGLVWLLVGCFVNQFFIFRYPSISIGSDVLQLLTYPCGELLARILPDWGFTWRGTRISLNPGPWSRKEQMFATFFLSGGDGATYVSAYNLPTQLLPMYYNQKWATFGYQIMLTLSSQYIGFGFAGILRRFAIYPTKAMWPLNMPTIALNRALLDPERKQKINGWTISKYWWFLATFVVSFIYYWIPDYLFQAISNFNWMTWIAPNNVNLALITGQSGMGINPIPTFDLNQIGVGSVVTPWWSIVNSLIGLVIGTFAVIGVYYSNVRWTAYLPMNMPGIYNNKGGSYKVTKILTNGVFDLEKYHEYGPPLWSAGNLVAYGAFFSVYTLGFVYTMLAYWQDMKQASIDFYNGIAFWNGTKRTEVDSPFAKQLKKYADVPDWWFFLILLISIGFCIGTVKGWETTTPVWGIFFVLGINLVFLIPICLLQAYTGNGFALNVLVEIICGYALNGRPTALNILKAYGVNVDSTSQGFVSVWKTGMYTYVPSRAIFRSQVLSTLISAFVTVGILQYQLTLQDICTPAQRATTKFTCPGQNTFYAASVLFGAIGTKRFFGTGGNTGLYPFLKWCFLLGAVVGLVFFVVQYTIPHYIGKRFPERKQAMIRLSERLGKYNPVVINMGLIGFAPGNLSYSIGGVYLAAAWTLYIKKPVP

SEQ ID NO: 38173 - protein, 502 aa, Oryza sativa (japonica cultivar-group)
MEAAAKLKRSISRQLSSGAARVWRQLSLEPVYTPRRAGAVGGGGGGGGGGGGGGGGARPTRFGLARQSSLDPTPREGGGAAEDGSGAAAMLAVPENLDATMRLLFAACQGDVAGVEELLRDGVDVDSIDLDGRTAMHIAACEGQGEVVRLLLSWKANMNARDRWGSTPAADAKHYGHFEVYNLLRARGAKTPKQKKTPMTVSNPKEVPEYELNPLELEFRRGEEVTKGHYVARWYGSKVFVKILDKDSFSDANSINEFKHELTLLEKARHPNLVQFVGAVTQNVPMMIVSEYHQKGDLASYLETKGRLQPYKAIRFSLDIARGLNYLHECKPEPIIHGNLSTKSIVRDDEGKLKVAGFGSRSLIKVSEDNPQMDQTTSKFNSVYTAPEMYRNGTFDRSVDVFAFGLILYEMIEGTHAFHPKPPEEAAKMICLEGMRPPFKNKPKYYPDDLRELIQECWDPTPSVRPTFEEIIVRLNKISTSFTKQTRWRDTFKLPWKQASER

SEQ ID NO: 38174 - protein, 392 aa, Prochlorococcus marinus str. MIT 9312
MSQVNLSERALSIEPSLTLQISAKANQLSAEGVDICNLSAGEPDFNAPKEVIEATSKAIFDGFTKYGPAAGNLDLRKAIANKLRIQNNLNYEFENVMVTNGAKQAIYNLFQVLLNIGDEVIIPSPYWLSYPQMVRLAGGKPIFTNSSAEDGFKIDIKDLKSKISSKTKFIIINSPNNPTGRVMSKEELLQIADIVRENPNINILSDEIYELILKKEFKHYSISSQANDLKDRIFIINGFAKGWAMTGWRIGYLVGPKDVIKASSALQSQSTSNVCSFVQKGALEALKINNEFFSMINSHYDQRRSLLYEGLKNINGIYIEEPNGAFYAFPRLPNSSITSVDFCNKALQDYGLVVVPGKAFGADECIRISCATSEIKIKDGLERFKKAISKYF

SEQ ID NO: 38175 - protein, 137 aa, Helicobacter pylori 26695
MKQRTLSIIKPDALKKKVVGKIIDRFESNGLEVVAMKRLHLSVKDAENFYAIHRERPFFKDLIEFMVSGPVVVMVLEGKDAVAKNRDLMGATDPKLAQKGTIRADFAESIDANAVHGSDSLENAHNEIAFFFAARDL

SEQ ID NO: 38176 - protein, 347 aa, Treponema denticola ATCC 35405
MTIKKYKTALSGMFPEEIQSFCGLKEKFRAQQIFHWIASGVNSFDEMTNLSFDMRSKLKNDFSLFSTKIKEALKDKDGTIKLAVELYDGSVIETVLLTDKAKRKTACVSCQAGCPMKCAFCKTGQIGFLRNLSASEIVEQFLHLEREAGSLDNIVFMGMGEPMLNLPEIDKAINILAHPKGRNLSKRRITISTSGLCKGIYEMADKGPEVRLAVSLTTADETLRSELMPITKTNSLDELKQAIKYFNSKSNKRVTLELALMKGLNTDKKAAQEVIEFAKGLECFINLIPWNPVEGLNFKTPSETEVRTFETYLKKAGLNISTRQKRGQSIGGACGQLGSTAARSNRF

SEQ ID NO: 38177 - protein, 469 aa, Salmonella enterica subsp. enterica serovar Typhi str. CT18
MSAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRATGIADTVLFGPEPEFFLFDDIRFGASISGSHVAIDDIEGAWNSSTKYEGGNKGHRPGVKGGYFPVPPVDSAQDIRSEMCLVMEQMGLVVEAHHHEVATAGQNEVATRFNTMTKKADEIQIYKYVVHNVAHRFGKTATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLPPEEAKEIPQVAGSLEEALNALDLDREFLKAGGVFTDEAIDAYIALRREEDDRVRMTPHPVEFELYYSV

SEQ ID NO: 38178 - protein, 545 aa, Ostreococcus tauri
MSAARAAPAVAARARTSERASSARAVRRPSVVDRRRSGRSRANDAAATSPSSVAENEGSGDSAWVRNAPTVVTYTFNGENGEECETTWEDGSQAKCVEGGPAKLVEEEFPRSEVERLQKKTLIGMFISYSSAYFVRKPLSVVKAPVKEALGLTTGTMGLIDSAFLLTYALGQFFMPSLGDKIGPKAVIVGGGIISFLCCVAFGYSTVPVVLMGLWAVNGLAQAAAYPLHVKVLNPWFTSKERGTAMGIWATSQQVGATLATFSAAFLLNKVGWKLSIALPASFALVTAALVAVMQLDPPWLQTTTYSSEALQKTKKRADIEPASKQVGFMEILAIPRLKMLMLSYFFVKIVRYCLLFWLPFYLSSEYNMPVAIAGYLSCIYDIGGVLGGLACGIIGDKYFERRRTMLGALSCAGLCFAIAGYQTACGMGMLANAVVMGFIGFLVAGPDAMLGSTAVSDCCEQAGYGQEVLGTAAGIVNGMGSLGAVLQGALTAMIAETYGWGALFVTLAVLSALSVVTMLAATNPKFVDTDELGGNNAPGQLVVA

SEQ ID NO: 38179 - protein, 1485 aa, Yarrowia lipolytica CLIB122
MTDPVPITQDPTIYSSQQDAEIRSLAESIHSQHSNNSNNSTELTNPYVDTSDPELDPWSGQFNSRKWSRTILGLKRRYGTSKEITAGVSFKNLGAYGYGGGADYQKTVANAVLGLEGVVRTLFHLEKKEDKVQILSDFNGVLWPGETCVVLGRPGSGCTTLLKSIACETYGFQLDKETEWNYQGIPRKIMQKTCRGEIVYNAEVDVHFPHLTVGDTLMFASLARTPQNRFDGVTREQYAKHTRDVTMASLGLSHTLDTKVGNDFVRGVSGGERKRVSIAESIVCGSPLQCWDNSTRGLDAATATEFLRWLRHSAELTGASMFVSLYQASQEAYELFDKVTVLYEGQQIYFGPGEQAKQYFEEMGFECPHRQTTGDFLTSITSPAERIVAPGFEGKTPRTASEFAERWRQSQAYANLQEEIERFNTEFPVGGNRVADIMELKQEKQSDHIKVSSPYTISIPMQVKLCLTRGFQRLRGDLSMALTTVLGNFVVALILSSMFYNMPEDTSSFFSRGALLFFAMLMNAMSSVLEIIVLYELRPIVEKHQRYAMYHPFCEALASIICDFPTKFLTMLCVNVTLYFMSNLRREAGPFFIFFLFTLLCVLAMSMIFRTIAAVTKTLQQALAPAAVIILALIIYTGFTLPISYMRGWARWINYIDPIAYGFEAVMVNEFRNREFPCALFIPQQSTYDQLGSPYQGCMAVGAKPGERFVNGDRYLEMAFDYSQAHLWRNLGIMFGFILFFAFTYLTAVEFIQSAKSKGEVLVFLRSSLKQRKKRAHLMDVEANAEKVGAAQDREILVQQEEGQQEETSSCTPSDSTPKDIFQWKDVCYDIKVKGGEKRLLDNVDGWVKPGTLTALMGCSGAGKTTLLDVLADRKATGVITGDMRVNGQKRDASFQRKTGYVQQQDLHTATSTVREALEFSALLRQPSNVPKAEKIAYVDEVIDILEMQAYADAVVGVPGEGLNVEQRKRLTIGVELAAKPELLLFLDEPTSGLDSQTAWSIICLLKKLANRGQAILCTIHQPSAILFQEFDRLLFMTLGGKTVYYGDIGANSSALINYFESKGADPCPEEANPAEWMLAAIGAAPGSIAKHDWAVVWNESEERARERDLLDKMAEELAAQSTHDEKNELVTSKSVGSSQTSSSSYSAKSQYATSQATQLYYLTKRLWTYYWRSPRYIWSKLLMSIASALFIGFSYYKASQDIQGLQNQMFAFFMLFLIFVIIMVQILPHFVAQRELYEARERSSMAYSWQAFMGSNILVELPWQTLVAVLVFFCFYYPIGLQNNATGHLGERGALFFLLLWSFYVYNSTFAHMMGAAFENKENAATIGYLLFALCLIFCGVLATKEDMPHFWIFMYRVSPLTYLISGLLSAGVGETRVECTDNELVLFKPMNGTNCGKYMHPFMEGLGHTDMPMGYLVDPSATDMCGYCPISNTNGYLDQIDVKYSQRWRNYGILFAYPAFNVFMAFAFYYIFRVPKKSRKQKA

SEQ ID NO: 38180 - protein, 341 aa, Trifolium repens
QTISYMAERVVGHGSFGVVFQAKCLETGETVAIKKVLQDKRYKNRELQTMRLLDHPNVVSLKHCFFSTTEKDELYLNLVLEYVPETVHRVIKHYNKLNQRMPMIYVKLYTYQIFRALSYIHRCIGVCHRDIKPQNLLVNPHTHQVKLCDFGSAKVLVKGEPNISYICSRYYRAPELIFGATEYTTAIDVWSVGCVLAELLLGQPLFPGESGVDQLVEIIKVLGTPTREEIKCMNPNYTEFKFPQIKAHPWHKIFHKRMPPEAVDLVSRLLQYSPNLRCQALDALTHPFFDELRDPNARLPTGRFLPPLFNFKPHELKGIPVETLVKLVPEHARKQCPFLGL

SEQ ID NO: 38181 - protein, 119 aa, Silicibacter pomeroyi DSS-3
MPFDPSTLKYDAAGLIPAIAQDAATGEVLMMAWMNAQAVARTLESGRVTYWSRSRQSFWVKGESSGHVQELVDFRVDCDRDCLLVTVRQTGPACHTNRRSCFYTAVREGEEVELMAPLL

SEQ ID NO: 38182 - protein, 319 aa, Burkholderia vietnamiensis G4
MMAEIVIVGELLAEFVALERGQGFDAPGLFAGPFPSGAPAIFADQAARLGARVAYAGCVGRDAFGDAIVARLERDGVDITRIRRVERPTGTAFVAYRDDGSRSFVFNLATSAAACIDAGDVDAAMFDGCRYFHVMGSSLTSEAAIAAVQRGVIEAARAGAKVSFDPNVRPEMLSFPPLRAALDAMLAACHLFLPSDADLPFFCGPQPAERAIAGLLATHPLLERVVLKRGAAGSAAFDRTSRVDAPAWPVDELDPTGAGDCFGGTLVASLVAGMPTDAALRRANAAGAIAVTRRGPMEGNSDAAEIERFLTERGVACPA

SEQ ID NO: 38183 - protein, 199 aa, Streptococcus pyogenes M1 GAS
MAEEQVLNTHNASILLSAANKSHYPQDDLPEIALAGRSNVGKSSFINTILGRKNLARTSSKPGKTQLLNFFNIDDKLRFVDVPGYGYAKVSKSERAKWGKMIEEYLTSRDNLRAVVSLVDLRHAPSKEDIQMYDFLKYYDIPVIVVATKADKIPRGKWNKHESVVKKALNFDKSDTFIVFSSVERIGIDDSWDAILEQV

SEQ ID NO: 38184 - protein, 486 aa, Saccharomyces cerevisiae
MVQRLLPGAHICRRSFNSSAIIKSSALTLKEALENVIPKKRDAVKKLKACYGSTFVGPITISSVLGGMRGNQSMFWQGTSLDPEHGIKFQGLTIEECQNRLPNTGIDGDNFLPESMLWLLMTGGVPTFQQAASFRKELAIRGRKLPHYTEKVLSSLPKDMHPMTQLAIGLASMNKGSLFATNYQKGLIGKMEFWKDTLEDSLNLIASLPLLTGRIYSNITNEGHPLGQYSEEVDWCTNICSLLGMTNGTNSSNTCNLTSQQSLDFINLMRLYTGIHVDHEGGNVSAHTTHLVGSALSDPYLSYSSGIMGLAGPLHGLAAQEVVRFLIEMNSNISSIAREQEIKDYLWKILNSNRVIPGYGHAVLRKPDPRFTAMLEFAQKRPIEFENDKNVLLMQKLAEIAPKVLLEHGKSKNPFPNVDSASGILFYHYGIRELLFFTVIFGCSRAMGPLTQLVWDRILGLPIERPKSLNLEGLEALTKASNVNKL

SEQ ID NO: 38185 - protein, 227 aa, Streptococcus pyogenes M1 GAS
MEALKKIAGVTAAQYVTDGMTIGLGTGSTAYYFVEEIGRRVKQEGLQVVGVTTSSVTSKQAEVLGIPLKSIDDIDSIDLTVDGADEVDKNFNGIKGGGAALLMEKIVATPTKEYIWVVDASKMVEHLGAFKLPVEVVQYGADRLFRVFEKAGYKPSFRMKGDSRLVTDMQNYIIDLDLGCIKDPVAFGHLLDGTVGVVEHGLFNGMVDKVIVASKDGVTVLEAPTAG

SEQ ID NO: 38186 - protein, 153 aa, Zea mays
MACSTNLCFSASIPPLPASSSSSSVSSPFLTMERVSYVPSLSRWTIRYKQLGHAYQRSHVLAFASADASQGKRSSGENVVMVDPLEAKRLAAKQMQEIRAKEKLKRRSQAEAINGALAMIGLTAGLIVEAQTGKGILGQLAGYLTAISSLFGQ

SEQ ID NO: 38187 - protein, 1060 aa, Zea mays
MGSAATEGNDTLLGNGVVGILAETCNMWERRAPLTPSHCARLLLGGGKNGPRVNRIIVQPSTRRIHHDAQYEDAGCEISEDLSECGLIIGIKQPKLQMILSDRAYAFFSHTHKAQKENMPLLDKILEERVSLFDYELIVGDDGKRSLAFGKFAGRAGLIDFLHGLGQRYLSLGYSTPFLSLGQSHMYPSLAAAKAAVIVVAEEIATFGLPSGICPIVFVFTGVGNVSQGAQEIFKLLPHTFVDAEKLPEIFQARNLSKQSQSTKRVFQLYGCVVTSRDMVSHKDPTRQFDKGDYYAHPEHYTPVFHERIAPYASVIVNCMYWEKRFPPLLNMDQLQQLMETGCPLVGVCDITCDIGGSIEFINKSTSIERPFFRYDPSKNSYHDDMEGAGVVCLAVDILPTEFSKEASQHFGNILSRLVASLASVKQPAELPSYLRRACIAHAGRLTPLYEYIPRMRNTMIDLAPAKTNPLPDKKYSTLVSLSGHLFDKFLINEALDIIETAGGSFHLVRCEVGQSTDDMSYSELEVGADDTATLDKIIDSLTSLANEHGGDHDAGQEIELALKIGKVNEYETDVTIDKGGPKILILGAGRVCRPAAEFLASYPDICTYGVDDHDADQIHVIVASLYQKDAEETVDGIENTTATQLDVADIGSLSDLVSQVEVVISLLPASFHAAIAGVCIELKKHMVTASYVDESMSNLSQAAKDAGVTILCEMGLDPGIDHLMSMKMIDEAHARKGKIKAFTSYCGGLPSPAAANNPLAYKFSWNPAGALRSGKNPAVYKFLGETIHVDGHNLYESAKRLRLRELPAFALEHLPNRNSLIYGDLYGISKEASTIYRATLRYEGFSEIMVTLSKTGFFDAANHPLLQDTSRPTYKGFLDELLNNISTINTDLDIEASGGYDDDLIARLLKLGCCKNKEIAVKTVKTIKFLGLHEETQIPKGCSSPFDVICQRMEQRMAYGHNEQDMVLLHHEVEVEYPDGQPAEKHQATLLEFGKVENGRSTTAMALTVGIPAAIGALLLLKNKVQTKGVIRPLQPEIYVPALEILESSGIKLVEKVET

SEQ ID NO: 38188 - protein, 223 aa, Pseudomonas aeruginosa PAO1
MNQDQLKQAVAQAAVDHILPHLDSKSIVGVGTGSTANFFIDALARHKAEFDGAVASSEATAKRLKEHGIPVYELNTVSELEFYVDGADESNERLELIKGGGAALTREKIVAAVAKTFICIADASKLVPILGQFPLPVEVIPMARSHVARQLVKLGGDPVYREGVLTDNGNIILDVHNLRIDSPVELEEKINAIVGVVTNGLFAARPADLLLLGTADGVKTLKA

SEQ ID NO: 38189 - protein, 362 aa, Oryza sativa (japonica cultivar-group)
MWPCLSPRAAVLIALLLLPAAMAAAAAAAGGHGEEMKSIYAGPKVVPVRLGRPAFGPESLAFDHRGGGPYTGVSNGRVLRWRADRRRPGWTEFAHNYKHATVAECAARKKAAAAAESVCGRPLGVQFDRRTGEMYIADAYLGLMRVGRRGGMAEVVAAEAGGVALNFANGVDVDQATGDVYFTDSSTTYKRSDYLLVVLSGDATGRLLRYEPRTGNVTVLESGLAFPNGVAVSADGTHLVVAETASCRLLRHWLRGSNAGATEVLADLPGYPDNVRHAAADGGRGASYWVALNRDKAWTVNGTTPASVAAVRVVVDDGGSKVDVALRGFGGATVSEVVERNGSLWFGSVDTPYVGLLKLTSL

SEQ ID NO: 38190 - protein, 300 aa, Mycobacterium leprae TN
MTTVGFDVPARLGTLLTAMVTPFDADGSVDTAAATRLANRLVDAGCDGLVLSGTTGESPTTTDDEKLQLLRVVLEAVGDRARVIAGAGSYDTAHSVRLVKACAGEGAHGLLVVTPYYSKPPQTGLFAHFTAVADATELPVLLYDIPGRSVVPIEPDTIRALASHPNIVGVKEAKADLYSGARIMADTGLAYYSGDDALNLPWLAVGAIGFISVISHLAAGQLRELLSAFGSGDITTARKINVAIGPLCSAMDRLGGVTMSKAGLRLQGIDVGDPRLPQMPATAEQIDELAVDMRAASVLR

SEQ ID NO: 38191 - protein, 372 aa, Triticum aestivum
MLGAARRSGCVLGQLMQTLRPAASAATAARSYSATPKEMTVREALNSALDEEMSADPSVFLMGEEVGEYQGAYKITKGLLDKYGPDRVLDTPITEAGFTGIGVGAAYQGLRPVVEFMTFNFSMQAIDHIINSAAKSNYMSAGQISVPIVFRGPNGAAAGVGAQHSQCYAAWYAHVPGLKVLTPYSAEDARGLLKAAIRDPDPVVFLENELLYGESFPIKAEVLDSSFSVPIGKAKIEREGKDVTITAFSKMVGYALQAAEILSKEGISAEVINLRSIRPLDRAAINASVRKTNRLVTVEEGFPQHGVGAEICMSVVEDSFEYLDAPVERIAGADVPMPYAANLERLAVPQVEDIVRAAKRACYRSSSMAATG

SEQ ID NO: 38192 - protein, 210 aa, Salmonella enterica subsp. enterica serovar Typhi str. CT18
MTNLNYQQTHFVMSAPDIRHLPSDCGIEVAFAGRSNAGKSSALNTLTNQKSLARTSKTPGRTQLINLFEVVDGKRLVDLPGYGYAEVPEEMKRKWQRALGEYLEKRQSLQGLVVLMDIRHPLKDLDQQMIQWAVESNIQVLVLLTKADKLASGARKAQLNMVREAVLAFNGDVQVEAFSSLKKQGVDKLRQKLDSWFSELAPVEEIQDGE

SEQ ID NO: 38193 - protein, 346 aa, Flavobacteria bacterium BBFL7
MKETKKDIRSYTQDQLREYFVDQGQQAFRGNQVYEWLWKKGAHHFDDMTNLSKDTRAFLQEHFVINHIRVDHMQRSKDGTIKNAVKLHDGLTVESVMIPTPTRTTACVSSQVGCSLNCEFCATARLKRMRNLNPDEIYDQVVAIDQQSKNYHNRPLSNIVFMGMGEPLMNYKNVIKSIDKITGDDGLGMSPKRITLSTSGVPKMMKKLADDRPRFNLALSLHSAIDEKRVKIMPFNEQFPLEDIKEALRYWYDKTGTRVTYEYVVWKGINDTKEDIDALIEFCKVIPCKVNIIEYNSIDDARFEQASKQAVDAYERELNRYGFTVNVRRSRGKDIDAACGQLANKE

SEQ ID NO: 38194 - protein, 924 aa, Synechococcus sp. WH 7805
MKDQAPQASQPASVGSPDPAQLFPFPLDDFQLEAIDALNQGHSVVVSAPTGSGKTLVGEYAIYRAIAHGQKVFYTTPLKALSNQKLRDFREQFGADNVGLMTGDLSVNREASIVVMTTEIFRNMLYAEADESDDPLADVEAVVLDECHYMNDSQRGTVWEESIIHCPLPVQLVALSATVANAGQLTDWIERVHGPTHLVHSDFRPVPLQFSFCSAKGLHPLLNDQGTGLHPNCKVWRAPKGNKRKGRSQRPPQPEPPPISFVVAQMAEREMLPAIYFIFSRRGCDKAVRDLGVQCLVNESEQACIRERFKAYAAANPEAVRDGLHADALLRGIAAHHAGVLPAWKELVEELFQQGLVKVVFATETLAAGINMPARSTVIAALSKRTERGHRPLMASEFLQMAGRAGRRGLDSKGYVVTVQSRFEGVREAGQLATSPADPLVSQFTPSYGMVLNLLQRHDLAKARELVERSFGRYLASLDLVEEEEILQQLRLQLGQLQGTAGDVPWEDFEDYEKLRGRLREERRLLRILQQQAEETLAHELTLALQFASVGTLVSLKSPQLRGGVTPAVIVEKCEGPGQFPLLLCLTNDNVWLLLPCQAVVSLHAELSCLQVEGLRTPDLGRAGELRHGDQHSGGLALAVGHMAQRHDMTTPQYDLAGEVLTQMQSVQELEAELETHPAHRWGDRKQLKKHRRRMEELELEITERQQLLHHRANRHWETFLALMEILQHFGALDDLVPTEIGRTVAALRGDNELWLGLALMSGHLDDLPPAELAAVFEAISTEVNRPDLWSGFPPPPRAEEALHDLSGIRRELLRVQERHQVVVPAWWEPELMGLVEAWARGVAWNDLIANTSLDEGDVVRIMRRTIDLLAQVPYCEAISEQLRSHARQALKAINRFPVAEADDLLKAAAAESESLNPATERAA

SEQ ID NO: 38195 - protein, 329 aa, Burkholderia pseudomallei K96243
MQVPLDVVTYGEAMAMFVAAEPGPLDSATHFTRRIAGADLNVAIGLARLGFRVGWMSRVGADSFGRYVLDTLAREQVDASCVTVDARYPTGFQLKSRATDGADPSVEYFRKGSAASRLSLDDYVPDYVLGARHLHLTGVAPALSDSSRELAFHLACTTRAAGKTVSFDPNLRPTLWPSPEAMARTLNALAEHADWVLPGLAEGRQLTGLDTPADIARFYLERGARGVIVKLGAAGAYFRVADGREGEIAAERVEHVVDTVGAGDGFAVGVVSALLEGRAIDEAVARGNRIGALAIQVIGDSEGLPTRAALDRIENLSNARDRLEAPLAR

SEQ ID NO: 38196 - protein, 183 aa, Arabidopsis thaliana
MVKAYRQEHVYKHPWERVSAASWRKFADPENKRILSHILEVDTLNRKLDTETGKLHTTRALTIHAPGPWFLHRIIGQDICHCVESTVVDGKSRSMQLTTKNISLKKFIEVEERIRYDPHPDNPSAWTVCSQETSIRIKPLSALASMAEKVEQKCAEKFMQNSAKGREVMERICKYMEAESARI

SEQ ID NO: 38197 - protein, 149 aa, Zea mays
MISSCPPRRRSTPSWPSPPPRSFSDKNKAKKITMNKNEKKEVKAVKKEKKCPFATVKIEEISEDNDAGCVAIKKAFAKGNGKGKRKELSPQDAALLIQMTYRAHLAHRSQVLRCLRDLAVAKAKLKELRSLFYNISYRHRIAHDHEERQ

SEQ ID NO: 38198 - protein, 251 aa, Pseudomonas aeruginosa PAO1
MCLIVFAWQPGHALPLLVAANRDEFYARPSLPLAAWEDAEGVFAGRDLEAGGTWLGLGPAGRFAALTNVRDPSQALGKRSRGELVADFLRGGGNPADYLAQVAGRAADYSGFNLLIGDRHQLWHYNPRVGPPRLLPAGIYGLSNAALDTPWPKLLKARAALAERLAEPHPQALLELLADAAPAADGQLPDTGVGLATERLLSSVFIASPSYGTRASSVVRVHADGTREMIERSFGPSGARLGEVSLVLPPG

SEQ ID NO: 38199 - protein, 273 aa, Oryza sativa
MGRSFRDSLKVLEADIQHANSLAAEFRREYDGACLQMRMSYCPAAHFFLFLVQWTDCNLAGALGLLRILIYKVYADGTTTMSAHERKASIREFYAVIFPSLMQLHEGINEVEDKKQKAICIERYRRRDEDQKMVISEIDDNIEEECGICMEINGKVVLPTCSHAMCIKCYRDWRSRSQSCPFCRDSLKRVNSADLWIYTDNRDIVDIATVRKENLRRLFMYIDKLPTVIPETVFDVYDSHVKWPCTHAQILCWCVTTSAVEIVEPLVFMLPRL

SEQ ID NO: 38200 - protein, 384 aa, Staphylococcus aureus subsp. aureus Mu50
MKLSLNSNSKYLRAPSIRQFSNRMNNLDDCVNLTIGQPDFPMPDVVKKAYIDAINNDKTSYSHNKGLLETREAISQYFKNRYHFSYDPEEIIVTNGASEAIDTTLRSIIEPGDEIIIPGPIYAGYIPLIEVLGGKPIYIDTTATQFKITPDALESHISPKTKAVLLNYPTNPTGVVLKRNEVLNIVNVLKKYPIFIISDEIYAENTFSGKHVSFAEFEDIRDQLILIGGLSKSHSATGIRIGFLLGPQYLIDKLTFMHAYNCICANVPAQIACITALNEGLEAPKYMNEAYVERRNYLVSELTKLGFEITAQPEGAFYIFPSIKHITDDDFEFCVDLLESTHLAIVPGSSFTEFGKGFVRISYAYEMDVLKEGMKRLAKYLNTK

SEQ ID NO: 38201 - protein, 329 aa, Sinorhizobium meliloti 1021
MNVVVSDPILASISRTIATAADGINALAGCLEDNAALRRSFVDAIELVASKRGRVVVAGVGKSGHIGRKIAATLASTGTSAYFVHPTEASHGDLGMITAEDLLILLSWSGETVELGNVLTYAKRFNVPVISVTSNADSTIARNSTIPVVLPKVPEACPHGLAPTTSAMLQLAVGDALAIALLERRGFSAEDFKTFHPGGKLGSQLLLAHELAHSGEAVPLLPIGSPMSEAVIQMSSKGFGVVGVVGGDGELVGVITDGDLRRHMSQSLLLLTVETVMSHMPRVITPGMLASAAMEMMQSQKITVLFLVDDVGRPSGILHVHDLLRAGVA

SEQ ID NO: 38202 - protein, 358 aa, Agrobacterium tumefaciens str. C58
MPHKASVFIVEFKFELESCPLGVVIPLEESKNKLASVKPLVDLTRPDMERVNQLILSRAGSDVQMIPEVANHLISSGGKRLRPMLTLASASMFGYEGDNHIKLATSVEFMHTATLLHDDVVDESDLRRGKSTARTIWGNQASVLVGDFLLGQAFRMMVDVGSLDALDVLSTAASVIAEGEVLQLSVAKNMETTEDDYLQVIRAKTAALFAAAAEVGPIVAKTDKASRSALKSYGMNLGLAFQLVDDVLDYGGKSADLGKNTGDDFREGKITLPVILSYRRGTQDERAFWRNAIEKGESSDENLEKALGLITKYNGLGDTIGRATHYGTIARDALAPLPQSPWKNALLEVIDFCIERLN

SEQ ID NO: 38203 - protein, 325 aa, Flavobacteria bacterium BBFL7
MKIVEQIKAPVAHEMELFEKKFQLAMASRIALLNRITHFIVNRKGKQMRPMFVFLVAKMIGDGEVNDRTYRGASVIELIHTATLVHDDVVDDSLKRRGFFSVNALWKNKIAVLVGDYLLSKGLLLSIDNGDFDLLQIISVAVREMSEGELLQIEKARRLDITEEVYYDIIRKKTATLIAACCSLGACAVSPGSQDVEKMREFGEMIGIAFQIKDDLFDYGNERIGKPTGIDIKEQKMTLPLIHTLQIASKKDRKWLINSVKKHNRDKKRVKEVIDFVKNNGGLEYAVKAMYDYRDRAMSILNTYPDSEYKRSLELMVEYVIDRKK

SEQ ID NO: 38204 - protein, 1114 aa, Arabidopsis thaliana
MELSETYACVPSTERGRGILISGNSKSDTILYTNGRSVVTLDLNNPLKVSIYGEHAYPATVARYSPNGEWIASGDVSGTVRIWGAYNDHVLKNEFKVLAGRIDDLQWSADGMRIVASGDGKGKSLVRAFMWDSGSNVGEFDGHSRRVLSCAIKPTRPFRIVTCGEDFLVNFYEGPPFKFKLSSREHSNFVNCVRFAPDGSKFITVSSDKKGIIYDGKTCEILGELSSDDGHKGSIYAVSWSPDGKQVLTVSADKSAKIWDISDNGSGSLNTTLNCPGSSGGVDDMLVGCLWQNDHIVTVSLGGTISIFSASDLDKSPFQFSGHMKNVSSLAVLKGNADYILSGSYDGLICKWMLGRGFCGKLQRTQNSQIKCFAAHEEEIVTSGYDNKISRISYKDDQCTNEESIDIGNQPKDLSLAPLSPDLLLVTFESGVVFLRDGKVVSTINLGFIVTALAVTPDGTEAVIGGQDGKLHLYSINGDSLTEEAVLERHRGAISVIRYSPDLSMFASADLNREAVVWDRVSREMKLKNMLYHSARINCLAWSPNSTMVATGSLDTCVIVYEVDKPASSRMTIKGAHLGGVYGLGFADDSHVPEARRHTLILVHNSLPSPHILSHSELHMFLFLLLLSASRSGEESPSGDAVPLATGGLNRKSFPEGFLFGTATSAYQVEGETHQDGRGPSIWDAFVKIPGKIANNATAEITVDQYHRYKEDVDLMQNLNIDAYRFSISWSRIFPEGSGKINSNGVAYYNRLIDYLIEKGITPYANLYHYDLPLALEQKYQGLLSKQVVVLFQTFGDRVKNWMTFNEPRVVAALGYDNGIFAPGRCSEAFGNCTDGNSATEPYIVAHHLILAHAAAVQRYRQNYQEKQKGRVGILLDFVWFEPLTSSQADNDAAQRARDFHVGWFIHPIVYGEYPNTLQNIVKERLPKFTEEEVKMVKGSIDFVGINQYTTYFMSDPKISTTPKDLGYQQDWNVTFNFAKNGTPIGPRAHSEWLYNVPWGMYKALMYIEERYGNPTMILSENGMDDPGNITLTQGLNDTTRVKYYRDYLVQLKKAVDDGANLTGYFAWSLLDNFEWLSGYTSRFGIVYVDYKDLKRYPKMSALWFKQLLKRDQK

SEQ ID NO: 38205 - protein, 275 aa, Triticum aestivum
  misc_feature (75)..(75): Xaa can be any naturally occurring amino acid
  misc_feature (219)..(219): Xaa can be any naturally occurring amino acid
  misc_feature (224)..(224): Xaa can be any naturally occurring amino acid
  misc_feature (246)..(246): Xaa can be any naturally occurring amino acid
HYRTSLYKKAGWYRSGIPGISSTHASGAAIELTDKDELIVIRSDESSGLDVLDNELANLATWLAGSYQKADSKLXFPLKSGNSLTLFLTKEADVEFASSLISLLKTIKRGIQVHEDFSGGIVSHAELLVCHFTGIKALEDEYGPAEIVKQGAEVVQTALTKAFDQLQGAYNGKIVGLVISAKEASTSLASIIDAPSSLHISRRLAEASKTNATASIAAXIFVRXVLAWITGIILLVSTLIGICLLXMNMPLTRDTLLIFKCQELISLGYIRIFTR

SEQ ID NO: 38206 - protein, 309 aa, Salmonella enterica subsp. enterica serovar Typhi str. CT18
MKTAGNLIVLGSINADHILNLESFPTPGETVTGSHYQVAFGGKGANQAVAAGRSGANIAFIACTGDDDIGDSIRKQLVSDRIDIAPVSVIKGESTGVALIFVNGEGENVIGIHAGANAALSPALVDAQRERIAQADALLMQLESPLESVLAAAKIAHQHHTTVALNPAPARELPDELLALVDIITPNETEAEKLTGVRVENDDDVAKAAQVLHDKGIRTVLITLGSRGVWASVNGEGRRVPGFSVEAVDTIAAGDTFNGAFITAILEETPLPEAIRFAHAAAAIAVTRKGAQPSVPWREEIEAFLHQQG

SEQ ID NO: 38207 - protein, 380 aa, Ustilago maydis 521
MASNTSADAFERRTAEVKRVTNETKIEVSLSLDTHPTFAPQIINVKTGIGFLDHMLHALAKHGGMSLTLACDGDLWIDDHHTAEDCALALGAAFKKALGPVKGIKRYGTGHAPLDEALSRAVIDISSRPYCVAELGLKREKIGDLSCEMIPHVFHSFAMEAGVTLHVDCLRGDNDHHRAESAFKALALAIKEAITRTGSDDVPSTKGEYAAEKPKTSQLISAKIYADPLKLMYSYFHPFVLQAFCENVDEEKLFTLPGFHENVDTLYARVCPCMWLAFKDAADDERALSRQTRIACQMLCQAICHKQQPVKPRKAFSQGYNRREPELSELNEGWFMRHGNPWLVISTHTHTHTILQIVGQRQHLDRFRFMHLTPPGGGAG

SEQ ID NO: 38208 - protein, 247 aa, Yarrowia lipolytica CLIB122
MPKLILLRHGQSDWNEKNLFTGWVDVKLSELGHTEAKRAGTLLKESGLKPQILYTSELSRAIQTANIALDEADRLWIPTKRSWRLNERHYGALQGKDKAATLAEYGPEQFQLWRRSFDVPPPPIADDDKWSQYNDERYQDIPKDILPKTESLKLVIDRLLPYYNSDIVPDLKAGKTVLIAAHGNSLRALVKHLDGISDDDIAALNIPTGIPLVYDLDDNLKPTKAAEYLDPEAAAAGAAAVANQGKK

SEQ ID NO: 38209 - protein, 1842 aa, Arabidopsis thaliana
MALGDESEVFESENCHGDETERNMKVLFGGFKRLCADKVQHEEKLESMDSVLRQVVATLERMEIREGKRVEQGEHSCQSPRHSFSSSMPQRGAGESPILLDNRSSLIRRIEMPVFDGSGVYEWFSKVERFFRVGRYQDSDKLDLVALSLEGVALKWFLREMSTLEFRDWNSFEQRLLARFDPVKIHSSPEVLMPTTLIHVVAHETESRCTEELIEEDESSVRKKSNPEIVLITQKKSFPRFQNVATIVVGEFQEGTWFFDDKSKDNEANNSSDSKLKFGAYKVLDKILIRSHNLKQRRKLSLSPKNWMFKFKNRNLQQNRSKMDPCQAIEFSNIHYMYLCFSANVGLVRKNKSFQSLRLKKQAHMSRDLKKLESISSEELQPALPIVETLGDEDMVALQSDLRRLGEANFATIDSAQLLRLDDATLMNSALKRKCSKSWHFIYKHYKVRMQNLHTGIYKTQRPWHCLVHEANNTDSHLWHRWKTKVETLQEISEFLSWGLVHSHSSEVISFLGFSHGPLVTVNGASSDKVIDAAATSIFSEAIGLQQYEKVMILCMRLFTCMTLTGMMIVLFSSGNRCIDIENLTLPHNFSCSDEESRDHLFLTCTYSAQLWLQILARIDPNRSLFVSWAELLSWLRASSVSAPSTLRKVAAQTSIYHIWKQRNNVIHNQLIISNVTVFKLINREIKNIITARQHRKRYEVASMSRTSHVNIVSLLGFCYEGSKRAIIYEFLENGSLDKFISSKKSSNMDQSALYGIALGVARGLEYLHNGCRARIVHFDIKPQNVLLDDNLCLKVSDFGLAKLCEKKESILSLLDTGGRYMLGARNKTSIEVSVSNTSSMYQNTTLDYTKTKKCGNITADFPFWGGNRHKPCGHPLLELHCNNNNITSLYISNQEFYVRQINQTSNTLTLARSDLLGSFCSSYAYNTTTLPPEIFELSPTYKSLTVLYHCDPKLSYRSSYTCPALGTFSMSQSVDYQYSCQNSFTVNVPTSFHPEERGLNLTNLESALRKGFEVKLVIDEIPCQQCSSTRGICSFNGTTQSCCNATSPSGGVSCVPYQHSADEVYRRCSESFSCGSQRDLNYPLWKPGREECGHPNFKLNCSGGFAEINIASVKFRILDSYRSLIRLARSDYIGDLCPANPLTAPFIEKFLPVLELTGETELLTLYYGCRFNSSDIPANIYVGELGCDEGRSYYVTRNLSSPLLDSSRGVLNNLREMCKRNVSVPASGPALFDLQTRPNQDNLKMALDQGFRMLITSDCERCRGSGGACGYNQTSSGFGCYCKDGKCGYEYDALGALTGVVIVFLVLLCPCFRVQIFRKRKTSDEVRLQKLKALIPLKHYTYAEVKKMTKSFTEVVGRGGFGIVYSGTLSDSSMVAVKVLKDSKGTDGEDFINEVASMSQTSHVNIVSLLGFCCEGSRRAIIYEFLGNGSLDKFISDKSSVNLDLKTLYGIALGVARGLEYLHYGCKTRIVHFDIKPQNVLLDDNLCPKVSDFGLAKLCEKKESILSLLDTRGTIGYIAPEMISRLYGSVSHKSDVYSYGMLVLEMIGARKKERFDQNSRSDGSSIYFPEWIYKDLEKANIKDIEKTENGGLIENGISSEEEEIARKMTLVGLWCIQSSPSDRPPMNKVVEMMEGSLDALEVPPRPVLQQISASSVSDSFWNSEESSSASDILVFSTNSKLESSSVRLCFSLDSMNLSWQRSDLYFSPVITLPTLNSTNNILQREETVKTENKSQESIPEVVSYAVKTSPSFSEFGLAKLCEEKESILSMLDTRGTVGYIAPEMISRVYGNVSDKSDAYSYGMDLESCKSGRHIEDGINSEENELAKKMTLVGLWCIQPSP

SEQ ID NO: 38210 - protein, 847 aa, Ustilago maydis 521
MPSALRKPKPPNQELLLRWFKAQSQLLAEERKEEQAQSKLVLSRTAPKLLEKHGLALLSLGVASIRIGVGAKLLVELERPSAHHMSPKFPPHTFRSGDLAAILDNGADPQATNDTCLLQGVVYKVSDARIVLALSDDKKRGVPKDNTQIGQNKRDARRGENDKVSGNNLDLPERIRLVKVANESTFDRLELTLDKLAKALDVPLSAPLDSNADTSAEETEATQTSSSSTTSATSLTRSLFGLLEPTWHETDLPLPPFNPNLNDTQLNAIRHALSANHFSLIHGPPGTGKTTAIVELIMQIVASNFGAVDDGAPVRVLVCGASNLAVDNILERLVGVPEHREVFKKKGIGVTRIGHPARVVANLQKFTLDAQCTQSSEAQLVKDISKEIESIMSELKPTAAPAGNKSTRGKPKIRGHDRRKRWEEVRELRKEYRRRDRQVTRSVLDRAQVVLATCHTAGGKQLAHRQYDWVIIDEACQALEVACWIPILKAREGARLVLAGDHLQLPPTVKATVHGPRSKRSKPNVSGRDKAGGVKSKDLTDSPAKSEGEADHMDADQDCVDSDADESELVKKLVDASHDNSARTQLRVPRSLERTLFSRLLGLYGPGIKSLLSIQYRMNTEIMSFPNTELYESKLSAHASCANIWVCDLENVSTCDGLDEDEQELYAPVVFYDTSGCEFYESSPAPQESVMLTDSKSNMHEVGLIIQHLEQLFARGVHARQVTILTPYSAQVSLLHSMIRLHRFSGRIASAVVNAEEIELGTIDSMQGREKDVVLISLVRSNAEQQVGFLAQKKRLNVAITRAKRQLVLVGDADTISGAKDLPDSFLPNYMRWLEENAVVYPVVATI

SEQ ID NO: 38211 - protein, 1385 aa, Oryza sativa (japonica cultivar-group)
MAKNKKGRRNKPACHSVKDKDRLTTLPNDVLLNILERLDTADDIRACTLCKRMTKLPAELSRIVVDANSFTPNKIAPDLLTLSDVVQMNEALAGATEKLLNFRSQQIALRQLSLRFYLRYYDCLTIGKAVQHAMSTYNLETLEFTILTEKQGGCCEETHMLCFGKQFRTFLAAFPDAFAGLTRLQLQHLHFAEPDIPNLLTTCKQLKHLRLFSCLNQDDPAVLRIEHPQLVELDINYGDFEFVELKCLPKLRHMAYVHWDCHGDPLSFGDIWVRPECPKLLGPVFHKLQRVSLVDVPEGCNIDWTMFILEAAPSLKEICITIWDRWCNMKTEEDRREEGYGDKTVVDWESSAPDGFRHENLSKVTIYGFQPDDNLVGFVRRVMEVAVNLEEVSLYDRKARAASACWCSRSDQVSGDGDLRPEAACFCLHGAGAQIRQGVGLPQPLQSIPQVPKEVYNNLDTGAQDEKWWEGVDLQKLILAHNNLEVLREDLRNLSSLVVLNISHNNISSLPAAIGDLPLLKSLDVSSNQINAFPEEIGFATALVKVDCSNNCLTDLPVSLARCLELSELNASNNTISVLPDELAGCSKLFRLNLEGNKLVTLSDKMFMSWTMLTEMNAEITLIPPSIKDCSSLAEFYMGNNLLTSIPEDIGMLSNLGILDLHSNQLKEYPVGACRLKLSFLDLSNNSLSGLPAELDHRADSFFPWGICFENLACSMQVCYYLNELSKLWTLTYASACYIQGTMTTLRKLLLTGNPMRTLRSSLVSGPTTALLKYLRSRLSSDEGASGSGSTPTKDDQIAAARRLSLSSKELDLSGLGVTSVPPAAWETNDVMKLDLSKNSIEDLPNELSLCSSLQSLILSNNKIKRWPGTVFSSLASLSLLKLDNNPLAEILATDLEALSKLEVLDLSGSASSLPEPSAVSKLPHLKELYLRRMKLHGFPDSLLGLKLLRILDLSQNYLTSVPEGIKDLTSLIELDLSDNNITTLPPELGLLEPNLQVLKLDGNPLRRVIDVKCWYLNANGLTPSLVPGKDRLNDLPDDVVLNILERLDTSDAMKTCILSKNMRATLPDMLSRIAVDVAAFSRPNHRRLTLREVVRTNGAVADLTAAVLEFRRPEIPVHHLALRFYLRSAADDLVYFAGQFHTLFTAYPAVFAGLTRLWFGDSDIAGILLTCKNLRFLRLFNCKSVRRSVLQIWVEPEGWKRLAPVLGELRHVTLVDLPEGCDIAWTMFIVEAAPRLESLSIRVWDHCCKMERDETTRQENGYCDKSNVEWQPSVANLEHRNLAKLTIVGFQPDEHFVGFIRRVMESAVNLEEISLYDRVVGRCCSYLDPKTKSKVVPSRYPRTMKEQVLLRKEDDQGVIIGDGFVSCNSLQVLVVNYYKLEFGI

SEQ ID NO: 38212 - protein, 631 aa, Magnetospirillum magnetotacticum MS-1
MCGIAGIVADRPVSPGAVEAMTGRLVHRGPDDQGIWRSDDGCAVLGHRRLSILDTSAAGHQPMERDGLVTVFNGEIYNFVEVRAELVGLGEVFHTNSDTEVLLAAYDRWGPECFARFNGMFALAILDRRRKVLVCARDRFGEKPFLFAARPGLFAFASEYKALLAMAEIGRDFDPVPLLRFAHRPATGLDDERATLFPAILQLLPGERLELDLSTLDTRIDRYWTLARDPALGALGMGEAAERFRDLLTDSIRLRLRSDVAVGSCLSGGLDSGSIIMLARRLLGDDAPYHVFTGRFPGTRADEWDYARHTSQAAGAIVHQVEPSAAGLLADLPDFLWANELPVGSASQYAQYCVFRLAKEQGVTVLLDGQGADEILGGYEQYFARYLAGLPGPERGAEEAAIRARYPGALDSPRQALSKALPPRLRHWLAQISGKGSDLLFGLSPDLAEQVAKANAPPVVPQGWSPLAAELMRDSFSTHLPVLLRYGDRNSMAHSREVRLPFCDHRIAEFALSLDPKLLMGEAQTKRLLREAVKGILPEQVRTRWNKQGFLPPQDIWFAQGLIDEAERVIEDPSFARAGYWNVSWWRCAIRRFRAGETHLGWVLWRPLMLESWRRHFLERITAQPGVEALP

SEQ ID NO: 38213 - protein, 239 aa, Arabidopsis thaliana
MFFMEVQYSNTGPLPSHGFVRQRFWEVETKPPPLPSLSTAHVDLIVRSSNEDLKIWPHKFEYRLRVALGHDGDLTLTSRVKNTDTKPFNFTFALHPYFAVSNISEIHVEGLHNLDYLDQQKNRTRFTDHEKVITFNAQSITKKKHTLQKKLDRLYLSTPDQLRIVDHKKKKTIVVHKEGQVDAVVWNPWDKKVSDLGVEDYKRFVTVESAAVAKPITVNPGKEWKGILHVSVVPSNRKA

SEQ ID NO: 38214 - protein, 460 aa, Bifidobacterium breve
MTMIFPKGFMFGTATAAYQIEGAVAEGGRTPSIWDTFSHTGHTLNGDTGDVADDFYHRWEDDLKLLRDLGVNAYRFSIGIPRVIPTPDGKPNQEGLDFYSRIVDRLLEYGIAPIVTLYHWDLPQYMASGDGREGGWLERETAYRIADYAGIVAKCLGDRVHTYTTLNEPWCSAHLSYGGTEHAPGLGAGPLAFRAAHHLNLAHGLMCEAVRAEAGAKPGLSVTLNLQICRGDADAVHRVDLIGNRVFLDPMLRGRYPDELFSITKGICDWGFVCDGDLDLIHQPIDVLGLNYYSTNLVKMSDRPQFPQSTEASTAPGASDVDWLPTAGPHTEMGWNIDPDALYETLVRLNDNYPGMPLVVTENGMACPDKVEVGTDGVKMVHDNDRIDYLRRHLEAVYRAIEEGTDVRGYFAWSLMDNFEWAFGYSKRFGLTYVDYESQERVKKDSFDWYRRFIADHSAR

SEQ ID NO: 38215 - protein, 340 aa, Streptococcus pyogenes M1 GAS
MTIAIDWDNLGFEYHKLPFRYISYYKNGQWDKGQLTEDATLHISESAPALHYGQQAFEGLKAYRTKDGSIQLFRPDRNAVRLQATADRLLMPQVSTEQFIDAAKQVVKANEDFVPPYGTGATLYLRPLLIGVGDIIGVKPAEEYIFTIFAMPVGNYFKGGLAPTNFIVSEAFDRAAPYGTGAAKVGGNYAGSLLPGKAAKSAGFSDVIYLDPATHTKIEEVGAANFFGITANNEFVTPLSPSILPSITKYSLLQLAEERLGMTVIEGDVPINELDKFVEAGACGTAAVISPIGGIQYKDNLHVFYSETEVGPVTRRLYDELVGIQFGDIEAPEGWIVKVD

SEQ ID NO: 38216 - protein, 229 aa, Synechococcus sp. WH 5701
MIEFIGGSYLAATPQISYRRLLEALCRRGLSLRAWSYVPGFDHQAQATEAWRAFRGARQGTSAGTPALPVLRLGHSLGCKLHLLAPDGGRGSSALVAMSFNNFSADRSIPLLADLAPRLGVRTEFSPSPQETLRLVSQLYGVPRNLLIRFGSDPLDQSPPLLEVLQQRPGDGSSLLQLGGDHLTPASAGLRQNLLGPWADDPLRQRQIDRLAATIDSWWRQDGGQAERG

SEQ ID NO: 38217 - protein, 152 aa, Crocosphaera watsonii WH 8501
MSHSVLISSLKMTETVENAFEQGLERYKEGESIDTLIPYFKEICDRSPKNPTAWACLAWLYLLADKPESALKAARKSVKIDSRPPQARINLALAMLDTGAKGVRDHIEAAQQLISLDEDIRNDIMENIEDGLSRKPGWKSLERVKKWLVSPE

SEQ ID NO: 38218 - protein, 461 aa, Pseudomonas aeruginosa PAO1
MSSLQSPSDASARNDLVYGLDDRPSAPIALLAALQHLLAIIVPIVTPGLLICQALGVSPRDTNLIVSMSLVISGIATFVQCKRFGPFGAGLLIVQGTSFNFVGPLIAGGALMVKQGTPVESVMAAIFGVVIAGSFVEMGISRILPFVKRLITPLVTGIVVLMIGLTLIKVGLISMGGGFSAMSNGTFANGENLLLSGVVLGIIVVLNRIPVVWMRSCAIVIALAVGYALAGYLGRLDFTGMHQAELFQVPTPLHFGLDFSWPLFIPMLVIYLVTSLEAIGDVTATSKVSKQPVEGPLWMQRIKGGVLVNGANSFLAGIFNTFPSSVFAQNNGVIQLTGVASRYVGLWIAAMLVLLGLFPSVAGVIQAVPEPVLGGAAMVMFGAVAASGINILAGIQLDRRALLIIAVSLALGLGVSQVPEFLAHMPAALRNVLESGVATGGICALLLNWFLPESPVQKAGH

SEQ ID NO: 38219 - protein, 461 aa, Spiroplasma citri
MSRIEKINAREVIDSRGNPTVQVEVWTEFGGYGSAMVPSGASTGSREALELRDGDKGRYQGKGVLKAVGNVNTKIAEQLVGMEVTNQVEIDHAMIALDGTDFKKNLGANAMLGVSMAAAKAAASELEMPLYKYLGGVNGKKLPVPMLNIINGGEHADSAIDFQEFMIMPVGAETFKESLRWSSEIFHTLKKILHDKGDITAVGDEGGFAPHFNWAYKDQTLTSFQAKTPAEVALDLIVEAIEVAGYKPGKDGVMIAMDCASSELYFDDKKYHFKKIEKVTGKEYAMTTEELIKYLDKLVDKYPIISIEDGLAEGDWAGFELQVKTMGHKIQIVGDDLFVTNPKITAEGIARNAANSVLIKLNQIGTVTETIDTIQLAQKAGWTAVVSHRSGETEDSTIADLAVALNTGQIKTGSMSRSDRIAKYNRLLAIEDELGKVAEYDGIKTFYNLKKHVSDLKKITS

SEQ ID NO: 38220 - protein, 411 aa, Bacillus halodurans C-125
MIEIKVPELAESITEGTIAQWLKKVGDHVSQGEYIAELETDKVNVEITAEHSGVIQELKREEGDTVEVGEVIAVLAEGDSPTASTEQAEAPKEEKKVSTVASEEAAPAPGNRPVASPAARKLAREKGIDLEAVPTADPLGRLRKQDVASYEEKPAASAPAKAPEKKAAPAAANVESPGKPVERIKMSRRRQTIAKRLVEAQQTAAMLTTFNEVDMSAVMELRKRRKDQFFEKHDVKLGFMSFFTKAVIGALKEFPLLNAEIQGDEILLKKYYDIGIAVSTDEGLVVPVVRDADRLGFAGIEREIMHLGKKARENKLSLSELQGGTFTITNGGVFGSLWSTPILNAPQVGILGMHKIQWRPVAIDEENFENRPMMYIALSYDHRIVDGKEAVSFLVRVKEMLEDPESLLLDS

SEQ ID NO: 38221 - protein, 370 aa, Sulfitobacter sp. EE-36
MKTRAAVAVAAGQPLEVMDVNLEGPKRGEVLIEIKATGLCHTDEFTRSGDDPEGIFPAILGHEGAGVVLEVGEGVTTLEVGDHVIPLYTPECRECEYCLSGKTNLCQAIRVTQGQGLLPDGTTRFSMMDGTPIHHYMGCSTFANHTVIPEIALAKVRKDAPFDKICYIGCGVTTGIGAVINTAKVEIGARCVVFGLGGIGLNVIQGLRMAGADQIVGVDLNDDKEETGRYFGMTDFVNPTKVEGDMVAHLVELTKGGADYTFDATGNTKVMRQALEAAHKGWGESIIIGVAPAGAEISTRPFQLVTGRVWKGTAFGGAKGRTDVPKIVDWYMNGKIEIDPMITHKLTLDQINEGFELMHKGESIRAVVEF

SEQ ID NO: 38222 - protein, 275 aa, Crocosphaera watsonii WH 8501
MRFRALLIAFFALCLGLITACSDGPDSTANPQDLTYDEILNTGIANNCPQISEFTRGSLAIEPGQTYFVDDLCLQPQEYFVKEEPVNKRQEAEYVPGKLLTRYTTSLEQISGNITVDEEGVVTFKEKGGIDFQPVTVQLPGGEQVPFFFTIKNLVGKTEPGFNSINTSIDFVGDFRVPSYRGATFLDPKGRGLATGYDNAVALPATADKEDYANVKQTPIGKGSISLQVTKVDKETGEISGVFESEQPSDTDLGAKEPVDVKIRGIFYARLTPEV

SEQ ID NO: 38223 - protein, 582 aa, Oryza sativa (indica cultivar-group)
MRRLLELLPGELRRRVEGHPELPALVEVVMDLGRPPLARFPSGDFLLSQSPISFDDLRHATSQVGDFGADNRAGISRTLHRISAIRNRKGAIIGLTCRVGRAVPGSANLLQDLVKDGGSLLLIGPPGVGKTTVIREIARMLADDYRKRVMIVDTSNEIGGDGDIPHPGIGNARRLQVPNQDMQHKVLIEAVENHMPQAIVIDEIGTKLEAMAASTIAQRGIQLVATAHGITIENLIMNPSLDMLVGGVQSVTLGDEEANRRGVQKTVLERKGPSTFTCAAEIVSKIELRVHRSLEDTVDALLAGKMPNVEIRKVGSKGPVQEVYVQKERLDLGPSEGATQLDTDSLSNARRSLDSAFNLDPAEGHIGRSTEAEPDLNLYAYGISESTALQAIKQLELEDIVTLTYNISEADAVIALQSKLKKNTQIQAVVKSQDIPVFFTKTNSLVQIRRALRALVDDHTDGLMDFEDTEEVRSSEETDALEEARLAIEQVVIPKGESVQLLPRPPSIIASQVDLVESFKLKWESIGQEPNACLRILPQFVGVEEGGKSVKQEAATELTDSDNSDDMDYKQNGVSRLPFLPE

SEQ ID NO: 38224 - protein, 268 aa, Thermoplasma acidophilum DSM 1728
MDENRGSRIAINLTGKIALVTGSSSGLGAAIAKYMARAGAKVAVHYRSGKDRADAIVDEIKNDGGFAMAFYGDVSKKEDVQKLFSEIDSKLGTVDILVNNAGIDGKRELVGEDDPDDWEKVIEVNLMGPYYCAREAVKRMKPKKSGVIINITSVHEYVPWSGYTAYSSAKAGLSMFTKALAQELSDYNIRVVAIAPGAIKTPINKDVWGNPESLKDLLNKIAMPRLGEVDDIGQAAVFLASDLASYITGTTLLVDGGMALYPDFKHGG

SEQ ID NO: 38225 - protein, 376 aa, Oryza sativa (japonica cultivar-group)
MAPSRPLMRGIRPPRVFPTRGGRTSPLALALAALLLASALLLALIAFGVFSLPVSAPNAATTDSAAAGGDAEPADPRPPRTRARRDLSEGLGERGAQWTEVISWEPRAFVYHNFLSKEECDYLIGLAKPHMVKSTVVDSTTGKSKDSRVRTSSGMFLQRGRDKVIRAIEKRIADYTFIPMEHGEGLQVLHYEVGQKYEPHFDYFLDEYNTKNGGQRMATLLMYLSDVEEGGETIFPDANVNSSSLPWYNELSECARKGLAVKPKMGDALLFWSMKPDATLDPLSLHVPLQISLWSEQGVVLSSKETNGHQPSGCMSSNPEEKESLVVWNRQNTLGGIMLDEVIDTQVVVEVTLSDQVQACWSKKKMMPHSVVDGTI

SEQ ID NO: 38226 - protein, 316 aa, Methanococcoides burtonii DSM 6242
MVMEDDWDPKGPKRTKDPQMPEINIPPMVANILRGGAIVLVILLIFSAVFGSIFVSVGAGQVGVKFSQFGGVMDDELGEGLHIVPPWISVTKYSVRSEMYTMSGRAAEGEVVGDDQINALTNEGLTLGLDISVRYRLVADDASVVHSKLGTSYAQKIIRPTIKSVIREVVSGQTAMAIYGEQRDLVATEMQLEMEKALVGDGIIVEEVLLRNVQLPTKIADAIESKLQADQDAQRMIFVKQKEQLEAERRIIEANGIANATIVEATGEAEALRLVNQELSKNPKLINYKYIQMLESQEVQTLIVPSDQGIILDATA

SEQ ID NO: 38227 - protein, 304 aa, Bordetella pertussis Tohama I
MTTGAAPRPLPAAFAGRSNVFELRNLADVQRLQPAFLAGRRLLVLGGGYIGLETAAVAAQAGLSVQVVERASRVLERVACPATAAAIRALHQRHGVLIHEGRTVAGTEGDEALTGVELDNGLRIACDLVVAGVGVAPQTALAEAAGIDCDDGILVDAYGRTSAPDVWAAGDCARFVLGGEPARLESVQNAIDQAEAVADDMLGQGRPYQPVPWFWSDQYDMKLQIVGLNRGYDAVVSHASAKGESHWYFRADRLISVDALNDGRAYMVGKKLLEAGRAVGRGEVERPGFEPMQLLRDQAEGRLR

SEQ ID NO: 38228 - protein, 559 aa, Oryza sativa (indica cultivar-group)
MGKLLCDSSSAAVAVAEAPSPAPAPPLLTWPTPDPDPPTSWTAVAALEDQQRRRLHRIWERGVAWKPPATLPLPPLVFRLDHAGEVDADGNCLFTAARKAASAKPDARDLRHRIVRRFSHLYAAAQAPDRDAIDAAVRHLYAPDLKAGWGVHVVQELKLLAPKTLRHHLDAAINDLVDLGIQREMAAETIYRERCIAVNNGDSWAKYMSVSGSAEDEHNIITLQYTEEGLLTIDENRDGHAAAFGDDIAIECLATEFKREVYVVQAHGADAMVDEDNCVFFLPHRPRGEICEPPIFLFMKGTVAVYAVSCNVSGLKVLTVEEEIQSVRKTAEAVGDFRKTPIYIVGTDCTAKRNIAKLLANSIIYRYLCSEELLEDVLGGKDALNAFRESDLNGYLEVETEGLKQLTSMGSLVLCCGDGAVMNSTNLYAAFTHHSLISHIRLLINSSYANSLRGLLRHGVSIWIDIPLELVVNDMLKTQATSDPDSFSEAMSRVRQRHDELKERYGVSDITVSVQNVASQLGYSSIDSVTLEDMVLEIVRQIERLIRAKSMMEAAGKPF

SEQ ID NO: 38229 - protein, 1300 aa, Pseudomonas syringae pv. syringae B728a
MKAAAHSIDRTPHWLIKQAIFNYLEKLESGATLLELDGAAGKDNEDRGELAEEAGLQCFLDFAESIQPQSVLRAAITSAYRRPEPEVVPMLLEQARLSAPVAEATNKMAASIAEKLRNQKSAGGRAGIVQGLLQEFSLSSQEGVALMCLAEALLRIPDKGTRDALIRDKISNGNWQPHLGNSPSLFVNAATWGLLLTGRLVATHNEAGLTSSLSRIIGKSGEPMIRKGVDMAMRLMGEQFVTGETIGEALANASRFEAKGFRYSYDMLGEAALTEHDAQKYLASYEQAIHSIGKASHGRGIYEGPGISIKLSALHPRYSRAQYERVMDELYPRLLSLTLLAKQYDIGLNIDAEEADRLELSLDLLERLCFEPQLTGWNGIGFVIQAYQKRCPYVIDYVIDLARRSRHRLMIRLVKGAYWDSEIKRAQVEGLEGYPVYTRKVYTDVSYIACARKLLAAPEVIYPQFATHNAHTLAAIYQIAGQNYYPGQYEFQCLHGMGEPLYEQVVGKVADGKLNRPCRVYAPVGTHETLLAYLVRRLLENGANTSFVNRIADHSISIQELVADPVSQIERMATQEGGFGLPHPRIPLPRDLYGTERANSSGIDMANEHRLASLSSALLATAHNDWKAAPMLGCPASAGTLSAALNPSDLRDVVGHVQEASLQDVDNAIQCALSAGPIWQATPPVERAAILERAADLMEAEIQPLMGLLVREAGKTFANAIAEVREAVDFLRYYAVQARNDFTNDGHRPLGPVVCISPWNFPLAIFSGQVAAALAAGNPVLAKPAEQTPLIAAQAVRLLLEAGIPEGVVQLLPGRGETVGAGLVGDERVKGVMFTGSTEVARLLQRNVAGRLDSQGRPIPLIAETGGQNAMIVDSSALTEQVVIDVVSSAFDSAGQRCSALRVLCLQEDSADRVIEMLKGAMAENRLGNPERLSVDIGPVIDAEAKAGIEKHIQAMRDKGRTVYQVAIADSAELKRGTYVMPTLIELESFDELQREIFGPVLHVVRYKRKELGLLIDQINASGYGLTLGVHTRIDETIAKVIDNVNAGNVYVNRNIVGAVVGVQPFGGEGLSGTGPKAGGPLYLYRLLSTRPQDAIEKSFVRSDALSAPDTRLREVLGKPLQALKAWAASNQQSDLDALCSQYAEQSQSGITRQLAGPTGERNSYAILPREHVLCLADDENDLLIQLAAVLAVGSSAVWPETDIGKPLRARLPKDVQARIKLIPDWAKDEVIFDAVLHHGDSDQLRAICQQIAQRSGAIVGVNGLSHGETNVPLERLVIERALSVNTAAAGGNASLMTIG

SEQ ID NO: 38230 - protein, 215 aa, Silicibacter pomeroyi DSS-3
MSKMNGPLRVGIGGPVGAGKTTLTAALSEALRDSHSIGVITNDIYTREDAEALMRLQILPQDRIIGVETGGCPHTAIREDASINLAAVAEMERRHPGIEIILIESGGDNLSATFSPELADVTLYVIDVAAGEEIPRKGGPAITKSDILIINKTDLAPHVGASLEVMERDAGRMRCGRPFVFSSLRNRDGVAEIVKLLAEIAGLEIRSDLQVANLA

SEQ ID NO: 38231 - protein, 319 aa, Arabidopsis thaliana
MFFDGYHYHGTTFEQSYRCYPASFIDKPQLESGDKIIMPPSALDRLASLHIDYPMLFELRNAGIERVTHCGVLEFIAEEGMIYMPYWMMQNLLLQEGDIVRVRNVTLPKGTYVKLQPHTTDFLDISNPKAILETALRNYSCLTSGDSIMVPYNNKKYFIDIVETKPANAISIIETDCEVDFAPPLDYKEPERPTAPAAAKGPAKAEEVVDEPEPKFNPFTGSGRRLDGRPLAYEPAPASSSKGKQPVVANGNGQSSVASSSEKATRAQGKLVFGANGNRAPKEAAPKVGAAKETKKEEQEKKDEPKFQAFSGKKYSLRG

SEQ ID NO: 38232 - protein, 570 aa, Coccidioides immitis RS
MNNRKRDLKLYFYYNSLKPWAFTGISDSEASKMLPSTSSPNLKVPLERDEEGRPRFKGCSSIREYEFLGKLGEGTFGEVYKARSKHSGSIVALKKILLHNEKDGFPITALREIKLLKVLSHTNIIRLEEMAVERSRGEGRKKPSMYMVTPYMEHDLAGLLENPNVHLTEPQIKCYMLQLLEGLRYLHQNNILHRDMKAANLLISNRGILQIADFGLARPYDGHPPAPGKGGGEAVRDYTSLVVTRWYRPPELLLQLRRYTTAIDMWGAGCVFGEMFKGKPILAGSSDLNQAQLIFTLVGSPTEETMPGWSALPGCEGVKSWGSKPGNLSTVFREQGPGAISLLSELLKLDWRKRINAIDALKHPYFLNPPLPARPGDLPQFEDSHELDRRKFRGQKAMPPAPAGGSVGMGANGEWTSGSGVRVPPDPKLNSRIPSAARNGPRGAYDSRVPDSARGHKRQASDDHPPRSRDPSIHGRPPGQLPGRPNAATWRGGDRREQRGRDEWDRHRSRDSYVPKYDDDSTSVSRRDNLDSRPRADSRGDRFYRPSRSRSPERPRSRAGDGDSHNIYRR

SEQ ID NO: 38233 - protein, 180 aa, Saccharomyces cerevisiae
MSEYASSIHSQMKQFDTKYSGNRILQQLENKTNLPKSYLVAGLGFAYLLLIFINVGGVGEILSNFAGFVLPAYLSLVALKTPTSTDDTQLLTYWIVFSFLSVIEFWSKAILYLIPFYWFLKTVFLIYIALPQTGGARMIYQKIVAPLTDRYILRDVSKTEKDEIRASVNEASKATGASVH

SEQ ID NO: 38234 - protein, 1220 aa, Oryza sativa
  misc_feature (995)..(995): Xaa can be any naturally occurring amino acid
NGPGDPSMATITINHLRQALQTSNKPIFGICLGNQLLAIAAGGSTYKLPYGNRGQNQPCMDTLTGRCLISSQNHGFAVDVKTLPPEWTEYFRNLNDGSNEGIIHKTKPFFTVQFHPEAKNGPTDPAYLFDMFIDKVREYKHDPSNMTFYIPPLPRPDPPRVRKVLILGSGGLQIGQAGEFDYSGSQAIKALKQEGIRSVLINPNIATVQTQAGLADAVYFAPLTIESVEEVIRKERPEGLFLGFGGQTALNLGVAMEQSGLLRRYGMKVLGTQVSAIINSEDRQLFNDRLAEIGVKVAESYACTEIEEAVVAANKIGYPVMVRAAYALGGLGSGFCQNDEEIRARWRQALACCPQVLIEKSLKGWKECEYEVVRDMYGNTVTVCNMENFDPMGIHTGESIVVAPSQTLTDDGYHWLREIAIKTVNHLQVVGECNIQYTYDPNSRDYRVIEINPRLSRSSALASKATGYPLAYVAAKLALGIPLPVLRNSVTKTTSADFEPSLDYIVTKLPRWDMAKFPHVDRHIGSAMKSVGEVMAIGRNFEESFQKAIRMVDSSNLGFHAKNWSSKTEHELRDELENPTDQRVFALKEALNRGYTVDQLFELTKITPWFLHKLHHIHEIEQELAAFKGSGRRVPANLLRAAKQHGFSDKQIGLLVGESELEVHNYRKSLKIIPVIKQIDTQAAEFPAATNYLYATYNGSVDDVPRNDGPPNGVIVLGSGTYRIGSSVEFDYGGVGVCKALRAMGEKTIMINFNPETVSTDYDESDSLYFEELSLERVLDIVDRENPKGVVVSVGGQLPQNIALKLHECGVPVMGTSPVQIDRAEDRFKFSQMLDRLGIDQPEWKELSSKEDGMEFARKVSYPVLVRPSYVLSGAAMNVVHNDDDLWALLSEASSVSPDHPVVMTKFLQRAKELEIDAVCQNGKIVNWAIAEHVVFAGVHSGDATLMFPTKHITQETKDRVFAISEKITEELQVSGPVNVQYLFTEAGELKVIEXNLRASRSLPFVTKTLGVPMIDNLARVFMNQEVRKDERCRRGVPFFGVKSSMFSFQRLKGADPRLTVEMASTGEVACYGKNVHEAFLKAFLSSSFKWPTNKTVLVSSVTDDLAREIRTLSGYGYKIFSTEAAADTLNGQGVPTTVIPNSHITEFISNKGADFVICWPDSLLHEDPFYYQLRRKAADFALPVIMNERVAKMLVESLCHIKSQSDIPTETFDFYHSLY

SEQ ID NO: 38235 - protein, 172 aa, Streptococcus pyogenes M1 GAS
MDLTNYIASIKDYPKAGITFRDISPLMADGKAYSYAIREIAQYACDKDIDMVVGPEARGFIIGCPVAVELGIGFAPVRKPGKLPRDVVSADYEKEYGLDTLTMHADAIKPGQRVLIVDDLLATGGTVKATIEMIEKLGGIVAGCAFLIELEGLNGRHAIRNYDYKVLMQFPG

SEQ ID NO: 38236 - protein, 429 aa, Carboxydothermus hydrogenoformans Z-2901
MTQLLKAKEGVITREMEVVAAEERKSPEEIRQKVALGEVVIPANVNHQNLHPKGIGAGLKVKVNANLGTSENRCFYEDELKKVKVAIKAGADAIMDLSTGGNLDEIRRAIIKESSVPVGTVPLYQAAAETLNKYGDISRLDPELLFDVIEKQAADGVDFMTVHVGVTREILKVLDRFPRVTEVVSRGGSLTIAWMEKNGRENPLYEQFDRLLAICRKYDVTLSLGDGLRPGSIADATDQLQIMELMKLGELVKYAQNQGVQVMVEGPGHVPINQIEMNVKLMKRLCANAPFYVLGPLVTDIAPGYDHITAAIGGAWAAYFGADFLCYVTPAEHLGLPTVEDVEEGVIALKIAAHAADLARGNREAWNRDYEMSVARKELNWERQFELAINPERARKMRIERGSQDIKSCSMCGELCAMKIMNERGGKNA

SEQ ID NO: 38237 - protein, 318 aa, Sulfitobacter sp. EE-36
MGGRVIQPDYRVLLDEEIWAYMDRSDSFYPPDAVSLTIDQQRAVYNRMCAAFHQPHPDGVRTWDVAFGGVPCRVYEADTSAITVVYYHGGGFVVGGLDSHDDVCAEICAATGYRVISVDYVLAPEAVFPACFNDAWAAFQAIAAAYDGRVVLAGDSAGGNLAAAVAHTARGSHDGRIAGQVLIYPGLGGDRSRGSYITHANAPQLTVADMEFYQQVRSGGAPPVDDPRYAPLHDTDFTDLPPTVILTVACDPLSSDGEAYAAAINGAGGQAHWHEAAGLVHGCLRARVMSRKAAAFFDQVTAAISAVGAGQWPAISTA

SEQ ID NO: 38238 - protein, 332 aa, Magnetospirillum magnetotacticum MS-1
MTVRVGINGFGRIGRMVFRAVAKEFPEIEIVGINDLLEPDYLAYMLKYDSVHGRFAGDISVEGSNLIVNGKKVRLTAVKDPAELKWDEVKADIVIESTGLFLDAVNAEKHIKAGAKKVLMSAPSKDDTPMFVYGVNHEKYAGEKIVSAASCTTNCLAPVAKVLNDNWGIKRGLMTTVHAATATQKTVDGPSQKDWRGGRGILENIIPSSTGAAKAVGKVLPELNKKLTGMAFRVPTSDVSVVDLTVELNKDASYEDICKAMKAASEGALKGVLGYTEDKVVATDFVGCNMPSIFDADAGIALDSTFVKVVTWYDNEYGYTCNMLRFLRHIAK

SEQ ID NO: 38239 - protein, 157 aa, Glycine max
MTVLSPSLSLPKLHSSFLCCPLKSKLSSSATNRIQQKPTSYPRIRALDLDQNTVVAISVGLVSVAVGIGIPVFYETQIDNAAKRDYTQPCFPCNGSGSQKCRFCLGSGNVTVELGGGEKEVSRCINCDAVGSLTCTTCQGSGIQPRYLDRREFKDDD

SEQ ID NO: 38240 - protein, 174 aa, Oryza sativa (japonica cultivar-group)
MATGSGAAAAAAADAEEKESGSRMITLTSNEGKAFVVTEASARQSATIRSMVDDGGCVDKGFPLPNVDSKTLARVIQYCDEHGNKEPHTVDERAALAKFDRDFIAELDADKAFLYDVTMAANYLHIQGLLALTTQCVADTIKGKTPEEIRTAFGIEYDLTAQDEKEIKEEDTHA

SEQ ID NO: 38241 - protein, 693 aa, Arabidopsis thaliana
MASTSSGGGGGGDKKKKKGFSVNPKDYKLMEEVGYGASAVVHRAIYLPTNEVVAIKSLDLDRCNSNLDDIRREAQTMTLIDHPNVIKSFCSFAVDHHLWVVMPFMAQGSCLHLMKAAYPDGFEEAAICSMLKETLKALDYLHRQGHIHRDVKAGNILLDDTGEIKLGDFGVSACLFDNGDRQRARNTFVGTPCWMAPEVLQPGSGYNSKADIWSFGITALELAHGHAPFSKYPPMKVLLMTIQNAPPGLDYDRDKKFSKKMSSCAQSFKELVALCLVKDQTKRPTAEKLLKHSFFKNVKPPEICVKKLFVDLPPLWTRVKALQSEYQRGVSAWNFNIEDLKEQASLLDDDDILTESREEEESFGEQLHNKVNDRGQVSGSQLLSENMNGKEKASDTEVVEPICEEKSTLNSTTSSVEQPASSSEQDVPQAKGKPVRLQTHSGPLSSGVVLINSDSEKVHGYERSESERQLKSSVRRAPSFSGPLNLPNRASANSLSAPIKSSGGFRDSIDDKSKANVVQIKGRFSVTSENLDLARASPLRKSASVGNWILDSKMPTGQAIKESSSHLSFIIPQLQNLFQQNSMQQDLIMNLVNTLQQAAETTDGSQNGKLPPLPRGSDSNGTVVELTAAERERLLLTKITELRARLFLFFNQSHLSYRRSMWMKELTEELEVEKSKQTQLQQKLKSVTGREQL

SEQ ID NO: 38242 - protein, 161 aa, Brassica napus
  misc_feature (12)..(12): Xaa can be any naturally occurring amino acid
GIQMLISQIAIXVMIGVKFGTVGTGNIGKTDANLIVALICIYVAGFAWSWGPLGWLVPSEISPLEIRSAAQAINVAVNMFFTFLVAQLFLTMLCHMKFGLFFFFAVFVFIMTIFIYLMLPETKNVPIEEMNRVWKAHWFWGRFIPDEAVGVSAAEMQQKSV

SEQ ID NO: 38243 - protein, 244 aa, Musa acuminata
MGRGRVELKRIENKINRQVTFAKRRNGLLKKAYELSVLCDAEVALIVFSNRGKLYEFCSSSSMLRTLERYQKCNYGAPETNIISRETQSSQQEYLKLKARVDGLQRSQRNLLGEDLGPLNIKELEQLERQLDASLRQIRSTRTQYMLDQLGDLQRLGTNAMWSLIKPWKIRLEESSEADQQQLWDPNTHAVAYGRQQPQPQGDGFFQFIDCEPTLQIGYHPDQMAIAAAAAAAPGPSYMPGWLA

SEQ ID NO: 38244 - protein, 320 aa, Ostreococcus tauri
MTSTPESSQPSAADGTAAKRERQYSLDEFDDPNVDPMSSYDGTTCVITDELEVDRRTLGTTLREQIKTMGGEQLMDPHAFVSTDEQRRQCAMLFGSCALLVVKGLGEFGADGFEAWEAAAALATAALAYWTSDLGTGIFHWSVDNYGSKDTPLLGKVIDAFQGHHKYPWTITKRQWANNIHTTCVAPLVFTTPTLLLNDRPTDLIFVGVFTALIVLSQQFHAWSHMKKSELPSAVLAAQDIGLLVGRRDHGQHHKAPFEGHYCIVSGYWNPILDDSGFFRKLEQMIFKATGVAPRCWSDDLNFIVQEDAPEGWGKGIITK

SEQ ID NO: 38245 - protein, 690 aa, Sorghum bicolor
MVTLLAFRLPPLFLLLAAAAAAAAADNGNMTEAEAAAMAALVNLKKSFTDPTGRLEAWSATSPFPPCDAASPWPGVQCYKGSLVGVRLTHMNLSGTFDFGAIAKLPRLHSVNLKHNALSGPLPASLGTLRGLRALYLSSNNFSGPIPADVFANMRWLKKLYLDNNRITGPLPADAIAKAPRLMELHLDRNQIDGPVPFKLPESLKRFNVSHNRLSGTIPQSVAERYDASSFAGNPGLCGSPGSDAAVCVAAGPALPPAFPPPTAADYMAMEEETSVFVVIGIILLVILLVSGAMVLMLRQDERNSVATAWDYYAGSTTTGGAGAGASGSSKSVADAASTTAAAPRAGEAVAVDMASGGSSSSHGGGGSSSGRRMGEFVLLNEDIPAFGLPDLMKASAEVLGNGTLGSAYKAAMRNGVTVAVKRLRDMNRFGRDEFEQHVHMLGQLRHPNVLPPVGYHYRKEEKLIVSEYMPRGSLLYILHGDQSPNRVILDWQGRVRIAVGVVRGLAFLHERLGIPAGRLVSMDGADFDAPPPPPPHGNLKSGNILLGADMEPLLVDYGFFPLVNAAQAPQAMFAFRSPEGTTRGVVSARSDVYCLGVVLLELVTGRFPSQYLLSARGGTDVVHWAATAVAEGGEAELVDPAIAAAGGDAAVRLLRVGVHCASPEPECRPSVAEAAWMVEEIGSAAGGAS

SEQ ID NO: 38246 - protein, 307 aa, Helicobacter pylori 26695
MQEKQLKTIQNKIASWIKEIESAFIDELFSKIGPSKMLRSKLMLALLNEKTDAILLDKAFNLCAIVEMIQTASLLHDDVIDKAAMRRKLPSINALFGNFNAVMLGDVFYSKAFFELSKMGESIAKSLSNAVLRLSRGEIEDVFVGGSFNSDKQKYWRILEDKTAHFIEASLKSMAILLNKDAKMYADFGLNFGMAFQIIDDLLDITQDAKTLGKPNFSDFKEGKTTLPYLLLYEKLNQRDQGLLISYFKQDSHEIIEWTKEKFKQYGTIEETLKIAQVYSKKALEAIKGENNLILEKLAQDVIYRTF

SEQ ID NO: 38247 - protein, 746 aa, Sorghum bicolor
MSMIHCKLNVQAEDLMGGATGAQGDVQWCNGGKLEEVAVLGCAHRIMAAEVSTVHQEVCKMYFWFAGAAIASRLIDCEAYLRTEFSGFIIVCKRAIVLDEMKSTVFSAVVVSIGYAMLGWDFAALLEANHHMKKEFELLNGPSIEGITLAASTFGAIVITIFSGALLDWLGRRAILVYSSLVLFSGGVLMLWSPNIYIVLLARLIVGSGSGLVFTCVPIYISETSPPNMRGLLGTMPQFMFFIGTIFSYCLIFWLTLMSSPNWRIMIGAIFAPSIVYFALLVYYLPESPRWLASDGKISEARVSLQRLRGKKHDVSGEIAVIVDGVDIISDSAVGTARAQSFSGTSASRTWPRSTFYWQLSDPLVDLLGSIHENMSEGGSRRNSFFPVFNSFSFPEHEHMNEHRDGNSDQQTREAYSAGEVNNGDGLRASLLSQAASVEVNDANTSFTSEGSSSYLRRHGTSVLAQEFMASIHDHDIEEEEEIHGFVLPHQSAPRDMESRGRHQVVRLSETADMKFKWRVLLQPGIRHALCYGMLIQALQQSTGISGLLRCAPEILEQVGVSLFSDIGLSPHSTSILISTLQALLILPCITAAMLLMDVCGRRVLVLATTPILILSLSVMSMSILFNMGPFDRAIVFHFALTVCFCSYVIGLGPIPNILCSEIFPTKARATCASFCSLSFWFGGLLSAYCLPVMMSTIGLGGACGIYALVCCAPLFLFYYRIPETKMLNLELIAELFKLSRQEYVQ

SEQ ID NO: 38248 - protein, 335 aa, Methanococcoides burtonii DSM 6242
MTTVLGIEGTAWNLSAAIVDEDDVIAEVTETYRPKTGGIHPREAAQHHALHASDVIERLLKEYRDKGHSPENIDAIAFSQGPGLGACLRTVATSARALALSLDIPLVGVNHCIGHVEIGRWKTPAVDPVVLYVSGGNSQVLAHRAGKYRIFGETLDIGIGNALDKFARGAGLTHPGGPKVEEYARKATNYVKMPYVVKGMDFSFSGLSTAATDALKDNSLEDVCYSFQENAFAMLVEVTERALAHTGKSEVLLAGGVGANMRLREMLDLMCEDRGASFYVPERRFMGDNGAMIAYTGLLMFNSGTTLPIENSHVDPSFRPDTVDVTWIADEKEVL

SEQ ID NO: 38249 - protein, 521 aa, Zea mays
MAMAAPAFLLPSLFPKPTLLAASLHSSFPRGLSLRCSPNGAAVPESPEPASRRGRKKSPSPSAPKPRATRRRTKKADRDPDSEGEEEPVKRTNRRTRKSKGEAKQEEVAQAANHGTGDTIQKANEEEDAVEVGSDDDDFANEWPPLVCCFGAPRWEFVPTVRVSDRQMHPDMYSTWRHLQWEPPEFARAPGSAASNVAIALTRLGGRAAVLGKVGDDDFGRELVYRMNCERVQTRAIKFDDKAVTATARMKVSFRDREDGKGGTKLVAETVKSAAEDSLSRTEINVDVLKEARMFHFNSEVLLNPSMHDTLFRAIELSKKFGSKVFFDLNLPLPLWTSKDKTKEVINRAWKEAEIIEVSRDELEFLLDHEYYEYKRNTPPQYYLEGFHFTRNWPQYYHYSPEEIAPIWHDGIKILLVTYGTLRIHYYTPKFHGCVVGTEDALITPYTTDRTGSGDAIVAAAIRKLTTCPEMYEDQDTLERQLRFAVAAGIISQWTIGAVRGFPTESATQNLKEEVYVPSMW

SEQ ID NO: 38250 - protein, 1584 aa, Oryza sativa (japonica cultivar-group)
MATAIPQRQLFVAGEWRAPALGRRLPVVNPATESPIGEIPAGTAEDVDAAVAAAREALKRNRGRDWARAPGAVRAKYLRAIAAKIIERKSELARLETLDCGKPLDEAAWDMDDVAGCFEYFADLAESLDKRQNAPVSLPMENFKCYLRKEPIGVVGLITPWYFTFFSHPALIFIYDPSMALMNYPLLMATWKVAPALAAGCTAVLKPSELASVTCLELADVCKEVGLPSGVLNIVTGLGSEAGAPLSSHPGVDKVAFTGSYETGKKIMASAAPMVKPVSLELGGKSPIVVFDDVDVEKAVEWTLFGCFWTNGQICSATSRLILHKKIAKEFQERMVAWAKNIKVSDPLEEGCRLGPVVSEGQYEKIKQFVSTAKSQGATILTGGVRPKHLEKGFYIEPTIITDVDTSMQIWREEVFGPVLCVKEFSTEEEAIELANDTHYGLAGAVLSGDRERCQRLTEEIDAGIIWVNCSQPCFCQAPWGGNKRSGFGRELGEGGIDNYLSVKQVTEYASDEPWGWEILYSIKPELIDYPSSFKSPVSSGTKTVLLPEARARVFKSNYSQSLGELKILRSSWLVASFSESGKAGFSSFWLLVHFLDFTTTASQNLDQKLDCLGELLIMGEAAAARSSPNRPFVSLYQQPCNLLFLQNEKNNGKIQSHMDYNIVLSIFTMKSSLRSQSYWSRQVAYVKKLIEVLQREQDILWRILWENIDKVKELTDSTSATLRGPEIESMPKTAKIWLHQVREINRDIEDILEKSPSKTCSSKGSNILSCITQPINFVARQRIYKQVQSLSARIDTIKLRLSLLTNFDDKEAPANPTRYQLDDRQLDMLSLDEAKVIGIGYPKAKVTQLLLDEEKQLRVISIIGSAGVGKTTLARSVYNDKKVQGRFRCHAWITIGAPIPMVDRLKSIMVQIFVEKLEEIPARLDFMDEIQIAEVIGRYLADKSFLVVLDDIWNSDTWDYLKLALPNNGQGSRIIVSTRAQEIGRDCRLASDIQIFEKRPLNEDDAWLLFCNKAFPAIQARCPAELEETGRKIVRECHGVPLLVVTIGGLMSMKEQTVQVWKNVLDNLHKKYLPEFTLPSILWFAYSDLPHHLKCCLLYFIMFPRKYSIKRMTLIRLWMAEGFIKNDQESTLEDTAGRYLTELIDRGMVQVADFYDYGRVKSCSVHDMLREIIILKSTEDNFGIPVTRGVNKVRGNVRRLSIINTNDDFLEDNSCTNLRTLFVFGASSISTTSLHAFLVGFRLLRILDLEGAPVESLPDELPDLFYLRYLSLRNTRIDKLPKSLKKMMNLQTLDLKGTYVSQLPSGITKLESLRHLLAYRYYSGRHPPYYYTLGVTLPRGIGNLKELQKLTYVEANQGNGTIEELGSLTQLRRLGIVKLRERDCMHLCSSVAKMTELLSLSASSLDDEILDLGSLNPAPQCLRRLYLRGPLPGIPSWLHSLKNLVRIRLRWSRLNEDSLKELQSLPLVELALIQAYDGTKLEFTQGFARLEILELDHLTNLEHINLEKSMPGLQKISIRSCDKLLTIPHGIEGLENLKELYLFAMPKNFVESLMTGGVKHRRVEHIPVIRHFNEHRDISLTNL

SEQ ID NO: 38251 - protein, 637 aa, Magnetospirillum magnetotacticum MS-1
MCGLAGLFLPRHAALAEADIAAMLRVMRHRGPDGTGIHLSDDRRFQAGFTRLAIIDLATGDQPLVRNGGETVLLGNGEVYNYRELRAELAAKGHTFLTQGDMEAALESFMAKGRDFVHDLNGMYALAILERDDHRLTLVLDRLGIKPLYWARLGNGGILFASEIKALFASGLLRPLVDEVSVAAYLAHGYVPAPATLYKGVSKLPPGSIMSVDASGEVQIERYWRAAAATDLPGDEAGIRAHLVSILDDAVGLQLRSDVPVGAMLSGGLDSGLLVALAARRLDRPLKTYTVRFLGARVDETPLAAQVAERYGTDHTVFELETGSAAQLLPRLVWHADEPLADASLLPNHLINEVIGKETRVVLNGTGGDELFGGYGRYFQLPVEARWLRLPRPLRKAAEAMIGLGNPFLAWQLARAEKFGRDRGGYLHDHCALFPPPMAKLLGCTLPWPIPAQAAFADEYAGPLDSAALYAELNTYLPEDLLTLLDRTTMAHSVEGRVPLLDHRMVEAALAVPPHIRNPGGRQKALERAIAAEYLPDSLLSAPKQGFASPVPAWFESGGLAPLARRLLTSRRALERGWWSREGVERLLAQPGRHAFRLYSLLVLELTVRIHVEGAFAEAPAFGLAEMAEGEDAPCAA

SEQ ID NO: 38252 - protein, 440 aa, Ostreococcus tauri
MAVTRFESMRSDPFFFRGIVDDADAAAFCASHNDVRRLDLSVIASSRHRSIPARAHSRSIRALRSQNASPRDVLRHSSTFRALGTRDRGVTTTRARVDTNRHFREKSTHRSSDADAPTRCSGFVQSLAYPNFVALISRNVRDERRGSVLTVWVMASPVGDIVGLSIARAVLERYGDDNWPVVMFVAAAFVVINLAIFLVFVREPKEDTVGTSGEDAESTALLGSSEDDSASFFEIARRVWIVPGVVDFCCSVMALKVVITSMLFWTPYYVDDVYPTQKKYSIVSTQLFDLALILGIGSTALMNRVFNRWIAVFLVSLAVGLAPLFALPYAHVLGWTVAYIFAVGFFVGPPAALLASTMSSDLGERAEARTGMRSIVGVISGFVDSAGAVGSGVGQILVGAVAQSGGWHSVFSMLCVFVVLGMLSLTRVARMEHIELSTRA

SEQ ID NO: 38253 - protein, 557 aa, Pseudomonas syringae pv. syringae B728a
MSELIRVPDIGNGEGEVIELMVKVGDRIEADQSVLTLESDKASMEIPAPKAGVIKTMKVKLGDRLKEGDELFELEVEGEAAAAAAPAAEPAPAPAPAPAPAAAEKPAEAAPAPAAAAEPAPAASASVQDIHVPDIGSSGKAKIIELMVKVGDSIQADQSLITLESDKASMEIPSPAAGVVESIEVKLDQEVGTGDLILKLKVEGAAPAAAPAPAASAPAAAPAKAEAAAPAAPAPKAEAAPAPAAPAAPAKDGAKVHAGPAVRQLAREFGVELNAVSATGPHGRVLKEDVQAYVKTMMQKAKEAPAGGASGGSGIPPIPEVDFSRFGEIEEVPMTRLMQLGASGLHRSWLNIPHVTQFDQADITDLEAFRVAQKGAAEKAGVKLTVLPLLLKSCAHLLKELPDFNASLAPSGKAVIRKKYVHIGFAVDTPDGLLVPVIRDVDQKSLLQLAAEAAALAEKARNKKLTANDMQGACFTISSLGHIGGTGFTPIVNAPEVAILGVSKATIQPVWDGKAFQPKLMLPLSLSYDHRVINGAAAARFTKRLSELLADIRTILL

SEQ ID NO: 38254 - protein, 881 aa, Pseudomonas syringae pv. syringae B728a
MQDLDPVETQEWLDALESVLDKEGEDRAHYLMTRLGELATRSGSQLPYAITTPYRNTIPVTHEARMPGDLFMERRIRSLVRWNALAMVVKTNIGDPDLGGHISSFASSATLYDIGFNYFFQAPTDEHGGDLIYFQGHASPGVYARAFMEGRITEEQMTNFRQEVDGNGLSSYPHPWLMKDFWQFPTVSMGLGPIQAIYQARFMKYLEHRGYIPEGKQKVWCFLGDGETDEPESLGAIALAGREKLDNLIFVVNCNLQRLDGPVRGNAKIIQELEGVFRGAQWNVTKVIWGRFWDPLLAKDVDGILQRRMDEVIDGEYQNYKAKDGAFVREHFFNSPELKAMVADLSDDEIWKLNRGGHDPYKVYAAYHEAVNHKGQPTVVLAKTIKGYGTGAGEAKNTAHNTKKVDVDSLRHFRDRFDIPVKDSELEALPFYKPEEGSAEARYLSERRAALGGFVPQRRAQSFSLPTPPLETLKAILDGSGDREISTTMAFVRILTQLVKDKEIGQRIVPIIPDEARTFGMEGMFRQLGIYSSVGQLYEPVDKEQVMFYREDKKGQILEEGINEAGAMSSFIAAGTSYSSHNQPMIPFYIFYSMFGFQRIGDLAWAAGDSRTRGFLIGGTAGRTTLNGEGLQHEDGHSHILASTIPNCRTFDPTYGYELAVIIQDGMRRMFEEQQDVFYYLTVMNESYAQPAMPAGVEEGIVKGMYLLEEDTKEAAHHVQLLGSGTILREVREAAKILRDEFNIGADVWSVTSFNELRRDGLAAERNNRLHPGQKPQLSYVEECLNGRKGPVIASTDYMKLFADQIRQWVPTKEYKVLGTDGFGRSDSRKKLRHFFEVDRHFVVLAALEALADRGDIEPKVVAEAIAKFGIDPEKRNPLDC

SEQ ID NO: 38255 - protein, 408 aa, Oryza sativa (japonica cultivar-group)
MLSYNYLDVAFAPYSDYWREMRKLFVVELTSVSRVRSFAYARAAEVARLVDTLAASPPGVPVDLSCALYQLLDGIIGTVAFGKGYGAAQWSTERAVFQDVLSELLLVLGSFSFEDFFPSSALARWADALAGVERRRRRIFRQVDGFLDSVIDKHLEPERLSAGVQEDMVDALVKMWREQQDRPSGVLTREHIKAILMNTFAGGIDTTAITAIWIMSEIMRNPRVMQKARAEVRNTVKNKPLVDEEDSQNLKYLEMIIKENFRLHPPGNLLVPRQTMQPCLIGGYNVPSGTRVFINIWAMGRGPMIWDNPEEFYPERFEDRNMDFRGSNFELVPFGSGRRICPGVAMAVTSLELVVANLLYCFDWKLPKGMKEEDIDMEEIGQISFRRKVELFIVPVKHEQYQLMGHIN

SEQ ID NO: 38256 - protein, 360 aa, Oryza sativa (japonica cultivar-group)
MDPNRSSGYYDFLNDPDLAHPFGQASTQGDFSHPHNDFPYAHAQFPLFSTQPPPAAAGNGGPTAASRCGVRQRVQANPGSQDDGKARMYYTRDEDLRLVSAWLENSTDPIEGNARKGDTYWRQVADTYNATTEDDRKRDPKHLKGHWHKHTRKVSAFNGIYVQLRDNYQSGRSEEMLMDQAMELYQSREGHPFTLGYWWKAVRDSPKWNAHICLLGHGPRKIRAEFDVNAPPVEEQPAQVRPAGIKRAKKGRQSDYSAELAELIKHLCKAHASQQEETASMKDFQQKLSGEKVEAATLNLQAAKEKTKAKLIDQQTKMLDKFTQMISVDTSSMEPWAREAHIKACTLMSDQLWGKGATLE

SEQ ID NO: 38257 - protein, 155 aa, Synechocystis sp. PCC 6803
MKPIHRYIRLILSKDQDLLFLSLLRTFEKILSKLLAICLMVVVFVAVFDLFKVLIIELQTEPFGFFNRSLIEIFGLFLNILIALELLENITVYLKDNVIQVELVIVTAMIAVARKIIIFDFGKYEGMDLLALGFAIVCLAASFWMVKKLNVNNKH

SEQ ID NO: 38258 - protein, 1209 aa, Synechocystis sp. PCC 6803
MINSGTLITKIEELQSTLAKMDIALGTVDEAIVWTDGTGQIQWCNTAFDHLMGKLHILILGKNLVELLPLHRNSQPLEVSHHPFTIIVATQQKFTDHYEFNQNGKWLHLEIMTSPLMNAQGAVLVIRDISDRHLQEQTLQQLNENLEKRVLERTQAVSLINNKLEQELRERKKTEIALKATTSRLEALIQNLQAGVLVENENGKIVLVNQVFCDLFGIDVPPEKLIGFDCRQSAQFAKILFEDPEAFIIGIDNILQNRQIVTNEELRLKDGRTFARDYVPIEVGNHHDGRLWLYRNITPQKQAEVSLRKQYQRTLLLKEITEEIRQSLDPVKIFQVAVSRLGQTLQVSRCIVHLYSDMPQPHLTCVAEYLIPGMTSMLDLNLLIADNPHLLRALNQDDAVQVDNLKMVPTAVPLQDFYNQLQVYSLLIIRTSYQDKTNGLLILHQCDRSRSWNTEEVELVKAVADQVGIALAQAKLLEQEREIRQQLIEQNKALMTATKAAEDANRAKSDFLATMSHEIRTPMNAVIGMTGLLLDTHLNTQQQQFTETIRSSGEALLSLINDILDFSKIESGQFKLEIHPFEIQQCVEECLDLVAPQAFAKKLDLVYQIEPQVPMAILGDLTRVRQVLVNILANAVKFTTSGSIQVRVSATVANQQQNKYTIQFSIKDTGIGISPDQQSALFKSFSQVNTSIARKYGGTGLGLAICKRLTEMMGGQIWVESYGEIAGNPPVDWAKTSKNNPLESTGATFYFTITAQSTTIVRRPNDLSCQLSLAGKRLLIVDDNQLSCEGLKQLVTAWGLQAQATTSGWEAFSWLRQGECFDLAIIDLQMEEVDGLQLAEALRTLPTGESLPLVILTPSPTSLAELSARTDISIAACLSSPIKKSLVYEVLCEVFKADETDNSLFNGDWRSGITEAVKRTCSPQEREARIKTLSPLRILLVEDNNINQRVALLMLEKLGYRPDIAGNGLEALQVLHQASYDVILMDVEMPEMDGLSATKAIRQDFPADEQPWIIAVTAYAMQGDRETCLAAGMNDYITKPIRENDLLDALQRIDFSVLSLTKNKPAPLSEPVVNVGLVNPVPEVLKADQLEENLVLDLSILTGIREMAGPDGATFLQVIIGDYLHTTPSLLEKLKTAIAAQEIDTVRATAHSLGSSSANLGAVEFAKQCKQLENLARSGMLSGVDGQYIQLEKEYEKVSQALALQLNPN

SEQ ID NO: 38259 - protein, 119 aa, Oryza sativa
  misc_feature (8)..(8): Xaa can be any naturally occurring amino acid
  misc_feature (14)..(14): Xaa can be any naturally occurring amino acid
  misc_feature (33)..(33): Xaa can be any naturally occurring amino acid
  misc_feature (68)..(68): Xaa can be any naturally occurring amino acid
  misc_feature (88)..(88): Xaa can be any naturally occurring amino acid
MGVLGDGXGWCLCXGGAKMERIKNSVLAAQGSXPVAAVSLPAGGGGGGRGGSGLLIHRDLLLTTKGTXPSAVAAPPPRFAQQRPLPVXLVPQRLFINTPILDITIVGFDVVNDELNSHG

SEQ ID NO: 38260 - protein, 457 aa, Mycobacterium smegmatis str. MC2 155
MSHPGATASDRHKVVIIGSGFGGLTAAKTLKRADVDVKLIARTTHHLFQPLLYQVATGIISEGEIAPATRVILRKQKNAQVLLGDVTHIDLENKTVDSVLLGHTYSTPYDSLIIAAGAGQSYFGNDHFAEFAPGMKSIDDALELRGRILGAFEQAERSSDPVRRAKLLTFTVVGAGPTGVEMAGQIAELADQTLRGSFRHIDPTEARVILLDAAPAVLPPMGEKLGKKARARLEKMGVEVQLGAMVTDVDRNGITVKDSDGTIRRIESACKVWSAGVSASPLGKDLAEQSGVELDRAGRVKVQPDLTLPGHPNVFVVGDMAAVEGVPGVAQGAIQGGRYAAKIIKREVSGTSPKIRTPFEYFDKGSMATVSRFSAVAKVGPVEFAGFFAWLCWLVLHLVYLVGFKTKIVTLLSWGVTFLSTKRGQLTITEQQAYARTRIEELEEIAAAVQDTEKAAS

SEQ ID NO: 38261 - protein, 411 aa, Magnetospirillum magnetotacticum MS-1
MNSQHDFHRIKRLPPYVFAEVNAMKARARAAGEDIIDFGMGNPDQPTPTHIVDKLVEAARNPRAHRYSMSRGIPGLRKALSAYYQRRFAVDIDPEAECIVTLGSKEGLANLANAITSPGDIVLVPNPSYPIHPYGFIIAGGSCRFVPVTPDAEFLKALDRAVRHSVPKPIALVLNYPSNPTALLADLDFYGQVVEFCRHHGIWILSDLAYSEIYFDVAPPPSILQIPGAKDIAVEFTSMSKTYNMPGWRIGFAAGNKTLINALARIKSYLDYGAFTPIQVAATAALNGPQDCVDEIRALYKSRRDALIEGLAAAGWDIPSPPATMFAWAPIPKPFAHLGSLEFSKLLMREAQVAVAPGIGFGEYGDSHVRIGLVENVQRTRQAVRNIKTFLGSTGQVLEASEKQRAAGTEP

SEQ ID NO: 38262 - protein, 331 aa, Porphyra purpurea
MSKVFMFDALRAATDEEMEKDLTVCVIGEDVGHYGGSYKVTKDLHSKYGDLRVLDTPIAENSFTGMAIGAAITGLRPIVEGMNMSFLLLAFNQISNNAGMLRYTSGGNFTLPLVIRGPGGVGRQLGAEHSQRLEAYFQAIPGLKIVACSTPYNAKGLLKSAIRDNNPVVFFEHVLLYNLQEEIPEDEYLIPLDKAEVVRKGKDITILTYSRMRHHVTEALPLLLNDGYDPEVLDLISLKPLDIDSISVSVKKTHRVLIVEECMKTAGIGAELIAQINEHLFDELDAPVVRLSSQDIPTPYNGSLEQATVIQPHQIIDAVKNIVNSSKTITT

SEQ ID NO: 38263 - protein, 344 aa, Porphyra purpurea
MSYPKKVELPLTNCNQINLTKHKLLVLYEDMLLGRNFEDMCAQMYYKGKMFGFVHLYNGQEAVSTGVIKLLDSKDYVCSTYRDHVHALSKGVPSQNVMAELFGKETGCSRGRGGSMHIFSAPHNFLGGFAFIAEGIPVATGAAFQSIYRQQVLKEPGELRVTACFFGDGTTNNGQFFECLNMAVLWKLPIIFVVENNQWAIGMAHHRSSSIPEIHKKAEAFGLPGIEVDGMDVLAVRQVAEKAVERARQGQGPTLIEALTYRFRGHSLADPDELRSRQEKEAWVARDPIKKLKKHILDNQIASSDELNDIQSSVKIDLEQSVEFAMSSPEPNISELKRYLFADN

SEQ ID NO: 38264 - protein, 323 aa, Porphyra purpurea
MATSSSLFHPIEKELYSVEHNLKSVAGTRHPILYAAAKHLFEAGGKRLRPAIVLLVAKSTSEQQEIKPGQRRLAEITEIIHTASLVHDDVIDECSTRRGEKTVHKLFNTKIAVLAGDFLFAQSSWYLANIGNLEVVKVITKVITDFAEGEIRQGLVHFDPSISIDDYIEKSFYKTASLVAASCRGAAMLNDLNSQMHNDLYLYGKHMGLAFQIMDDVLDIAGSTKSLGKPSGADFMNGNLTAPILFALTQEGKLDQLIQREFSDERDISLALFLIKKSGGITKAKDLAKEQVQAALCCLQFLPKSAPVSSLKELTHFIITRLS

SEQ ID NO: 38265 - protein, 518 aa, Sorghum bicolor
MATSPAASSGTATGTIGETIVGSHLWKIDRFSATKDLGVGKSIKSSTFNVGGHTWYIECYPCGDNEYSAGLVTLFLCLSAHKEQVEAKCRFTLMDDDRDYYQDGYNHTYNAEDSRGLGIDLIKRADLKKHLKDDCFRIRCDVYIVREFPAVPPPDLHRPLSDLVASGMPGGDRTFQVGGEVFTVHRGLPDPSAHIAASPTPAGTSSSTAGSISSVSHVLTIDGYSKSKKMFRTDDYVESEWFRVVGGHSWYIKLYPSREKEDDDSGCLAVFLNNNWWLLDEDHIEDKVLKVRVELTLLTFAREIISSAQFCYAFTSRYDKCRCYFPFNTEMEPLIGDSFHVKCDVTVVKEITPILRPPDLNLYFGHLLASQVATDVTFEVGSDLFSAHKLVLATRSRAFMAEFFGPAGKGSSTTVTRVQIDDMEPRVFKALLHFIYTDTLPELHEDDDKIVMAQDLLVAADRYDMGRLKLICADMLCNYVNDARAAFAMLELADKHCCRRLKVKCMKLLKGHFAKVAP

SEQ ID NO: 38266 - protein, 256 aa, Salmonella enterica subsp. enterica serovar Typhi str. CT18
MTKRINKDTQVCMSLAARPSNFGTRFHNYLYEALDLNYLYKAFSPTDLTQAISGVRGLGIRGCAISMPFKEACIPLVDELDASAKAYNTDYIAIARLLANYKVSPDQVFALRGSGGMAKAVACALKDAGFTRGYIVAIDEASGKQLAELYGYEWRPDTDGIEADLLINATPIGMAGGNDADKLSYSEQEVDKASVIFDVVALPPVTPLIRYARERGKTVIIGSEVFAIQAVEQFVLYTGIRPDDALFQKAAAWSRL

SEQ ID NO: 38267 - protein, 64 aa, Glycine max
CRNHLMGFCIEGQANQGRAPNEECPVAWGVCNHAFSFPCISRWVKTRQVCPLDNSEWGFQKYGP

SEQ ID NO: 38268 - protein, 368 aa, Sorghum bicolor
MSTSASSSATGDDDDDSGSTSTITAETTTGRHELKGESYTRTKGGVGKFIDSVTFRVGGHSWYIRYYPDGNRDESADWISVYLYLDGAGSEDDGGGVKARYKFSLFRDAAAAGDGEAPPVLIHTRTASNYSFWSADQHRRGYCRFIKATDMEEATKGGGFCIRCDVAVMKETCVETTMADSVTVPASELNQHLGALLDSKVGGDVTFDVGGEQFTAHRYVLAARSSVLMAELFGPMKENTMSSIQIDDVEPRVFRALLHFIYTDSLPEIDGEDEPGMAQHLLVAADKYGMQRLKLMCEAMLLKHIDTSVLATTLTLAEQHDCQGLKDGCFKFLRSPGNTKAVVESDGFQHLRSSCPSLIEEMLVKVAP

SEQ ID NO: 38269 - protein, 362 aa, Helicobacter pylori 26695
MPIDLNEHLKKKNSQRETPTPNTPNNGGRFIPPSNSFNSKKLSVLIVIVLLGVIAFLAKPFEVISSGEIGIKITAGKYEPTPLQPGIHFFVPIIQDILIVDTRIRNINFSRTEDMGVAGKNQGIFRNDAINVMDSRGLTVSIELTVQYRLNPQTTPQTIATYGLSWEQKIINPVVRDVVRSVVGRYPAEDLPIKRNEIAALINSGINKEVSKLPNTPVELSSIQLREIVLPAKIKEQIEKVQIARQESERVKYEVERSKQEAQKQAALAKGEADANRIKAQGVADAIVIEAKAKSQANLSISQSLSDKLLRLRQIEVQGQFNEALKTNNNAQIMLTPGGAVPNIWIDTKSKVKSSIAETKEP

SEQ ID NO: 38270 - protein, 417 aa, Sorghum bicolor
MAGQLQPAVGHAGTSTSWHQLVSTTDSDTYGSSSTLSAETTTGSYVFTVADYSRDKELHAAGSALPSNTFTAGGYSWRITYSHDTDDWIRFSLCLEPPVAGGGAGTGGGRDLGDAAIMVRTRYILLDKAGLPLPSSIRKDSERALSTMRSMRATQFMRRKRFESYYLKDNRFSVRCDVTLVRRTMCGRETGAMPPPDMRRHLGELLAGGVGADVVLEVGAEAFRAHRSILAARSPVFKAELLGGPTDDKDAPPPTTSTTSRRLRIHDIEPSVFRAVLHFIYTDSLPPEIGAGDEMVMAQQLLVAAQRYKLEGLKWICEDVISTLCHRRAANESSCPCLLYQLHAYAKTILSYSRHCRLAESQARSPCSPKTQLLRVSSPWLKKTTTSLVLVYWAPTYRRSKLIARLGGPARSLRGTS

SEQ ID NO: 38271 - protein, 333 aa, Sorghum bicolor
MSSWSRRRRTMLRNDDDDDDDGRASTTMLTEIATGWHVLKATPGASPTSPIDGLTEDTADCISFALRLEDRRAGTGRDAVKVRTTFSLLDVAAGGPVPSLTVSCGVWTFSRIGQSCCDARFMERKEFESCYVKDDEFCIRCDVTVLSAAAAPPLDLRRQLGDLLAGGDGADVTLDVGGESFRAHKNVLAARSPVFMAEFFGGPHKEQVAGRVSIHGIEPSVFKALLHFIYTDSLPDIDGGDMTAMAQHLLVAADRYGIQRLKSICEYLLRTFVDRSAVVTTLVLAERHGCHQLKEACFKVMKSSANYKELVSGEDFQYLASTCPSLVQELEAA

SEQ ID NO: 38272 - protein, 499 aa, Schizophyllum commune
MGAQQSRRSGHGSRPCSTMKHDSSRSSSEASDSKGSRSLKTVSVASASAFAAIAAVTPSSSSSAEDISRLSERTRVEKREVQKPPPPRPKSYLEMPQTTVPCQYRTGKTLGSGTYAIVKEAIHIHTGKYYACKVINKKLMQGREHMVRNEIAVLKRISSGHKNIVTLHDYFETTHNLYLCFDLCTGGELFDRICAKGNYYEADAANLVRTILQAVKYIHDCGIVHRDLKPENLLFRTQAEDADIMIADFGLSRVMEEEKLNMLTEICGTPGYMAPEIFKKTGHSKPVDIWAMGVITYFLLAGYTPFDRDSQQLEMEAIIAGDYKFEPEEYWENVSSTAKDFVTQCLTIDPTNRPTAAEALQHKWLSDPTAHFVTDKEGPVDLLPHVKKAFNAKQLWKKAAFSIKALNRMTMLASSGLDKDAAELSENLKKYKEESAREIMEESTITHSHNMETESTTDLTLKEKEVRDAVKASDDISAHDHEDISSKLASVSLDEGQKK

SEQ ID NO: 38273 - protein, 359 aa, Oryza sativa (indica cultivar-group)
MASSSSSSSLCDNHLLQDDLIPWPSMPFAPAPNTFGLNHQWSQPPMLSSSTDQLSSYELESLQSVESQLAAAAPPTLSPHLQAHQLSTVLMMQELGFQWSSCAAPADQHSIASSTNNNSNVMMNEEELRPRPDQSLISNPRSCSATTLLPPPHLHLDGAVLPSINVSRLQKLAAGDEPPQICCKRQAAAAAVVGHSSIRDEHVPCPYAGPPAHLIQGPSNTLQLLRVTCVIFLPQKVLMKRNTNAAAQGRGGRHGSSTEHRSSTALPPSSKKPRLDSHSSSMLPSFKVRKEKLGDRIAALQQLVSPFGKTDTASVLMEAIGYIKFLQDQVETLSGPYLRSSKNSKKLACRAAQQQRVKR

SEQ ID NO: 38274 - protein, 578 aa, Janthinobacterium lividum
MTVIFQRRCYADPYQSRNRELQNSSTYIIYQETSMTADFNTGLGKNSANYAALTPLDYIARAAAVYGNRLAIAHGAVRQTWGVTYARTRRLASGLIKLGVSTGDTVAVMLPNTPAMVEASFGVPMAGAVLNALNIRLDLASLTFMLRHGQAKVLLADTEFAELARQMAAQIPGLRVIQVNDVLGPEVDAFSDLDYESLLASGDPDYDWQPPADEWDAIALNYTSGTTGDPKGVVYHHRGAALNALSNILEWDMPKHAVYLWTLPMFHCNGWCFPWTIAARAGVNVCLRKFEPKLVFDLMRELRITHYCAAPIVHAALANAPANWRDGIDWTVRGMVAGAPPPAAMVAKIEAMGFDLIHSYGLTEVYGPAAICAEQDEWAALSQEERAVLKSRQGVRYHLQSAVAVIDPETMQPVAADGEQIGEIMFRGNICMKGYLKNERATQEAFAGGWFHTGDLGVMYPDGYIKLKDRSKDIIISGGENISSVEVEDALYHHPQVLAAAVIAQPDEKWGETPCAFVELREGGTVTEAELIAFCKNNLAGFKVPKAIYFGPLPRTSTGKIQKFELRKRMQSDKAIDV

SEQ ID NO: 38275 - protein, 116 aa, Vibrio sp. Ex25
MAEETIFSKIIRKEIPADILYQDELVTAFRDINPRTPSHILIIPNKLIPTTNDVEAEDEAMMGRLFTVAKKLAKEEGIAEDGYRLIVNCNPHGGQEVYHIHMHLLGGRPLGPMVLS

SEQ ID NO: 38276 - protein, 280 aa, Zea mays
  misc_feature (141)..(141): Xaa can be any naturally occurring amino acid
  misc_feature (179)..(179): Xaa can be any naturally occurring amino acid
  misc_feature (234)..(234): Xaa can be any naturally occurring amino acid
  misc_feature (267)..(267): Xaa can be any naturally occurring amino acid
MPDLHPPEHQVAGHRASASKLGPLIDGSGLFYKPLQAGDRGEHEVAFYEAFSAHAAVPARIRDTFFPRFHGTRLLPTEAQPGEPHPHLVLDDLLAGFEAPCVADIKIGAITWPPSSPEPYIAKYLAKDRGTTSVLLGFRVXVRVVGPEGAVWRTERPEVKAMDTVGVRRVLRRYVSSAXDEGMDCALAAAVYGGKGGVLSQLRELKAWLEEQTLFHFYSASILLGYDAAAVAAXGGGGGVTVKLVDFAHVAEGDGVIDHNFLGELCXLIKFVSDIVPETP

SEQ ID NO: 38277 - protein, 253 aa, Nocardioides sp. JS614
MSRTALVTGPTAGIGRSFAHQLAERGHDLVLVARDQARLEAEAEELRTAYGVLVEVLPADLTDRAQLDVVAARLADPDRPVDLLVNNAGFGLKKRFLDNSVEEEQAMLDVLVTAVMRLSHAALAPMSERGSGGIINVSSVASFLPRGSYSAAKAWVNSFSEWAHYEYGPQGVTVTCLCPGFTRTEFHERMGVRRDSAPGFMWLDADTLVARALKDHARGKPFSIPGAQYQAIATAARLVPTGVLQRFQSMGRR

SEQ ID NO: 38278 - protein, 570 aa, Escherichia coli K12
MSEKHPGPLVVEGKLTDAERMKHESNYLRGTIAEDLNDGLTGGFKGDNFLLIRFHGMYQQDDRDIRAERAEQKLEPRHAMLLRCRLPGGVITTKQWQAIDKFAGENTIYGSIRLTNRQTFQFHGILKKNVKPVHQMLHSVGLDALATANDMNRNVLCTSNPYESQLHAEAYEWAKKISEHLLPRTRAYAEIWLDQEKVATTDEEPILGQTYLPRKFKTTVVIPPQNDIDLHANDMNFVAIAENGKLVGFNLLVGGGLSIEHGNKKTYARTASEFGYLPLEHTLAVAEAVVTTQRDWGNRTDRKNAKTKYTLERVGVETFKAEVERRAGIKFEPIRPYEFTGRGDRIGWVKGIDDNWHLTLFIENGRILDYPARPLKTGLLEIAKIHKGDFRITANQNLIIAGVPESEKAKIEKIAKESGLMNAVTPQRENSMACVSFPTCPLAMAEAERFLPSFIDNIDNLMAKHGVSDEHIVMRVTGCPNGCGRAMLAEVGLVGKAPGRYNLHLGGNRIGTRIPRMYKENITEPEILASLDELIGRWAKEREAGEGFGDFTVRAGIIRPVLDPARDLWD

SEQ ID NO: 38279 - protein, 461 aa, Colwellia psychrerythraea 34H
MTIALKPYHRPIIEVLPFLALEKHQLHNITVAADEPLTLDTVGLLQKFGSPLYVVSEQRLRQDFKNFKRSFSDEHVKTKVAYSIKTNYLPAVCAILRQEGAQAEVVSGMEYELARTLGIPGKDIIFNGPHKTQSELKLALSEGALVNIDNFNELEHIDRISEELITPARVAIRVNFRYGTNPWTKFGFNNENGESLNALKKIARNKKLQFEGFHCHVGTFVLVHELYANAVEKLIELAKQAREIGLNPTSIDIGGGFPSANTLRPEYDLPGGSQRANNDYLLPYAEHIFGQLRKHSELFGNNPTLILEPGRAIVDASTQLLSTVIAKKEIVGGRNAVIIDAGVNLVPTVCYYNHQIKTVAATKSEERGLLKPVDIFGPLCMQSDRLREQILMPALNVGDHLSIGNVGAYCHTQSNQFIQPRPATILLGEHGPELIRRAETYKDIFALDLLPGRLRDDKCQF

SEQ ID NO: 38280 - protein, 429 aa, Vibrio sp. Ex25
MTRIIVVGGGAGGLELATKLGRTLGRKNRAQITLVDRKASHLWKPLLHEVATGSLDEGVDALSYRAHAKNHSFDFQMGSLQDIDRERKVIILSELKDEHGELLMPSRELEYDILVMAIGSTSNDFNTPGVRENCIFLDSPEQAHRFRTEMNNEFLKLHAKNGNGTVDIAIVGAGATGVELSAELHNAVKELRTYGFGDLDSSKLNVNLIEAGERILPALPPRISAAAHQELVKLGVNVRTATMVTKAEKDGLTTKDGEKIPAQIMVWAAGIKAPDFIKDIAGLETNRINQLVVKNTLQTTRDDDIFVIGDLAQCTQADGSFVPPRAQAAHQMASQAFSNIVAKINGRELKDYVYKDHGSLVSLSRFSTVGSLMGNLTKGSMMVEGRIARVVYISLYRMHLMALHGVFKTGLMMLVGRINRVLRPNLKLH

SEQ ID NO: 38281 - protein, 507 aa, Mycoplasma genitalium
MHKKVLLAILDGYGISNAIYGNAVQNANTPMLDELINSYPCVLLDASGEAVGLPMGQIGNSEVGHLNIGAGRVVYTGLSLINQHIKDRSFFANKAFLKTIEHVEKNHSKIHLIGLFSNGGVHSHNEHLLALIELFSKHAKVVLHLFGDGRDVAPCSLKQDLEKLMIFLKNYPNVVIGTIGGRYYGMDRDQRWDREMIAYKALLGVSKNKFNDPIGYIETQYQNQITDEFIYPAINANLNSDQFALNNNDGVISFNFRPDRARQMSHLIFNSNYYNYQPELKRKENLFFVTMMNYEGIVPSEFAFPPQTIKNSLGEVIANNNLKQLRIAETEKYAHVTFFFDGGFEVNLSNETKTLIPSLKVATYDLAPEMSCKAITDALLEKLNNFDFTVLNFANPDMVGHTGNYQACIKALEALDVQIKRIVDFCKANQITMFLTADHGNAEVMIDNNNNPVTKHTINPVPFVCTDKNVNFNQTGILANIAPTILEYLNLSKPKEMTAKSLLKNNN

SEQ ID NO: 38282 - protein, 227 aa, Oryza sativa
  misc_feature (44)..(44): Xaa can be any naturally occurring amino acid
MDSEHWISRLAAAKRFYAAQLGHADRAGMEEVDMDEEVRPEFAXCPYCYEDHDVVSLCAHLEEEHPFEPHAAPCPICSDKIAKDMLNHITVQHGYLFKNRRRLRRFVIPGSQALSLLSRDLREAHLQVLLGGGGHRSNNSSNTTNISADPLLSSFGLSFPTSDTEETSKPPISIPDDASVIKETPAQPWDSSIDSSLTREEREQKRKQASVRATFVQDLLLTTLFGD

SEQ ID NO: 38283 - protein, 423 aa, Arabidopsis thaliana
MAVEYECCGTSFFIHIAVIVLLVLFAGLMSGLTLGLMSMSLVDLEVLAKSGTPRDRIHAAKILPVVKNQHLLLCTLLICNAAAMEALPIFLDALVTAWGAILISVTLILLFGEIIPQSVCSRHGLAIGATVAPFVRVLVWICLPVAWPISKLLDFLLGHGRVALFRRAELKTLVDLHGNEAGKGGELTHDETTIIAGALELSEKMAKDAMTPISDTFVIDINAKLDRDLMNLILDKGHSRVPVYYEQRTNIIGLVLVKNLLTINPDEEIQVKNVTIRRIPRVPETLPLYDILNEFQKGHSHMAVVVRQCDKIHPLQSNDAANETVNEVRVDVDYERSPQETKLKRRRSLQKWKSFPNRANSLGSRSKRWSKDNDADILQLNEHPLPKLDEEEDAVGIITMEDVIEELLQEEIFDETDHHFEDL

SEQ ID NO: 38284 - protein, 424 aa, Staphylococcus aureus subsp. aureus COL
MEITMPKLGESVHEGTIEQWLVSVGDHIDEYEPLCEVITDKVTAEVPSTISGTITEILVEAGQTVAIDTIICKIETADEKTNETTEEIQAKVDEHTQKSTKKASATVEQTSTAKQNQPRNNGRFSPVVFKLASEHDIDLSQVVGSGFEGRVTKKDIMSVIENGGTTAQSDKQVQTKSTSVDTSSNQSSEDNSENSTIPVNGVRKAIAQNMVNSVTEIPHAWMMIEVDATNLVKTRNHYKNSFKNKEGYNLTFFAFFVKAVADALKAYPLLNSSWQGNEIVLHKDINISIAVADENKLYVPVIKHADEKSIKGIAREINTLATKARNKQLTAEDMQGGTFTVNNTGTFGSVSSMGIINHPQAAILQVESIVKKPVVINDMIAIRNMVNLCISIDHRILDGLQTGKFMNHIKQRIEQYTLENTNIY

SEQ ID NO: 38285 - protein, 327 aa, Staphylococcus aureus subsp. aureus COL
MAKLSYLEAIRQAQDLALQQNKDVFILGEDVGRKGGVFGTTQGLQQKYGEDRVIDTPLAESNIVGTAIGAAMVGKRPIAEIQFADFILPATNQIISEAAKMRYRSNNDWQCPLTIRAPFGGGVHGGLYHSQSIESIFASSPGLTIVIPSTPYDAKGLLLSSIESNDPVLYFEHKKAYRFLKEEVPEEYYTVPLGKADVKREGEDLTVFCYGLMVNYCLQAADILAADGINVEVVDLRTVYPLDKETIIDRAKHTGKVLLVTEDNLEGSIMSEVSAIIAEHCLFDLDAPIMRLAAPDVPSMPFSPVLENEIMMNPEKILNKMRELAEF

SEQ ID NO: 38286 - protein, 149 aa, Oryza sativa (indica cultivar-group)
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIRDFRESESTGFNVSSLSY

SEQ ID NO: 38287 - protein, 470 aa, Xanthomonas oryzae pv. oryzae KACC10331
MRRPDAGDATCCRSRDALTRPVHCGCGMLSSPRRTPSDLTMTAPPSQAPLHLVVVGGGFAGLWATRALDDPNIRITLIDRQNHHLFQPLLYQVATAGLSAPDIAAPLRHILREQRNVEVLLGDVTDIAPSRREVVLADGNTLGYDMLLLATGATHAYFGNDQWAEHAPGLKTLYDALVLRRKLLLAFERAEAESDPAARAAWLSFAVVGGGPTGVELAGTLSEIARHTLKNEFRHIDPQQARVRLVEAGPRVLPSFPEDLTDKARKQLQHLGVEVHTSAPVTHIDALGYQLGDTFVPARTVVWAAGVAASPLARTLGVPLDRAGRVLVEADLSVPGHPEIFVGGDLASVQQDGRPVPGVAPAAKQMGKHIAKAIRARHRGQTAPAFRYQDYGNLATIGRMAAIVHVGKLKLSGIVAWWFWLAAHVYFLIGFRNRFVVLVNWAMAYWSYQRAARIIFGGATDDTPPSSKDG

SEQ ID NO: 38288 - protein, 303 aa, Pediococcus pentosaceus ATCC 25745
MSNKVVVLGSLNVDTILQVGRFPEPGETLALKDKQMAGGGKGANQAIAAARSGAETSFIGKVGTDANGQFMLKQLLDSGVSTEYVATSKVADTGQAFVMLENTGENRILIYGGSNAELNEDDVNKAAEKIQQADFIVAQLETPLETTKYAFEIAKQAGIKTILNPAPAVKNLPKELIQLTDVITPNETEAEILTGVTVVDDASMKEAAQRLHKMGVQTVIITLGSKGVYYDDGDVSGIVPAFKVHAIDTTAAGDTFLGSFSSELKPDLSNLKEAIMYGNKASSLAVQKMGAQPSIPTRKEVLK

SEQ ID NO: 38289 - protein, 565 aa, Porphyra purpurea
MLIADDLEKLLEILPHFVREPLKQHSNRKNLIEVVMDLGRRPEARFPGNPEYLSQRSISWQDLDYCVKKVGNFSGDNRAGIEKTLHRISSMRNREGSIIGLTCRVGRAVFGTISIIRDLLEQGDSILLLGKPGVGKTTAVREIARVLSDEMEKRVVIIDTSNEIAGDGDIPHPAIGRARRMQVAQPDLQHQVMIEAVENHMPEVIIIDEIGTELEALAARTIAERGVQLVGTAHGNYLESLIKNPTLADLIGGIQYVTLGDDEAKRRGTQKSILERKAAPAFQIAIEIHDRKAWIVHEKVEETIDQILQGHQPFVQKRQIQDNGRILIKCYPSQSTEVLSTNSSSLQKMSSLKQKTHFLQQREVKNKTFDLNKLENRDTSLLSTTINTPVNINNHSFQVEASIQYLYAYSLSWQHITSVISALDLPIILTKEIEKSDAILALRSQVKQNTKLRQIAKSRQIIIYTIQNSTVPQITRALRKILNINTSSDLNWVKLCKSKKFYEIQALQEAKLAIEIIILNENSIVQLTPRSAYIRKMQHNLIDNYQLRARSFGEEPYRKLRIYPE

SEQ ID NO: 38290 - protein, 86 aa, Alaria esculenta
IDINNGENIFTANCSACHAGGNNVIMPEKTLKKDALADNKMVSVNAITYQVTNGKNAMPAFGSRLAETDIEDVANFVLTQSDKGWD

SEQ ID NO: 38291 - protein, 366 aa, Janthinobacterium lividum
MTTSTPNLVVTPSAHPLSDAERAARMVNPAFGRIFTDHMVVIPYRDGKWQQGELKAYGPLMLDPSASSLHYGQAIFEGYKAFAQPDGSIKTFRPEQNAARFNRSAARLAMPAIPVELFLEAGDALISQDRNWVPKNTGESLYMRPLMIATDPYLGVRPSEEYLFVLFASPAGAYFPKGVKPVTVWISEDFVRAAPGGTGEAKCAGNYAASLMAQSQAQEKGCDQVVWLDAVHREFIEEMGGMNLFFVYKDGEKVTVVTPELTGTLLPGITRRSLLEMAKDLGYATEERKLSVQQWRDDIASGRMTEVFACGTAAVITPVGVAKANGFEMTINNNENGAVTLALREALLGLQHGTAPDTHGWMHKVC

SEQ ID NO: 38292 - protein, 1220 aa, Ustilago maydis 521
MSSSAETSPPRAGSYILISSSTAALDAPAPAADESARVFGSRPRLFFFLPLLAALDVATTLTLGILVLNQLAKHDEPAAHILGGPLSHDPVMTSSLPGRTDPRLDDAAWERRKIVLLVIVFSIARAFSYGIVGFSIRIRQLGVTVAAISILSTLFYVSVANLLFQARPKPGIVDKRSNSWSGVLASDAWRWPDAFRHFEPTMPILVGVQMAFTLFEWILYIAIVGVKIPPGGNPVEAKRWARDLADDPQYRRGADMHSLYLSDDGHDQDITEEVRQPLEHLDAQDGGELQEVRTQLSSPISNLSCRGKSDGSDQPLLGASSSTPRGYGSTLADPKTPQGPGSVRSVRSPVALQQHGMSRSSSALSGLYSRSPGTAELGPADRYEEVLADDDDDEDEQDGEGDEDAEGSDPDDIIDITPNRAVARKEARLRLARAALPARRASGGTLSTLNLFGGGGGSTNGSSGDAVSTRTGGGGTGGAGIFSDEAGSPLGRNAREGDVSRPALLSVATSDEASRGESLAADPSIQSSNSMTLPSSSSTRTASTRASSFKDRKFKLPKWIKRGNSRSSCERQACPPTTKSRMSAQLSRADFVLHLARASLSPPIDRECEITNRESRFVISTGLARIQNPYKLTSSTVTALFKALRSAARSVKITPLALFSSVRVLRASRALGPSTTTTFTRAISVGVATIDKLRSSTTSACARLPIATASVAANRLQQTSTHLSSFSHFSTSSAVKMPPVPKPTSTHYDMVVIGGGSGAMGVSRRAAAYGKKVCVIEEDGRLGGTCVNVGCVPKKLMWHAADMAEHLKEAPEYGFGDVVNKPKVPEFAWKYFAEKRDAYVRRLNGIYDRNLDKDGVEYLSGHGKLTGKNEVEVTMRGQDGSFNAGTYKITGDRIVIATGGRPVIPSDDKIPGASLGIDSDGFFELKEQPKRVAVVGAGYIAVELAGVFNTLGSQTHLLIRHDTFLRPFDPIISETLQDYMSRTGLNVHKQTNITKVEGSKGGPLTIHTDKGDSIEVDCLLWAIGRRPNTDNLGLETVGVQLDKGGNIVVDKYQETNVRNVFAIGDIQGKALLTPVAIAAGRKLSNRLYSNHASLKDDHMDYDNIPTVIFSHPTSGTVGLSEAQAVQKFGRENVSIHTSKFTSMYYGMLDHKAPSAFKMVVAPGDKVVGLHIVGLGADEMLQGFAVAIKMGATVKDFQDTCAIHPTSAEEVVTMIPTTKHA

SEQ ID NO: 38293 - protein, 484 aa, Hordeum vulgare subsp. vulgare
GKTLGIGSFGKVKIAEHIITGHKVAIKILNRRKIKSMEMEEKVKREIKILRLFMHPHIIRLYEVIDTPADIYVVMEYVKSGELFDYIVEKGRLQEEEARRFFQQIISGVEYCHRNMVVHRDLKPENLLLDSKCNVKIADFGLSNVMRDGHFLKTSCGRPNYAAPEVISGKLYAGPEVDVWSCGVILYALLCGTLPFDDENIPNLFKKIKGGIYTLPSHLSPLARDLIPRMLVVDPMKRITIREIREHSWFKARLPRYLAVPPPDTAQQVKKLDDETLNDVIKMGFDKNQLTESLQKRLQNEATVAYYLLLDNKLRTTSGYLGAEYQESMDSSFSQISPETPSSASEARQYGSPGFGLRQHFAAERKWALGLQSRAHPREIITEVLKALQELNVCWKKIGHYNMKCRWSPGFFENMMHNNNGFGVESAIIEADGLGDKSTHIVKFEIQLYKTRGDKYLLDLQRVSGPQLLFLDLCSAFLTQLRVL

SEQ ID NO: 38294 - protein, 615 aa, Magnetospirillum magnetotacticum MS-1
MCGIAGFVGDGDRDILAAMAGAIAHRGPDGEGLWIDPERAVHLAHRRLAVIDLEGGAQPMWSGDGRIGVVFNGEIYNHRALRRDLESLGHVFASDHSDTEVLIHGWRQWGRDLPGRLNGMFAFAIHDRERGSLFLARDRFGEKPLYVVERPGLFAFASEISALLRHPGVPAEADALAIRKFFAYCLFPAPHTPFKAIAKLPAGHWLELSLSGLTTERGCYWRFAIEPEETGRSETELAEELRALLDASVRDRLESDVPLGIFLSGGIDSSAMLALAARHRPAASLDGFSIGFTEASFDESAFARRMAAEVGCRHHVETCDLDAARRDLPDLLARLDEPSGDPSILPTSLLCRFARRSVTVALSGDGGDELFGGYDPLTALAASRRYRALVPGAVHPAIEALAGLLPPSDANMSLDFKIQRWLRGVGREPSMWLPGWMGALSPSEIDQVFGSRLAPEELYSEAIERWEACASPDPIDRALDYFTAFYLQDGILTKSDRASMQVALEVRAPFLDNDVADFARRLPSRFKVAGGQRKVLLKKAVRGLVPDALIDRPKKGFGIPLARWLRDMDPPTAGTPLLDDAWLRQRWERHRTKRQDCRHGLWCWLALERRFSTVN

SEQ ID NO: 38295 - protein, 475 aa, Ostreococcus tauri
MGGDAGTRSATTTRATVRILGDAASAVDVREAYAFGVELGRGQFGEVREVVDTSTGRALACKSISKRGLKSESSREMVRNEVVELVSVHEDATHVHLIMEKLDGPEWFDAITEQFDEAPYSEAEAAAQFRNVARTVEYLHAMDVMHRDLKPENFVLKSKEKDSPICAIDFGLSTFFLPDQEFTELVGSPYYVAPEVMGYKYSNEADVWSCGVILYILLSGVPPFWGSSEKQIFDEIKRYKTGATSLDFASEPWPSVSDAAKELVQGMLTVNRKDRMTIEDVLSHPWLADPGVAPKTALDNIVLQRFKNFAGMDKFKRFGLHAMARSMPEEEVIGLGVMFKELDKDKSGKITIVELRQGLKLQSAEAAAQLEEVVASVDLDGSGDLDYEEFIVATIARSKRESRAAVQRAFDFFDIDGDGSITADEFQRALESLSPVERTNLGDVNELLAAADTNGDGVIDFDEFMAAMSSDTDAR

SEQ ID NO: 38296 - protein, 290 aa, Glycine max
MNVNQRHKEVCEHKETSQSQKKHLVYRLLKKMELMCHCSSFLLPPENPNTTCSLSLKYALVVLNQSLPRFAPLLWDHAQVRVCADGGANRVYDEMPLFFPHQQPSHVRTRYKPDVIKGDMDSIRTEVLDFYAKLGTKIIDESHDQDTTDLHKCVAYIRDLTPNVDGSELCILVAGALGGRFDHEIGNINVLCRFSNTRIILLSDDCLIHLLPKNHCHQIFIQSSVEGPHCGVIPIGMPSGSSTTTGLKWDLNDAAMSFGGLISTSNIVKGEIVTVQSDSDLLWTISIKKL

SEQ ID NO: 38297 - protein, 300 aa, Arabidopsis thaliana
MENKTQEEASTIKVSSLTCIDLANPNFQQSAVSLKQACLDCGFFYVTNHGISEELKDEAFEQSKKFFALPLEEKMKVLRNEKHRGYSPVLDQILDPENQVDVVLPGWRATMEKYHQEALRVCKAIARLLALALDLDTNYFDKPEMLGNPIAVMRLLRYEGMSDPLKGIFGCGAHSDYGMLTLLATDSVTGLQICKDKDVKPRKWEYVPSIKGAYIVNLGDLLERWSNGIFKSTLHRVLGNGQDRYSIPFFIEPSHDCLVECLPTCQSENNLPKCPAIKCSTFLTQRYQQSHVNLSIYKQP

SEQ ID NO: 38298 - protein, 746 aa, Synechocystis sp. PCC 6803
MPQLISVPNLSTDVHLGQTFPLGATVYADGVNFCLFSKHAERVTLLLFDRPNDPAPARTIELHRGRNRTFYYWHVFVKGLKAGQVYAYRVDGPHEPEKGHRFDPDKVLLDPYAKAIVGKDIYDRKAAMALGDNCAQALRSVVVDTSVYDWEDDHAPRTPYAASIIYELHVGGFTRNPNSGLSENKRGTYAGLIEKIPYLKELGITAVELLPVHYFDPEDAQPGLTNYWGYSTIGFFAPHQGYSAADDPLEVVDEFRDMVKALHKAGIEVILDVVFNHTAEGNEKGPTLSFRGIDNRTYYILDEDKSSYSNYSGCGNSVKANHPVVGGLILDSLRYWVSEMHVDGFRFDLASVLVRDTKGVPLHGSEIATANIIWAIESDPILAGTKLIAEAWDAAGLYSVGKFVELADWFAEWNGPFRDDVRRFVKGDNGAVPALASRLLGSPDIYYRQDTDINRSINFVTCHDGFTLVDLVSYNEKHNEANGEKNRDGTNDNFSWNCGVEGETDDPKINQLRLRQIKNFLTILFFSQGTPMLLMGDPVGRTQQGNNNGYCQDNELSWFDWSGEETHSDETHFLRGIIALTQSLSLFLEESLLPVLNFALPRFPDENDGSEGDGQDGEEPVYKPLPPVDEAALREMYLKATKDLPGSCVVWHGVKLAQPDWSYTSHTLAVTLFHPGAEEILHLIFNAYWEPLNFELPPLNDGLIWHRLVDTYLPTPLDFQEPAIASPVEGETYWVQPRSSVVLMAK

SEQ ID NO: 38299 - protein, 325 aa, Staphylococcus aureus subsp. aureus Mu50
MAQMTMVQAINDALKTELKNDQDVLIFGEDVGVNGGVFRVTEGLQKEFGEDRVFDTPLAESGIGGLAMGLAVEGFRPVMEVQFLGFVFEVFDAIAGQIARTRFRSGGTKTAPVTIRSPFGGGVHTPELHADNLEGILAQSPGLKVVIPSGPYDAKGLLISSIRSNDPVVYLEHMKLYRSFREEVPEEEYTIDIGKANVKKEGNDISIITYGAMVQESMKAAEELEKDGYSVEVIDLRTVQPIDVDTIVASVEKTGRAVVVQEAQRQAGVGAAVVAELSERAILSLEAPIGRVAAADTIYPFTQAENVWLPNKNDIIEKAKETLEF

SEQ ID NO: 38300 - protein, 468 aa, Staphylococcus aureus subsp. aureus Mu50
MVVGDFPIETDTIVIGAGPGGYVAAIRAAQLGQKVTIVEKGNLGGVCLNVGCIPSKALLHASHRFVEAQHSENLGVIAESVSLNFQKVQEFKSSVVNKLTGGVEGLLKGNKVNIVKGEAYFVDNNSLRVMDEKSAQTYNFKNAIIATGSRPIEIPNFKFGKRVIDSTGALNLQEVPGKLVVVGGGYIGSELGTAFANFGSEVTILEGAKDILGGFEKQMTQPVKKGMKEKGVEIVTEAMAKSAEETDNGVKVTYEAKGEEKTIEADYVLVTVGRRPNTDELGLEELGVKFADRGLLEVDKQSRTSISNIYAIGDIVPGLPLAHKASYEAKVAAEAIDGQAAEVDYIGMPAVCFTEPELATVGYSEAQAKEEGLAIKASKFPYAANGRALSLDDTNGFVKLITLKEDDTLIGAQVVGTGASDIISELGLAIEAGMNAEDIALTIHAHPTLGEMTMEAAEKAIGYPIHTM

SEQ ID NO: 38301 - protein, 355 aa, Rubrobacter xylanophilus DSM 9941
MGLAGAQERAGRPLAAEFLPEVEEVLAERGEPPYRLRQVYAALAGSLASGWDEVASLPKGLREELAGRVPASVLELRRISRARDGTRKYLFFTRDGHAIETVMIPERSRRTVCISTQVGCPMACTFCATGLLGIKRNLKAREIAEQVFAVARDIAPERVTNVVVMGMGEPFLNYRETLRALRVLNDRRGFNLAARHIAVSTSGLVDKIRRFADEPEQFHLAISLHTPFEEERRRLMPVAARHPIPELMNAARYYVERTRRKLFFEYTLLAGVNDRMRHAEALAELLDHPLYHLNLLRFNWTDTGFSATSARRAKEFLRRARELGLSATLRPSRGQDIEAACGQLAARDARSPTAR

SEQ ID NO: 38302 - protein, 273 aa, Cryptococcus neoformans var. neoformans JEC21
MRHLTLIRPALQPIVPRTFARTLITTPPRLLATPSNDTGPQHVTPGPPKSPNPLDTATQSAISAQKYPDYSTGPSAIDKASQILFLTEIVRGMWVVLEQFFRPPYTIMYPFEKGPLSARFRGEHALRRYPNGEERCIACKLCEAICPAQAITIESEAREDGSRRTTRYDIDMTKCIYCGFCQEACPVDAIVETQNQEFSTETREELLYNKEKLLLNGDRAEAEIAANLQSEHGLEDSMWEWDVHAQYHGYKMYHNYALQLSCSQRGVISRRMR

SEQ ID NO: 38303 - protein, 351 aa, Oryza sativa (indica cultivar-group)
METAAAAPPRVQALADAGVSLLPAQYVQPPELRPDPTTTTHRRAPTAASLSVPVVDLSSPGAGDAVRRACAEWGAFHVVGHGVRPGLLDAMRGAGLAFFRSPMEEKLRFACDQARGAAAEGYGSRMLANDDSVLDWRDYFDHHTLPDSRRDPTRWPDFVPGYRDTVVKYSDSMKDLAQKLLRIVSESLNLPPSYIEEAVGEVYQNITVSYYSPCPQPDLALGLQSHSDMGAITLLIQDDVGGLEVLKDGLWIPVPSLPDGILVILADQTEIITNGRYKSAVHRAIVNADRARLSVATFYDPSKSRKICTAPQLVCKEHPQKYRDVIYGDYVSSWYSKGPEGKRNIDALLIE

SEQ ID NO: 38304 - protein, 87 aa, Aphanizomenon flos-aquae
ADTVSGAALFKANCAQCHVGGGNLVNRAKTLKKEALEKYNMYSAKAIIAQVTHGKGAMPAFGIRLKAEQIENVAAYVLEQADNGWKK

SEQ ID NO: 38305 - protein, 88 aa, Bryopsis maxima
GGDLEIGADVFTGNCAACHAGGANSVEPLKTLNKEDVTKYLDGGLSIEAITSQVRNGKGAMPAWSDRLDDEEIDGVVAYVFKNINEGW

SEQ ID NO: 38306 - protein, 86 aa, Bumilleriopsis filiformis
ADIENGERIFTANCAACHAGGNNVIMPEKTLKKDALEANGMNAVSAITYQVTNGKNAMPAFGGRLSDSDIEDVANYVLSQSEQGWD

SEQ ID NO: 38307 - protein, 148 aa, Chlamydomonas reinhardtii
MLQLANRSVRAKAARASQSARSVSCAAAKRGADVAPLTSALAVTASILLTTGAASASAADLALGAQVFNGNCAACHMGGRNSVMPEKTLDKAALEQYLDGGFKVESIIYQVENGKGAMPAWADRLSEEEIQAVAEYVFKQATDAAWKY

SEQ ID NO: 38308 - protein, 309 aa, Oryza sativa (japonica cultivar-group)
MKATHYPLSTSAPSAYGLRNCDIASRLEFLIPLLGSYEVLLKTVKRSYRILTSDIEEVIKPNFAQLQECGLTVCDIVKTNPRLLSFNPERIKRYVHRADMLGVPRCSPAFRMAVCSTNEGSVTARMEFLSRTLGCSMDNILIAVGKRPTILGLSMDNLRRKIEFLVTEVGLKLECIVECLGILRYSLEKRMVPRHSVMEILRARGLMKKGASLYGLIMQGEADFVARYIDTHKDMVHGLADAYNASCFGKMPVVPDSTVKKRHGRRDIYCRGFAMFEIWNLLSYMLDNYTCRSALHLADTLLEFSELQQ

SEQ ID NO: 38309 - protein, 81 aa, Microcystis aeruginosa
DGASIFSANCASCHMGGKNVVNAAKTLKKEDLVKYGKDSVEAIVTQVTKGMGAMPAFGGRLSAEDIEAVANYVLAQAEKGW

SEQ ID NO: 38310 - protein, 83 aa, Pavlova lutheri
GDIANGEQVFTGNCAACHSVZZZKTLELSSLWKAKSYLANFNGDESAIVYQVTNGKNAMPAFGGRLEDDEIANVASYVLSKAG

SEQ ID NO: 38311 - protein, 85 aa, Petalonia fascia
VDINNGESVFTANCSACHAGGNNVIMPEKTLKKDALEENEMNNIKSITYQVTNGKNAMPAFGGRLSETDIEDVANFVISQSQKGW

SEQ ID NO: 38312 - protein, 502 aa, Debaryomyces hansenii CBS767
MSLPLEYNVTLPDGNKFSQPSGLFINNEFVKSKSGKTIESINPSTGEVNGSVYAADEEDVDSAVKHARNAFHAVWRKTTGVARGDLLNKFAQVLQEQRDLIGAIEAWDSGKTKEQNAVYDIDECINCFKYFAGWADKIQGKVIQNDPKKLAYTVHEPFGVCAQIIPWNYPLAMAAWKLAPALAAGNVVVLKSSEVTPLSILYLAKIFRDVGFPPGVVNILSGYGATCGKALASHLDVDKIAFTGSTATGKLIQQMASSNLKAVTLECGGKSPLIVRKDADLEQAVKWAAIGIMSNQGQICTSTSRVYVHESVYDTFLTMYAKHIKEEYVQGDMFEKNAIVGPQVSKQQFDKILSYIDIGKKEGARVILGGEKNSDGNMSKGFFVKPTIFADVKPDMRIVNEEIFGPVVTCGKFASDEEAIKYANQTQYGLGAAIFTSDITKAHSMASDIQAGMVWINSSNDSDCHVPFGGVKMSGVGRELGEYGLSMYTQAKAIYVNLGTHL

SEQ ID NO: 38313 - protein, 97 aa, Pyrus pyrifolia
MGRPLGTDFIEDWDWYRIAGSEEGKADRGADTPFPELCGHCEKEAVNVSIGNLLSYPFVREGLLKKTLAIKGGYYDFVNGHFELWDVDFSLNPTFSV

SEQ ID NO: 38314 - protein, 377 aa, Glycine max
MGRKGNSWFSTVKKALSPEPKEKNDQNSSRSKKKWFQKQKLQTSESTSQSDNAPPLPLPEIILTHVESEINHDRVEVATAVDAEEPVLAVQTAAAEVQATTIVQFDNKPTEEMAAIRIQKAFRGYLARRALRALRGLVRLRSLMEGPVVKRQAISTLRSMQTFAHLQTQIRSRRLRMLEENQALQKQLLQKHAKELESMRLGEEWDDSVQSKEQVEAKLLSKYEASMRRERAMAYSFSHQHNWKNASRSINPMFMDPTNPAWGWSWLERWTAARPWESHSQMEKEKNGNKSLRSSSRGITSAEISKAFAKFQLNSEKHSPTASQNPGSPNFESHSQSHSNPPKPPSPAVAKKLKKASPKDILAIDDDTKSMISVQSE

SEQ ID NO: 38315 - protein, 487 aa, Nocardioides sp. JS614
MSMFKWELVDPKPGEAVAPHQRLSWGKTVGLGAQHVVAMFGATFVFPLIMGLNANLAIMMSGIATICFLLIVQGKVPSYLGTSASFVGAAAAIYAYQGGDGPGGPADVTGAILVAGIVLAIVGVIVHYLGADSVNAVLPPVVTGAVVMLIGFNLAPVATLTYMPSDPWVALITMTAVILMAVGLRGFFGRIAVFLGLIFGYLLSVVWDWIFGQSTLPLPGNPEPGPHDRVNWDAVKNADWFGFPVHTKDGLVGNQAFTDGYANVGWHMPSFSIAFILLALPAVIALVAENIGHVKAVAEMTKTDLDPVMGRAIAADGVGTVIASTVGGSPTTTYAENIGVMAATRVYSTAAYFVAAIVAILLGLVPKFGQIVNATPPAVLGGITLVLYGMIGLLGAKIWKENGVDFAKPINLVPVAAGIILAIGNADLKITDDFHLTGIALGTLVVVLGYHLARVVAPKDLDDGTMIAVGHEGVHAEDHAAPHDHHH

SEQ ID NO: 38316 - protein, 450 aa, Staphylococcus aureus subsp. aureus Mu50
MNNKRHSTNEQLSLDEINNTIKFDHRSSNKQKFLSFLGPGLLVAVGYMDPGNWITSMQGGAQYGYTLLFVILISSLSAMLLQSMTVRLGIATGMDLAQMTRHYLSRPIAIIFWIIAELAIIATDIAEVIGSAIALNLLFNIPLIVGALITVLDVFLLLFIMKYGFRKIEAIVGTFIFTVLFIFIFEVYISSPQLNAVLNGFIPHSEIITNNGILYIALGIIGATIMPHNLYLHSSIVQSRTYSRHNNEEKAQAIKFATIDSNIQLSIAFVVNCLLLVLGASLFFNSNADDLGGFYDLYHALKTEPVLGATMGAIMSTLFAVALLASGQNSTITGTLAGQIVMEGFLRLHIPNWLRRLITRSLAVIPVIVCLIIFKGNAAKIEQLLVFSQVFLSIALPFCLIPLQLATSNKDLMGPFYNKTWVNIISWTLIIILSILNVYLIVQTFQELQS

SEQ ID NO: 38317 - protein, 181 aa, Zea mays
SEILSLVSGAVSGSRDMDNNNNKNNEENGNTSKTASDDEGVGSVGRQMSESSLCVTEEEEEDDSKLHLGPQYTIKEHLEKDKDDESLRKWKEQLLGSVDVTNIGETLDPEVRIISLVILSPGRPDIVLMVPENGNPKGMWFTLKEGSRYCLKFTFQGNNNIVSGLRYTNTVWKTACKGKRE

SEQ ID NO: 38318 - protein, 705 aa, Oryza sativa
MRRPSPSPPAARGPALAAAAAVVVLLPSIFPAIFTPLGRAFPSLFSEWNAPKPMHESLLNEALRRTISNEQKRELWSPLPYQGWKPCLKSSSVHGVPLEPTGYIQVFLDGGLNQQRMGICDAVAVAKILNASLVIPHLEVNPVWKDTSSFEEIFDVDHFINTLKAEVSIVKVLPKKFSWSTREYYGTGIRATRIKTAPVHASASWYLENVSPILQSYGIAAIAPFSHRLAFDDLPVDIQHLRCKVNFQALVFLPHIISLGETLVKRLRSPVQGQSGELIQEVGEDTNQAGKYAVLHLRFDKDMAAHSACDFGGGRAERLALAKYRQVIWQGRVLNSQLTDEELRNLGRCPLTPEEIGLLLAALGFDSRTRIYLASHKDKRSLASEEELTNVEGKASVLAALDYYISMHSDIFISASPGNMHNALMAHRTFENMKTIRPNMALLGRIFVNKSMEWLEFQEAVQAGHKGRYGQIRLRKPKQSIYTYPAPDFRGKNHTSPVYRKLTSKQIVEHHRRFNEFVRDQQQFTRVFYEKTKPKSPMAEAAAKEVAGAAAAAGDMILLISSDGQRFEVAQAVASMSRLVRNMVEDECTDNGVPLPNVPSAVLAKVLEYCSEHAAAAAAAGEEVEELKSFDAAFIEVDNATLFDLILAANYLNVPCLLALACQRAADLIRGKTVEEIRAEFNIANDFTPEEEAEIRKENAWAFQD

SEQ ID NO: 38319 - protein, 85 aa, Leptolyngbya boryana
ADAAAGGKVFNANCAACHASGGGQINGAKTLKKNALTANGKDTVEAIVAQVTNGKGAMPAFKGRLSDDQIQSVALYVLDKAEKGW

SEQ ID NO: 38320 - protein, 421 aa, Arabidopsis thaliana
MLPVRESLQKQVKILIGLGNLGFGGYRGLYTRFTNPNGFLEPASSDLLLINERRNLSVIGAVSRTFSVPSVSGPAFQVCGYHIDLLLSDPCKSMASLGSKSLFVDRHSASLVSKRFTGGMVSGDGPNRGRISMRLRAGNAPDVSLDNSVTDEQVRDSSDSVAAKLCTKPLKLVSGSCYLPHPDKEATGGEDAHFICAEEQALGVADGVGGWAELGIDAGYYSRELMSNSVNAIQDEPKGSIDPARVLEKAHTCTKSQGSSTACIIALTNQGLHAINLGDSGFMVVREGHTVFRSPVQQHDFNFTYQLESGRNGDLPSSGQVFTVAVAPGDVIIAGTDGLFDNLYNNEITAIVVHAVRANIDPQVTAQKIAALARQRAQDKNRQTPFSTAAQDAGFRYYGGKLDDITVVVSYVAASKEEGKH

SEQ ID NO: 38321 - protein, 485 aa, Thermoplasma acidophilum DSM 1728
MENGVRYSDLIERLDMSRVTRFYWLLTILATIGGFLFGYDTSNIGSALPLLERIYPGISGFVEGYLVAGASLGAAVGAIIAAGLTDRYGRKYLLIADAAIYAAGALLSAFTVDLVMLLLSRTLIGIAVGADSGIATAYIAEYAPKARRGSLGILQQWMITIGILAAYLIGMATLFFAPGLAYAVGWRIMLGVAAIPAIIGLAFRFMMPESPRWLLVNGKYKEASASLKRLGLNMSEEDLKSVKLSQPHKITPGVKRALLIVGLFFVFQQITGINIPFYYGPVVLENLHIVGKSTSLVYSIYYSIAASAILAIINVAATYIGFRYIDSVGRRKLALMGYAGMTFFGILGGILLYLKLDIGLFIAFAGFIIFFAFGVGGTGWMIQGEYFPTSMRGLYASLGAFIDWIANFAIIELFPVMDSAITIKNVEFVFGVLSLIALILFYYIMPETKGLSVEQIDTLFENNSLGQMKHASISMKKESVPADPK

SEQ ID NO: 38322 - protein, 85 aa, Porphyra tenera
ADLDNGEKVFSANCAACHAGGNNAIMPDKTLKKDVLEANSMNTIDAITYQVQNGKNAMPAFGGRLVDEDIEDAANYVLSQSEKGW

SEQ ID NO: 38323 - protein, 89 aa, Arthrospira maxima
GDVAAGASVFSANCAACHMGGRNVIVANKTLSKSDLAKYLKGFDDDAVAAVAYQVTNGKNAMPGFNGRLSPKQIEDVAAYVVDQAEKGW

SEQ ID NO: 38324 - protein, 87 aa, Synechococcus lividus
ADLANGAKVFSGNCAACHMGGGNVVMANKTLKKEALEQFGMNSEDAIIYQVQHGKNAMPAFAGRLTDEQIQDVAAYVLDQAAKGWAG

SEQ ID NO: 38325 - protein, 465 aa, Comamonas sp. DJ-12
MTSTPINQNTNPTVANVQTVLNENPFSRYQWVIFGLCFLIVLLDGFDTAAIGFIAPSLLGEWGLDKSHLGPVLSAALFGLAFGALGAGPLADRFGRKTVLIIAAVVMGVASIVSGTVHDLNGLTIWRFITGLGLGAAMPNAITLMNEYCPDSKRSFITNCMFCGFPVGSALGGFIAAWMIPHFGWRSLLIVGGVVPLILAAIMIVMLPESVRFMVLKNYSADRVRKIMVRIAASTRNATRFVLDDNAQRAAQVQQGPQGLRLVFSQKYLVGTLALWVTYFMGLVIVYGLVNWMPVLFKDAGVPPSQAAVIAALFQLGGVGAIFFGLLMDRWNANLIIAVGYFLTSIAVAMIGQVLGGGVGMLVASVFIAGLVINAAQSSMQALAAEYYPTECRASGVSWMLGIGRFGGIAGSFLVAELSRRHLELPQVFMVVAIPGVIAALALLIKNRYAGGAPRKSMAGLGGAH

SEQ ID NO: 38326 - protein, 614 aa, Oryza sativa
  misc_feature (117)..(117): Xaa can be any naturally occurring amino acid
  misc_feature (124)..(124): Xaa can be any naturally occurring amino acid
  misc_feature (139)..(139): Xaa can be any naturally occurring amino acid
MASHALRLHPLLFSAAAARPAPLAARPGGGARRVHRRHSLAVVRCSSSAAQALKIKSIPTKPVEGQKTGTSGLRKKVKVFQQENYLANWIQALFNSLPPEDYVGGTLVLGGDGRYFXNKDAAQXIITKIALGEMVLGKXILVGKETVLLSTPAVSAVIRKRQANGGFIMSASHNPGGPDNDWGIKFNYSSGQPAPETITDQIYGNTLSISEIKTADIPDVDLSSLGVVSYGDFTVEVIDPVLDYLELMENVFDFQLIKGLLSRPDFRFVFDAMHAVTGAYADPIFVEKLGADPDYILNGVPLEDFGNGHPDPNLTYAKELVFTMFGSGAPDFGAASDGDGDRNMILGRRFFVTPSDSVAIIAANAQAAIPYFQSGPKGLARSMPTSGALDRVADKLNVPFFEVPTGWKFFGNLMDAGKLSICGEESFGTGSDHIREKDGIWAVLAWLSILAHRNKDKKAGERLVSVEDVAREHWATYGRNFFSRYDYEECESESANKMMEHLRDVIAKSKPGEKYGNYTLQFADDFSYTDPVDGSTVSKQGLRFVFTDGSRIIFRLSGTGSAGATIRIYIEQFESDASKHDLDAQIALKPLIDLALSVSKLKDFTGRDKPTVIT

SEQ ID NO: 38327 - protein, 427 aa, Pseudomonas syringae pv. tomato str. DC3000
MSRSETLFANAQKHIPGGVNSPVRAFKSVGGTPLFFKHAAGAYVTDEDDKRYVDYVGSWGPMILGHSHPDVLDAVRNQLEHGLSYGAPTAMETEMADLVCELVPSMEMVRMVSSGTEATMSAIRLARGFTGRDSIIKFEGCYHGHSDSLLVKAGSGALTLGVPSSPGVPAAFAKHTLTVPFNDLNAVRDLLAEVGQEVACIIVEPVAGNMNCVPPAPGYLQGLRALCDEHGVVLIFDEVMTGFRVALGGAQAYYDVKPDLSTFGKIIGGGMPVGCFGGKREIMSHIAPLGPVYQAGTLSGNPLAMAAGLTTLRLISRPGFHDELSDYTRRLLEGLQQRADAAGIAFVTTQAGGMFGLYFSDASEIVTFEDVMTSDAERFKRFFHLMLEGGVYLAPSAFEAGFTSIAHGDAELKLTLDAAEKAFAALK

SEQ ID NO: 38328 - protein, 87 aa, Synechococcus sp. PCC 6312
ADIADGAKVFSANCAACHMGGGNVVMANKTLKKEALEQFGMNSADAIMYQVQNGKNAMPAFGGRLSEAQIENVAAYVLDQSSNKWAG

SEQ ID NO: 38329 - protein, 282 aa, Solanum lycopersicum
MTGGKEIIDKIKEKVGLSSSDTGRGKSKMSKNITHGYHMVEGKSHHTMEDYVFAQFKQVDENELGLFAIFDGHLSHEIPEYLRSHLFNNILNEPNFWAEPESAIRKAYRITDTTILDKAADLGKGGSTAVTAILINGQKLVVANVGDSRAVIYKNGVAKQLSIDHEPGREREIIEGKGGFVSNFPGDVPRVDGQLAVARAFGDKSLKMHLSSEPDVVVELIDDDTEFLILASDGVWKVLSNQEAADCIKDIKDARSAAKHLNEHALARGSTDDISCVVVRFQ

SEQ ID NO: 38330 - protein, 571 aa, Striga hermonthica
MCGILAVLGVSENSQAKRSRIIELSRRLRHRGPDWSGLHNHQNCYLAHQRLAIIDPTSGDQPLYNEEKTVFVTVNGEIYNHKELREKLKSHVFRTGSDCEVIAHLYEEYGEEFVNMLDGMFSFVLLDTRDNSFIAARDAIGITPLYIGWGLDGSTWFASEMKALSDDCERFMTFLPGHIYSSKSGGLRRWYNPPWYAEQIPSAPYEPLVLRAAFEKAVIKRLMADVPFGVLLSGGLDSSLVASVASRYLADSPAAQWGTQLHTFCIGLKGSPDLRAAREVADYLGTRHHEFHFTVQEGIDALEEVIYHIETYDVTTIRASTPMFLMSRKIKSLGVKMVLSGEGSDEIFGGYLYFHKAPNKEEFHEETCRKIKALHLYDCLRANKATSAWGLEARVPFLDKEFIDVAMGIDPEWKMIRPDLGRIEKWILRNAFDDEEKPYLPKHILYRQKEQFSDGVGYSWIDGLKDHANQQVTDAMLANANFVYPENTPTTKEAYYYRTVFERFFPKNAARSTVPGGPSVACSTAKAVEWDASWSKNLDPSGRAALGVHVAAYDEAKMAGEGPTANGSPKE

SEQ ID NO: 38331 - protein, 406 aa, Arabidopsis thaliana
MKNGMAECSVCRSRLVSPSSKAISRAYDNYNYKIRVSSKQRALNVFLVVGDCMLVGLQPVLVYMSKVDGKFNFSPISVNFLTEIAKVIFAMVMLLFQARHQKVGEKPLLSLSTFVQAARNNMLLAVPAGLYAINNYLKFTMQLYFNPATVKMLSNLKVLVIAVLLKMIMKRRFSIIQWEALALLLIGISINQLRSLPEGATTVAVPIATGAYICTFIFVTVPSLASVYNEYALKSQYDTSIYLQNLFLYGYGAIFNFLGILGTVIYKGPGSFDILQGHSRATMFLILNNAAQGILSSFFFKYADTILKKYSSTVATIFTGIASAALFGHILTMNFLLGISIVFISMHQFFSPLSKAKDEQQNGNIELVDAKDGHRAKDSFINMAAGATEEASHRIESDDRVPLLPR

SEQ ID NO: 38332 - protein, 837 aa, Janthinobacterium lividum
MKFGFIAHPTSVGLKRYVKMLDLLQRQSKDLQSGYQRDLWRRENMVPFVDFGQIRSAAGATCEGIVHYLPLTADEMLASAREVQERIFEGIDTLGKQGAQLVGLGGFTSIIGKRGLVTAERASLPVTSGNSLTTYAGYKALLQVFDWLQLHPQEARVAIVGYPGSICLSLAKLLLAQGCRLDLLYRSGSASPDELLEHLPAKWHAQVTLRDSIDDCYVNNRIFASATSSGDVIDEARLLPGSIVVDIALPRDAVRSTPPRTDTLVIDGGCMTASPQVKLGGESLNMAIKQQINGCLTETMVLALEGRAECFSIGRTLEPEKVLEIGALAERHGFYAFPLASWGERINEKIISGLRRYHRRQESAPAQADGGEQRRTQTLQRYRSHINPMMADFLGMQRCDHVFDRAEQCTLTDTEGRQFLDMVSGYGCLNLGHNPSIVTDAIRKFLTDSTPNFVQYVSLPQETAKLAERLCAIAPGEFERVFFSNSGTEAVEAALKLARAATGRTRFVYAENSYHGKTLGALSVTGREKHKKHFRPLVPGCVGVAFGDLEALRSELISEEVAAYIVEPIQGEGGVKMPPAGYLAAAQEICRQTGTLLIVDEIQTGLGRTGRMFASEWEGLEPDIMVLAKSLSGGLIPIGATLSTAQVWDAAYGTMGRFLLHTSTFGGCNIAAVAGLAALDGLHQQGLAERADELGTYFKAELEKATEHYPFIAEVRGRGLMLGIQLDNDFAGAVEACAREFGTRLPGDWHLTYRFFPDEVKQHLADAMSKMEESLAEMFCMRFVTKLSNDHGILTFVTANSSTVIRIQPPLVISREEIDHFVRSFATVCEEMSTFLN

SEQ ID NO: 38333 - protein, 486 aa, Burkholderia pseudomallei K96243
MYLEHALKDPSLLRHQAYIGGEWQAADSDATFEVFDPATGESLGTVPKMGAAETARAIEAAQAAWAGWRMKTAKERAAILRRWFDLVIANSDDLALILTTEQGKPLAEAKGEIAYAASFIEWFAEEGKRVAGDTLPTPDANKRIVVVKEPIGVCAAITPWNFPAAMIARKVGPALAAGCPIVVKPAESTPFSALAMAFLAERAGVPKGVLSVVIGDPKAIGTEITSNPIVRKLSFTGSTAVGRLLMAQSAPTVKKLTLELGGNAPFIVFDDADLDAAVEGAIASKYRNNGQTCVCTNRFFVHERVYDAFADKLAAAVSKLKVGRGTESGATLGPLINEAAVKKVESHIADALAKGASLMTGGKRHALGHGFFEPTVLTGVKPDMDVAKEETFGPLAPLFRFASEEELVRLANDTEFGLAAYLYSRDIGRVWRVAEALEYGMVGINTGLISNEVAPFGGVKQSGLGREGSHYGIDDYVVIKYLCVAV

SEQ ID NO: 38334 - protein, 182 aa, Candida albicans SC5314
MPAYHSTFLAEEQNQSINSGIRTIGNLSLLPFHTNFRGPIYSENNSDYDIIEEVLDLFRANSFFKNFEIKGNSDRLLIYGILFINQCLTKLTKFTNSKEATKILINLSVDNFHLPGDIGFPLNSLYVSPANKSEYELLKNYLTQFRQELSDRLIKRIYHDDPNIPSKHWLAFTKRKFMNKSL

SEQ ID NO: 38335 - protein, 410 aa, Cytophaga hutchinsonii ATCC 33406
MNTTVSLSQQAIELEDKYGAHNYHPLPVVLAKGEGVHVWDVEGKHYYDFLSAYSAVNQGHCHPRIINALIEQAQTLTLTSRAFYNDKLGEAEKFICDLFGYDKALLMNSGAEANESAIKLARKWGYQVKGIPTDQAVIVAVERNFHGRTTGIISASTDPDSRNNFGPFMPGYQIIPYNDVIALEEALKNPNVCGFWVEPIQGEAGVFVPGDGYLKKAQELCTKYNVILMMDEIQTGCGRTGKLIASNHEGVHPDMLILGKALSGGTYPVSCVLTSDEIMLTIKPGEHGSTFGGNPLACAVLVESLAVLMDEGLIDNAASMGELFRDRMNALKDKCEHVTLVRGKGLLNAIIIKPTADGRTAWDVCMKLMENGLLAKPTHGDIIRFAPPLIITEEQINACCDIIEKTLLEF

SEQ ID NO: 38336 - protein, 335 aa, Carboxydothermus hydrogenoformans Z-2901
MPVKVGINGFGRIGRNMFRAALNNPEIEIVAVNDLTDAKTLAHLLKYDSVHGIFAADVEAKDDAIVVNGKEVKVYAEKDPANLPWKELGVEIVIESTGKFTKKADAVKHLEAGAKKVIISAPATDEDITIVMGVNEDKYDPANHHVISNASCTTNCLAPVAKVLHEKFGIVKGLMTTVHSYTNDQRILDLPHKDLRRARAAATSIIPTTTGAAKAVALVLPELKGKLNGFAMRVPTPNVSVVDLVVELEKPATKEEINAALKEAAEGELKGILGYTELPLVSVDFNGNPLSSIVDGLSTMVIEDNMAKVIAWYDNEWGYSNRLVDLATYIAKKGL

SEQ ID NO: 38337 - protein, 223 aa, Triticum aestivum
MAALLARQAALALRARQTARLGPSATAMQGHLRTYMDAGAPKRFKEDEEKEQLAKELAKDWSAVFERSINTLFLTEMVRGLMLTLKYFFERKVTINYPFEKGPLSPRFRGEHALRRYDTGEERCIACKLCEAICPAQAITIEAEEREDGSRRTTRYDIDMTKCIYCGFCQEACPVDAIVEGPNFEFSTETHEELLYDKEKLLENGDRWETEIAENLKSEALYR

SEQ ID NO: 38338 - protein, 154 aa, Oryza sativa (japonica cultivar-group)
MAAKAAFPAPAGDEPAIGIPYHPAAAGAQGGYYYAPDPYAAGMPPPNAIYAGAPKGVPLQQTMFRDTPAPFHCQACGAAAVSSLRSKPSLASVVACMMPFMMGVCFLCPSMDCLWHKYHYCPSCGEKVAEFKKSDPCLVVDPTRWSEPSFAVPA

SEQ ID NO: 38339 - protein, 419 aa, Zea mays
  misc_feature (303)..(303): Xaa can be any naturally occurring amino acid
  misc_feature (305)..(305): Xaa can be any naturally occurring amino acid
MPEARRQMQHVIVAVEVTRKEERRKRTRRTAVLVFTYSTGLLDCKWTYMFRSETPPPNVQALSPPPNPPIEGGRIHIPSNGLLSRATAADLPRASVPKRRRTVYLPQQPCLFAGAQPHSPNWRASDLSTRRAVVKPLTKGWMNTPPPLNEASVSLINAQSSGSRALPPHPPLVPQQFDSSISASGAIGNNGMASLPYGSSKVTTRNKQTNFSAYEDNVLCKSWLEISCDPITSTGQRRESFWVRVCSRYNAQRGTYPERSQKSINTRWDYIKAEVNKFSGYMAAKIRSNPSGMSDSDKSIAAXAXFASIEKHNFSLMHCWHILKDEPKWMELKRNMDKPKSSGTKDATPERSNSNTVDLDPNDTSPSSSSRKRPIGRDAAKAAKKKASSVSLSHEYASKMHDLSVQKIELFKETEDERK

SEQ ID NO: 38340 - protein, 107 aa, Hordeum vulgare subsp. vulgare
MAEAAQGGGLRGRGVLLGGVQDAPAGRENDLETIELARFAVAEHNAKANALLEFERLVKVRQQVVAGCMHYFTIEVKEGGAKKLYEAKVWEKAWENFKQLQEFKPAA

SEQ ID NO: 38341 - protein, 662 aa, Spiroplasma citri
MKSTNNNIETKSLSNLRILGLDPIIYNKTGHPGIVLSAAPLMQAIYLDNLIANPAVPDWINRDRFVLSPGHASTLQYAILHLAGYNLTIDDLKNYRHINSKTPAHPEYGVTPGVDNSSGPLGQGVGYGVGMALSEQHLAAKFNKPDYKIIDHYTYVLCSDGDLQEGGAIEAIQLAGVWKLNKLIMLYDSNDCQLDTKCDAVLKIDYQRFFEAQNWNYIRIENADEDLPAIQKAIEQAQKSDKPTLIECKTIIGYGHPKQGSPMHSSPFTSEEMDQVKAFYDFNHPQFYVDNDVKKHWQDTFAKRGAIKYEEWKKKITAYKTEFPKEYEELFAIPSVDLKSFAELLTTDKDKKAGTRIIMGDVFKYYQQKCLNNMFGGSADLGTATKIIGYNGSWTTSTPQNNNVHFGVREFAAGTISIGVELHQGLKGFNSTFLIFADYMKPCVRMACIQNLPVIFSFSHDSIGVGFDGKSHQPVEQLAMLRNCPNLNVFRPADIKEAIGCLKASVEAKSTPSALILSRQDTPYQLSETCWEQTLKGGYIVVAEDETKPLEAIIIATGTEVAPAIIAAKTIKKNIRVVSMPCVELFEQQPRAYQEKIVPKNITKVIAIEFSNDYVWYKFVGKTGLVLGVDDYGLSGSADAVIKYKQLDQSSIINRITAYLEE

SEQ ID NO: 38342 - protein, 451 aa, Solibacter usitatus Ellin6076
MRPRTHMNRYLLKSTIVAALGGLLFGFDTVVISGATSTLSDVYHLTPMLLGFTVASALLGTVLGSMVAAAPSDRYGRRQCLQALAVLYVVTAIGCAAAWNWPAFVVFRFIGGLAIGGSSVIGPMYIAEIAPAAKRGRLVGLFQFNIVAGILIAYLSNYFVGTLALGPEEWRWKLGLAALPAVLFFVTLFGIPQSPRWLIRRGFIAEAREIFRRIGEPDPDREVADVVRSVESEDRTKVEPLFQHKYRRPIFLAIAIGFFNQLSGINAILYYLNDIFKSAGFDKVSSDLQAVAIGGTNLLFTMIAMSLIDRLGRKKLLLTGAAGTAVCLAGVAVIFSTGQGEHLLVWLLIGFIGFFAFSQGAVIWVYLSEVFPNLVRAKGQSLGSFTHWIMNAIIAFTFPLVAALSRPAPFVFFAAMTVVQFVVVLFLFPETAGITLEDMEKQLERKASSGV

SEQ ID NO: 38343 - protein, 339 aa, Prochlorococcus marinus subsp. marinus str. CCMP1375
MSDNFSNKSNLNKNISPWLDPKHSDILFPFANLQSLLNDLGWESDEWINYWLAKDGYNLAASFWAKGTKLDWLWGLGLPFLTDIKRFAKINNARKVYGISALPGCGKTSFGKWIEAAAKELDISIKVLSLDDFYLPGSELEKAMKDNPWNVPRGLPGSHSINLLENVIDKWISTGSLKAPQFDKSLRKGLGDRSGWTNSSPDVLVLEGWFLGCTPLKSSLNFNGKDDVLSPKLTIFESDYRLKVQELIKDYLPIWQRINRIWHLKANDFSSTCKWKVDQEKEMLVSKGSALQGELLSSFVRMIEASIPQESLMNIDCNVVVEINNLREILNILPSRRQF

SEQ ID NO: 38344 - protein, 861 aa, Triticum aestivum
MILGGLIDSLTGANKNARLKGTAVLMRKNVLDLTDFGATIMDGIGDFLGKGVTCQLISSTLIDHDNGGRGKVGAEAELEQWVTSLPSLTTGESKFGLTFDWEVEKLGVPGAIIVNNYHSSEFLLKTVTLHDVPGRGNLSFVANSWIYPAATYTYSRVFFANDTYLPSQMPAALKPYRDDELRNLRGDDRQGPYQEHDRVYRYDVYNDLGEGRPVLGGSAEHPYPRRGRTGRKPNASDPSLESRLSLLEQIYVPRDEKFGHLKTSDFLGYSIKAITQGILPAVRTYVDTTPGEFDSFQDIMNLYEGGIKLPMVPALEELRKQFPLQLIKDLLPVGGDSLLKLPVPHIIQADQQAWRTDEEFAREVLAGVNPVMITRLTEFPPKSSLDPSKFGDHTSTITAAHIQKNLEGLTVQQALESNRLYILDHHDRFMPFLIEVNNLPGNFIYATRTLFFLRGDGRLTPLAIELSEPVILGGLTTAKSKVYTPVPSGSVEGWVWEFAKAYVAVNDSGWHQLVSHWLNTHAVMEPFVISTNRHLSVTHPVHKLLSPHYRDTMTINALARQTLINAGGIFEMTVFPGKFALGMSSVVYKDWKFTEQGLPDDLIKRGMAVQDPRGPYKVRLLVSDYPYAADGLAIWHAIEQYVSEYLAIYYPNDGVVQGDVELQAWWKEVREVGHGDLKVAPWWPRMQAVGELAKACTTIIWIGSALHAAVNFGQYPYAGFLPNRPTVSRRRMPEPGTEQYAELERDPERAFIHTITSQIQTIIGISLLEVLSKHSSDELYLGQRDTPEWTSDPKALEVFKRFSERLVEIESKVVGMNHDPQLLNRNGPAKFPYMLLYPNTSDHKGAAAGLTAKGIPNSISI

SEQ ID NO: 38345 - protein, 496 aa, Glycine max
  misc_feature (159)..(159): Xaa can be any naturally occurring amino acid
MGCVLGTPAGAGHQRRRRRRSEKPDGAADEANNAVRVREKERNRHTGDFPGTLPAAERRKPRLDPCAVTQQGWPSWLMAVAGEAIGDWTPRRANTFEKLAKIGQGTYSNVYKARDLVTGKIVALKKVRFDNLEPESVKFMAREILVLRRLDHPNVVKLXGLVTSRISSSLYLVFEYMEHDLAGLSAAVGVKFSEPQYVKCYMKQLLSGLEHCHSRGVLHRDIKGSNLLIDNEGILKIADFGLATFFDPKKKHPMTSRVVTLWYRPPELLLGSTSYGVGVDLWSAGCILAELLAGKPTMPGRTEVEQLHKIFKLCGSPSDEYWKKYRLPNATLYKPQQPYKRNILETFKDFPPSSLPLIETLLAIDPEDRGTASATLNSEFFTTEPYACEPSSLPKYPPSKELDVKLRDEEARRQKALNGKASAVDGAKKVRVRERERGRAVPAPEANAEIQTNLDVSHTRSCLCLSSFLPPLVFLFVLISYSFKSQVRAYVIDFHE

SEQ ID NO: 38346 - protein, 477 aa, Oryza sativa (japonica cultivar-group)
MDTGMRVALHRQVSSGSLKESGELRRQSSLESPRTGRAATRFLFGRQSSMDPNRRRGRSQSPVGLAEDLTVPDNLDATMQLLFLACHGDAAGVEALLRGGVDVNSINLDGRTALHIASCEGHPDVVRVLLTWKANIDARDRWGSTAVADAKCYGHTEVYNLLKARGAKIPRNRRTPMMVSNPGDVPEYELNPSELQFKKGDEVVKGVYQVAKWNGTKVHVKILDRECYCDQEVINSFRHELTVLEKVRHPNVVQFVGAVTQNIPMMIISEYLPNGDLSSCIPRKGKLHGQKVLKYGLEIARGMTYLHQCKPDPIIHCDLKPKNIFLDSGGQLKIAGFGLTRLSKISPGRVKLADHESMVDSFSHYTAPELYRNEIFDASVDAFSFGFILYEMVEGTHTVHGKSSEESGHTIRYDGMRPSLKNKLRGYPPDFKALIEECWDTQGIARPTFSEIIIRLDKIYAQCMKQGTWKDSLKIWK

SEQ ID NO: 38347 - protein, 323 aa, Bifidobacterium longum NCC2705
MAPSKLDWFGWANPIRSIMKRDTKQRRNEGKLMTQNRAELNRNLAQMLKGGVIMDVTTPEQAKIAQDAGACAVMALERIPADIRAAGGVSRMSDPAMIKGIQEAVSIPVMAKVRIGHIAEARILQAIEIDYIDESEVLSPADDVYHIDKNQFDVPFVCGAKNLGEALRRIAEGAAMIRTKGEPGTGDVIQAVRHMRTMNKQIRELVGLRDDEVYEAAKQLAVPYDLAKYVHDNGRLPVVNFAAGGVATPADAALMMELGAEGVFVGSGIFKSGDPAKRAAAIVKATANWQDADLLAKLSENLGEAMVGINEDEIQTIMAARGE

SEQ ID NO: 38348 - protein, 307 aa, Triticum aestivum
MAAATATATAAEEEARLLRLEEQAEHGGGGAWEYLSLARRLRARRPAPVLRLGLSLLNDASARSRLASEQWTLYEQVAVAAMDCQRLDVAKDCIGILSKQFPGSARVGRLEALLFEAKGDWAEAERAYALILETNPFDQIVHKRKIAIAKAQGDMSLAVDYLNKYLELFMADHDAWRELAEIYVSLQMYKQAAFCYEELILAQPTIPLYHLAYAEVLYTLGGLENLQTAKKYYASTIQLTGGKNTRALFGVCLCSAAISQLTKGRNKEEESSELQSLAAEALMKDYKRRAPSMEALVAGMLKNMKLS

SEQ ID NO: 38349 - protein, 600 aa, Ustilago maydis 521
MADPAGQGVDVSDAANGPTRKRKPDQLANLDRYNFLRPSRGGNDDDDAAEEEDELLPLDHSELSSASYLARLTGVACLGGLQFGWDTGIASGMLVAIHSDLGHELNEGEQELIVSATTVGAILGSIVAGRMADWLGRKKVMIGSGVLFLLGALEQAASQVVRELVLGRVLVGLGVGMASMVVPTYLAEVAPTKVRGRIVGINSLLVTGGQVIAYLIDAAFYNLPHGWRWMVLAGGVPAVLQLVGMIYLDESPRWLVARGRIIRARRVLQRIYPHASVHTIDNEIDRISRSMQGATQHDSVDPDACHTAVQQAEEVQHDLSATLGRVTAAPAQLTSTARQTTTRVKSKLDMLLQDRTHRRALLIACVLQFFQQATGANSLLYYSSRLLMMAGFVVNPNAAAIGIAIANFGGTVIAVRYIDSWGRRKLLLYTTAAMTLCLALVAIGFSQIDLGPVTGTSEQGEPVSTSWPYWTLVFMIMFTLSYALGLGIVPWLVQSEIFSGQVRGVGAGLATATNWSTNLLISSTFLHLVKLIHPQGCFALFSAVSALSCAFTYWLLPETAGVSLNDVSGALPSTDRPGTHAHAAQAYQAIPSTEDADALE

SEQ ID NO: 38350 - protein, 478 aa, Bifidobacterium longum NCC2705
MDQLVAESTPLKRTMRTFDLTMLGIGAIIGTGIFVLTGKGALTAGPALSVSFLLAAVCCGFAGLCYAEFAAMAPVSGSAYSYAYLAFGELIAFVIGWDLILEYALQAATVSAGWSGYFNKLLEGFGLHLPVELTAAYGTNPDVTTYFNLPGFVIVLIITWVLSIGINQTKRTNDVMVLIKLAIIVLFIACAVWYVKPSNWQPFSPYGVYTFQPGSTQPYGIVPAASIVFFSFIGFDAVSSSAEETINPNKTLPRGILLSLAVSTVLYIVMTMIMTGVVPYQDFAKYIDAPVAGVILETGMNWLAVIVNLGALIGMTTVMLVQLYGQSRICYAMSRDGLFPKFFGHVHEKYRTPFKGTWFFGLLTAFAGGFININVLFELVNIGTLSAFIIVSAGILWMRKTQPNAPRGFRAPGVPVTPILAIVFCFVLIAGLNWETWVRFAIWFGLGLIVYFGYSRKRSKLGLEQKAGADTKVAATED

SEQ ID NO: 38351 - protein, 293 aa, Elaeis oleifera
MAEEDGRSESSNYTSEDEGTEDYRRGGYHAVRVGDSFKQGAYVVQSKLGWGHFSTVWLAWDTVHSRYVALKVQKSAQHYTEAAMDEIKILKQIAEGDPDDKRCVVKLLDHFKAFGTLWAPCVHGVLSFSGITSHLIKYTLLPGCSLSMVKEICHHVLGVLTTFTVICKLSTLTNAWRTFSWYPTLTLAKDPLRSGFLPLSLAIQVLRTGYPSLLPSWGTLTSELIKNKSSRKSKSEALCCHNGGILGASNFLGNAYGPRIKLALVKWVWELLNTMGHLCHRGDPEQGKAWLNP

SEQ ID NO: 38352 - protein, 231 aa, Oryza sativa (japonica cultivar-group)
MACRPAVCSPSALAPPRHRLLSLGCARTAAPSGGLPLRLRLRSSPAPRGHGADLVGAVELQAKVNSKCFFDVEVGGEPAGRIVIGLFGEVVPKTVDNFRALCTGDKGYGYKGCSFHRIIKDFMIQGGDFQNNNGTGGRSIYGECFDDENFTLKHTGPGVLSMANAGPDTNGSQFFICTVKTPWLDNRHVVFGHVLEGMDVVKNLESQETSRSDIPKQPCRIVNCGELPVDG

SEQ ID NO: 38353 - protein, 236 aa, Thermosynechococcus elongatus BP-1
MSDDAVKQMKQVVAKAAADRVQSGMVVGLGTGSTTAFVIQFLGDRLRKGELSNIVGVPTSFQASVLAKKYGIPLVTLDDVEKLDIAIDGADEVDPAKNLIKGGGAAHTREKIVDSLAEQFLVVVDSSKLVQKLGSTFPVPVEVLPFAVAPVTRALKALGGEPELRMGVKKDGPVVTDQGNFVLDVRFDDIPDPAELEKAINNIPGVVENGLFVNVADVILVGEIVDGQPQVREIFH

SEQ ID NO: 38354 - protein, 224 aa, Brassica napus
QASQGDLCAGLYSWVRNLLPLVANNKDYSSSQSTHLILQFVEMILSSNPEARAVLLNGAVRHGEWLIPPCPFEMLVRLTFPARVEEATTERFQAIYPLLKEVALAPDTSADALKQIFTFSLKLAGQKGNPALANEATAIAISVLTRNVDCFKQWDVLYKENLEASVALLNKLVDEWEHHSLKLLSSSSSVKHAMNSFRMKTGTSITEGVDSFLYEEAHRSCKLI

SEQ ID NO: 38355 - protein, 365 aa, Aspergillus fumigatus
MAEFVRAQIFGTTFEITSRYNLQPVGMGAFGLVCSARDQLTGQPVAVKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILINENCDLKICDFGLARIQDPQMTGYVSTRYYRAPEIMLTWQKYDVEVDIWSAGCIFAEMLEGKPLFPGKDHVNQFSIITELLGTPPDDVIQTICSENTLRFVKSLPKRERQPLANKFKNADPEAVDLLERMLVFDPKKRIRAGEALAHEYLSPYHDPTDEPEAEEKFDWSFNDADLPVDTWKIMMYSEILDFHNIDQGNDAGQVLMEGGVAQAQQNYA

SEQ ID NO: 38356 - protein, 338 aa, Yarrowia lipolytica
MEANPEVQTDIITLTRFILQEQNKVGASSAIPTGDFTLLLNSLQFAFKFIAHNIRRSTLVNLIGLSGTANSTGDDQKKLDVIGDEIFINAMKASGKVKLVVSEEQEDLIVFEGDGRYAVVCDPIDGSSNLDAGVSVGTIFGVYKLPEGSSGSIKDVLRPGKEMVAAGYTMYGASANLVLSTGNGCNGFTLDDPLGEFILTHPDLKLPDLRSIYSVNEGNSSLWSDNVKNYFKALKFPEDGSKPYSARYIGSMVADVHRTILYGGMFAYPADSKSKKGKLRLLYEGFPMAYIIEQAGGLAINDNGERILDLVPTEIHERSGVWLGSKGEIEKAKKYPLK

SEQ ID NO: 38357 - protein, 245 aa, Oryza sativa (japonica cultivar-group)
MAGRSELVVSFGEMLIDFVTLRADGEREFMFYRNPSADMLLTHAELNVELIKRAAVFHYGSISLIAEPCRSAHLRAMEIAKEAGALLSYDPNLREALWPSREEARTKILSIWDQADIVKVSEVELEFLTGIDSVEDDVVMKLWRPTMKLLLVTLGDQGCKYYARDFRGAVPSYKVQQVDTTGAGDAFVGALLRRIVQDPSSLQDQKKLEEAIKFANACGAITATKKGAIPSLPTEVEVLKLMESA

SEQ ID NO: 38358 - protein, 660 aa, Bacillus cereus ATCC 10987
MTKENKSFYITTPIYYPSGKLHIGHAYTTVAGDAMARYKRMQGYNVHYLTGTDEHGQKIQKKAEELNVTPQAYVDNIVAGIKELWEKMDISYDDFIRTTEDRHKDVVEKIFKQLVDQGDIYLDEYEGWYSVQDETFYTEHQLVDPIMEGDKVVGGKSPDSGHDVELVREESYFFRMGKYVDRLLKFYEENPHFIQPESRKNEMINNFIKPGLEDLAVSRTSFDWGVRVPGNPKHVIYVWVDALSNYITALGYGTENEEMYKKFWPADVHLVGKEIVRFHTIYWPIILMALDLPLPKKVFAHGWILMKDGKMSKSKGNVVDPVTLIDRYGLDALRYYLLREVPFGSDGVFTPEGFVERINFDLANDLGNLLNRTVAMIDKYFNGEIPAFKANVTEFDGTLVTFAQDTLKKVEEAMENMEFSVALSSIWQLISRTNKYIDETQPWVLAKDENDREKLASVMAHLAEVLRQTGIMLMPFLTVAPSKMFAQLGLTEEAHTSWESLSTIGCIPAGTKVEKGNPIFPRLEMEVEVAYIKEQMKASAPKVEEKKEEEPKAEEITIDDFFKVELRVAEVLSAEPVKKADKLLKIQLDLGTEKRQVVSGIAKFYSPEDLKGKKVICVTNLKPVKLRGELSQGMILAGEENGVLSLASIDQNLPNGTKIK

SEQ ID NO: 38359 - protein, 556 aa, Psychrobacter arcticus 273-4
MSNIYHSAPSAYDFPLLVKQLLNRAKTVSQDQEIVYADKKRFTYKDLFNRINRLANVLDGLNLVAGDVVAVMDWDSHRYLESYFSVPMSEYILQTVNIRLSPEKILYTINHAKPKVLLLNSEFAPLVKDYQFENSSIEHIIWLDDNGVTSDGVFGGNQNRVKGEYEALLAAADDHFDFPDFDENTIATTFYTSGTTGDPKGVFFSHRQLVLHTLTEAASIGMLPNKQGVSYGDVYMPMTPMFHVHAWGFPFTATMTGLKQVYPGRYAPNLLMDLIINEKVSITHCVPTILQMVLKEAQDRDASFNGLKMIIGGSRLTEGLAKAAMDQGIEVYTGYGMSETAPLISLTDFSLNEPLLSEEEDIARRCMTGKPVLMVDAQVWGESNQPVGTGQENTGELVLRAPWLTQSYLKNDDAGKELWENGYMHTQDIAYIRPDGYIKITDRLKDVIKSGGEWISSLEIETILSLHPAVADVSVIGVRDKQWGERPLALVVLKSNCQDTKVDDIKALAEQAVARGIIPKYGVPSQFKFVDELPKTSVGKHDKKVMREMYANQSEV

SEQ ID NO: 38360 - protein, 186 aa, Xanthomonas campestris pv. campestris str. ATCC 33913
MNDCSRCAGSTSSGPAHWSGRIRDIADFPKPGIVFKDITPLLSDGPDFASALDEMAQPWRTTPLDAVLGIEARGFILGAALARELRTGFVPVRKPGKLPGRTLIQEYALEYGTDRIEMHEDALPRGARVLIVDDVLATGGTLRAALGLAAQLELEIVGAAVLVELLALQGRSKWLNDVPLLATLSY

SEQ ID NO: 38361 - protein, 77 aa, Brassica napus
  misc_feature (7)..(7): Xaa can be any naturally occurring amino acid
  misc_feature (45)..(45): Xaa can be any naturally occurring amino acid
  misc_feature (53)..(53): Xaa can be any naturally occurring amino acid
  misc_feature (59)..(61): Xaa can be any naturally occurring amino acid
EKEEVVXAYSMLSSAAVVTSPAQATMGAPFTGLKSSSAFPVTRKXNNDITSIXSNGGRXXXVPSIFASINLPSLPLP

SEQ ID NO: 38362 - protein, 291 aa, Xanthomonas campestris pv. campestris str. ATCC 33913
MPSRASRWFRPALVLLGSLTLSACSSVFFGGINAATSREGVIEHRNELFDPALGLALDVYQPRNALNAPVVVFFYGGTWKRGTRQNYSWVGRSLARQGVVALVADYRKYPQVGLDGFMTDAAKATAWGYQHAQAYGGDPTRVAVMGHSAGAHIAGLLVTDRSWLQAQGLRPQQLCGFVGLAGPYDFSPMTDPELIEVFGTSPEQQAASQPVVHADGDEPPMLLLHGQDDRVVEPRNSTSLAAAERRVGVQANTTFYPGMGHMGLVLSLRKNPADSPALRDTLQFLRDCKAP

SEQ ID NO: 38363 - protein, 393 aa, Angiopteris evecta
MTMLATKKDPMIVSMGPQHPSMHGVLRLIVTSDGENVIDCEPILGYLHRGMEKIAENRTIIQYLPYVTRWDYLATMFTEAITVNAPEKLANIQIPKRASYIRIIMLELSRIASHLLWLGPFMADVGAQTPFFYIFREREMIYDLFEAATGMRMMHNYFRIGGVAVDFPYGWVDKCLDFCDYFLPKVDEYEQLITNNPIFLKRVEGVGFIGREEAINWGLSGPMLRASGVRWDLRKVDHYECYDELDWQIQWQKEGDSLARYLVRIGEMRESVRIIQQALKVIPGGPYENLEARRLNQQKDSEWNDFDYQFISKKSSPTFKLPKQEHYVRIEAPKGELGIFLIGDDNVSPWRWKIRPPGFINLQILPQLVKGMKLADIMTILGSIDIIMGEVDR

SEQ ID NO: 38364 - protein, 241 aa, Triticum aestivum
  misc_feature (208)..(208): Xaa can be any naturally occurring amino acid
LYRRVLPSPPAVEFASAEGKRLFAEALQGGTMEGFFNLISYFQTQSEPAFCGLASLSVVLNALAIDPGRPWKGPWRWFDESMLDCCEPLHKVKAEGITFGKVVCLAHCAGARVQSFRADQTTIHDFRAHLTRCASSQDCHLISSYHRSPFKQTGTGHFSPIGGYHAEKDMALILDVARFKYPPHWVPLTLLWDAMNTTDEATGLLRGXCGHGSWKSMAKYCVEDVPNLLKDENLDNVTTLL

SEQ ID NO: 38365 - protein, 359 aa, Arabidopsis thaliana
  misc_feature (152)..(152): Xaa can be any naturally occurring amino acid
MAAALVRRFCRGSSFPVSGHGYRMLSTVENVSESGKSMNLYSAINQALHIALETDPRSYVFGEDVGFGGVFRCTTGLAERFGKSRVFNTPLCEQGIVGFGIGLAAMGNRVIAEIQFADYIFPAFDQIVNEAAKFRYRSGNQFNCGGLTIRAXPYGAVGHGGHYHSQSPEAFFCHVPGIKVVIPRSPREAKGLLLSSIRDPNPVVFFEPKWLYRQAVEDVPEDDYMIPLSEAEVMREGSDITLVGWGAQLTIMEQACLDAENEGISCELIDLKTLIPWDKEIVETSVRKTGRLLISHEAPVTGGFGAEIAATIVERCFLRLEAPVSRVCGLDTPFPLVFEPFYMPTKNKILDAIRSTVNY

SEQ ID NO: 38366 - protein, 1353 aa, Thermosynechococcus elongatus BP-1
MPAAPLPANEPERQRALEQYQVLDTPPEPIFDEITNLAAAICETPIALISLVDRQRQWFKSKVGIDACETPRNVAFCAHVILQDQLVIVPDARLDPRFADNPFVTGPPYIRFYAGMPLVTPQGYGIGTLCVVDYQPRQLNPVQQQTLRTLARQVINELEIRHHLEVTQQQLAYIQQMSSLQEAVFNSSNHAIIATRTDGIITLMNRAAQQWLGYPASELVGKATPERFHDPQEMERYAQILSAQLGEPIPAGFETLVARARRGLADEQEWTFVRRDGSCFPVSLSVTPMHDRQGQLIGFLESAVDITDKKQIEAALRLRERAIIASTNGIVITDYRQPDNPVIYVNPAFERMTGYRATEVIGKNCRFLQGSDRHQPGATAIRNAIKKGQSCRVVLRNYRKNGQLFWNELAISPIYNEFGEITHYIGIQSDVTERQRAQLFLQQQVKRTLLLNRITEEIRQQIEREHICRTAVQQVGVTLNVSRCLLFVYQENAPTPMELVAEYCGPGVPSVNECDLDLTQMRAPFLASVFASDEVFSCDDVQNDDRLAPLHAYCEALRVKSALIVRTAYRNQANGLLILHQCDRQRRWTDAIQSLLKSVAAQVGIGLAQVQLLEQETRQRQQLQQQMQRALLLNQITEQIRQSLDTETVFATTVTQIGQAFGVNRCLIHRYDPGPPPHIPDVAEYLQPGYASMRGISIPVENNPHALAVLSGDTAVVSNDVTQDPLLANAMHLCHQFQIQSMLAIRTSYKGVPNGIIGLHQCDRQRQWTPEEIELLEAVAAQVGIAIAQAELLRHEQQQRQLLAQQNQELEQARLQAELANRAKSEFLATMSHEIRTPMNAVLGFTNLLLDTPLNEQQRDFLQTLHQAGEALLTIINDILDFSKIESGKLVLEQQPFDVRECVEDVLSLLASKAQEKELELLYTCTPETPAQIKGDVTRLRQILVNLVGNGIKFTHEGQVAVHVGVLKREGKDFLQFQVQDTGIGIPRDRLDRLFKPFSQVDASTTREYGGTGLGLVISKRLCELMGGDMSVESTEGQGTTFTFTILAEGQKPYVPPKVHPALEGKRVLVIDDNAASRENLCTLLHNWGMVPIGYSDPRLVLEAAPPWDLAVIDLNMPQMTGLQLAERLQSEPNFNQQPMILLTPLSWLETASRKELITAHVPKPIRPLTLRQTLIRTLSSESATQPALTKTGIDLNLGNRFPLRILLAEDNAVNQKVALHILKRMGYRADVAANGLEVLEALQQRPYDVILMDVQMPKMDGLETTERICAQWPPSQRPWIIAMTANALAGDRERCFAAGMDDYISKPIKIEALAAALNRCRCLNPKSTYPQLCDQINIDSDQGHQSATESMT

SEQ ID NO: 38367 - protein, 112 aa, Thermosynechococcus elongatus BP-1
MKKRFISVCAIAIALLVSLTPAALAADLANGAKVFSGNCAACHMGGGNVVMANKTLKKEALEQFGMYSEDAIIYQVQHGKNAMPAFAGRLTDEQIQDVAAYVLDQAAKGWAG

SEQ ID NO: 38368 - protein, 584 aa, Oryza sativa (japonica cultivar-group)
MSAAVGGAEFHGFRGGGGGAAQLQRSRMLGRPLRVATPHAAAPAGGGGSSSASIRAVSAPLKKDASEVKRSKVEIIKEKSNFLRYPLNEELVSEAPNINDSAVQLIKFHGSYQQTDRDVRGQKNYSFMLRTKNPCGKVPNQLYLAMDTLADEFGIGTLRLTTRQTFQLHGVLKKNLKTVISTVIKNMGSSLGACGDLNRNVLAPAAPYVRKDILFAQETAENIAALLTPQSGAYYDLWVDGEKIMSAEEPPEVTKARNDNTYGTNFPDSPEPIYGTQYLPRKFKIAVTVAGDNSVDILTNDIGVVVVSDSAGEPVGFNIYVGGGMGRTHRVETTFPRLADPLGYVPKEDILYAIKAIVVTQRENGRRDDRRYSRMKYLIDNWGIEKFRAEVEKYYGKKFEDSRPLPEWQFNSYLGWQEQGDGKLFYGVHVDNGRVAGQAKKTLREIIEKYNLEVSITPNQNLILCGIDQAWKDPITAALAQSGLLEPKDVDPLNITSMACPALPLCPLAQTEAERGILPILKRIRAVFDKVGIKDHESVVVRITGCPNGCARPYMAEVGFVGDGPNSYQIWLGGTPNQKKKMCL

SEQ ID NO: 38369 - protein, 352 aa, Oryza sativa (japonica cultivar-group)
METAAAAPPRVQALADAGVSFLPAQYVQPPELRPDPTTTTHRRAPTAASLSVPVVDLSSPGAGDAVRRACAEWGAFHVVGHGVRPGLLDAMRGAGLAFFRSPMEEKLRFACDQARGAAAEGYGSRMLANDDSVLDWRDYFDHHTLPDSRRDPTRWPDFVPGYRDTVVKYSDSMKDLAQKLLRIVSESLNLPPSYIEEAVGEVYQNITVSYYSPCPQPDLALGLQSHSDMGAITLLIQDDVGGLEVLKDGLWIPVPSLPDGILVILADQTEIITNGRYKSAVHRAIVNADRARLSVATFYDPSKSRKICTAPQLVCKEHPQKYRDVIYGDYVSSWYSKGPEGKRNIDALLIEQ

SEQ ID NO: 38370 - protein, 383 aa, Glycine max
  misc_feature (277)..(277): Xaa can be any naturally occurring amino acid
MGKRQSLRNKATHLVSVLLNPISDSDTSNPKTSKQHPPAPTPTPPSGQVGGSETNDEEGNRGLVDGPDTSSFTAFLYSLLSSSDTGDNANSRVQSDDNKSAAPDHNPLPDSSSLKENGGRKSLISRSKQSIGKAIRRIGGFRHQDRRDNVEMKLDDGHGSKVSGGVEMRRIEPVTVPLVDLPEISEPSVLLSDSIRNVLYVSLPPLIHGRKWLLFLLYMFCSTWRHGISLSTLYRRSMLWPGLSLLVVGDKKGAVFGSLVEAPLRSSSKKKYQILYXGTNKTFVFTNISGQPVIYRPTGVNRFFTLCNTDYIAIGGGGHFALYLDGDLLNGSSSVSETYGNPCLANSQDFEVKEVELWGFVHASKYEEVLAMSKTEAPGVCRF

SEQ ID NO: 38371 - protein, 291 aa, Glycine max
MMAGNPNWWTMHPPSLIPPHTGLPGEEERVAFSHFQSKKLDEWNEQMLNPSSIVPMADVIKQEVSQSGNLYHHGHDQEFQVSGAPWSHMVPVSSSPRSSVASFSSNNLLDFTYNKTDHRKNQLPDHTSECNSTATGGVYKKTKSQPSSSQPPLKVRKEKLGDRITALHQLVSPFGKTDTASVLLEAIGYIRFLQGQIEALSSPYLGNGSKNMRNPQSQQVHGERNSVFPEDPGQLLNDNGLKRKGAPNQDAKDKPRDLKSRGLCLVPVSCTQHVGNENGADYWAPAYGSGF

SEQ ID NO: 38372 - protein, 602 aa, Physcomitrella patens
MQGTMQSQMWRGQVSGASLHFTGATRVQGNSHQDLVYPTQFHKHGVRASAEREVKAKAVAAPPTIAADRLVPRVEERDGYYVLKEEFRQGINPSEKIKIAKEPMKFFMENEIEELAKTPFAELDSSKAGKDDIDVRLKWLGLFHRRKHQYGRFMMRFKLPNGITNSSQTRFLAETISKYGEYGCADLTTRQNWQIRGIVLEDVPALLKGLESVGLSSLQSGMDNVRNPVGNPLAGIDPDEIVDTAPFCKVLSDYIINRGQGNPQITNLPRKWNVCVVGTHDLFEHPHINDLAYMPATKNGVFGFNILVGGFFSPKRCAEAIPMDAWVPADDVVPLCKAILETYRDLGTRGNRQKTRMMWLIDEMGIEEFRAEVERRMPGGSILRAGKDLVDPSWTRRSFYGVNPQKQPGLNYVGLHIPVGRLHAPEMFELARIADEYGNGEIRISVEQNLILPNVPTEKIEKLLKEPLLEKYSPNPTPLLANLVACTGSQFCGQAIAETKARSLQLTQELEATMETTRPIRLHFTGCPNTCAQIQVADIGFMGTMARDENRKPVEGFDIYLGGRIGSDSHLGELVVPGVPATKLLPVVQDLMIQHFGAKRKT

SEQ ID NO: 38373 - protein, 123 aa, Porphyra purpurea
MKDNNIKLSLLMKSVEQPLMKTELPEIKVGDTIRLGLLVKEGSKTREQLCEGVVLSRKKRKSLNTSLTLRCSFQGVGVERVFFLNSPRVTFVKVIRRAKVRRAKLYYLRDLLGKASRLKQIFN

SEQ ID NO: 38374 - protein, 241 aa, Zea mays
  misc_feature (42)..(42): Xaa can be any naturally occurring amino acid
  misc_feature (150)..(150): Xaa can be any naturally occurring amino acid
  misc_feature (200)..(200): Xaa can be any naturally occurring amino acid
HWDPRGRPGYCFAPHTDAQRIGLCRQERVLFASYLRMKAVRXMIMGHPLDFFNHHLNRLLPPHRADFYSIIHAMTALPEAIKLLYPPLHKDLPHGNILDVVGDFCADTFALHENALRANCPAFQHAGPMLGFRALTLGTSYPELYDMHRXTIFEAAITMTNQAAQVIPDIMSPLDGTPQQLAHQVTLIRQDDEKVFDYGXQTIGNKVGTMIEIPTAALEPDDIAEQDEFFSFGTNDLTQMT

SEQ ID NO: 38375 - protein, 275 aa, Methanopyrus kandleri AV19
MSPLRVRLYDYRKADVERATFIIEETSAEFVNTIRRALYTLVPTLRIEEVIIYENDTPMYDEMLAHRLGLIPLRVDDIDQFELPDLCDCGGKGCEKCQVRAELEVEGPTKVYARDLKFDHPDVEPAFPDTLITEVGEDQRIRLEVIAVPGLGLEHAKWKPVSAVGYKGLPELEIDEDKLKEKKITYECPQGIIRIENGEVVHIDEDRLPECRMYKEYERETDGAVRVRLRDDAFVFNVETDGSMSLDTAILKALDAIEHKLESLKKNLQKEVSGE

SEQ ID NO: 38376 - protein, 332 aa, Wolbachia endosymbiont of Drosophila melanogaster
MATLSVREALCTAIREEMQNDSDVLIMGEEVAEYDGAYKVTKGLLKEFGENRIVDTPITEHGFAGLAVGAAFAGLKPIVEFMTFNFSMQAIDQIVNSAAKTNYMSGGQLGCPIVFRGPNGAAARVAAQHSQCFAAWYSHIPGLKVIAPYFASDCRGLLKAAIRDPNPVIFLENEIAYGHEHEVSDSELSNKDYLLEIGKAAVIREGKDVTITAFSLKLMDALNAADLLSSKGIEAEVIDLRTLRPLDTQTVINSIQKTNRLVSVEEGWPFAGIGAELSAVVMEQGFDYLDAPVVRVTGKDIPLPYAANLEKKALPQVEDIVEAVHQVCFRKK

SEQ ID NO: 38377 - protein, 127 aa, Bacillus cereus ATCC 10987
MKSMKVVQTKNAPQAIGPYSQGIIVNNMFYSSGQIPLTASGELVVGDVTVQTEQVFQNLQAVLEEAGASFDTVVKTTVFLKDMDDFNAVNEVYGSYFSAHKPARSCVQVAKLPKDVSVEIEVIALVK

SEQ ID NO: 38378 - protein, 277 aa, Bacillus cereus E33L
MKKSEMEESRMWNYEAEEAKAVIVIVHGAMEYHGRYEAVAEMWNHIGYHVVMGDLPSHGTTSRNRGHIDSFDEYIEEVKLWVKEARKYRLPIFLFGHSMGGLIVIRMMQETKREDVDGIILSSPCLGVLAGPSAPLQAASKILNIIAPKLQFATNLTVEMSTRNHEVRDAMENDSLFLRKVSVRWYSELTKSIEIAHKKIDDFPDVPLLLMQACEDKLVDKTRVRTWFDNVKISDKAFKEWPNCYHELLNEYERDEILNYIQSFTEIRINNIIETNK

SEQ ID NO: 38379 - protein, 438 aa, Oryza sativa
VTCSSSSKVSGARALTAADRASMAAAANNGGEGGDGFDVIVVGAGIMGSCAAYAASTRGGARVLLLERFDLLHHRGSSHGESRTIRATYPQAHYPPMVRLAARLWDDAQRDAGYRVLTPTPHLDMGPRADPALRASIVNGAATEVASDAAAPWPWSGVFRLPEGWTAATSEIGGVMKATKAVAMFQSLAAKNGAVVRDRTEVIDIAKQGDGSIVVKTSSGEEFHGAKCIITVGAWASKLVRSVAGVDLPVQPLHTLICYWRARPGREHELTPESGFPTFASYGDPYIYSTPSMEFPGLIKVAAHGGPPCDPDRRDWLAGAGAGLVEPVARWIDEVMPGHVDTAGGPVIRQPCMYSMTPDEDFIIDFVGGELGKDVVVGAGFSGHGFKMGPAVGRILAEMALDGEARTAAEAGVELRHFRIGRFEDNPEGNLAENKVKN

SEQ ID NO: 38380 - protein, 259 aa, Lilium longiflorum
MSPAEPSREENVYMAKLAEQAERYEEMVEFMEKVARTVDTEELTVEERNLLSVAYKNVIGARRASWRIISSIEQKEESRGNEDHVALIKDYRGKIEAELSKICDGILKLLDSHLVPSSTAPESKVFYLKMKGDYHRYLAEFKSGAERKEAAESTLLAYKSAQDIALAELAPTHPIRLGLALNFSVFYYEILNSPDRACNLAKQAFDEAISELDTLGEESYKDSTLIMQLLRDNLTLWTSDINEEAGDEIKEASKAVEGQ

SEQ ID NO: 38381 - protein, 413 aa, Candida albicans SC5314
MNSRHSLPIVILRTAFITPLFILGCLSISLTQFLTLLIFKNNPDVKQAIINNTKNHFVILISYITTIVNPCKIEITIDETTVPNSDHFTVDESNNIHTMFQPNSVLISNHQIYTDWLYLWFLTYTSKFGNSVFIILKDLSKIPVLGYGMKNYNFLFLSRKWEKDKIVLTNQLLEIDANARGMGPANGVQLIGSSSTTNTEFTKWPQGSNVNKIWPYELILFAEGTVPSDRTTKKSAEFIASRGLPPLKHVLLPRIRGLFLALKKLKSSVEIVYDITTAYSGLTEDQYGEIEYSLKRFYLKGYGPPKINYYIKGWKLKDIPLGEDVDDIDNILEQDLKKFEDWLLKIWYEKDKLMDNHYKLGNWGELNHKTTRSIIGDFKLRNQFEIFLPFLATIATILFLRIAYILIRRIINV

SEQ ID NO: 38382 - protein, 346 aa, Alkaliphilus metalliredigenes QYMF
MKNRAVFMQGTDNMVTKDVPMPKIKEKDVLIKVDIVGICGSDVHYYKHGKIGDFVVEGEFILGHEAAGEVVEVGEQVKGLTVGDRVTMEPGKTCGKCEFCKGGKYNLCPDVEFFATPPYHGVLTNYVSHPEDMCFKLPKNVSNVEGALVEPLAVGLHASDQGGVKLGDTVVIFGTGCIGLMTIISCKAKGAAKIIVVDILENRLEVAKKVGATDTINAKEVNVLKKIQELTDGKGAEVVIDAAGAAITVKQTVDAVKPGGTIVLVGMTPKDEVEFNFMKLMGKEAEVKTVFRYRNLYPIAINAIASGAINIKDIVSHEFDFEQTKEAFDFVAEHASDVVKAVIKIK

SEQ ID NO: 38383 - protein, 437 aa, Thermosynechococcus elongatus BP-1
MAVQMEFSMKRVLAIILGGGAGTRLYPLTKRRAKPAVPLAGKYRLIDIPVSNCINSEIHNIYVLTQFNSASLNRHIARTYTFPGLTGGFVEVLAAQQTPENPNWFQGTADAVRQYLWLLADWDVDEYLILSGDHLYRMDYRLFVQRHRDTGADVTLSVLPVEEKAASGFGLLKVDGTGRVTDFREKPTGDALRDMRVDTTRYGLTIEEAHRKPYIASMGIYVFKRQVLIDLLQQMADATDFGKEIIPAAARSHLVQTYLFNGYWEDIGTIGSFYEANLALTQQPQPPFSFYDENAPIYTRPRYLPPSKILSSTITESIISEGCILKECQVHRSVLGVRSRVESGCVIDHSLLMGADYYQDSAQRSQLRLQHKIPIGIGANSVIRRAIVDKNACIGRDVKIINKDNVEESNREDQGFYIRSGVVVIIKNAVIPDGTII

SEQ ID NO: 38384 - protein, 394 aa, Thermosynechococcus elongatus BP-1
MPKIETRTEPMVINMGPHHPSMHGVLRLMVTLDGEDVIDCEPVIGYLHRGMEKIAENRTNIMFIPYVSRWDYAAGMFNEAVTVNAPEKLAGIPVPKRASYIRVIMLELNRIANHLLWLGPFLADVGAQTPFFYIFREREYIYDLFEAATGMRFINNNYFRIGGVAADLTYGWVTKCRDFCDYFLPKVDEYERLITNNPIFVRRLQGVGKISREEAINWGLSGPMLRASGVKWDLRKVDHYECYDDFDWDVPVATEGDCLARYIVRIQEMRESVKIIRQALDGLPGGPYENLEAKRMLEGAKSEWNGFDYQYIGKKLSPTFKIPKGEHYVRVESGKGELGIYLIGDDNVFPWRWKIRPPDFNNLQVLPQLLKGMKVADIVAILGSIDVIMGSVDR

SEQ ID NO: 38385 - protein, 329 aa, Bradyrhizobium japonicum USDA 110
MIWPRPDGAHLLKPAPHHGLAEALCGNRARALDRARGTRNGSPPIRSGEKMTVTKAPAACLIGWPAAHSRSPLIHHYWLRTLGIAGGYVIEAVPPEDLRDFVLRLSLRGFVGANVTIPHKEGVLALSTPDARAKAVGAANTLWFEDGELRSTNTDVEGFINNLDASAPGWDTAEEALVLGAGGSARAVVFGLRERGIKRIHLANRTIARAETLAKQFGPNVQPVTWDGIDDVLPRAKLLVNTTSLGMRGQPSLDVDVARLPQAAVVADLVYVPLVTPLLAAAKARGLRTADGLGMLLHQAVRGFELWFGRRPRVTDELRALVEADLTKS

SEQ ID NO: 38386 - protein, 495 aa, Xanthomonas campestris pv. campestris str. ATCC 33913
MYAPLALYDTAAARMLDAQATTLLGGDGYTLMQRAGQAAWQWLQERLPRARRIVVMCGTGNNGGDGYVLARLAHRAGRQVQVVHLPEQGPASELAQRACTDYLAVGGAIALFPCALAHADVLVDAVFGIGLNRAPGAQMDALFDAINAAGVPVLALDVPSGIDADRGIAPGSAVRASATLQFIVPHVGLYTGDALEYAGERDLATLEVPGSAFDGLAPVAQRWERDALAAHLLPRRRNTHKGESGRVLCVGGNAGSGGAIMLTTEAALRSGSGLVQVATRAEHVAPLLARCPEAMVRGVQEDADITALAEAADAVALGPGLGRDSWARALWSGVLASATPTVIDADGLNLLASTSVPARGPRVLTPHPGEAGRLLGQSTAQVQRDRLGAAHALATRFDAVVVLKGAGTVVAAPDRLPRLIDAGNAGMAVGGMGDLLTGVIASLLGQGWAPFDAASLGALLHACAGDAAAADGERGLLPTDLLPALRRLANAGAIA

SEQ ID NO: 38387 - protein, 258 aa, Deinococcus radiodurans R1
MSTAPKPTVQNPFASADAAGRYAAGRPAFHLLVLSRLAPHLTGRELGADVACGTGLSSAALAELVGEVRAFDASAAMLAEAAPHPRVTYAQAPAEALPLADGVLDVMTVAQAFHWFDHAAFLAEARRTLKPGGVLALYDDFFLGEMEGEPNFGTFAKTYLARYPTPARHRDPFGETEAQAAGFTFHEETWKHPLALTQPQLVAYLLTHSNTLAATENGTASQDEIAEWLNEQLAPFYAGGGTRNVVYGALLTVLRREG

SEQ ID NO: 38388 - protein, 520 aa, Kluyveromyces lactis
MNEYDAVDRHTFKVFNQDFTVDKRFQLIKEIGHGSYGIVCSARFTEAADETTVAIKKVTNVFSKTLLCKRSLRELKLLRHFRGHKNITCLYDMDIVFQPDGMFNGLYLYEELMECDMHQIVKSGQPLTDAHYQSFIYQILCGLKYIHSADVLHRDLKPGNLLVNADCQLKICDFGLARGYSENPVENNQFLTEYVATRWYRAPEIMLSYQGYTKAIDVWSCGCILAELLGGKPIFKGKDYVDQLNRILQVLGTPPEETLKRIGSKNVQDYIHQLGYIPKIPFSTLYPNANPDALNLLEGMLSFDPQLRITVDDALQHPYLSIWHDPADEPICTEKFDFSFESVNEIEQLKQMVIDEVTDFRQYVRLPLLHEQQQQQGKTDGGFDDQIREDQRTFQAQLEEQVNNGRTASNVPSFDEPFSSQMMGSASQQDPLVGIHSDNLPSHELDFPPRPSENVLDSPMGLSHQQTHNGSPECQDINDLLGLERELEFGLDRQFNETVWYIASSTLFVEHKLLLRFCYT

SEQ ID NO: 38389 - protein, 428 aa, Actinobacillus pleuropneumoniae serovar 1 str. 4074
MTIETIVVVGGGAGGLELATYLGDKLGRKKKSKVILIDRNTTHLWKPLLHEVATGSLDEGIDALSYRAHAKNHAFEFQQGTLTSVNRDKKEITLAPIYNEQNQLLVKERHIAYDKLVIAIGSKSNDFNTKGVAEHCIFLDGSEQAKQFQKRMMELFLHFSHSEDQDVKIAIVGGGATGIELSAELYNTVKHLNEYGFGKLHRASLKVTLIEAGPRLIPALTEKVSASALAELRKAGVDVRLNTMITEAVEDGLITKDGEKIEANLMVWAAGIKAPEFVKEFGFETNRLNQIEIKETLQTTVDDSVYVIGDCASLIQDGKAIPPRAQAAHQMATQCGKNIVALLEGKEQKPFKFNDKGSLLSFSHFGTVGNLMGNLMSGDMFIEGKIARLAYLSLYRMHQVALHGWVKTALILFVGQINRFLRPSMKLH

SEQ ID NO: 38390 - protein, 204 aa, Brassica napus
AGCVLHTAAVSRESEMAAAAAAKEDGQDPRIPKIASSIRVIPDFPKPGIMFQDITTLLLDTEAFKDTIDIFVERYKCKGISVVAGVEARGFIFGPPIALAIGAKFVPMRKPKKLPGKVISEEYSLEYGTDKIEMHVGAVEPGERAIIIDDLIATGGTLAAAIRLLERVGVKIVECACVIELPELKGREKLGEAPLFILVTSDAA

SEQ ID NO: 38391 - protein, 551 aa, Pseudomonas syringae pv. tomato str. DC3000
MTELEDPSRDRLKHHFAQRVIHQARQILETWQRLQKAQWSVADMAELKEATLRLMRFAERFEQAEHVALAHEINQSLDAVDANRGRLNSHVITELNRLMQRLSRTGLRHGDRLEQTSLPPLRKPVYVVLQDHERAERLAKQLEFFGLSALSLHSVADFQRAMAQRHPAAIVMDVDFSGPGMGLELASQAQEGLEQKLPLLFFSVHETDTPTRLAAVRAGGEEFLTGALEASSLLEKIEVLTCVAQYEPYKVLIIDDSRAQAMHTERVLNAAGIVTRVLIDPIQAMSELADFQPDLIILDMYMPGCTGTELAKVIRHNDRYVSVPIIYLSAEDDQDKQLDAMSEGGDDFLTKPIKPRHLITTVRNRAARARNLKSRMVRDSLTGLYNHTHILQLLEDCSFRSRREGKPLCFAMLDIDHFKRVNDSHGHPMGDRVIKSLALFLKQRLRKTDFIGRYGGEEFAIVMPDTDIHNAHKVLDEIRHRFAEIHYPAQPADLFCTFSAGVVCLGADDDSLSLASQADNALYRAKHAGRNQVHSALVQAPYHIVLAEIEA

SEQ ID NO: 38392 - protein, 151 aa, Brassica napus
MGLSQTATALVAVFALCLTAVTAQLAYVLWWKRRFRRRSISGGSELDVFSSRGGDPTATPPPSKELLYFFLFCVENKQFRIGSATAPPLPTAAPPADDVASKWSTTGEDLLSGPSETLFTIAEDSTSESDHRTADMEPRGSVSVDDHVRDD

SEQ ID NO: 38393 - protein, 379 aa, Hordeum vulgare subsp. vulgare
MATAGKVIKCKAAVAWEAGKPLTMEEVEVAPPQAMEVRVKILFTSLCHTDVYFWEAKGQTPMFPRIFGHEAGGIVESVGEGVTDVAPGDHVLPVFTGECKECPHCKSAESNMCDLLRINTDRGVMIGDGKSRFSIGGKPIYHFVGTSTFSEYTVMHVGCVAKINPEAPLDKVCVLSCGICTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERTLKGTFFGNFKPRTDLPNVVEMYMKKELEVEKFITHSVPFSEINKAFDLMAKGEGIRCIIRMDN

SEQ ID NO: 38394 - protein, 302 aa, Pseudomonas syringae pv. tomato str. DC3000
MYMIRAIFLTLITGAVLAVLSGCSPLKVLNSLNPSGPVEHVNGLAYGPYPRNKLDIYMPRSKTANSPVVVFFYGGSWRRGSKTDYAFVGEALAARGMVVVIADYRLYPQVRYPDFLDDSAKALAWAYKNAKTYGGDPDRLYVMGHSAGAYNAAMLALDPRWLAREGLAPSILSGWIGLAGPYDFLPIEEEEVKPVFFFPNSPPESQPINYVSAGAPPALLMASNTDTLVNPRRNTGGLAQKLRAANVPARDLYFSRTNHGTLVGAFAKLLSGLAPVVDEVDMFVKHTPGAQRETKGWGLTAQ

SEQ ID NO: 38395 - protein, 388 aa, Legionella pneumophila str. Lens
MNQCEKKNLPKDSATVAINSLAQQKINAGIKIHNLSAGEPKLPPHPSIINAVTQAMEQGHTLYPPIMGIPELRHLGCEWMHRSYDCSFQNEQCLVVNGGKLGIYLLMQLLLQPNDEVIIPSPYWVSYPAMVSLFGGTPVPVETTEAEEWKLTPQALQKACTTKSKILILNNATNPTGALYTQSELIHLLQTAKKHNLLVISDEVYSELTYDGHHYVSCGSLPQFRESVIIIQSCSKNFSMTGWRVGFIFAPEVFIKPLSALVSQSTSGVTTLSQWAAVAALQEVNQVNIWVQQNMEKRRNCLLRTLHDYLGLTITPPISSLYVFLSLKDIGCKNQNSEEFCKQVLDKANVAMVPGIAFGKEGYVRLSFGGNEDDLKSGIYALAQWLHR

SEQ ID NO: 38396 - protein, 400 aa, Aspergillus parasiticus
MPLLEAPRNGPKVSNGVLSGVSHSQSFGIDTESHSDDPNRRQRIVVVGLGMVAISFLEKLVKQDSERRKYDIVVIGEEPHVAYNRVGLSSFFEHRNIEDLYLNPKEWYGSFKDRSFDYHLNTRVTDIFPDRKTVKTSTGDTIAYVLLVLATGSDAVLPTHTPGYDANGVFVYRTISDLERLIEFASKHQGETATTVGGGLLGLEAAKAMTDLEDFGKVKLIDRNKWVLARQLEADAGTLVTRKIRELGLDVLHQKRVAKIKTDDNNNVTGIVFEDGEEIDCCCVCFRIGVRPRDELGTTAGIQCASRGGFVINESLQTSIPEIYAIGECASCANQTFGIIAPGIEMADVLAFNLTNPDKEPKSFRRPHLSTKLKLLGVDVASFGDFFADRDGPKFLPGRR

SEQ ID NO: 38397 - protein, 107 aa, Wolbachia endosymbiont of Drosophila melanogaster
MSNFEQIKKDITENDVVLYMKGTSDFPQCGFSGLVVSILKKLNVKFKYINVLENDEIRESIKKFSDWPTIPQLYIKEEFIGGCDITREMYEKGELQSLLKEKKIIAE

SEQ ID NO: 38398 - protein, 218 aa, Alkaliphilus metalliredigenes QYMF
MRVKGLEEVTFDEKGLVATIIQEMSSNEVLMVAYMNRESLKKTLETKETWFWSRSRGELWHKGGTSGHIQRVKEMRYDCDGDALLVKVEQTGVACHTGEKSCFYSTLYKEEAVKKKEAMLEESENIEELLSSLYERIVDRKAHPKQGSYTNYLFDKGVDKILKKVGEEASEVIIAAKNPGKEELVSETSDLLYHLLVLLVEKGVSLEAIYQELNSREK

SEQ ID NO: 38399 - protein, 426 aa, Thermosynechococcus elongatus BP-1
MIRELFMPALSSTMTEGKIVSWLKSPGDKVTKGETVLIVESDKADMDVESFYDGYLAVITVPAGEVAPVGSTIGLVAETEAEIAEAEAKAKSLGTATSSGPAPASTSTVATSNGSGTAPVAAAPAASAAVPAGRVMASPRARKLAKEHKIDLKTLKGTGPNGRITAADVEALIGAPATPVPPVATSPAPIPTAPPATAAVVAKEDLVPLTTLQNAVVRNMVASLGIPDFHVAYTITTDALDRLYQQIKSKGVTMTALLAKAIALTLQKHPIMNAYYTEQGIQYRRDINIAVAVAMPGGGLITPVLKNADQIDLYSLSRTWKDLVERARAKQLQPDEYSTGTFSLSNLGMFGVDFFDAILTPGQGAIMAVGASRPTVVATEDGLLGVKRQMKVNITCDHRVIYGADAAAFLQDLAKLIETNPQALTL

SEQ ID NO: 38400 - protein, 93 aa, Glycine max
IKCSPWMDWFHGGLQFQVEHHLFPRLPRCHYRMVAPIVRDLCKKHGLSYGAATFWEANVMTWKTLRAAALQAREATTGAAPKNLVWEALNTHG

SEQ ID NO: 38401 - protein, 195 aa, Alkaliphilus metalliredigenes QYMF
MTRSYRGDRRTKETDIELILNLDGKGQGKIATGIGFFDHMLEQIMKHGQLDLELKAVGDIEVDFHHTVEDVGILMGKAIAEALGDKKGIVRYATAFIPMDEALSMVSMDISGRPFLQYGVNYSGEFVGQFEVQLVEEFFRALAFNSGITLHIQTQYGRNNHHIVESIFKAFAKALREAITIDPRIEGVLSTKGSL

SEQ ID NO: 38402 - protein, 551 aa, Zea mays
MASAAARGAAVRSPLLVHHRVPLVHPSGGGSLRVGWPGIGPGREGRRRGAPVGARVFARYSQAQDFSTRLQDRAGELPKLVEDLIQTSISTGPRGAFRMAQGIQAVLGVGGEWLNDLSKTANTSASAGIPSQMQLGLLSPLYLRRLFERMGATYIKLGQFVASAPTLFPAEYVEEFQKCFDQAPAVPYDVIESILREELQRPLDSVYEYIDPVPIASASIAQVHGARLKSSQKDVVIKVLKPGIEDTLVADLNFIYVVARVLEFLNPELQRTSLVGIVKDIKESMLEEVDFRKEAANIQAFQGYIDAMGFDRQAKAPFVYQHCSTKRVLTMERLYGVPLTDLDSIRSLVPDPELTLVTALNVWFGSLISCESFHADVHAGNLWLLRDGRIGFIDFGIVGRISPRTWAAMEVFLASFATEDYDAMASALSEMGATGNDINTNEFAKDLRKIFSSIQDLDTEIIVATARTPDATAVSANVVLDERQMNALFLDLVRVSESYGLKFPREFALLMKQLLYFDRYTRLLAPSMNMLRDERINISTNRQPRRTDRFQ

SEQ ID NO: 38403 - protein, 120 aa, Thermosynechococcus elongatus BP-1
MNAQDIIRSIEAEQMKTDLPVIYVGDRVRVGVKIKEGDKERVQPYEGDVIAMRNTGINRTITVRRVFQGVGVERVFLLHSPRIDSIKVIQRGKVRRAKLYYLRDRMGKASRIKPRFDRPL

SEQ ID NO: 38404 - protein, 270 aa, Brassica napus
MVRCSNNLVGVLNFIVFLLSIPILAGGIWLSQKGSTECERFLDKPVIALGVFLMVVAIAGLIGSCCRVTWLLWTYLLVMFLLILLVFCFTIFAFVVTNKGAGEKVSERGYKEYRLGDYSNWLQKRVNSDKNWRRIRSCLVESKVCPKLEAKLINEPVNKFYQEHLTALQSGCCKPAEQCQFTYVSATNWTKTAGTQPNPDCQSWDNAPNKLCFDCQSCKAGLLDNVKSAWKKVAVVNIIFLVFLIIVYSVGCCALRNNKRDGSYGYGYKP

SEQ ID NO: 38405 - protein, 252 aa, Brassica juncea
MAYQTELGGESSSQRKAGRGKIEIKRIENTTNRQVTFCKRRNGLLKKAYELSVLCYAEVALIVFSSRGRLYEYSNNSVKGTIERYKKAISDNSNTGSVAEINAQYYQQESAKLRQQIISIQNSNRQLMGETIGSMSPKELRNLEGRLDRSVNRIRSKKNELLFAEIDYMQKREVDLHNDNQLLRAKIAENERNNPSMSLMPGGSNYEQIMPPPQTQPQPFDSRNYFQVAALQPNNHHYSSAGREDQTALQLV

SEQ ID NO: 38406 - protein, 624 aa, Mycobacterium smegmatis str. MC2 155
MSSGVQTGTITTQVPSRLDRLPWSRFHWRVVLGLGGVWILDGLEVTMVGNVASRLTESGSGIELSAGQIGIAAAVYITGACLGALFFGQLTDRFGRKKLFLLTLAVYLVATVATAFAFAPWFFFVCRFFTGAGIGGEYAAINSAIDELIPARVRGRVDLIINGSYWLGAAGGALGALLLLNTAIFPADIGWRIAFGIGAVFGLVVLVVRRHVPESPRWLFIHGQEDEAERVVGEIEREVERSTGRPLDEPEGSLTVRQRKTISFVEIAKVAFTKYPKRAVLGLALFIGQAFIYNAFTFNLGTLLSGFFDVASGAVPIFYAVWALSNFAGPILLGRLFDTVGRKPMIALAYLGSAAVAVILTVLFVNEIGGVWLFMLVLGVCFFLASSGASAAYLTVSEIFPMETRALAIAFFYAIGTAVGGITGPLLFGQLIESGERGLVAVSFLIGAAVMAVGGVVELILGVKAEGQKLEDLAMPLTADEGDGESGGDAENADDQADERARARKEREARIAARVERQRAAQSRARRYRPGPPPGWEGAWREPPTPGVPESALDHEIDAIARAVADNESMTVRELHRAVGAQYWGPGEFRKALREALAENRIARKARGRVGPPSGMAEPGTPNR

SEQ ID NO: 38407 - protein, 571 aa, Sorghum bicolor
MAPLLLHASAISHSAHPGLRSHIGPNNEHISRHLSSSSQNTKRRCNISLRSRAQRISSQLGGQKLEHWEIPKRDWFPPSFTFGAATSAFQIEGGWNEDGKGPSTWDHFCHTYPDFIADKSNGDVAADSYHLYEEDVKLLKEMGMDAYRFSISWPRILPNGTLSDINEKGIAYYNNLINLLIDNGIEPYVTIFHWDTPQALVDDYGGFLDKRIIKDYTDFAGLCFERFGDRVNNWLTFNEPHTFTCLSYGTGILAPGRCSPGMKCPDPTGDSIREPYLVGHNFLLAHAETVDLYNKFHRGEKGRIGLALNVMGTVPYGSTFLDEQAHERCMDYNLGWYLEPVVRGDYPHSMRSSVRDRLPHFTEKEQQKLVGSYDMIGINYYSSRFAKHVDITENFSPELNTHDCCATEEITGPNGNTIGPATGNAWVYMYPKGLKDILMIMKKRYGNPPVYITENGMGDIDNGDLSMEAALDDHIRLDYLQRHISVLKDSIDSGANVRGHFTWSLLDNFEWSSGYTERFGIVYVDRENGCKRTLKRSARWLKEFNGAAKRPGNLIKPNFSEINKIKVVTPA

SEQ ID NO: 38408 - protein, 424 aa, Wolbachia endosymbiont of Drosophila melanogaster
MNKVINNVFAREILDSRGYPTIEVEIELCDGAIGRASVPSGASTGKLEVLELRDQDEKRYCGKGVLKAVQAVNGIIADEIIGMNAADQNAIDKALIELDGTKNKSKLGANATLGVSLAVAKAAANSFKMPLYRYLGGKQTSVMPVPLINIINGGVHADNKLDFQEFMILPVGAETFSEAIRISAEVFHNLRSILKKKGYSTNVGDEGGFAPNIESTEEALDLIIYVIESAGYSAQSDFALGLDVASSTFYEDGIYKFEHRDLTSEELTEYYCNLVERYPIISIEDAMSEDDYEGWKLLTAKLGSKIQLVGDDLFVTNCELICKGIEEKMANAVLIKPNQIGTLTETFAAIEMAKSNGYKAVVSHRSGETEDTTISHIAVASNCGQIKTGSLSRSDRLAKYNELIRIESALGKDAKYYRGLAWVL

SEQ ID NO: 38409 - protein, 330 aa, Psychrobacter arcticus 273-4
MNSPERNLTHEQFISTAIDAINTEKAALALLTEQIDDRFAQACDIILACQGRVVVTGMGKSGLIGRKIAATFASTGTPAFFMHPGEAGHGDLGMLVKGDVLLAISNSGESDEIKMLLPVVKRLNIPLISISRDKRGMLPHAADIILTLGKSQEACPLNLAPTSSTTATLALGDALAVALVHARNFTSEDFALSHPAGALGRQLLTRVEDLMHTKSEDLPLINQQAPLQEALFIMSAGRLGMTVVTDDKSKVVGIFTDGDLRRGLEKGIDLQTPMRELMVSNPRRINKSMRASDALSVMNENAISQLLIVDDEQRLEAIITVHDLLQAGVK

SEQ ID NO: 38410 - protein, 468 aa, Zea mays
TPSSRVGCCSANATYGRIRYTPPPPSRPSPSGQRSSIHPHPIIKPPNAPRVPRPPRRRRSRLLSPGEGAPRGAFPTADCRLTLRDRKRRRRRPAMAIPLVLVVLPLGLLFLLSGLIVNAIQAVLFVTIRPFSKSFYRRINRFLAELLWLQLVWVVDWWAGVKVQLHADEETYRSMGKEHALIISNHRSDIDWLIGWILAQRSGCLGSTLAVMKKSSKFLPVIGWSMWFAEYLFLERSWAKDEKTLKWGLQRLKDFPRPFWLALFVEGTRFTPAKLLAAQEYAASQGLPAPRNVLIPRTKGFVSAVSIMRDFVPAIYDTTVIVPKDSPQPTMLRILKGQSSVIHVRMKRHAMSEMPKSDEDVSKWCKDIFVAKDALLDKHLATGTFDEEIRPIGRPVKSLLVTLFWSCLLLFGAIEFFKWTQLLSTWRGVAFTAAGMALVTGVMHVFIMFSQAERSSSARAARNRVKKE

SEQ ID NO: 38411 - protein, 1111 aa, Arabidopsis thaliana
MSSNTSRSCSTRSRQNSRVSSQVLVDAKLHGNFEESERLFDYSASINLNMPSSSCEIPSSAVSTYLQKIQRGMLIQPFGCLIVVDEKNLKVIAFSENTQEMLGLIPHTVPSMEQREALTIGTDVKSLFLSPGCSALQKAVDFGEISILNPITLHCRSSSKPFYAILHRIEEGLVIDLEPVSPDEVPVTAAGALRSYKLAAKSISRLQALPSGNMLLLCDALVKEVSELTGYDRVMVYKFHEDGHGEVIAECCREDMEPYLGLHYSATDIPQASRFLFMRNKVRMICDCSAVPVKVVQDKSLSQPISLSGSTLRAPHGCHAQYMSNMGSVASLVMSVTINGSDSDEMNRDLQTGRHLWGLVVCHHASPRFVPFPLRYACEFLTQVFGVQINKEAESAVLLKEKRILQTQSVLCDMLFRNAPIGIVTQSPNIMDLVKCDGAALYYRDKLWSLGVTPTETQIRDLIDWVLKSHGGNTGFTTESLMESGYPDASVLGESICGMAAVYITEKDFLFWFRSSTAKQIKWGGARHDPNDRDGKRMHPRSSFKAFMEIVRWKSVPWDDMEMDAINSLQLIIKGSLQEEHSKTVVDVPLVDNRVQKVDELCVIVNEMVRLIDTAAVPIFAVDASGVINGWNSKAAEVTGLAVEQAIGKPVSDLVEDDSVETVKNMLALALEGSEERGAEIRIRAFGPKRKSSPVELVVNTCCSRDMTNNVLGVCFIGQDVTGQKKLTENYSRVQGDYARIMWSPSTLIPPIFMTNENGVCSEWNNAMQKLSGIKREEVVNKILLGEVFTTDDYGCCLKDHDTLTKLRIGFNAVISGQKNIKKLLFGFYHRDGSFIEALLSANKRTDIEGKVTGVLCFLQVPSPELQYALQVQQISEHAIACALNKLAYLRHEVKDPEKAISFLQDLLHSSGLSEDQKRLLRTSVLCREQLAKVISDSDIEGIEEGYVELGCSEFGLQESLEAVVKQVMELSIERKVQISCDYPQEVSSMRLYGDNLRLQQILSETLLSSIRFTPAWKGLCVSFKVIARIEAIGKRMKRVELEFRIIHPAPGLPEDLVREMFQPLRKGTSREGLGLHITQKLVKLMERGTLRYLRESEMSAFVILTEFPLI

SEQ ID NO: 38412 - protein, 644 aa, Streptomyces sp. 139
MCGIAGTYRWPDGKAVTDRLTETLAHRGPDGSGGYSHALGDGEVHLGHRRLAILDLSENGAQPMVSGGLALTYNGELYNAPELRAELEGAGVRFRGTSDTEVLLEAWRRWGTDCLPRLRGMFAFAVFDERTGDLVLVRDQLGIKPLFLLRRGKGLVFASELKALAAVTGGSLEVDPAALVASLLYYWVPDSRCAFRGAEKLPPGTWLRCRADGSVSAAGSGTCARSPPRAGAGTVRYLPDLAAVVEESTRRHLLSDVPVATFLSGGLDSSYLTALAARDRPGIPAYTIGFRAEDARFEAMPDDLRYARRVAERFGVDLREIEIAPDVLDLLPRMTYHLDEPVGDPAAINTFLICSAAREAGVKVMLSGMGADELFAGYRKHLANLIAVRYRHVPGPVRRGVASAVDRLPVATSRRGLRSVRFAKRFLSFAGLPEETAFRRSYTLYDRQELAGLLDPDLAPAVDDVLAEHADVYQDNELDDFVNRMCLADARMFLPGLNLAYTDRSSMAASTEVRVPYVDVEVVRAAFAVPGARKIAGRQGKAVLKEAATTVLPREIVYRPKGLFSAPLRAWMSRDLAPLVREVVNDGLLVRSGFLRREALARMVAEDAAGQRDFSKHLWHVLTLEYWYRDATSRAGRNSPTSTA

SEQ ID NO: 38413 - protein, 62 aa, Triticum aestivum
  misc_feature (59)..(59): Xaa can be any naturally occurring amino acid
MENGFPGEVLKAVFPLLDGKDLVFCMLVCRQWCEIAKDDYFWKCICSRKWPSICKQPPXDTN

SEQ ID NO: 38414 - protein, 372 aa, Methanopyrus kandleri AV19
MILQRDSDYSDGTVLGSMCTEPHPVAAEAFVAGLHVNLGDPYLFPNAYRAERECIGWLAETLLDHPAPEEAEGSIVSGGTEANILAAYAAREVTGGREIIVPATRHFSFEKAARMLRMKLVEAPLRSDYTVDVDAVQDLISRDTALIVGIVGTTETGSVDDIEALSDVAEDHGVPLHVDAAFGGFTAPFLREEYPLPRFGFDLEAVVSVTVDPHKMGLVPPPAGGIVFRDDEFPKAIEVYAPYLSGGGASQYTITGTRPGAPVLALYANILELGEEGYRRIAFRCYEETLKVAEKARELGLELAVDPPHLNLVNIRLPDRGTAERLLRESEREGWKISVSTKPLGVRIVMMPHLDAETVSRFLELVARVLGG

SEQ ID NO: 38415 - protein, 301 aa, Bifidobacterium longum NCC2705
MSEHDMHLLDSAPFGRILPAMVTPMKSDGSVDFAAAQKLAKYLVADGADGLVVNGTTGESPVTHMDEKVELVRAVKEVVDVPVISGAGSNDTAHTVRMVEQTQEAGADAVLVVMPYYSRPSQDGIVGHYKAVDESAEKPIIVYDVPGRTGLKVKVGTYDRLAELEHVKAVKDATGDLAAAVEKQQRTGLAWYSGDDGLFLPFLSIGAVGIISVIAHVASNPMQQLVQAFDRGDITTARRLANQLAPLVHALNGDGYQAVMAKAALKVKGVIPSTTMRLPNIGPDATQLDKAEEGMRAAGLL

SEQ ID NO: 38416 - protein, 461 aa, Burkholderia thailandensis E264
MVSDQDNDSLKRGLKNRHIQLIALGGAIGTGLFLGIAQTIQMAGPSVLLGYAIAGVVAFFIMRQLGEMVVDEPVAGSFSYFANKYCGHFTGFLSGWNYWVLYVLVSMAELSAVGIYVQYWWPGVPTWISALVFFVAINAVNLASVKSYGETEFWFSIIKVAAIVGMIGFGGYLLLSGHAGPDAGVANLWRHGGFFPNGIGGLAMAMAVIMFSFGGLELVGITAAEADDPSHSIPRATNQVIYRILIFYIGALGVLLSLYPWQKVVTGGSPFVLIFHALSSDVAANVLNVVVLTAALSVYNSCVYCNSRMLYGLAQQGNAPRALARVSRRGIPIAALGVSAFATALCVVINYFMPGKAFELLMGLVVSAIIINWAMISVIHLRFRQAKRASGETTRFKSLGYPLTNYLCLVFMAAILVVMFRTPDLRLSVYLIPVWLVVLALGYRFRQRGAGYALGEGVSAR

SEQ ID NO: 38417 - protein, 507 aa, Arabidopsis thaliana
MAMASLARRKAYFLTRNLSNSPTDALRFSFSLSRGFASSGSDENDVVIIGGGPGGYVAAIKASQLGLKTTCIEKRGALGGTCLNVGCIPSKALLHSSHMYHEAKHSFANHGIKVSSVEVDLPAMLAQKDNAVKNLTRGIEGLFKKNKVTYVKGYGKFISPNEVSVETIDGGNTIVKGKHIIVATGSDVKSLPGITIDEKKIVSSTGALSLSEVPKKLIVIGAGYIGLEMGSVWGRLGSEVTVVEFAGDIVPSMDGEIRKQFQRSLEKQKMKFMLKTKVVSVDSSSDGVKLTVEPAEGGEQSILEADVVLVSAGRTPFTSGLDLEKIGVETDKAGRILVNDRFLSNVPGVYAIGDVIPGPMLAHKAEEDGVACVEFIAGKHGHVDYDKVPGVVYTHPEVASVGKTEEQLKKEGVSYRVGKFPFMANSRAKAIDNAEGLVKILADKETDKILGVHIMAPNAGELIHEAVLAINYDASSEDIARVCHAHPTMSEALKEAAMATYDKPIHI

SEQ ID NO: 38418 - protein, 541 aa, Oryza sativa (japonica cultivar-group)
MSAAHLLRHSRKLRSLHNALDCERSGLVRYFSTASGSFPTKGNGAEKRIGGARFPQRKQPGKELETSKLSLGLNGSYTCRRSPNNFIPNTITGLNGSLSCGQIASARSFSSSADLPPHQEIGMPSLSPTMTEGNIARWLKKEGDKVSPGEVLCEVETDKATVEMECMEEGYLAKIIHGDGSKEIKVGEIIAVTVEEEGDIKKFKDYKPSTLAAPVAPSELKAQSEPTEPKVEEREPSKASELKAPRTEEPSRSGDRIFSSPLARKLAEDNNVPLSSVKGTGPDGRILKADIEDYLAKGCRKEALAAPGLSYTDVPNAQIRKVTANRLLSSKQTIPHYYLTVDTRVDNLIKLRGELNPLQESSGGKKISINDLVIKAAALALRKVPQCNSSWMNDFIRQYHNVNINVAVQTEHGLFVPVIRDADKKGLGMIAEEVKQLAQRARDNSLKPDDYEGGTFTISNLGGPFGIKQFCAIINPPQSAILAIGSAERRVIPGSANGQYEFGSFMSATMSCDHRVIDGAIGAEFLKAFKGYIENPTSMLL

SEQ ID NO: 38419 - protein, 372 aa, Nocardioides sp. JS614
MTIQTVPPAAAPLLALTPGAPAPRVAVITGSYGAGHNSAAREIARVLTTAGCEVAIHDVVTLLPWRIGPILRRVYYAQLRRRPNSWGTTLRLLEPGRAAHRLVTWLLAFAAAPVVEATRGCDLVVTTHPFGAQALGHARTTGDLAVPAVTYLTDTSVHPLWIHPRVDLNLAIHDVAAAEARRWGGRTDVVRPLIPTRREAPAPIHGEPRAADITGPWALVTGGSLGMGQLAATARDILEDGQMTPVVLCGTDDRLRRRLARIPGVVALGWRDDIPDLMAACDCIVQNAGGFTSLEALASGKPVITYRPLPGHGVANSANLEAAGLIPWARTPEELAVWMAGAQVAPRHNRLPMDAPDLLDVLTGRHAATVAA

SEQ ID NO: 38420 - protein, 666 aa, Bacillus cereus G9241
MSHSIEQLSINTIRTLSIDAIEKANSGHPGMPMGAAPMAYTLWTQFMKHNPNNPTWFNRDRFVLSAGHGSMLLYSLLHLSGYDVTMDDLKNFRQWGSKTPGHPEYGHTAGVDATTGPLGQGIATAVGMAMAERHLAAKYNRDAYNVVDHYTYAICGDGDLMEGVSAEASSLAAHLQLGRLVVLYDSNDISLDGDLNRSFSESVEDRYKAYGWQVIRVEDGNDIEAIAKAIEEAKADEKRPTLIEVRTTIGFGSPNKSGKSASHGSPLGVEETKLTKEAYAWTAEQDFHVAEEVYDNFRKTVQDVGETAQAEWNTMLGEYAQAYPELANEFQAAMNGQLPEGWEQNLPTYELGSKAATRNSSGAVINAIAESVPSFFGGSADLAGSNKTYMNNEKDFTRDDYSGKNIWYGVREFAMGAAMNGIALHGGLKTYGGTFFVFSDYLRPAIRLAALMQLPVTYVFTHDSIAVGEDGPTHEPIEQLAALRAMPNVSVIRPADGNESVAAWRLALESTNKPTALVLTRQDLPTLEGAKDDTYEKVAKGAYIVSASKKETADVILLATGSEVSLAVEAQKALAVDGVDASVVSMPSMDRFEAQTAEYKESVLPKAVTKRFAIEMGATFGWHRYVGLEGDVLGIDTFGASAPGEKIMEEYGFTVENVVRKVKEML

SEQ ID NO: 38421 - protein, 412 aa, Triticum aestivum
  misc_feature (272)..(272): Xaa can be any naturally occurring amino acid
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDFLRINVDRGVMIGDGQSGFTINGKPIFHFVGTSTFSEYTVIHVGCLAKINPEAPLDKVCVLSCGISTGLGATLNVAKPKKGSTVAIFGLGAVGLAAMEGAKMSGASRIIGVDLNPAKYEQAKKFGCTDFVNPKDHTKPVQEFFPSPSTHIFTFVRSSXHAQSCAKNSMCNVALQVLVEMTNGGVDRAVECTGHIDAMIAAFECVHDGWGVAVLVGVPHKEAVFKTSPMNLLNERTLKGTFFGNYKPRTDLPEVVEMYMRKELDLEKFITHSVPFSQINTAFDLMLKGEGLRCIMRMDE

SEQ ID NO: 38422 - protein, 452 aa, Amylomyces rouxii
MSNIATLTSTARTKTESMKPPLPKTKMPPLFDQPVTSKNWTKFVNWPQAILLCVTPLIALYGIFTTELTKKTLIWSWIYYFITGLGITAGYHRMWSHRAYRGTDLLRWFMSFAGAGAVEGSIYWWSRGHRAHHRWTDTDKDPYSAHRGFFFSHFGWMLVQRPKNRIGYADVADLKADHVVAFQHKYYPYFALGMGFIFPTLVAGLGWGDFRGGYFYAGVLRLCFVHHATFCVNSLAHYLGESTFDDHNTPRDSWVTALVTMGEGYHNFHHQFPQDYRNAIKFGQYDPTKWKIIVLSWFGLAYELKQFPTNEVTKGRLFMEEKRIQAQKAKLSYGTPLKDLPIYTWEEYQSLVLNDNKKWVLIEGVLYDVEEFMKEHPGGMKYLSTAVGKDMTTAFNGGIYNHSNGTRNLLTSLRVGVLRNGMQVMTEADATASLYDDSLEFDSKAALFNKSK

SEQ ID NO: 38423 - protein, 369 aa, Thermosynechococcus elongatus BP-1
MSSSRKRLGVFTSGGDCPGLNTAIRAIVAHATLSYGWEVLGILHATQGLIERKAIPLNAEGLGGMDVLLNMGGTILGAINKGDTLGHADEVIAGYYELGLDALIAICGDGSLRILHQLAQKGNWNFLAIPKTIDNDVALTDRAIGFDTAVNTVVEALNRITSTAASHDRVFVVEVMGRTAGHLALYSGIAGGADIILIPEIPYSIEGICQHLQKLRDRWGRQFALIVVAEGSKQLEEDANHPRHCSIGQYIADKIAQHSPIPIELRVSVLGHIQRGGAPMAMDRLLAAGMGNTAVDLAAQGTFGRMVAWQAGQVVTVPIADVVAKCPRHVDPNSFLIRTAQGLGIYVGDKPMLPYVDPTLCRDQVICAI

SEQ ID NO: 38424 - protein, 455 aa, Ruminococcus flavefaciens
MALKNQYLKELLERVEKRNPGEPEFIQAVTEVLETLQPVAEKRQDLIDAGVFERIVEPERQIIFRVPWVDDNGKVQVNRGFRVQFNSAIGPYKGGIRLHPSVYLGIIKFLGFEQVFKNSLTTLPMGGGKGGSDFDPKGKSDGEIMRFCQSFMTELSKHIGADCDVPAGDIGTGAREIGFMFGQYKRLRNEFVGVLTGKGLTYGGSLARTEATGYGLCYFTNEMLQANGKSFEGKTVVISGSGNVAIYATEKATQYGAKVVTVSGSNGYIYDPDGIELDLVKQIKEVERGRIKEYASRTSHKNAEYHEGSVWTLKCNAGGIKLDIALPCATQNEINGDGAKAIVANGGFAIAEGANMPSTPEAIETYLSNGLLYGPAKAANAGGVATSGLEMSQNSERLSWTFEEVDEKLHGIMKSIFKACDDAAKEYGMAGNYMAGANIAGFLKVAEAMKAQGCV

SEQ ID NO: 38425 - protein, 469 aa, Cryptococcus neoformans var. neoformans JEC21
MSPIALNQRTGVSTTHLKSSVAPTPISTAATSTYQLHHTVPNPVATKGDGMHFTLTTGETVLDAAAGGAAVSCLGNGNSEVIETMYEQAKKMAYTYHQSLDAEGSEKLAKWLCDRSEGALVAGAFLNSGSEAIEAAIKMARQYWVEAGKPERKYIIARFPSYHGNTLGALAIGNAPGRRDIYKPLISMNAFHHVTSPVYKRYAQPGETEEAYSARLADELEAKILELGPENVIGFFAEPVVGSALGVMPPPKGYFPAMDKVIKKYGTLFIMDEVMSGSGRVGQLFAHQAVGEGVKPDIVAIAKGLGGGYVSISGVFVGQRVADRVREGGQWKNSHTYQNHPINCAVAAKVMEIVERENLLQNVRERGEQILEELKEAAKGVPTIIDVRGKGLFIGVEFDGPSSLKPRFASRVKDQAFKNGLIVMGISGTIDGVEGETTIICPAYTVTKKQISEIVRLLVKSIKEVVEEL

SEQ ID NO: 38426 - protein, 377 aa, Oryza sativa (japonica cultivar-group)
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTSAEREIVRDIKEKLAYVALDYEQELETAKNSSSVEKSYELPDGQVITIGAERFRCPEVLFQPSMIGMEAAGIHETTYNSIMKCDVDIRKDLYGNIVLSGGTTMFPGIADRMSKEITALAPSSMKIKVVAPPERKYSVWIGGSILASLSTFQQMWISKDEYDESGPAIVHRKCF

SEQ ID NO: 38427 - protein, 455 aa, Legionella pneumophila str. Lens
MALLSFLKPAPYLDEIQDKNIVKRQYRYWRIRTFYAMYIGYALFYFTRKSFTFVMPALQSTLGMTKTELGMIASILSLSYGISKFLSGILGDKSNPRYLMAIGLILTGVFNILFGLSSTWWLFAIFWGLNGWFQGWGWPGCTKLLTHWYSQSERGRWWSLWNTSHNVGGALIPLIVAVCAQYFGWRSAMFVPGIICILGGIFLINRLRDTPQSLGLPAIEQYHEDCSGSANHHQEKTELSVKEILWNYVLCNQYIWILSISYLFIYIVRTAINDWSMLYLTEVKEYSLITAGSCVIWFEVGGFFGNLVAGWSSDKIFQGKRNPINVLFTAGVFATLLLFTLTRAYTPFLDALFLFFFGFFIFGPQMMIGMACAELAHKKAAATATGFAGFFAYCLGAVLAGAPLGAIIKNYGWDNFFITLFICCLIPLFLMLPLWHVKVNPKYRQSEFSGKSEFA

SEQ ID NO: 38428 - protein, 380 aa, Aspergillus nidulans FGSC A4
MNFMNSTFSSTTPETYWDHYDDISAHSSHLNVAERLWAAWYAWMQNDVLATGIMSFVMHELVYFGRSLPWILIDTLGFFKNYKIQSSKIPSLREQWDCAKFVLLSHFTVELPQIWLFHPMAQFFGLSTSVPFPSFWTMAYQIAIFFVMEDTWHYFSHRALHWGPLYKAIHKIHHQYSAPFGMAAEYASPIEVMILGFGTVGCPIVWCAATGDLHIFTMPLMHTVGMSSHGVYTTFFLFGLEQIITTFTTRSSLATTPAVSGGGIMFWTQSTVPRRSGGGGITRRSAVRRKPNNAIVLEVSWNGINMSIVTPLARSTSPDMLIWDRGIPRHIDSPTAHRLGEVPGLEEPPRFSFDYIGHSSSFNNPLWDWNPYPVNGADLS

SEQ ID NO: 38429 - protein, 343 aa, Vibrio sp. Ex25
MKIKALSKLKPEEGIWMTEVDKPEVGHNDILIKIKKTAICGTDVHIYNWDEWSQKTIPVPMVVGHEYVGEVVAIGQEVRGFEIGDRVSGEGHITCGHCRNCRGGRTHLCRNTIGVGVNREGAFAEYLVIPAFNAFKIPDEISDDLASIFDPFGNAVHTALSFDLVGEDVLITGAGPIGIMAAAVAKHVGARHVVITDVNEYRLELARKMGVTRAVNVAEEKLEDVMAELGMTEGFDVGLEMSGNPAAFNSMLTTMNHGGRIALLGIPPSDMGIDWNQVIFKGLVIKGIYGREMFETWYKMASLIQSGLDLSPIITHHYKIDDFQEGFDVMRSGMSGKVILDWE

SEQ ID NO: 38430 - protein, 426 aa, marine gamma proteobacterium HTCC2080
MNRSEALFERAKNTIPGGVNSPVRAFKAVGGTPRFMERSDGAYIWDADGQRYIDYVLSWGPMIMGHNHPEVREAVIKAAETGLSFGCPTEIECEVAELIIDYVPSVELVRMCSSGTEATMSALRLARGATGRDKIVKFEGCYHGHSDSLLIKAGSGALTFGVPSSPGVPEVLAQHTITLPFNDIEALGVAFEEMGSELACVIIEPITGNMNCILPEPGFLETLRELCTQHGVILIFDEVMTGFRFGTQCAQGWLGITPDLTCFGKVIGGGMPVGAFGGRRDIMEHISPLGPVYQAGTLSGNPVAMAAGLTCLKIIGRDGFYDTPFRHTQELVKGMQGAADKAGVPFTTNHAGTMFGGFFTEEPKVTRYEQVINSDTERFSQFFHSMLESGVYLAPASFEAGFMSSAHSDADIEATIHAATKAFSSL

SEQ ID NO: 38431 - protein, 247 aa, Brassica napus
HASAHASGRTRRREMSTGMGSGKGKSRPSPSDPSILVSDKINAREKYALIPDRFTSLDQSNEWSGKTSFNGKSLHALGRIQNPYEKAIFVIGQTLAPFDEDNLIPCFGFGDSTTHDEEVFSFHSDNSPCHGFEEVLACYKRITPNLILSGPTSYGPLIDAAVDIVEKNNGQFHVLVIVADGQVTRGFDKAEGELSQQERATIDAIVNASSYALSIVLIGVGDGPWEDMRKFDDKIPKREFDNFQFVN

SEQ ID NO: 38432 - protein, 132 aa, Triticum aestivum
VTLQNKFVQKSRLVPVRNSRDIVDPRVRLGAPAVSAYCATWDASKPLSWRSKYGWTAFCGPAGAHGQASCGKCLQVTNPATGAQITARIVDQCANGGLDLDWDTVFTKIDTNGIGYQQGHLNVNYQFVDCRD

SEQ ID NO: 38433 - protein, 203 aa, Solanum tuberosum
MEFWGAEVKSGEPLTVQPGDGMVLHLSQASLGELKKDKSESVCLSVNIDGKKLVLGTLNSEKVPQQQFDLVFDRDFELSHNLKSGSVYFFGYKATNPFEEEEDDEDDYDESDEDIPLTLANSGKPEPKEAGKSNAGKDSASGKQKVRIVEPTKDDEDESSDDDDSELGEDEDDSDDSEEETPKKAEPAKKRKADSATKTPVTD

SEQ ID NO: 38434 - protein, 227 aa, Oryza sativa (indica cultivar-group)
MAIARTGVYVDDYLEYSSTLAGDLQRILSTMRELDERAHGIMGQTKEQIKYLLGVPSHGFDRSNMDDDESASERMKKDIEASQDNALSLCTEKVLLARQAYDLIESHIKRLDEDLGQFAEDLKQEGKIPPDEPSILPAISAFSRDDKRRPGFSTPQATKKFREREWDRERGMDFDLMPPPGSNKKTTAPMDVDQTIDPNEPTYCICHQISYGDMIACDNDNVVLEKL

SEQ ID NO: 38435 - protein, 469 aa, Corynebacterium diphtheriae NCTC 13129
MFSVFDLKKIPNKGIPLEQQRKMWLGQFLKAFFVVFFVYMSMYFIRNNFKAAQPMLKEDFGLTTLQLGYIGLAFSITYGIGKTLVGYFVDGHNSKRIISTLLICASTMVLLMGLLLSYFGSVIGIFIVLWGLNGLFQSAGGPASYSTISRWAPRTKRGKYLGLWNASHNVGGALAGGLALWGANVFFGGNVVGMFIFPALIGLTIGIIGLFVGKDDPEELGWNRSEEIFGEAVEAENSQAETMPQREIFLNYVLKNPWLWTLCIANVFVYIVRIGIDNWAPLYVTEELHFDKGDAVNTIFYFEIGALVASLLWGYVSDLLKGRRAIVAIGCLFMIYFAVMLYRNASSVTMVNLSLFILGALIFGPQLLIGVSLVGFVPKRAISVANGMTGTFGYLFGDSMAKVGLAAIADPEQKGLTVFGHLLHGWGAVFTVFYFALTIGIVLLMIVAVGEERRIRKLQAAEAVGKALA

SEQ ID NO: 38436 - protein, 443 aa, Yarrowia lipolytica CLIB122
MLLRRVVHNTSSIRFYSSMTLQPLPKPARFAQTPKDVWSLINEAAAASEEASGKKVVNLGQGFFSYSPPQFAIDAAKKALDVPALNQYSPTRGRPSLLKAVSDAYSPYFGRTLDPASEIVITAGANEGMYAAFTAFLNPGDEVIVFEPFFDQYISNIELPGGKVVYVPLHPPKDSQHTSSAANWSLDIAEFEAAITPKTKMIVVNTPQNPTGKVFSKEELTQIGELAVKHNLIVLSDEVYDRLYFEPFTRIATLNEALARLTLTVGSAGKIFAATGWRVGWLIGNPDLIKYVAAAHTRICFCVNSPLQEASAQALIQAQTNSYYDDTIASIKKKHELLNSAFEYLGLPYSQAQGGFFVLVNFSKVKIPADYAFPSDLDGRAKDFRTAYWLIKEVGVVAIPPTEFFIPEHAHLAEDYLRFAVCKDDDLLEEAVERLKGLKKYIE

SEQ ID NO: 38437 - protein, 462 aa, Deinococcus radiodurans R1
MSVRRLRWREGGPMTNPNAHTLPIIVVGAGMTGLAAAWELQQRGVPYVLLEAGDSFGGKVQSERTEDEFLVEKAADAFILGKPWALQLAQEVGLQDELIHPRAETKKLYFLRGGELLDFPQNLKMFVPLDDESFLQSGVLSPEGLRRMLDEQNVPPKENTDEDESLADFIIRRFGAEAMNFIVPLAAGIYVANPFELSMKAAFPQFLALEQKYGSVIKGSRATPRAQGPIFGSFKDGMSTLANAVAAKLTGDVRLNTPVLAVHPDGVTLTGGEKIAASGVVLTAPAWVAAPTLGQSFPAASALVGELQTNGSVAVILAYREGQFPRDMHLHGLQVAADEGIEMKAITVHSAKLHGRAPEGHVLLRVFFKDLDPQKALAEAVHEVARLFGAQGDPLWHAYADWRGKNPAYQVGHLDHIARIRAALPPNIQVAGSSYTGVGIPDCVNAGRTAARDVVAALGVDG

SEQ ID NO: 38438 - protein, 695 aa, Oryza sativa
MEIVDKIAEPKEPLMVTGRKVQSLEAPIPIKASWKGKSSQQQQQQQQDEKDFPADGEESFLSLDSSDEGGRSSFSGASHPLEPIDMDLMKTVYVAIDEEKSEQPVCLVRGVSAKGPFIDDLSICVTGMKANAVVGAGSADGLAEEMKVPGAAVPSLATARSSQATEAVSLPPDSEEKDCVWDASLPPSGNVSPHSSIDSMGVVTAMNTMSSCTSTYKSEAVSSEPVPTMERNCGSVKGSVRGDSLESAKTSMSRASDSSGVSDDSSWSNITGGASKPHKGNDPRWKAIHAVRTRDGVLGMSHFRLLKRLGCGDIGSVYLSGTRGTRCYFAMKVMDKASLARRKKLNRAQTEREILQLLDHPFLPTLYTHFETDRFSCLVMEFCPGGDLHTLRQRQAGKHFSEYAARFYAAEVLLALEYLHMLGVVYRDLKPENVLVRDDGHIMLSDFDLSLRCAVSPTLIRASAFDSDPRRAGGSFCVQPVCMEPTSVCIQPACFMPKLFGQKSKKKTKKTRSELGPSATTMPELVAEPTSARSMSFVGTHEYLAPEIIKGEGHGSAVDWWTFGIFLHELLYGKTPFKGSGNRATLFNVVGQQLRFPESPSTSYASRDLIKGLLVKEPQHRLGVKRGATEIKQHPFFEGVNWALIRCSTPPDVPRPVEAELPVKYGVAEAIGSNSKRMVGADMKSGGKYLDFEFF

SEQ ID NO: 38439 - protein, 748 aa, Salmonella enterica subsp. enterica serovar Paratyphi A str.
MLTRLREIVEKVASAPRLNEALNILVTDICLAMDTEVCSVYLADHDRRCYYLMATRGLKKPRGRTVALAFDEGIVGLVGRLAEPINLADAQKHPSFKYIPSVKEERFRAFLGVPIIQRRQLLGVLVVQQRELRQYDESEESFLVTLATQMAAILSQSQVTALFGQYRQTRIRALPAAPGVAIATGWQDATMPLMEQVYEASTLDTSLERERLTGALEEAANEFRRYSKRFAAGAQKETAAIFDLYSHLLSDARLRRELFAEVDKGAVAEWAVKKIIEKFAEQFAALTDNYLKERAGDLRTLGQRLLFHLDDSVQGPNTWPERFILVADELSATTLAELPQDRLAGVVVRDGAANSHAAIMVRALGIPTVMGADIQPSVLHRRTLVVDGYRGELLVDPEPVLIQEYQRLISEEIELSRLAEDDVNLPAQLKSGERVKVMLNAGLSPEHEEKLGSRIDGIGLYRTEIPFMLQSGFPSEEEQVAQYQGMLQMFNDKPVTLRTLDVGADKQLPYMPISEENPCLGWRGIRITLDQPEIFLIQVRAMLRANAATGNLSILLPMVTSIDEVDEARRLIERAGREVEEMIGYAIPKPRIGIMLEVPSMVFMLPHLANRIDFISVGTNDLTQYILAVDRNNTRVASIYDSLHPAMLRALSMIAQEAEKNGLDLRLCGEMAGDPMCVAILIGLGYRHLSMNGRSVARVKYLLRHIDFEDAQTLARRSLEAQMATEVRHQVAAFMERRGMGGLIRGGL

SEQ ID NO: 38440 - protein, 129 aa, Haemophilus ducreyi 35000HP
MAKVIHSENAPAAIGPYVQAVDLGNLVFTSGQIPVNPQTGEIATDIVQQTRQSLENVKAIIQQANLTVADIVKTTVFVKDLNDFAVVNAEYEAFFKANNHPAFPARSCVEVARLPKDVKLEIEAIAVRK

SEQ ID NO: 38441 - protein, 1119 aa, Glycine max
MTVMTPAPIDQQQEDEEMLVPHTDLAENNHQPMEVVAQPDAANTVESQPVEDPSTSRFTWKIDNFSRMNTKKLYSEIFVVGGYKWRVLIFPKGNNVDYLSMYLDVADSASLPYGWSRYAQFSLAVVNQIHNKYSVRKDTQHQFNARESDWGFTSFMPLGELYDPSRGYLVNDTLVVEAEVLVRRIVDYWTYDSKKETGYVGLKNQGATCYMNSLLQTLYHIPYFRKAVYHMPTTENDMPSGSIPLALQSLFYKLQYSDTSVATKELTKSFGWDTYDSFMQHDVQELNRVLCEKLERQKKGTVVEGTIQKLFEGHHMNYIECINVDYKSTRKESFYDLQLDVKGCPDVYASFDKYVEVERLEGDNKYHAEQYGLQDAKKGVLFIDFPPVLQLQLKRFEYDFMRDTMVKINDRYEFPLQLDLDRENGKYLSPDADRNVRNLYTLHSVLVHSGGVHGGHYYAFIRPTLSEQWYKFDDERVTKEDTKRALEEQYGGEEELPQTNPGFNNTPFKFTKYSNAYMLVYIREADKDKVICNVDEKDIAEHLRERLKKEQEEKEHKKKKKAEAHLYTIIKVARDEDLAEQIGKDIYFDLVDHDKVRSFRVQKQTSFNLFKEEVAKEFGIPVQFQRFWLWAKRQNHTYRPNRPLTHMEEAQSVGQLREVSNKVHNAELKLFLEVELGLDLCPIAPPDKTKDDILLFFKLYDPEKEELRYVGRLFVKCTGKPLEILTRLNKMAGYDPEEDIALYEEIKFEPNVMCEPIDKKVTFRTSQLEDGDIICFQKASSMDSEENARYPDVPSYLEYVHNRQVVHFRSLDRPKEDDFFLEMSRLFTYDDVVERVAQQLGLDDPSKIRLTPHNCYSQQPKPQPIKYRGVEHLSDMLVHYNQTSDILYYEVLDIPLPELQGLKTLKVAFHHATKDEVVIHTIRLPKQSTVGDVLDDLKTKVELSDPEAELRLLEVFYHKIYKVFPPNEKIESINDQYWTLRAEEIPEEEKNLGPHDRLIHVYHFNKDTAQNQMQIQNFGEPFFLVIHEGETLDEIKVRIQKKLQVPDDEFVKWKFAFFSLGRPEYLQDSDIVSSRFQRRDVYGAWEQYLGLEHTDNAPKRSYAVNQNRHTFEKPVKIYN

SEQ ID NO: 38442 - protein, 416 aa, Actinobacillus pleuropneumoniae serovar 1 str. 4074
MNHFNYKNQQLFAEDVSVSDIINQYGTPAYIYSRATLERHWHAFDKAFGAHPHLICFAVKSNSNIALLNVMARLGSGFDIVSQGELERVLAAGGEPSKVVFSGVAKSHSEIQRALEVGIRCFNIESIAELHRINEVAGQLGKIAPISLRVNPDVDAHTHPYISTGLKENKFGVSVTQAREVYRLAKTLPNVKITGMDCHIGSQLTELQPFLDATDRLIVLMEQLKEDGIELHHLDLGGGLGVPYNGEEPPHPTEYAKALLEKLKGYADLEIILEPGRAITANAGILVTKVEYLKANEDRNFAIVDTGMNDMIRPALYEAYMRITEVDQSLSREKAVYDVVGPICETSDFLGKDRELAIEQGDLIAMRSAGAYGAAMSSTYNSRPQAVEIMVDGDQAYLIKARASFADLWRLEKLLP

SEQ ID NO: 38443 - protein, 514 aa, Solibacter usitatus Ellin6076
MPSANLTTHAHSVPEILEKLHVEPVNSGACFGDWIAEPSGGELVSSSPATGEALARVRTAGPGDYETVMEFATAAFLEWRMLPAPKRGEIVREIGNELRAHKQHLGALVSLEMGKILPEGLGEVQEMIDICDFAVGLSRQLYGLTMHSERPGHRMYEQWHPLGVVGVISAFNFPVAVWAWNAMIAAVCGDCVLWRPSSETPLLAIAVQKIVNRVFDRHGLKGIFNLVIGPSNPIGEILVKDPRIPLISFTGSTEVGRRVAEVIAHRLGRSILELGGNNAIIVMDDANADLVLRAVLFGCVGTAGQRCTTTRRLFLQRGIAPRIREALTRAYGQVRIGHPLDEQTIMGPLVNRRAVDDMLDGLRRIREQGGEILYGGEALEGCYVQPTLVRARPDMPILKEEIFAPILYLIEFDHLDEAIHWHNDVPQGLSSAMFTTNVISSETFLSHRGSDCGIANINIGTSGAEIGGAFGGEKETGGGRESGSDAWKAYMRRQTNTINWSTQLPLAQGIEFKL

SEQ ID NO: 38444 - protein, 206 aa, Aspergillus nidulans FGSC A4
MAGTRNYDFLIKLLLIGDSGVGKSCCLLRFSEDSFTPSFITTIGIDFKIRTIELDGKRVKLQIWDTAGQERFRTITTAYYRGAMGILLVYDVTDERSFQNIRTWFSNVEQHASEGVHKILIGNKCDWEEKRAVTTEQGQQLADELGIPFLEVSAKNNINIEKAFYNLASDIKKGMDSSKPEQTGSQGVSIDNQASGLSGNAGGKCC

SEQ ID NO: 38445 - protein, 489 aa, Clostridium acetobutylicum ATCC 824
MSAELEKDKNGELKRSLKTRHMNMIAIGGSIGTGLFFTSGNTISTAGPGGAIAAYAIMGVLVYFLMTSLGEMATMIPNAGSFETYASKFVDPALGFALGWNYWFNWAITVAAELVAGGLVVKFWLPNTGTTIWSIGFLVILFGLNLLSAKAYGEGEYWFSSIKVVTIIVFLIMGVLIIFGIMGGHGVGFSNWVLKDGKGNSAPFVGGGMAILMSFLTAGFSFAGTEVVGLAAGEAENPEKDVPKAINSVFWRILIFYIGAIIVIGFIIPFNDSNLLKNGVSDIAYSPFTIVFKRSGIALAASIMNAVILTSVLSCGNSGLYAGSRMMYAMAKEGKAPKIFGKLNKSGVPLNALIFTSVIASTAFFASLIGDGKIYSILYNLSGITTFITWLGIAICHYRFRKAYIAQGNKIEDLKYKALLYPFGPIFAMILCTVVLFGANIWVFQAKTFSWFDFTTNYGSIPLFLCFYFIYKKVHKTRIVSLMECDLNK

SEQ ID NO: 38446 - protein, 478 aa, Candida albicans SC5314
MLRSASRISRHRLYQSLSSQINKQSARCYAAAASSGPENRPLVTPLGRHPQKYSTPAPGFGPTTFTEVLDDVNITWDKNDDPDRLEKQNTKIRHFTINFGPQHPAAHGVLRLILELHGEEIVRSDPHVGLLHRGTEKLIESKTYMQALPYFDRLDYVSMMTNELVFALAVEKLLNVEVPLRAKYIRTLFGEITRILNHCMSVLTHIMDVGGLTPFLWGFEEREKLMEFYERVSGARLHTAYFRPGGVSQDLPAGLLDDIYMWATQFGDRIDEVEELCTDNRIWKDRTIGVGVVSAEDALNYSLSGVMLRGSGIPFDIRKSQPYDAYDLVDFDIAVGINGDCYDRYLIRMAEFRQSLRIIFQCINDIPEGPVKVEDYKISPPSRSLMKEDMEALIHHFLLFTKGYAVPQGETYTAIEAPKGEMAVYVVSDGSERPYRCKIRAPGFAHLGAFDHIARGNLLADAVAIIGTMDLVFGEVDR

SEQ ID NO: 38447 - protein, 357 aa, Clostridium acetobutylicum ATCC 824
MKEYKVAVIPGDGIGVEIVGEALKVLEKVGAKYDTKFNFTEVKAGGCAIDEFGVPLPNETLEICKNSDAVLLGAVGGPKWDTLPGEKRPEKALMGLRGGLGLYANLRPAKVYDILKSASPLKEEIINKGVDLLVVRELTGGIYFGERGRDIQNGINSAYDTERYNVEEIKRIAHVAFKAALKRNKKVTSVDKANILESSRLWRETVTEVAKEYPEVELNYLYVDNAAMQLVREPSQFDVIVTSNIFGDILTDEASMVTGSIGMLPSASLRNDTFGMYEPIHGSAPDIAGQDLANPLAQILSVAMMLEYSFNMTEAARDVEDAVEKVLNSGYRTGDIYTEGSKKVGTKEMGKLVLAEL

SEQ ID NO: 38448 - protein, 292 aa, Xanthomonas campestris pv. campestris str. ATCC 33913
MSEDDSSQTSESPEKRRSWLERLSAAFSGEPHTRDELVALLRTAEQDGLIAADTLRMMEGAISVSELTVGDVMISRSQMVSLPVEARFLDLMKQVVESGHSRFPVHGENKDEVLGILLAKDLLRGVVADNGPGNVRELLRPAVLIPESKKLNVLLKEFRLSRNHMAIVVDEYGGVAGLVTIEDVLEQIVGEIDDEHDDAEEENSLIAIQADGRYVVDALTPIEDFNERFGADFPDDEYDTVGGLVTDAIGHLPETGEELTLGRFAFRVAKADARRVHAFHVTILPPDPQDDA

SEQ ID NO: 38449 - protein, 376 aa, Prunus cerasus
MAFTIRKKEILIDILVRLPTKSLVRFLCTCKSWSDFIGSSSFVSTHLDRNVTKHAHVYLLCLHHPNFECHVDPDDPYVKKEFQWSLFPNQTCEVFYKLSHPLGNTEHYGIYGSSNGLVCISDEILNFDSPIHIWNPSVRKLRTTPISTNINMKFSLVSLQFGFHPVVNDYKAVRMMRTNKGALAVEVYSLRTDSWKMIQAIPPWLKCTWQHHKGTFSNGVAYHIIEKGHIISIMSFNSGSEEFEEFIAPDAVCSSWRSCIEVYKEQICLLLDFYPCEEEGMEKFDLWVLQEKRWKQLCPFIYSSDYCYRTIGISIDNELLTARRGFDKGVADLCLCNYETNQLLETGIKLAIMRYGEIEFLFAITYIESLVLLNNH

SEQ ID NO: 38450 - protein, 127 aa, Corynebacterium diphtheriae NCTC 13129
MATIDVTEDTFEQTVTKDGIVLVDAWASWCGPCRAFAPTYEKASENHPDAVFTKLDTEANQGLAAALQIQSIPTLMVFRDGIMVYREAGALPPAALEDLITQVKGLDMEDVKRQIAEQNAQSDSAEL

SEQ ID NO: 38451 - protein, 390 aa, Prochlorococcus marinus str. MIT 9313
MATLLEQLSTMTVVVADTGDLDAIRKFTPRDATTNPSLILAAAQIPAYQSLIDEALHSSRQLLGNSAAVEEVVHEALDEICVIFGKEILKIVPGRVSTEVDARLSFNTEATIAKAHKLIGLYNDAGITNDRVLIKIASTWEGIKAAEVLEKDGIHCNLTLLFGFSQAVACAEAGVTLISPFVGRILDWYKASTGRDSYAGPEDPGVISVTKIFNYFKTYDYKTEIMGASFRNLDEIIELAGCDLLTISPKLLDQLGSTEAPLKRKLDAVNPVAAESQIHVDKESFESMMRADRMAFEKLDEGIRGFSKAIETLEAQLAHRLAVLEGGAAFCHVVQEIFMLNDLDGDGCITREEWLGSDAVFDALDHDHDGRLLQEDVRSGLGAALALTTA

SEQ ID NO: 38452 - protein, 171 aa, Prochlorococcus marinus str. NATL1A
MNLNPAFEFQFIYILDNAVLAWGLAACGLAQFSKLLFELIFKQRWRPSVLIETGGMPSSHSALVTGTAAGIGLQLGFNDPVFALASTIAFIVMYDASGIRRSAGLTAARVNQILKDNSNELSSETTLKESLGHTKIEVLIGSILGPIVALPGIFFIGSPLHILQMIGLVSL

SEQ ID NO: 38453 - protein, 444 aa, Bacillus cereus G9241
MARYTREDIFRLAKEENVKYIRLQFTDLLGVIKNVEIPVSQLTKALDNKMMFDGSSIEGFVRIEESDMYLYPDLDTWVIFPWTAEKGKVARLICDIYNADGTPFEGDPRNNLKRVLKEMEALGFSDFNLGPEPEFFLFKVDEKGNPTLELNDNGGYFDLAPMDLGENCRRDIVLELEEMGFEIEASHHEVAPGQHEIDFKYANAIRSCDDIQTFKLVVKTIARKHGLHATFMPKPLYGVNGSGMHCNLSLFKNGENVFFDQNGDLQLSDDARHFIAGILKHAPAFTAVANPTVNSYKRLVPGYEAPCYVAWSAQNRSPLVRIPASRGISTRVEVRSVDPAANPYLVMATLLAAGLDGIKNKLTPPAAVDRNIYVMTKEEREEAGIVDLPATLAQALVTLQSNEVVCGALGDHLLEHFIEAKEIEWDIFRTQVHQWERDQYMSLY

SEQ ID NO: 38454 - protein, 420 aa, Salmonella enterica subsp. enterica serovar Paratyphi A str.
MSLPHYYAETDLNAENLLRLPAEFGCPVWVYDAHIIRRQIAALQQFDVVRFAQKACSNIHILRLMRAQGVKVDSVSLGEIERALAAGYDPQTCPDDIVFTADVIDAATLARVSELHIPVNAGSVDMLTQLGQVSPGHRIWLRVNPGFGHGHSQKTNTGGENSKHGIWHSDLPAALAVMQKYRLKLVGIHMHIGSGVDYGHLEQVCGAMVRQVLECGQDLDAISAGGGLSIPYREGEEPVDTRHYYGLWNAAREQIARHLGHAVKLEIEPGRFLVAQSGVLVTQVRSVKQMGSRHFVLVDAGFNDLMRPAMYGSYHRISALAADGRALENGPWVETVVAGPLCESGDVFTQQEGGMVETRALPAVIPGDYLVLHDTGAYGASMSSNYNSRPLLPEVLFDNGQARLIRRRQTIEELLALEMF

SEQ ID NO: 38455 - protein, 344 aa, Magnaporthe grisea 70-15
MADSNNGPETEKVNTNIVTLTRFLTEEQAKHKEATGDFTLLCHALQFSFKAIAYYIRRATLVNLTGLAGSSNTTGDDQKKLDVIGNDLFIEAMRSSGKCALLVSEEEEEIIFFTNGNGSARYAVACDPIDGSSNLDAGVSVGTIFGIHKLAEGSTGSKEDILKPGSELLAAGFTMYGASAQLVLTMKNGGVNGFTLDNAFGEFILTHPDMRMPKSRAIYSVNEGNSLYWEDHVKEYFSSLKHPQEKSGKPYSARYIGSMVADAYRTLLYGGIFAYPADKKSPKGKLRILYECAPMAMVFENAGGQAIDSNMKRMLDVVPEHIHDRSGIFMGSWDEVEKVKAYHK

SEQ ID NO: 38456 - protein, 390 aa, Crambe hispanica subsp. abyssinica
MAMAAAVIVPLGILFFISGLVVNLLQAICYVLIRPLSKNTYRKINRVVAETLWLELVWIVDWWAGVKIQVFADNETFNRMGKEHALVVCNHRSDIDWLVGWILAQRSGCLGSALAVMKKSSKFLPVIGWSMWFSEYLFLERNWAKDESTLQSGLQRLNDFPRPFWLALFVEGTRFTEAKLKAAQEYAASSELPVPRNVLIPRTKGFVSAVSNMRSFVPAIYDMTVAIPKTSPPPTMLRLFKGQPSVVHVHIKCHSMKDLPESDDAIAQWCRDQFVAKDALLDEHIAADTFPGQQEQNIGRPIKSLAVSLSWSCLLILGAMKFLHWSNLFSSWKGIAFSALGLGIITLCMQILIRSSQSERSTPAKVVPAKPKDNHNDSGSSSQTEAEKQK

SEQ ID NO: 38457 - protein, 486 aa, Triticum aestivum
  misc_feature (136)..(136): Xaa can be any naturally occurring amino acid
MARVGGGDVEIGGLPAPAGDPRRRVVAADDSLDDDGKPRRTGTVWTASAHVITAVIGSGVLSLPWSVAQLGWVAGPVTLLLFAIITYYTSVLLGDCYRSEDAVTGKRNYTYMEAVGSLLGKGQVWFCGLCQYVNLXGTAIGYTITASISAAALYKANCFHSKGHSADCGVYTTMYMVVFGISQIVFSQLPTLHEMAWLSILAAVMSFSYATIGVGLSLAQTITGPTGKTTIGGTQIGVDVTSAQKIWLTLQALGNIAFAYSYSMVLIEIQDTVKAPPAENKTMRKANLMGVSTTTAFYMLCGCLGYSAFGNDAPGNMLTGFGFYEPYWLIDFANVCIVVHLVGAYQVYCQPLFAFVEKWAQQRWPKSGFITGEIQVPLVSSGFKLNLFRLTWRSAFVVATTVVSMLLPFFNDVVGFLGAIGFWPLTVYFPVEMYIVQKKIPRWSSQWVCLQLLSLACLIITIAAAAGSIAGIMSDLKVYKPFSTTD

SEQ ID NO: 38458 - protein, 443 aa, Cryptococcus neoformans var. neoformans JEC21
MSSDKFISNLFSLSLFDTPPTAMSFFKSRSASASTASLKPESLGPKTSEVFTVPPQESSVKKRWEYDDHQLGLIAQLKEYTKTIALPESDEYYPWEQRFLSDPATHARYMRAAKWKLHDGKHRIRGTMEWRREYKPELIQPDDVGVEAETGKIILTGFDMDARPILYMRPGRENTETSPRQIRHLIYHLERAIDLMPPGQEQVAIIVDYKSATSQSNPSIGTARKVLHILQNHYVERLGRGLVVNMPWWINAFFSGISPFMDPITRDKIRFNPRLLDLVPAAHLDSEFGGDYNFTYDYSVYWKTITEFCHIAPNGRRVPPPGKEEEGKGREGWIPPAGNGIKAAVEGYVPKEGTVKSGEIVKAGEKNEKSEKTGKGAAATSANGVAGAAPTASSTTAPAPPEKEMESLAIQTAPGEPIGGSVFDHPPSEGEVHEAKKSLNVSA

SEQ ID NO: 38459 - protein, 488 aa, Bacillus anthracis str. Sterne
MNSATNQTTSQTETTKGKGELRRGLKSKHLTMISLGGTIGTGLFLASGGVIHSAGPGGALIAYAAIGIMVYFLMTSLAELTAYMPVTGSFSTYATKFVDPSLGFALGWNYWYNWAITIAAELAAVTLIMKFWFPDTPSLIWSGLCLAIIFLLNYLSVKGFGESEYWFALIKVATIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFALCVIVILGQNYGAFMGESIDWNGVLVSYIGLPLFLVLWLGYKFTKKTKVIPLDKCELK

SEQ ID NO: 38460 - protein, 476 aa, Pseudomonas syringae pv. tomato str. DC3000
MPADKAGIIPRPTGYKCSNPFSSQFIPGDPLNEQQSARTSSVTLRPSACPGLLRIVPALDGGICRIKLAGGVITSAQALAVAQAAQTYAQGVIEATNRANLQIRGIGADHDGLIETLMAAGLGPANPASDDVRNLMLSPTAGLDPHMLFDARPLAAQILRALENHTRFQELSPKFALSLDAGEALVMLEHPHDVWLSALKTGDEVLLAFGLAGCPASDRPLAAVPPAAGEALVVALLELFLDLARPEHTRMRHLLAELSTDELLRQLSTRLSCPVRVDDAVTGWQRPAVQGNRHIGVYPQAQSGLVAVGAVVPLGRLTAPMLAAVAQLATDHGDGTLRLTPWQSLLLPNVPAERAAAVMAALQAAGLICSAEQPLAQIVACTGSAGCAKGLADTKADALQLASGLAVSQAVHLSGCTRSCAAAHVAPVTLLAVAPGRYDLYFRDATHSGFGVLRARDLTIEAVGAQLNADSRSSIA

SEQ ID NO: 38461 - protein, 319 aa, Nicotiana attenuata
MENFPIINLEKLNGSEKAATMEMIKDACENWGFFELVNHGIPHEVMDTVEKLTKGHYKKCMEQRFKELVASKGLEGVEAEVTDMDWESTFFLRHLPVANISEVAGLDDQYREVMRDFAKRLENLAEELLDLLCENLGLENGYLKNVFYGSKGPNFGTKVSNYPPCPKPDLIKGLRAHTDAGGIILLFQDDKVSGLQLLKDGQWIDVPPMRHSIVVNLGDQLEVITNGKYKSVMHRVIAQKDGTRMSLASFYNPGSDAVIYPAPALVEKEAAESKQVYPKYVFDDYMKLYAGLKFQAKEPRFEAMKSIESDVKLDPIATA

SEQ ID NO: 38462 - protein, 286 aa, Saccharum officinarum
MASTAAEAAREDAGAKQHGGTGKREEAANGQSKKAIVSYWGIEPPKLVKEDGTEWKWPCFRPWDAYTSDTSIDVKKHHAPTTLPDKAAYLIVKSLRVPMDLFFQRRHASHALLLETVAAVPGMVGGMLLHLRSLRRFEHSGGWVRALLEEAENERMHLMTFLEVTQPRWWERALVLATQGVFFNAYFVGYLLSPKFAHRVVGYLEEEAVHSYTEYLKDLEAGIIENSPAPAIAIDYWRLPADAKLKDVVTVVRADEAHHRDVNHFASDIHYQGMKLRDTPAPLGYH

SEQ ID NO: 38463 - protein, 307 aa, Saccharum officinarum
MADAKQQPQQAAAAAATTGVWKTVKPFVNGGASGMLATCVIQPIDMVKVRIQLGEGSAGQVTRNMLANEGVRSFYKGLSAGLLRQATYTTARLGSFRVLTNKAVEKNEGKPLPLIQKAFIGLTAGAIGACVGSPADLALIRMQADSTLPAAQRRNYKNAFHALYRITADEGVLALWKGAGPTVVRAMALNMGMLASYDQSVELFRDKLGAGEISTVVGASAISGFFASACSLPFDYVKTQIQKMQPDANGKYPYTGSLDCAVKTFKSGGPFKFYTGFPVYCVRIAPHVMMTWIFLNQIQKIEKKIGI

SEQ ID NO: 38464 - protein, 441 aa, Corynebacterium diphtheriae NCTC 13129
MLDAQQSPPLTRNQRLDRLPLNSQHKRLLVGSGLGWALDAMDVGLISFVMAALIKHWGLTHGQTSVLASAGFVGMAIGATFGGLLADKWGRRNVFALTLLVYGLATGASALAGGLAVLIVLRFIVGLGLGAELPVASTLVSEFAPLRHRGRLVVILEAFWAVGWILAAIIGAFVVSASDSGWRWALVLGCVPALYSAYVRSSLPESVRFLEARGRHDEAEAAVQQFEKASATIPDTPVIATEDPADQADSIFAPNMRRRTFGLWTVWFCINLSYYGAFIWIPSLLVADGFSLVKSFQFTLIITLAQFPGYALAAWLIEIWGRRTTLAVFLLGSAGSAALYGFADTTALIIAAGCCLSFFNLGAWGALYAISPELYPSQIRGTGTGSAAGFGRIASIIAPLIVPPIVAAAGTPALFALFGAAFLAAAIAAFTLPEQRGKALV

SEQ ID NO: 38465 - protein, 376 aa, Prunus cerasus
MTFTLRKNEILIDILARLPTKSLVRFLCTCKSWSDLIGSSSFVSTHLHWNVTKHARGYLLCLHHPDVERQADPDDPYVKQELQWSLFSNETFEECSKLSHPLGSTEHYMIYGSSNGLVCISDEILNFDSPIHIWNPSVRKLRTTSMSTNINIKFSHVALQFGFHPGVNDYKAVRMMRTNKNALVVEVYSLRTDSWKMIKAIPPWLKCTWQPFKGTFFNGVAYHIILKGPIFSIMSFDSDSEEFEEFIAPDAICHSWELCIDVYKEQICLLFSCYSCEEEDMEKVDLWVLQEKRWKLLCPFIYPLGYDYRPIGISIDNKLSMQRKDYTWGIADLHLCDYESKQVQETGIKLAIMKYDEIEFLFSITYIKSLVLLNND

SEQ ID NO: 38466 - protein, 375 aa, Prunus cerasus
MAFTLRKKEIVIDILVRLPAKSLLRFLSTCKSWSDLIGSSSFVSTHLHRNVTKHTHVYLLCLHHPNFERNEDPDDPYVEQEFQWSLFSNETFEECSKLSHPLGSTEHYVIYGSSNGLVCISDEILNFDSPIHIWNPSVRKLRSTPISTNINIKFSHIALQFGFHPGVDDYKAVRMMRTNKNAFAVEVYSLKTDCWKMIEAIPPWLKCTWQHHKGTFFNGIAYHIIEKGPIFSIVSFDSGSEEFEEFIAPDAICTSVGLWIDVYKDQICLLFKCYGCEEEGMDKVDLWVLQDKRWKQLCPFISSFDCCGPVGISVDNELLIEIRDFTSGVGHLHLCNYESRQVLDTRIKLAVMNYGEIEFLFSITYIESLFLLNNY

SEQ ID NO: 38467 - protein, 756 aa, Kluyveromyces lactis NRRL Y-1140
MTDQEVNEEQALRNIPEVGNFDKFTSVDWIEEEKRELSKGTSHDEFDIPRSSWYEYRRLIWKRGSSFITLTAIGLSIGGIAGFLQIFTELLVNWKSGHCARNWLLNKAFCCPKEEISKRSYGSIISSAGNAAEIFFKRSQSECIEKGIWVEATNPIFSFLLFMFLSVTFATISCLMVLHIAPFATGSGISEIKSWVSGFQYTPEFLNLKTLIVKSVALPLAISSDLSVGKEGPSVHYATCCGYVITNWLLSKEMAFPEQSEYLTASTAGGVAVAFGAPIGGVLFALEEMSASIPFKLSALWKSYYIALAGISALQYIDPSRNGKIVVFEVTYDREWHVEEIPIFILLGIFGGLYGKYISRWNVHYVSFRKKYLSRWPLQEVVILTFVTAIISYFNEFLKLDMTESMEILFHECQTNEKGSLWSHRLCTIDNEASFISFINLLLSLLFATVVRALLIVASYGCRVPAGIFVPSMAVGATFGRAVSLIVERYITGPNVITPGTYAFLGATAALSGITNLTLTVVVIMFEVTGAFTYILPTMVVVAFTRIICSSFGAEGGIADQMIIVNGFPLMEEQKGDHEFMDDFYADDIMTKELVYVNEKMTRQDLQNLIDGPAAEFSGLPITSSCSKGDSTCSGFILTKYARYFLDATTGSPDDIIDFRKCGDESLTSKINYTPITVSPSTPLSILFMMFQKLGCSTIIVENGGTMAGLVTKKDVLHFMRIKHKEYFGPLYAFDDRIDRKAIRLIEWYIDKCRRT

SEQ ID NO: 38468 - protein, 460 aa, Xanthomonas campestris pv. campestris str. ATCC 33913
MSERVVDPSVLRSLQQLDAAHHLHPFNDNAALASKGTRILTRGEGVYVWDADGNKLLDAFAGLWCVNLGYGRAELAQAAARQMEQLAYYNSFFQCTTEPTVHLAAKLAELAPGDLNHAFFANSGSEANDTILRLVRHFWAVQGQPQKHIFIGRHDGYHGTTMGGASLGGMRGMHRQGGLPIPGIEHIAPPNHFGEGGEMDPDDYGLLAARRLEEKILQLGPDTVAAFIGEPIMGAIGVYIPPRSYWPEIERICRRYDVLLVADEVICGFGRTGAWFGAEYFGFQPDVMTLAKGITSGYIPLAAAMFNDRVAGVLKRQGGELAHGGTYAGHPVCAAVALENLRLLQDEGIVDTARTQIAPYLAQRWAELGAHRLVGEARIAGLVGALELVPDKRRRGVYFPERGRVGALCRDFALRRGLILRATYDAMLLSPPLIITCEQVDELFDKTWAALDDTAQALGK

SEQ ID NO: 38469 - protein, 319 aa, Bartonella grahamii
DGDKGILLYRGYPIDQLAEKGDFLESCYLLLYGELPTQQEKNEFDRCIMQHTMVHEQFARFFHGFRRDSHPMAVMVACLGAMSAFYHDSIDITDPHQRMIASVRLISKVPTLAAMAYKYSIGQAFVYPRNDLSYAANFLRMCFAVPCEEYKTNPVLARAMDQIFILHADHEQNASTSTVRLAGSSGANPFACIAAGVACLWGPAHGGANEACLKMLQEIGSIERIPEFIARAKDKNDPFRLMGFGHRVYKNYDPRAKIMQKTCHEVLKELNIQDDPLLDIAIELEKIALSDEYFIEKKLYPNVDFYSGITLKALGFPTE

SEQ ID NO: 38470 - protein, 461 aa, Xanthomonas campestris pv. campestris str. ATCC 33913
MSIRTRSRKSTPKQPESALRRWLKERHITEVECLVPDITGNARGKIIPADKFSHDYGTRLPEGIFATTVTGDFPDDYYALTSPSDSDMHLRPDASTVRMVPWAADPTAQVIHDCYTKDGQPHELAPRNVLRRVLEAYAEVKLQPVVAPELEFFLVQKNTDPDFPLLPPAGRSGRPETARQSYSIDAVNEFDPILDLMYDYCDAMELDVDTLIHESGAAQLEVNFTHADALSRADQVFLFKRTMREAALRHGVYATFLAKPMETEPGSAMHIHQSLLHAGTGKNVFSGKREGGFSDTFAHYLGGLQKYIPMAMGLLAPNVNSYRRLMFGEVSPSNVLWGFDNRTCGLRVPIDAPQNMRVESRFAGSDANPYLAMAATLACGLLGIREKLEPTAPISSNGKEQGYDLPRSLGEALDELEGCEALKEMLGPRFVRAYISVKRKEYETFFRVISSWEREFLLLNV

SEQ ID NO: 38471 - protein, 818 aa, Thiobacillus denitrificans ATCC 25259
MDMSTPMGQGPKMKLVMVGNGMAGVRTLEELLKLAPELYDITVFGAEPHPNYNRILLSPVLAGEQTVDDIILNGADWYSENGIRLHLGQKVVRIDRAAREVETADGTRARYDRLLLATGSTPFILPVAGADLPGVVSFRDIADVDAMVDAAGRYKHAVVIGGGLLGLEAANGLMKRGMDVTVVHIGPWLMERQLDEPAARLLQRSLEEKGMKFLLQKHTAELVAGASGRVTGVRFKDGDAIPADLVVMAVGIRPNTELAESAGLHCNRGIVVNDTMQTFDPRIYSIGECVAHRGVAYGLVAPLFEQAKVCANHLAHYGIGRYQGSATSTKLKVTGVDLFSAGDFMGGEGTETILYSDPIGGVYKKLVIRDDKLVGGVMVGDTVDGAWYFSLLRDGKDIGALRDHLMFGQDHCGNLGHQGINRAAAMTDDMEVCGCNGICKGDIVKAIREKGLFTLEDVRKHTKASSSCGSCTGLVEQILAVTAGGDYSAAPKTKSMCGCTDHTHEAVRAAIREHRLLTIPQAMAFLEWRTPNGCASCRPALNYYLISTWPGEAEDDPQSRFINERAHANIQKDGSYSVIPRMWGGQTTPAELRRIAEVAEKYAVPSVKVTGGQRIDLLGVKKEDLPKIWADLDMPSGHAYGKALRTVKTCVGSEWCRFGTQDSTQMGIDLEKVFYKMWAPHKVKLAVSGCPRNCAEVAIKDVGVIGVDSGWEIYVGGNGGIKTEVAQFLVKVKTPDEVLEYSGAFLQLYREEARYLDRTVHYLERVGLDYVKKKVVDDAASRCALYERLLFALSVERDPWLERAQEGKLKHEFETISA

SEQ ID NO: 38472 - protein, 360 aa, Bradyrhizobium japonicum USDA 110
MSMKFDIQPASNPTPEKDRVAKLVDPGFGRVFTDHMAIVRYNQAKGGWYEARIEARANFQLDPAGAVLHYAQEIFEGLKAYKRDDGGVNLFRPDANARRFRDSADRMAMAQLPEDVFIEAVEQVVRIDRAWMPGGEGSLYLRPFMIASETFLGVKPSSEYIFAVIASPVGSYFKGGPAPVSIWVSENYTRAAVGGTGAVKCGGNYAASLRAQAEAIQHGCDQVVFLDAIERRYVEELGGMNIFFVFEDGSLSTPPLGTILPGITRDSIIALAKDAGKTVREEPYSLDQWRKDAASGKLKEAFACGTAAVISPIGKVRSVSGDFEISGGVAGPVAMGLRKQLVDIQYGRTNDPHNWIRKVF

SEQ ID NO: 38473 - protein, 894 aa, Thiobacillus denitrificans ATCC 25259
MSVVSSVCCYCGTGCGVLIEADAGVVTGVAGDPAHPANRGRLCTKGATLHLAAAAASGRARHPEFRRDRTSVRARAGWADALDHIAEKFRSVVAEHGPDAVAFYVSGQLTTEAYYVFNKLARGLVGTNNIDTNSRLCMSSAVAGYKATLGVDAPPGCYDDIEAAGTLFIAGSNTAYAHPILFRRIEAARRARPDLKLVVVDPRRTDTAAEADLHLAILPGTDVALFHAMLNVMLWEDRVDRAYIDAHTEGWTALRDLVRDYTPEKAAAICGVPAADIVTAARWFARGPTLSLYCQGLNQSTCGVDKNAALINLHLATAQIGKPGAAPLSLTGQPNAMGGREVGGMANLFSAHRELDNPEHRAEVARLWGVDALPGQPGKTAIEMFDAVRRGEIRALWIACTNPAQSLPDQARVREALAAAELVVLQDAYADTETAGFADVLLPAAAWGETDGTMTNSERRIARVRAAVPPPGEARADWEIVTDFARRLDPERGVRLFPYACAEDVFDEHRETTRGRDLDITGLSYARLDAGPQHWPFAEGAVEGRVRLYADGVYPTGSGRARFHAAPYRPVAEAIDARFPLHLNTGRLRDAWHGMSRTGRVARLFAHADAPRLAMHPRDLALRRLASGELVRVKSRRGEVVVEVEASEAVRPGQCFLPMHWGARFMSGLGANALTLPAFDAVSKQPELKHAAVQVARADLPWRMAAIAVGDGARLLDAVQPLLRACEYGAAGLAGRAHDVLTLRVGHAHPVPDELLAALDAALGLADPLTVMHYEDRPRGIAKRVRVEGGRVVAARLTGETAGFAWLRDLAVEGVDAQALRAWVLAPVAHPPAGGRVRGRVICNCFDVAEADIVAAADAGADLGALQAALKCGTECGSCVPELKRLLAASRAAA

SEQ ID NO: 38474 - protein, 151 aa, Neurospora crassa
MSTAARRRLMRDFKRMQTDPPAGVSASPVPDNVMTWNAVIIGPADTPFEDGTFRLVMHFEEQYPNKPPSVKFISEMFHPNVYATGELCLDILQNRWSPTYDVAAVLTSIQSLLNDPNTGSPANVEASNLYKDNRKEYHKRVRETVEKSWED

SEQ ID NO: 38475 - protein, 311 aa, Actinobacillus pleuropneumoniae serovar 1 str. 4074
MNYLASANETLSLYAQAISQLNQRLDGAFNQAVEMVLNCEGRVVVAGIGKSGLVGQKMVATFASTGTPSFYLHPTEAFHGDLGMLKPIDVVILISNSGETDDVIKLLPSLKSFGNKIIAMTGNPNSTLAQHANLILNIGVEREACPNNLAPTTSTLVTMALGDALAIALINARDFKAEDFARFHPGGSLGRKLLNRVKDVMQTKLPIAQPNADFSTILSVMNEGRMGVALIMQGEQLQGIITDGDIRRTLAQFGTDSLAKTAEQIMSKHPKTVSDNTYLAKAEEMMKELHIHSLIALNDEGKVSGIMEFSS

SEQ ID NO: 38476 - protein, 171 aa, Zea mays
  misc_feature (25)..(25): Xaa can be any naturally occurring amino acid
  misc_feature (164)..(164): Xaa can be any naturally occurring amino acid
MAPTVMMASSATAVAPFQGLKSTAXLPVARRSSRSLGNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKELQEAIKSYPDAFHRVIGFDNIKQTQCVSFIAXYKPPGSD

SEQ ID NO: 38477 - protein, 370 aa, Oryza sativa (japonica cultivar-group)
MSSGPPQRSKRWLYAIVISSIALLFIGIACMFLLCRNKSVATIGPWKTGLSGQLQKAFVTGVPKLQRSELEGACEDFSNIVASYPHYTVYKGTLSSGVEIAVVSTVIATNKDWSKHSEGRFRKKIDLLSRINHKNFINLLGYCEEENPFMRMMVLEYAPNGTLYEHLHVEGFDHIDWNGRMRVIMGVAYCIQHMHELNPSITHPDLHSSAILLSEDGAAKVADMSVWQEVISKGKMPKNDDIVDHHEPVSADPAGNVCSFGLLMLEIISGRPPYSEHKGSLANLAMECIKDDRNISCLLDPTLKTHKENELEIICELIQECIQSDPKKRPGMREVTTRLREVLAISPEAATPRLSPLWWAELEILSVEAT

SEQ ID NO: 38478 - protein, 436 aa, Haemophilus influenzae R2846
MAKIVKVIGREIIDSRGNPTVEAEVHLEGGFVGLAAAPSGASTGSREALELRDGEKSRFLGKGVLKAVAAVNNEIAQAIVGKDATNQAEIDQIMIDLDGTENKSNFGANAILAVSLANAKAAAASKGLPLYAYIAELNGTAGIYSMPLPMMNIINGGEHADNNVDIQEFMIQPVGAKTLREALRIGAEVFHNLAKVLKSKGMSTAVGDEGGFAPNLASNADALACIKEAVEKAGYVLGKDVTLAMDCASSEFYNKENGMYEMKGEGKSFTSQEFTHYLEELTKQYPIVSIEDGQDESDWEGFAYQTKVLGDRVQLVGDDLFVTNTKILKEGIEKGIANSILIKFNQIGSLTETLAAIKMAKDAGYTAVISHRSGETEDATIADLAVGTAAGQIKTGSMSRSDRIAKYNQLIRIEEALERAGTPAAFPGLKAVKGQA

SEQ ID NO: 38479 - protein, 298 aa, Deinococcus radiodurans R1
MMTGTQQPGTQPKVKVRLGENNYGKAEVQLMKIKRGTPRHELREAKVRVAMYGDFGAAHSEGDNTDLVATDTVRNTVYGLAKEGFESSIEEFGKELLTHFVKVGPRVTGGFAEFTEHLWERVQTPAQPQGHDHAFVRQMPKRTARVETQDGRRFTVTSGIEELYVLKTTESGWENYLLDERFTTLPETHDRVMATFVTAKWEYAVESCDYDAVWERVYRQIQHTFTDHYSPSLQRTLYLMGEAVLSVCPEISRIWFQMPNKHHLVYNLGRFGLENNNEILHVDPEPYGLMEAWVERAE

SEQ ID NO: 38480 - protein, 336 aa, Kluyveromyces lactis NRRL Y-1140
MSAEIPKAIKKLAKYLQDNPDVKVIFMVGAGISTSSGIPDFRSPETGLYHNLSKLNLPYAEAVFDIEYFEQNPKPFYTLAKELYPGNFKPSPFHYLMKLFESKNRLKRIYTQNIDTLEREANISDEFIIEAHGSFASNHCIDCGKEFPKEAFQNKLLLNEQETDEDGGNYATCDGCGGLIKPKIVFFGEGLPTEFFDTWDLDSSTKEKTVCIVCGTSLTVYPFASLPMEAPNSWLRVLLNREIVGDFKTSRQDTDLIFKGSADYAAFLLAQELCWLEDLENLSGKQFKPESKTKTKVHINKPEPEQQEKINTKEEEVLKEVTEEIALELNNLTIKE

SEQ ID NO: 38481 - protein, 800 aa, Triticum turgidum
MSWCCACKVLASPGPLHHFLGISPVSVYSICPLQGQIPPSLGNCFALRRLNLSFNSLSGAIPPAMGNLSKLVVMGISNNNISGTIPPFADLATVTVFSISSNYVHGQIPPWLGNWTALKHLDLAENMMSGPVPPALSKLVNLQYLDLAINNLHGLIPPVLFNMSSLDFLNFGSNQLSGSLPQDIGSILPKLRVFSVFYNKFEGQIPASLSNISCLEQVFLHGNIFHGRIPSNIGQNGYLSVFVVGNNELQATGSRDWDFLTSLANCSSLFIVDLQLNNLSGILPNSIGNLSQKLETLQVGGNQISGHIPSDIGKLSNLRKLFLFQNRYHGEIPLSLGNMSQLNKLTLSDNNLEGSIPATIGNLTELILLDLSFNLLSGKIPEEVISISSLAVFLNLSNNLLDGPISPHVGQLASLAIIDFSWNKLSGAIPNTLGSCAELQFLYLQGNLLNGEIPKELMALRGLEELDLSNNNLSGPVPEFLERFQLLKNLNLSFNHLSGPVPYKGIFSNPSTVSLTSNGMLCDGPVFFHFPACPYPVPDKPARHKLIHILVFTVAGAFILLCVSIAIRRYISKSRGDARQGQENSPEMFQRISYAELHLATDSFSVENLVGRGSFGSVYKGTFGSGANLSTAAVKVLDVQQQGATRSFISECNALKRIRHRKLVKVITVCDSLDHSGSQFKALVLEFIPNGSLDKWLHPSTEGEFLTPNLMQRLNIALDVAEALEYLHHHIDPPIVHCDVKPSNVLLDDDMVAHLGDFGLSKIIRAEESRQSLADRSSSVGIKGTIGYLAPGMMFPSYST

SEQ ID NO: 38482 - protein, 231 aa, Populus suaveolens
MVLAGSNSFSADKQESSLSSLLSDSSGSQQDSPCSNEKVLLAASRPKKRAGRRIFKETRHPIFRGVRKRNGDKWVCELREPNKKSRIWLGTYPTPEMAARAHDVAALAFRGKSACLNFADSAWRLPAPISNEAKDIRRAAGEAAELFRTSDLGGQVMEDFTTEGRGEVCSSSNDDIRDLPSENVSYIDEEAEFNMPWLLANMAEGLLLSPPHYTGDWNDGEIDADWSLWSS

SEQ ID NO: 38483 - protein, 269 aa, Triticum aestivum
MDVADIASPSGQQEQGHRTVSSEPPKRPAGRTKFHETRHPLYRGVRRRGRVGQWVCEVRVPGIKGSRLWLGTFNTAEMAARAHDAAVLALSGRAACLNFADSAWRMLPVLAAGSFGFGSASEIKAAVAVAVVAFLRKQIVLPVAVAVVALQQKQVPIAVAVVALQQKQVPVAVAVVALQKLPVPVAVAVVALQQQQIILPVACLAPEFYMSSGDLLELDEEQWFGGMEAGSYYASLAQGMLVAPPDERARPESGEQSGVQTPLWSCLFD

SEQ ID NO: 38484 - protein, 322 aa, Alteromonadales bacterium TW-7
MRRLPPVLLEDGCPRELLSLIRTILAACKEISFRVGQGALSGVLGSTLDENIQGETQKKLDVLSNQLLKDILLESGTVKAIASEEEDYTVAGNPDAKYIVAFDPLDGSSNTDINSLVGTIFSIMEAPEGSDAADESIFMQPGHKQVAAGYVLYGPSTMLALSTGKGTRMFTLDKTQGSFLLTEDFATIPADTNEFAINASNQRHWQPAMQNYINDLLEGDTGPRAKNFNMRWIAAMVGDVHRVLSRGGVFTYPTDTKDPNKPNKLRLLYEANPMAMLVEQAGGIASTGSERIMDIQPDAIHQRVAVILGSKNEVETCLGYHK

SEQ ID NO: 38485 - protein, 359 aa, Medicago truncatula
MLKSHKDWPEPIIRVQSLSEGCKDSIPDRYIKPPTDRPIVDTSSYDDINIPIIDLGGLNGDDLDVHASILKQISDACRDWGFFQIVNHGVSPDLMDKARETWRQFFHLPMEAKQQYANSPTTYEGYGSRLGVEKGAILDWSDYYFLHYLPVSVKDCNKWPASPQSCREVFDEYGKELVKLSGRLMKALSLNLGLEEKILQNAFGGEEIGACMRVNFYPKCPRPELTLGLSSHSDPGGMTMLLPDDQVAGLQVRKFDNWITVNPARHGFIVNIGDQIQVLSNATYKSVEHRVIVNSDQERLSLAFFYNPRSDIPIEPLKQLITPERPALYPAMTFDEYRLFIRMRGPCGKSQVESMKSSK

SEQ ID NO: 38486 - protein, 946 aa, Candida albicans SC5314
MISIVNGTSTLSLVAGSVETLNQAINFYTNILGLSVHSEQNDWTYLSNDDNKMIVKIQLDTKSGLSLDQINDRRTEIIAKLNITDWRSLDTTSVLKVQNLVALIETLTTFNYTLQITPNELYPNEVYCVDPLGYIIGFTACDEPLTLVPPLQKSHPKPGLVSNLMSKSGSQSRNIEETKAVRRNIAVMTSGGDSQGMNAAVRAVVRATIFHGSKAFAVQEGYAGLVKGGPEYIKEMKWQDVRGFLSEGGTNIGTARCMEFKERWGRLKGCKNLIDAGIDGLIVCGGDGSLTGADLFRHEWPSLIQELKDKGEITNEQFERHKHLYICGMVGSIDNDMAMTDATIGGYSALERICRAIDYIDATANSHSRAFVVEVMGRHCGWLALMAGIATSADYIFIPEKPASSKDWQDQMCDIVGKHRAQGKRKTIVIVAEGAITSDLKPITSDEVKDVLVDRLGLDTRITVLGHVQRGGTAVAFDRTLATLQGVEAVKAILELTPDVPSPLIAIDENKICRRPLVEAVRITKSVASAIEAKDFEKAMSLRDHEFKEHLANFMAMNTANHEKPTLPREKRKKIAIINIGAPAGGMNSAVYAMATYCMSRGHTPYAIHNGFAGLSRHESVKSIEWIDIEGWNSIGGSEIGTNRQTPEETDIGMIAHYFEKYQFDGLIIVGGFEAFVSLEQLERSRAMYPSFRIPMVLIPATISNNVPGTEYSLGADTCLNSLMEYCDIVKQSASATRGTAFIIDVQGGNSGYIATFASLISGAQASYVPEEGISLQQLEMDINSLREAFAVEQGMTKSGKLIIKSSNASKVLTPHTLADIFNDECHGDFDTKTAIPGHVQQGGLPSPIDRSRGDRFAIRAVQFIEDHCDVLAPYRYELDFPIDDKKILNTAAVLGIKSSRLRFTSIRHLFDFETELGRRMPKTIYWNTIRDISDQLVGRTRLDKP

SEQ ID NO: 38487 - protein, 522 aa, Triticum aestivum
MSSMQFSSVLPLEGKACISPVRREGSASERLKVGDSSSIRHERASRRMCNGGRGPAATGAQCVLTSDASPADTLVLRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKNKSIEHILILSGDQLYRMDYMELVQKHVDDNADITLSCAPVGESRASEYGLVKFDSSGRVVQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 38488 - protein, 173 aa, Oryza sativa (japonica cultivar-group)
MAAEGEKKMITLKSSDGEEFEVEEPVAMESQTIRHMIEDDCADNGIPLPNVNSKILSKVIEYCNKHVHAAAAAASKAADDAASAAAAVPPPSGEDLKNWDADFVKVDQATLFDLILAANYLNIKGLLDLTCQTVADMIKGKTPEEIRKTFNIKNDFTPEEEEEIRRENQWAFE

SEQ ID NO: 38489 - protein, 141 aa, Methanopyrus kandleri AV19
MSHVPLDPETARKVTSSLNYRFEIGGEPLVIAIAQDAENGDVLMTAFANEEAVYRTLTTGYAHYWSTSRREVWKKGEESGHVQRVVEVRVDCDKDAVLYVVEQEGGACHTGYRSCFYRRVTRDGSFEVVMDRVFNPDEVYR

SEQ ID NO: 38490 - protein, 906 aa, Mycobacterium bovis AF2122/97
MTELAELDRFTAELPFSLDDFQQRACSALERGHGVLVCAPTGAGKTVVGEFAVHLALAAGSKCFYTTPLKALSNQKHTDLTARYGRDQIGLLTGDLSVNGNAPVVVMTTEVLRNMLYADSPALQGLSYVVMDEVHFLADRMRGPVWEEVILQLPDDVRVVSLSATVSNAEEFGGWIQMVRGDTTVVVDEHRPVPLWQHVLVGKRMFDLFDYRIGEAEGQPQVNRELLRHIAHRREADRMADWQPRRRGSGRPGFYRPPGRPEVIAKLDAEGLLPAITFVFSRAGCDAAVTQCLRSPLRLTSEEERARIAEVIDHRCGDLADSDLAVLGYYEWREGLLRGLAAHHAGMLPAFRHTVEELFTAGLVKAVFATETLALGINMPARTVVLERLVKFNGEQHMPLTPGEYTQLTGRAGRRGIDVEGHAVVIWHPEIEPSEVAGLASTRTFPLRSSFAPSYNMTINLVHRMGPQQAHRLLEQSFAQYQADRSVVGLVRGIERGNRILGEIAAELGGSDAPILEYARLRARVSELERAQARASRLQRRQAATDALAALRRGDIITITHGRRGGLAVVLESARDRDDPRPLVLTEHRWAGRISSADYSGTTPVGSMTLPKRVEHRQPRVRRDLASALRSAAAGLVIPAARRVSEAGGFHDPELESSREQLRRHPVHTSPGLEDQIRQAERYLRIERDNAQLERKVAAATNSLARTFDRFVGLLTEREFIDGPATDPVVTDDGRLLARIYSESDLLVAECLRTGAWEGLKPAELAGVVSAVVYETRGGDGQGAPFGADVPTPRLRQALTQTSRLSTTLRADEQAHRITPSREPDDGFVRVIYRWSRTGDLAAALAAADVNGSGSPLLAGDFVRWCRQVLDLLDQVRNAAPNPELRATAKRAIGDIRRGVVAVDAG

SEQ ID NO: 38491 - protein, 613 aa, Alkaliphilus metalliredigenes QYMF
MCGIAGWIDYQRDLRDENPIIERMTASLGHRGPDTKSSYISKHGLLGHRRLIVVDPSGGAQPMTKRLGEKTYTMVYNGELYNTEDLRKELKDKGHTFNSYSDTEVLLVAYMEWGENCVQHLNGIYAFGIWNEVEKTVFLARDRLGVKPLFYNLKNGGLFFASEIKALLAHPEIDPVVTTEGLCEVFGLGPARSPGNGVFKDINEIKPGYCLTYTPQGVKIKSYWQLESKPHEDSLGDTIENVRGLLIDAIERQLVSDVPICTFLSGGLDSSAIASVTANAFKRDGRGQLHTYSIDYVDNDQYFKPSEFQPNADSEWIGRMVSHIDSKHHDIIIDTPQLTEALEAAVLSTDLPGMADVDSSLYLFCKNVKQNDTVALSGECADEIFGGYPWFRRREDIEANTFPWSKATTERRNILSGDLRKLPLEEYVATKYEETLREVPRMKGESLETHRMREIFYLNMKWFMITLLNRKDRMSMANGLEVRVPFADHRIVEYAWNIPWEMKYLGQREKGLLRSALKDILPEDVRTRKKSPYPKTHNPAYLKAVQQWMGEIMQDPSSPILQVINQEKVKEIVETGGKSFGKPWFGQLMTGPQLIAYLIQVNLWMKHYNVSIE

SEQ ID NO: 38492 - protein, 1000 aa, Euglena gracilis
KAKAKGVEIVLPVDFVTSSKFGEDGEIGTATLESGIPDGMLGLDCGPKTNALNAATIQASKTIIWNGPMGVFEMKKFEQGTKQMMDEIVKVTQQGATTVIGGGDTATACKVYGTEDKVTHVSTGGGASLELLEGKVLPGIAALTDASVAMMAVTGETSLNKLQLKDADVKGKRVFIRVDFNVPFDKKDPTKITNLARVQGALPTIQYCLENGAKSVVLASHLGRPDGKMPEKYSLAPVARALEGLISRPVTFLKDCVGPEVEAACDPAPGSVILLENVRFYAEEEGKGLDAEGNKVKASPEAVAAFPKSLAKVADVYVNDAFGTAHRAHSSMVGEGLPREASGFLVAKELDAFAKVLNNPVRPVLAILGGAKVSDKILLIENLLDKVDKMIIGGGMAFTFQKVLNNMAIGSSLYDEAGAKIVPEIMAKAKAKGVEIVLPVDFVTSSKFGEDGEIGTATLESGIPDGMLGLDCGPKTNALNAATIQASKTIIWNGPMGVFEMKKFEQGTKQMMDEIVKVTQQGATTVIGGGDTATACKVYGTEDKVTHVSTGGGASLELLEGKVLPGIAALTDASVAMMAVTGETSLNKLQLKDADVKGKRVFIRVDFNVPFDKKDPTKITNLARVQGALPTIQYCLENGAKSVVLASHLGRPDGKMPEKYSLAPVARALEGLISRPVTFLKDCVGPEVEAACDPAPGSVILLENVRFYAEEEGKGLDAEGNKVKASPEAVAAFPKSLAKVADVYVNDAFGTAHRAHSSMVGEGLPREASGFLVAKELDAFAKVLNNPVRPVLAILGGAKVSDKILLIENLLDKVDKMIIGGGMAFTFQKVLNNMAIGSSLYDEAGAKIVPEIMAKAKAKGVEIVLPVDFVTSSKFGEDGEIGTATLESGIPDGMLGLDCGPKTNALNAATIQASKTIIWNGPMGVFEMKKFEQGTKQMMDEIVKVTQQGATTVIGGGDTATACKVYGTEDKVTHVSTGGGASLELLEGKVLPGIAALTNA

SEQ ID NO: 38493 - protein, 171 aa, Oryza sativa
APPPLPPPLPFPPALALARAVAVAGEEEEGKARRFAELLMSSGVVMNSEVRWVTFHSGYDFGYLLKLLTGTYLPDTITGFFDLIRIYFPVVYDIKHLMRFCNSLHGGLNKLAELLDVERVGICHQAGSDSLLTALSFKKLKEAYFNGLTEKYAGVLYGLGTEGGETSSAAH

SEQ ID NO: 38494 - protein, 450 aa, Xanthomonas campestris pv. campestris str. ATCC 33913
MHDHPSSDAAHAMQTPAAMEAFWMPFTANRQFKARPRLLASAAGMYYRDVEGRQILDGTAGLWCCNAGHARERIVAAIRAQAGTLDFAPTFQMGSPLPFALAERLAALAPPGLGHVFFTNSGSEAVDSAMKIVLAYHRLRGEGQRTRFIGREKAYHGVGFGGMSIGGLPNNRKWFGPLLAGTDHLRHTLDLQRNAYSRGLPAFGVELADDLERLITLHDASTIAAVFVEPVSGSAGVILPPEGYLQRLRAICDRHGIVLVFDEVITGFGRVGEAFAAQRFGVTPDLITAAKGLTSGTVPMGAVLVADAIHDAFMHGPQAAIELFHGYTYSGHPLACAAALATLDTYAEEQLFTRAITLGPQWEEALHSLRGLPHVIDIRNIGLIGAIELAPREGAPGARGYEVFERCFHEGGLLVRVTGDVIALSPPLIVTPDQIGQMVETLAAILRKVD

SEQ ID NO: 38495 - protein, 534 aa, Coccidioides immitis RS
MASVAGNMASPSADASLASMASDPSSFVMGIYSRFTGWSALLALFMFLVAYDQIKYIWLKGSIVGPRFKIPFMGPFLESVNPKFTEYKAKWASGELSCVSVFHKFVVIASTRDMARKVFNSPAYVKPCVVDSAHKLLGKTNWVFLDGKEHVEYRKGLNGLFTRSALSVYMPQLDDVYEKYFKLFLEESKKNNFKPIPWMPYLRELMCALSCRTFVGHYMTEAAVKKIADDYYLITAALELVNFPIILPFTKSWYGKKAADMVLDEFSKCAAKSKVRMAAGGEVTCIMDAWIKQMLDSAKYREKIAKGIQVDDSEKPSHILRDFSDYEIAQTVFTFLFASQDATSSASTWLFQLMANRPDVLDKVREENLAVRNGDRNGKITMDLLDQLQYTRAVVRETLRYRPPVIMVPYMTKKDFPITPNYTLPKGCMIVPSVWPATHDPDAYPNPETFDPDRWISGDADKAAKNFLVFGTGPHYCLGQTYAQLNLMAMIGKASMMMDWEHHATPISEDIKVFATIFPQREPIRDIPTFVALL

SEQ ID NO: 38496 - protein, 302 aa, Panicum miliaceum
MADAKQQQAVAPSAAWMMVKPFVNGGASGMLATCVIQPIDMVKVKIQLGEGSAATVTKKMLANEGIGSFYKGLSAGLLRQATYTTARLGSFRVLTNKAVEANEGKPLPLLQKAVIGLTAGAIGASVGSPADLALIRMQADSTLPAAQRRNYKNAFHALYRIVADEGVLALWKGAGPTVVRAMSLNMGMLASYDQSVELFRDKLGAGELSTMLGASAVSGFCASACSLPFDYVKTQIQKMQPDANGKYPYTGSLDCVMKTLKSGGPFKFYTGFPVYCVRIGPHVMLTWIFLNQIQKFEKDMGL

SEQ ID NO: 38497 - protein, 519 aa, Thermosynechococcus elongatus BP-1
MSNKIEAIKKEKDGLAVKQELEKFAAMGWENIPEADRDVRLKWLGIFFRPVTPGRFMMRLRVPNGILTSQQLRTLGAIVDRYGENGNGDITTRQNIQIRGLPIEDIPEIIEQLQACGITSVQSGMDNVRNLTGSPVAGIDAAELIDTRPLIMKLQAMITNNGQGNPEFSNLPRKFNIAIEGGRDNSVHAEINDVAFVPAYRQGRLGFNVLVGGFFSARRCAAAIPLDAWVPPDDAVVQLSRAILEIFRDHGPRGNRQKARLRWLIDEWGIEKFRAAVVAKLPFELLSAAAKDEIDWDKRDHLGVHRQKQRRLNYVGLHVPVGRLYATDFYELARLAQVYGQSEVRLTVEQNVIIPHVPDAVLPSLLREPLLSKFRPEPPPLERALVSCTGAEFCNFALIETKNRALALARWLDQQLVLPQPVRIHWTGCPNSCGQPQVADIGLMGTKTRRNGETVDAVDLYMGGKVGKDAKLGTCVKKAIPCDELPEVLRQVLIEQFGAQPRGSERPPVATPAVAMMVS

SEQ ID NO: 38498 - protein, 119 aa, Deinococcus radiodurans R1
MSGHPGLTTHVLDTARGKPAAGVRVQLCRVTGDTRTPVTEAVTNSDGRTDAPLIERGSLKQGTYELTFHVADYFKGFVAAADPPFLDVVTLRFTVGDTSGHYHVPLVMTPWSYSTYRGS

SEQ ID NO: 38499 - protein, 449 aa, Bacillus cereus G9241
MISIGGVIGAGLFVGSGAVVHSAGPGSIVSYALAGLLVIFVMRMLGEMAAINPTSGSFATYAREAIGPWAGYTIGWLYWFFWVIVIAIEATAGAGIIQYWIPEIPLWLLSLILTILLTLTNVFSVKSFGEFEYWFSFIKVISIVLFLCLGLAVILGFVPGTEAPGTSNLVGQGGFMPNGISSVLLGITVVIFSFMGSEIVAVAAGESAEPVKAVKTATNSVIWRILVFFIGSIAIVVTLLPWNSANILKSPFVAVLEHIGIPAAAQIMNFIVLTAVLSCLNSGLYTNSRMLFSMAERGDAPKAFLKLNNSGVPVRAVLFGTFFAYIGVVFSYISPDKVFLFLVNASGGIALLVYLVIAVSHLNIRKKMGRVEQQNLKVKMWFFPYVTYVTIAAIIAVLIAMLAIESLRSQALLTMFVTVLIIISYFIFNRNKNSTVLNTKSKNEESIRF

SEQ ID NO: 38500 - protein, 245 aa, Bacillus anthracis str. Sterne
MIFVQQFEEVRTILEKAKKITVLTGAGASTESGIPDFRSANGLYADANVEMYLSRGYYNRSPKEFWKHYKEIFQINTFHQYKPNRGHRFLAELEEQGKDITILTQNIDGLHQVGGSKHVIDLHGTLQTAHCPKCKMGYDLQYMIDHEVPRCEKCNFILNPDVVLYGDTLPQYQNAIKRLYETDVLIVMGTSLKVQPVASFPQIAKREVGATTILVNEELTGQEYNFDYVFQNKIGEFVEGLSSIK

SEQ ID NO: 38501 - protein, 736 aa, Thermosynechococcus elongatus BP-1
MGTPQISALAVQSGPYLHHNHNTSERMQPTETVSSLCPYCGVGCGLEAVPQGKGTYKIRGDRQHPSSQGMVCVKGATILEAIDRDRLAYPLWRERLDHPFTVISWDEALTRLVERIQWVRHEQGADAICMYGSGQFHTEDYYVAQKLMKGCLGTNNFDANSRLCMSSAVSAYMASFGADGPPCCYDDLEATDCAFLIGTNTAECHPIVFNRLRNHHKRDRRVKLIVVDPRRTPTAEVADLHLAIRPGTDIDLLHGIGYLLLQWGHIDVDFIEKCTEGFADYVKLLAAYTPEWVAQRCGIPESDLEQAARYWGHAQAVLSLWSMGINQSAEGTAKARCLINLHLLTGQIGRPGSGPFSLTGQPNAMGGREAGGLSHLLPGYRQVTNPQHRQEVEDFWGLPRGQISDRPGRTAWQIIEGLEQGEVGLLWIAATNPAVSFPHLERTKAAFLKSPFTVYQDAYFPTETAAYAHLILPAAQWSEKTGVMTNSERRVTLAPAFRVPPGLARSDWEIFAEVGRRLGYGHLFSFADAAAVYAEFVQLTAGRPCDQSGLSHERLARLGALQWPCPASMDDEEARKPKRLYTDWRFHTPNQRAYFCLAHSQGVAEPTDHIYNFTLTTGRLYGHWHTQTRTGRIAKIQKMHPNPFVEMHPEDAANLHLQDGDWVEVRSRRGQVCLPVTLTKAIRPGTLFVPMHWGFLFADSGEVNQLTHPIACPVSKQPELKACAVQVLPLKLQQTS

SEQ ID NO: 38502 - protein, 944 aa, Triticum turgidum
MVETRPWLLRLLALLTTTTALLLSPSTSTSSSISTVDDLPALLSFKSLITMDPLGALSSWAINSSSNSSTHGFCSRTGVKCSRTHPGHVMVLRLQDLATVTVFSISSNYVHGQIPPWLGNWTALKHLDLAENMMSGPVPPALSKLVNLQYLDLAINNLHGLIPPVLFNMSSLDFLNFGSNQLSGSLPQDIGSILPKLRVFSVFYNKFEGQIPASLSNISCLEQIFLHGNIFHGRIPSNIGQNGYLSVFVVGNNELQATGSRDWDFLTSLANCSSLFIVDLQLNNLSGILPNSIGNPSQKLETLQVGGNQISGHIPTGIGRYYKLTMLEFADNLFTGTIPSDIGKLSNLRKLFLFQNRYHGEIPLSLGNMSQLNKLTLSDNNLEGSIPATIGNLTELILLDLSFNPLSGKIPEEVISISSLAVFLNLSNNLLDGLISPHVGQLASLAIIDFSWNKLSGAIPNTLGSCAELQFLYLQGNLLNGEIPKELMALRGLEELDLSNNNLSGPVPEFLERFQLLKNLNLSFNHLSGPVPYKGIFSNPSTVSLTSNGMLCDGPVFFHFPACPYPVPDKPARHKLIHILVFTVAGAFILLCVSIAIRRYISKSRGDARQGQENSPEMFQRISYAELHLATDSFSVENLVGRGSFGSVYKGTFGSGANLSTAAVKVLDVQQQGATRSFISECNALKRIRHRKLVKVITVCDSLDHSGSQFKALVLEFIPNGSLDKWLHPSTEGEFLTPNLMQRLNIALDVAEALEYLHHHIDPPIVHCDVKPSNVLLDDDMVAHLGDFGLSKIIRAEESRQSLADRSSSVGIKGTIGYLAPEYGMGTEISVEGDVYSYGVLLLEMLTRRRPTDPFFGDTTNLPKYVEMACPGNLLDIMDVNIRCNQEPQVTLELFAAPVSRLGLACCRGSARQRIKMGAVVKELGAIKRIIMASQNYASWSTVQ

SEQ ID NO: 38503 - protein, 200 aa, Triticum aestivum
  misc_feature (94)..(94): Xaa can be any naturally occurring amino acid
  misc_feature (118)..(118): Xaa can be any naturally occurring amino acid
MAIYIAREATKLWRKVCAETSVELQLLFEKWHLLLAGIVFQYIHGLAARGVHYLHRPGPILQDMGFMALPELGQDKGYLSETVFTCIFLSFLVXSFHPFVYHSKRFYTVLLWRRVLAXLVASQFLRIITFYSTQLPGPNYHCREGSKLATLPPPKNVLEVLLINFPRGVLFGCGDLIFSSHMIFTLVFVRTYHKYGSKRY

SEQ ID NO: 38504 - protein, 182 aa, Arabidopsis thaliana
MSENEVKDPRIDGIKTKIRVVPDFPKKGIMFQDITTLLLDPKAFKDTIDLFVERYRDMNISVVAGIEARGFIFGSPIALAIGAKFVPLRKPKKLPGQIIFEEYELEYGSDRLEMHVEAVDSGDRALVVDDLIATGGTLCAAMNLLKRVGAEVIECACVIELPELKGRERLEGKPLYVLVEYR

SEQ ID NO: 38505 - protein, 414 aa, Euglena gracilis
MPGSALGPKLSIDDLDIKDKNVLVRVDFNVPMKDGKILDDFRMRSALPTLEKVINSGGKLIIMSHMGRPAETGYEAKYSLKPIADHLGTLLGKPVTFAADCMDAAAEVAKLTPGDVLVLENLRFYPHEGSKDKDQRLEMAKKLASYADLYVSDAFGTAHRDAASMTGVPEVMGQGASGYLMKKEIDYFSKALKEPEKPVVAIVGGAKVSDKIQLLENMLKTVNQMVIGGAMAYTFLKAQGKSTGKSKCETEAETKKGKIDIVELAGKLLSKAKEQGVEIYLPVDHRCSAEFKDVEPVITSDENIPDDLMALDIGPKTEELYCSVDFAKAKTAIWNGPMGVFELEHFKPGTWAVARPLADHSDSCCSIVGGGDSERREKSGYAPKLSHISTGGGASLELLEGKVLPGLAILTDKP

SEQ ID NO: 38506 - protein, 111 aa, Brassica napus
FLIFLEKKLFGQGRGGKGLEKGGPKRLRKVLRNTFQGFTNPPIRLLPKKGGVNLFTGLIYKKTRGVLKIFLKNVIRNPVPSTDHPPRKTVTALAFVYPFKRQGRPLFGFGG

SEQ ID NO: 38507 - protein, 318 aa, Bartonella sp.
ITYIDGDKGVLLYRGYPIDQLAEKGDFLESCYLLLYGELPTKQEKNDFDRCIMQHTMVHEQFARFFHGFRRDSHPMAVMVACLGAMSAFYHDSIDITDPQQRMIASVRLISKVPTLAAMAYKYSIGQAFVYPRNDLSYAANFLRMCFSVPCEEYKTNPVLTRAMDRIFILHADHEQNASTSTVRLAGSSGANPFACIAAGVACLWGPAHGGANEACLKMLQEIGSVKRIPEFIARAKDRNDPFRLMGFGHRVYKNYDPRAKIMQKTCHEVLKELNIQDDPLLDIAIELEKIALNDEYFVEKKLYPNVDFYSGITLKAL

SEQ ID NO: 38508 - protein, 502 aa, Corynebacterium diphtheriae NCTC 13129
MFAYSTEAIRLSENPMIAAAQPDALMKQAAQAVAEAAVCMVPSASAAITVVAGTGGNGGDGLYAGAILAQLGYRVHAVLTGESAHAPALSAFVQAGGCVDKRAPRADLVIDAILGLGGTLGLRDAAWQIWQAATAGDPLILAVDVPSGIAADTGTAGEQHVVADATITFGAARIAHAVSAECGEVLIADINVPEAGGSLAAAIASHTPELQLYHAIERERYPWPEHFRRPEQLLIHESLEPSASHNKYSGGVVGVVAGSAHYPGAAVLTATAAVRATSSMVRYAGPCAREVVRACPEVVATDTLIDAGRVQAWAYGPGAGDTDALGDLLEREEPLVIDADGITQLAQEPALRELMHARNKSGRSTLLTPHEGEFWRLASCYGDAIPADDRVAAVRYLARETGCALLLKGRITTICVADTVTCVDARNSWAATPGSGDVLTGLLGAWIARNGLGSIALCVAVHATAAWLSAHTEYGLAPTSALRIANTIPQATALLSQGKKLR

SEQ ID NO: 38509 - protein, 252 aa, Oryza sativa
RKEASAMGASPSRPLEQSPSSSEGENHRVKYASYTTQGFRPHMEDALAVELDLDATTSFFGVYDGHGGAEVAMYCAKRFHTMLLEDVDYINNLPNAITSVCFRLDDDLQRSNEWRESLNPCANRNCLTNICANLHHFTEDYVPASYEGSTACVVIIRGNQIIVGNVGDSRCVLSKNGQAISLSFDHKPHHEAERERIQRAGGHVFLQRILGMLATSRAIGDFAYKQNRNMPPSQQMVTCVPDIRVVSVTMPF

SEQ ID NO: 38510 - protein, 556 aa, Clostridium acetobutylicum ATCC 824
MKTDIEIAQEAKMEPIVKIAEKIGLNEDDIDLYGKYKCKISLDVLKQNKNKQDGKLVLVTAINPTPAGEGKSTVTVGLGEALCKMNKNTVIALREPSLGPVFGIKGGAAGGGYAQVVPMEDINLHFTGDMHAITSANNLLCAAIDNHIHQGNSLKIDQRRIVFKRVMDMNDRALRSIVVGLGGKVNGFPREDGFMITVASEIMAILCLANDLMDLKERMGKILIAYDLDGNPVYCRDLKVEGAMAMLMKDAMKPNLVQTLENTPAIIHGGPFANIAHGCNSILATKMALKLGDYVITEAGFGADLGAEKFLDIKCRYGNLNPDCVVLVATIRALKHHGGALKEDLSKPNAKVLEKGLSNLGKQIENIKKYGVPVVVAINKFITDSEEEIKCIEEYCSKQGVKVSLTEVWEKGGEGGTDLANKVLDTLENEKSNFKYLYDEKLSIKEKMDIIAKEIYGADGVQYTPQANKQIKEIEKFNLDKLPICVAKTQYSLSDNPALLGRPTNFTINVKEVRVSNGAGFVVVQTGNIMTMPGLPKTPAANKMDIFEDGSIVGLF

SEQ ID NO: 38511 - protein, 248 aa, Oryza sativa (indica cultivar-group)
MAAAANGGGAALFSEEELRDVSGVRRCEDFVEVTCGCTSHRYGDAVGRLRVYASGDLEVSCECTPGCREGPLGSSSSVVPNAHKLTPSAFEKHSGRETAGKWRNTVWVMVQGEKVPLSKTALLKYYSLSHKSANGSNKGRNGRLSHRDEFIHCTECGKERRFRLRSKEECRIYHDALAKPNWTCADLTTDRVTCGDEEERASRKVLRGCSRSTSCTGCVKCVCFGCEICRFTDCGCQTCVDFYHNSKE

SEQ ID NO: 38512 - protein, 302 aa, Panicum miliaceum
MADAKQQQAVAPSAAWMTVKPFVNGGASGMLATCVIQPIDMVKVKIQLGEGSAATVTKKMLANEGIGSFYKGLSAGLLRQATYTTARLGSFRVLTNKAVEANEGKPLPLLQKAVIGLTAGAIGASVGSPADLALIRMQADSTLPAAQRRNYKNAFHALYRIVADEGVLALWKGAGPTVVRAMSLNMGMLASYDQSVELFRDTLGAGELSTMLGASAVSGFCASACSLPFDYVKTQIQKMQPDANGKYPYTGSLDCVMKTLKSGGPFKFYTGFPVYCVRIAPHVMLTWIFLNQIQKFEKDIGL

SEQ ID NO: 38513 - protein, 524 aa, Coccidioides immitis RS
MVGDPSTAKSQLLRFVLNTAPLAIATTGRGSSGVGLTAAVTTDKETGDRRLEAGAMVLGDRGVVCIDEFDKMSDVDRVAIHEVMEQQTVTIAKAGIHTTLNARCSVIAAANPIYGQYDTHKDPHKNIALPDSLLSRFDLLFVVTDDIEDTRDRLVSEHVLRMHQYRQPGTEEGAPVREQVNNSLGVGLEANENANVPTEVYEKYNAMLHAGITVTSGRGAGRKVEVVSLPFVKKYIQYAKSRIKPVLTKGAADHIVTTYSALRNDELTGNQRKTSPMTARTLETLIRLSTAHAKARLSNRVEEKDAKIAESILRFALFKEVVEDERRKRRKTTNVLDSDSDSSDSDDDADNTQRTTRGSTATAPRSSRRRGQQGRSRNTPDGDDEDEYAASLSSRPVGGSSRQTRSQATSQLDSQMSMASSQPASQLLQTQTDSTESQEEVIEKALAAASSLPPLPTERLNAFRSALGPLMRSDLFQGDSANVQRVVEAVNSSIRASSSSRSSVFELAEALQALNVMNDRNEVM

SEQ ID NO: 38514 - protein, 1010 aa, Oryza sativa (indica cultivar-group)
MVAARRSAASSSFFLLLLVLAVRVRASSDRVQERDRSALLELRGAAGLLGRWPTGSAVADHCSWPGVTCDASRRVVAVAVAAPPASGSSELAGELSPAVGLLTELRELSLPSRGLRGEIPAEIWRLEKLEVVNLAGNSLHGALPLAFPPRMRVLDLASNRLHGEIQGTLSDCKSLMRLNLSGNRLTGSVPGVLGSLPKLKLLDLSRNLLTGRIPSELGDCRELRSLQLFSNLLEGSIPPEIGRLRRLQVLDISSNRLNGPVPMELGNCMDLSVLVLTSQFDAVNLSEFNMFIGGIPESVTALPKLRMLWAPRAGFEGNIPSNWGRCHSLEMVNLAENLLSGVIPRELGQCSNLKFLNLSSNKLSGSIDNGLCPHCIAVFDVSRNELSGTIPACANKGCTPQLLDDMPSRYPSFFMSKALAQPSSGYCKSGNCSVVYHNFANNNLGGHLTSLPFSADRFGNKILYAFHVDYNNFTGSLHEILLAQCNNVEGLIVSFRDNKISGGLTEEMSTKCSAIRALDLAGNRITGVMPGNIGLLSALVKMDISRNLLEGQIPSSFKELKSLKFLSLAENNLSGTIPSCLGKLRSLEVLDLSSNSLSGKIPRNLVTLTYLTSLLLNNNKLSGNIPDIAPSASLSIFNISFNNLSGPLPLNMHSLACNSIQGNPSLQPCGLSTLANTVMKARSLAEGDVPPSDSATVDSGGGFSKIEIASITSASAIVAVLLALIILYIYTRKCASRQSRRSIRRREVTVFVDIGAPLTYETVVRATGSFNASNCIGSGGFGATYKAEIAPGVLVAIKRLAIGRFQGIQQFQAEVKTLGRCRHPNLVTLIGYHLSDSEMFLIYNFLPGGNLERFIQERAKRPIDWRMLHKIALDIARALGFLHDSCVPRILHRDVKPSNILLDNEYNAYLSDFGLARLLGNSETHATTGVAGTFGYVAPEYAMTCRVSDKADVYSYGVVLLELISDKKALDPSFSPYGNGFNIVAWACMLLQKGRAREFFIEGSNGTSEG

SEQ ID NO: 38515 - protein, 330 aa, Deinococcus radiodurans R1
MGSRRFVRGPLRAPGPYTVTVNVSAPDPSASVPARSGSGPRRAFLFADPAAHSLSPRMHRAAFAWAGLNGTYDAERVPAPELPTAMARLRAPDVLGANLSLPHKEAALPLLDGLSDAARAIGAVNTVIHRAGQLYGDNTDAPGLLQALAGSGLTGRLGAADRVVVLGAGGAARAAVYAGAVILGREVWVVNRTPARARALAAGWQGGGEVRAAGPGEVPWGQVGLVINSSSAGLDNPEETPLPGFDFGQLPAHAGVYDMVYKPRRTRLMRDAEAAGLPAENGLGMLAQQARLAFTAWTGVDVPVSVFLAALEAPATGRGAGDAARTEATR

SEQ ID NO: 38516 - protein, 556 aa, Actinobacillus pleuropneumoniae serovar 1 str. 4074
MKSDVEIAQAATMQPIHKIAEKLGLNADQIEQYGKYKAKINPTDAFKLPAKNGKLILVTAINPTPAGEGKTTVTIGLTDALNQLGKNAVVAAREPSLGPVFGVKGGAAGGGYAQVLPMEDINLHFTGDFHAITSANNLLAALLDNHIYQGNALNIDTKRVLWRRVIDMNDRQLRNVLGGLGNPTDGVIRPDGFDITVASEVMAIFCLAKDLADLKTRLGNILVAYTKDKQPVYAKDLNAHGAMAALLKDAIKPNLVQTIEGSPAFIHGGPFANIAHGCNSVTATRLALHLGDYAVTEAGFGADLGAEKFCDIKCRLADLKPDVAVVVATVKALKYNGGVEKANLAEENLTALQQGLPNLLKHISNLKNVFGLPVVVALNRFVSDTDAELALIQTACAKQGVEVSLTEVWGKGGAGGVDLAQKVLKAIDEQENRFNFVYDVNESVQNKIKAIAQKIYGADDVNFSAEALAEIKNLEKLGLDKLPICMAKTQYSLSDNAKLLGCPSGFTVTVRSISVSAGAGFIVAICGSIMRMPGLPKVPAANRIDVDENGLITGLF

SEQ ID NO: 38517 - protein, 247 aa, Desulfitobacterium hafniense Y51
MEGLLFPTLMGLVVGGSGIGLGGIVAFSLGKYFERISGIILANAAGVIFGLLAFELLPESIEIGGLIATGMGIIVGIFLIIRLEHFFHKVVIITNNPQKSMFIRSGILLAIGVAIHNLPVGFAMGSGLVNNGEMGMDLAIAMLLHNFPEGFAITLPLALSGLKPVSIPITAGIVALPAALGSFLGSSLGSINSTLLALLFGIAIGTIFSVTWHEILGHAIKNTRKVHLIPSVLTGLILGILFIRLIE

SEQ ID NO: 38518 - protein, 650 aa, Alteromonadales bacterium TW-7
MSNTTNKSSRRETRAAASEYIYNLTGQPFPNSQKVYVEGSQPGVRVGMREITLSDTFIGGTDENPVYESNEPLRVYDTSGPYTDPNFELDVRKGLPKFREQWIAGRNDTEVLDSVTSQFAQQRMADDGLDHIRFDHLPKIRRGKAGKNVTQMYYARQGIVTPEMEYVAVRENMGRAKIREELLAAQHKGESFGASIPDFITPEFVRDEIARGRAILPNNINHPETEPMIVGRNFLVKVNANIGNSSVTSSIEEEVEKMVWSTRWGADTVMDLSTGRYIHETREWVVRNSPVPIGTVPIYQALEKVNGVAEDLTWEIFRDTLIEQAEQGVDYFTIHAGVLLRYVPMTAKRVTGIVSRGGSIMAKWCLAHHKENFLYTHFEDICEILKQYDVCFSLGDGLRPGSIADANDEAQFSELRTLGELTQIAWKHDVQVFIEGPGHVPMHMIKANMDEQLAHCGEAPFYTLGPLTTDIAPGYDHITSGIGAAQIAWYGCAMLCYVTPKEHLGLPNKEDVKEGLITYKIAAHAADLAKGHPGAQERDNALSKARFEFRWHDQFNIGLDPERAREYHDETLPQESGKVAHFCSMCGPKFCSMKISQEVRDYANDLEERGIDPNNAGEAIEIKMIDVEAQMKAKSEEFKQTGSEIYHKAI

SEQ ID NO: 38519 - protein, 286 aa, Medicago sativa subsp. x varia
MSHFGRSGPPDISDTYSLLVLNITFRTTADDLFPLFDKYGKVVDIFIPKDRRTGESRGFAFVRYKYADEASKAVDRLDGRMVDGREITVQFAKYGPNAERIQKGRIIETSPRSKSSRSRSPSKRRHRDDYKEKDYRRRSRSRSYDRHERDRHRGRDRDHRRRSRSRSASPGYKGRGRGRHDDERRSRSRSRSVDSRSPVRRSSIPKRSPSPRRSPSPKRSPSPKRSPSPKRSPSLKRSISPQKSVSPRKSPLRESPDSRSRGGRSFTPRSPGASRSPSPRNSNGDE

SEQ ID NO: 38520 - protein, 218 aa, Pseudoalteromonas tunicata D2
MLKAVLFDCDGTLVDSESLHYQCWQHILVPYNIAYDEGHFCHLFSGKPTLEAAQFIIDEHGLTVDAKALAGQKNDYFADYVQNHLPPLLPYAKEVLSLAKQSSLQVALVTGSARAEVMPILAGYQLFDYFEVIVTKDDVTQPKPHPEPYLSALKQLGQAAQFGVAIEDTCTGLTSAKGAGLLAIAVPNHHSQHQDLSLADHTCTNLMQAWQRIELAQS

SEQ ID NO: 38521 - protein, 360 aa, Glycine max
MDLDDFRSVLDTAGVDVWMFIDAAIAVASADSAGELKRRRDGIVERLYAATAATPKCRICDDGGNDLNGHQIKKQSSPSPERQPHQRRAAAIAAAASPATPQSLENDNDGEEDLDPYGGLFDDEQKKILEIKEQLEEPDQSEDSLVELLQSLADMDITFQALKETDIGRHVNRLRKHPSNDVRRLVKLLVRKWKEIVDEWVKLNPQGRSNTLMADGDSPPVQKTTQNGHHHQQQIPDFAYSPNPHNGSSGSDRNNSEAEHKPKVVPRSEPRPKPAPSPSVSTPASATQNRQRDSNFDAERLASARRRLQENYKEAEIAKRQRTIQVMDIHELPKSKPKNNAFFGKNKGGGGGGGSQGRHW

SEQ ID NO: 38522 - protein, 326 aa, Gossypium hirsutum
MSTASINGWCLTSSSSTTTTSSFSARRRPTLRPSVVASLNSSPSPPTLIQDRPVFAAPIPLLTPREEMGNKSYDEAIEALKKLLSEKGELKAEAAARVDQITAELNTASADGKPSDSSVERLKEGFVYFKKEKYEKNPALYGELAKGQSPKYMIVACSDSRVCPSHVLDMQPGEAFVVRNVANMVPPYDQIKYAGIGSAIEYAVLHLKVQEIVVIGHSACGGIKGLMSFPFDGNNSTDFIEDWVKIGIPAKTKVLAEHGGEPLGVQCTHCEKEAVNVSLGNLLSYPFVRDGLVKKTLGIKGGYYDFVKGSFELWSLQFQLSSSLSV

SEQ ID NO: 38523 - protein, 525 aa, Oryza sativa
  misc_feature (224)..(224): Xaa can be any naturally occurring amino acid
MQKTSMNPVTDPVGVATGRVAIRQFPIKTQPNSQSLTPFLQLPPKPPPNLLFSSPLASVELRHRARARRRRRPSHPRRAPAMRMGKYEMGRALGEGHFGKVKLARHADTGAAFAIKILDRQRILAMKIDEQIKREIATLKLLKHPNVVRLHEVSASKTKIYMVLEYVNGGELFDKIALKGKLSEKEGRKLFQQLMDAVSYCHEKGVYHRDLKPENVLVDAKGNXKVSDFGLSALPQNQRKDGLLHTTCGSPNYIAPEVLLNRGYDGSLSDIWSCGVILYVMLTGNLPFDDQNTVVLYQKILKGDARIPKWLSPGAQDILRKILDPNPITRLDITGIRAHEWFRQDYTPAMPFDDDDDNNISDGNLHMTENQDIETSPAISQINAFQLIGMSSCLDLSGFFEKEDVSERKIRFVSNYSPTSLFEKIESTVTEKGFQVQKNSGKLKVIQVCKEPANPRGHGNLLISAEVFEINESLYVVELKRSSGDCSLYRQLCASLSEDLGICKRQQLLKKDSMRQDLCRYNSSF

SEQ ID NO: 38524 - protein, 433 aa, Pisum sativum
MVHSFKYILIGGGVSAGYAAREFVKQGVHPGELAIISKEAVAPYERPALSKAYLFPESPARLPGFHTCVGSGGERLLPEWYSEKGIQLYLSTEIVSADLAAKFLKSANGEHFDYQTLVIATGSAVIRLTDFGVIGANAKNIFYLREVDDADKLYEAIKRKKNAKAVVVGGGYIGLELSAVLKLNDLDVTMVYPEPWCMPRLFTSEIAAFYEGYYANKGINIIKGTVAVGFTANSDGEVKEVKLKDGRVLEADIVIVGVGGRPQISLFKGQVEEQHGGIKTDSFFKTSVPDVYAVGDVATFPLKLYNDVRRVEHVDHARKSAEQAAKVIFAADVRKSVEEYDYLPYFYSRSFDLSWQFYGDNVGETVLFGDNDPASSKPKFGTYWIKEGKVVGAFLEGGTPDENKAIAKVARAKPAVEDVNQLAEEGLSFASKI

SEQ ID NO: 38525 - protein, 268 aa, Alkaliphilus metalliredigenes QYMF
MDTSGLLFAFTITTLAGLCTGIGSLIALFTTKTNKKFLSISLGFSAGVMIYVSMIEIFFKANESLVEELGVRLGSAVNVMAFFGGMFFIGLIDKLIPSFEENVHKEKDVSDDEKSTDEKRLLRMGMFTALAVAIHNFPEGFATLISTLKDPALGISIAIAIAIHNIPEGIAISIPIYYATGSRLKAFMYSFLSGLAEPIGALIGYLILAPFMTEVVFGIVFASVGGIMVYISLDQLLPAARDYGDHHLSVYGTIAGMIVMAISLVLLA

SEQ ID NO: 38526 - protein, 389 aa, Blastopirellula marina DSM 3645
MKAVRWHGKSDVRVEDAPDPKIEDPGDVVIQITSTAICGSDLHLYNGFMPGMKAGDIIGHEPMGVVVEVGRDVRRLAKGDRVVVPFTISCGHCWFCEQTMFSLCDNSNPNAEQARKQMGHSPAGLFGFSHLLGGFPGGQAEYLRVPSADVGPIKVPEGLSDEQVLFLSDIFPTGYMAAENAEIAPGDTVAVWGCGPVGQFAIQSAWMFDAGRVIAIDRIPERLRMAETNGRAETINTDEVDVYEKLMEMTNGRGPDRCIDAVGAEAHASSSVWSAMDTMREAIHLESDKPYVLQEAIRCCRKGGTISVPGVYVGSVQLPFGAAMNKALTFRMGQTHVQRYLDPLMKKIEEGKIDPSFVITHRVPLMDAAKAYETFRDKEDECIKVVLKP

SEQ ID NO: 38527 - protein, 556 aa, Haemophilus ducreyi 35000HP
MKSDVEIAQSATMQHINHIAEKLGLTVDQIEQYGKYKAKINPADAFKLPAKNGKLILVTAINPTPAGEGKTTVTIGLTDALNHIGKQAVVAAREPSLGPVFGVKGGAAGGGYAQVLPMEDINLHFTGDFHAITSANNLLAALLDNHIYQGNALNIDPKRILWRRVIDMNDRQLRNILGGLGNTTDGVIRPDGFDITVASEVMAIFCLAKDLADLKTRLGNILVAYTKDKQPVYAKDLNAQGAMAALLKDAIKPNLVQTMAGSPAFIHGGPFANIAHGCNSVIATRLALHLGDYAVTEAGFGADLGAEKFCDIKCRLAELKPDVAVIVATVRALKYNGGVEKANLAEENLEALTEGLPNLLKHIANLKNVLGLPVVVALNRFVSDSDAELALIQTACAKQGVEVSLTEVWARSAVGGVDLAHKVLKAIDEQQNNFQFAYDVNDRIQHKITAIAQKIYGATDVNFSAEALAEIKNLEKLALDKLPICMAKTQYSLSDSAKLLGCPTGFNITVRSITVSAGAGFIVAICGSIMRMPGLPKNPATNRIDVDENGVISGLF

SEQ ID NO: 38528 - protein, 311 aa, Glycine max
  misc_feature (29)..(29): Xaa can be any naturally occurring amino acid
  misc_feature (116)..(116): Xaa can be any naturally occurring amino acid
MAQQEVVEGFKFEQRHGKERVRVARVWKXTRQGQHFVVEWRVGITLFSDCVNSYLRDDNSDIVATDTMKNTVYAKAKECSDILSAEDFAILLAKHFVSFYKKVTGAIVNIGEKPWXNRVIVDGQPHEHGFKLGSEKHTTEAIVQKSGSLQLTSGIEGLSVLKTTQSGFVNFIRDKYTALPDTRERMVATEVTALWRYSYESLYSLPQKPLYFTEKYQEVKKVLADTFFGPPKGGVYSPSVQNTLYLMAKATLNRFPDIAYVSLKLPNLHFIPVNISNQDGPIVKFEDDVYLPTDEPHGSIQASLSRLWSKL

SEQ ID NO: 38529 - protein, 329 aa, Haemophilus influenzae R2846
MKKQDLMSIDEIQKLADPDMQKVNQNILAQLNSDVSLIGQLGFYIVQGGGKRIRPLIAVLAARSLGFEGANSITCATFVEFIHTASLLHDDVVDESDMRRGRATANAEFGNAASVLVGDFIYTRAFQLVAQLESLKILGIMADATNVLAEGEVQQLMNVNDPETSEANYMRVIYSKTARLFEVAGQAAAIVAGGTEAQEKALQDYGRYLGTAFQLVDDVLDYSANAQALGKNVGDDLAEGKPTLPLLHAMRHGNAQQAALIREAIEQGGKREAIDEVLAIMTEHKSLDYAMNRAKEEAQKAVDAIEILPESEYKQALISLAYLSVDRNY

SEQ ID NO: 38530 - protein, 178 aa, Arabidopsis thaliana
  misc_feature (74)..(74): Xaa can be any naturally occurring amino acid
  misc_feature (116)..(116): Xaa can be any naturally occurring amino acid
  misc_feature (125)..(125): Xaa can be any naturally occurring amino acid
  misc_feature (171)..(171): Xaa can be any naturally occurring amino acid
SGIFGANHPSGLKTQWSFHPWFPKISVSFPVTRKARDDITSITSNGGRVSCMKAWPPIGKKKFETLSYLPDLSXTVELVNEADYLLRNKWIPCVEFELEHGFVYREHGISLGYYDXRNWTSLKLXLVGGTDSAQRATEVEDCQKEYPGAFFLIIGFDNTRQVQCISFIAHXPPSFTEA

SEQ ID NO: 38531 - protein, 180 aa, Butyrivibrio fibrisolvens
MKKVEDYIRTIPDFPEPGIMFRDVTSILQDAEGFKLAIDEMIKLLDGVDCDVIAGAESRGFIFGAPLAYALGKPSVLVRKKGKLPCETIEKTYDLEYGTATIEMHKDAIKPGQKVVVVDDLIATGGTIEAACQLIEELGGEVSKIVFLMELAGLNGREKLKYDVASVCYLRGKIITDFLG

SEQ ID NO: 38532 - protein, 444 aa, Oryza sativa (japonica cultivar-group)
MASSGCSSNRLRQTIVVALLLLASSSCLASAKHRGNGTTTTVPFHGKDELRRYRKIMAQSPDGDVIDCVPAHLQPAFEHPKLRGQKPEAEPEERPKVGGAAAAEAEEEAVFPQAWTDGGESCPEKTVPVRRTRRRDVLRSSSAVRFGMKQPRAAGVVRRDSTSDGHEHAVGYVTGDQFYGAKASLNVWSARVATAAEFSLSQIWVISGSFGNDLNTIEAGWQVSPELYGDNNPRFFTYWTFTLSFSYRYLDFDILPLKTCKKQQYLILQQTDAYQATGCYNLHCSGFVQTNNRIAIGAAISPTSVYNGRQFDISLLIWKDPRRGHWWLQLGSGPLVGYWPSSLFTHLGGHANMVQFGGEVVNTRPSGSHTPTQMGSGHFPREGFNRAAYFRNLQVVDWDNNLLPAAALRLVADHPSCYDIQGGYNRAWGNYFYYGGPGRNVRCP

SEQ ID NO: 38533 - protein, 527 aa, Brassica napus
MKHLGLILAFLLALATCKADEEITCEENLPFKCSQPDRLNSSSFEKDFIFGVASSAYQACCLGRGLNVWDGFTHRYPNKSGPDHGNGDTTCDSFSYWQKDIDVLDELNATGYRFSIAWSRIIPRGKRSRGVNKDGINYYHGLIDGLIDKGITPFVTLFHWDLPQVLQDEYEGFLDPQIIHDFKHYANLCFQEFGHKVKNWLTINQLYTVPTRGYGAGSDAPGRCSPMVDPTCYAGNSSTEPYIVAHNQLLAHATVVDLYRKNYSIGPVMITRWFLPYNDTDPDSIAATERMKEFFLGWFMGPLTNGTYPQIMIDTVGERLPSFSPEESNLVKGSYDYLGLNYYVTQYAQPSPNPVHWANHTAMMDAGAKLTFRGNSDETKNSYYYPKGIYYVMDYFKTKYYNPLIYVTENGISTPGNETRDESMLHYKRIEYLCSHLCFLSKVIKEKHVNVKGYFAWSLGDNYEFDKGFTVRFGLSYIDWNNVTDRDLKLSGKWYQKFISPAIKNPLKKDFLRSSLTFEKNKKFEDA

SEQ ID NO: 38534 - protein, 747 aa, Bacteroides fragilis YCH46
MDTENQKEIAEEQMIEQAFQELLNDYLATKHRKRIEIITKAFNFANQAHKGIKRRSGEPYIMHPIAVAKIVCNEIGLGSTSICAALLHDVVEDTDYTVEDIENIFGAKIAQIVDGLTKISGGIFGDRASAQAENFKKLLLTMSDDIRVILIKIADRLHNMRTLGSMLPNKQYKIAGETLYIYAPLANRLGLYKIKTELENLSFKYEHPEEYQEIEEKLNATAAERDKVFNEFTAPIREQLDKMGLKYRILARVKSIYSIWNKMQTKHVPFEEIYDLLAVRIIFEPRNMDEELNDCFDIYVSISKIYKPHPDRLRDWVSHPKANGYQALHVTLMGNNGQWIEVQIRSERMNDVAEQGFAAHWKYKEGGGSEDEGELEKWLRTIKEILDDPQPDAIDFLDTIKLNLFASEIFVFTPKGELKTMPQNSTALDFAFSLHTDIGSHCIGAKVNHKLVPLSHKLQSGDQVEILTSKSQRVQPQWEVFATTARARAKIAAILRKERKTFQKEGEELLNEFFKKEEIRPEAAVIEKLCKLHNMKNEEEFLVAIGNKTIVLGDADKNELKEKQSSNWMKYLTFSFGNNKDKQQEEKEPQEKEKINTKQILKLTEDALQKKYIMAECCHPIPGDDVLGYMDENDRIIIHKRQCPVAAKLKSSYGNRIIATEWDTHKKLSFLVYIYIKGIDNVGLLNEITQVISRQLNVNIRKLDMETDDGIFEGKVQLYVHDVEDVKAICNNLRKIPNIKSVTRVEN

SEQ ID NO: 38535 - protein, 428 aa, Prochlorococcus marinus str. MIT 9313
MNTTRSQAIFSAAQRLMPGGVSSPVRAFRSVGGQPIVFDRVKGAYAWDVDGNRFIDYIGSWGPAICGHAHPEVIVALQDALEKGTSFGAPCELENQLAEMVIDAVPSVEMVRFVNSGTEACMSVLRLMRAFTGRDKLIKFEGCYHGHADMFLVKAGSGVATLGLPDSPGVPRSTTSNTLTAPYNDLEAVKELFAENPDAISGVILEPVVGNAGFITPEPGFLEGLRELTREHGALLVFDEVMSGFRISYGGAQARFGVTPDLTTMGKVIGGGLPVGAYGGRAEIMEMVAPAGPMYQAGTLSGNPLAMTAGIKTLELLKQEGTYERLESTTERLIKGILEAAKAAEVPITGNSIGAMFGFFLCEGPVRNFEDAKATDTELFGKLHRAMLERGIYLAPSAFEAGFTSLAHSEADIETTLKAFRESFAAVA

SEQ ID NO: 38536 - protein, 297 aa, Arabidopsis thaliana
MENKTQEEASTIKVSSLTCIDLANPNFQQSAVSLKQACLDCGFFYVTNHGISEELKDEAFEQSKKFFALPLEEKMKVLRNEKHRGYSPVLDQILDPENQVDVVLPGWRATMEKYHQEALRVCKAIARLLALALDLDTNYFDKPEMLGNPIAVMRLLRYEGMSDPLKGIFGCGAHSDYGMLTLLATDSVTGLQDKDVKPRKWEYVPSIKGAYIVNLGDLLERWSNGIFKSTLHRVLGNGQDRYSIPFFIEPSHDCLVECLPTCQSENNLPKYPAIKCSTFLTQRYQQSHVNLSIYKQP

SEQ ID NO: 38537 - protein, 174 aa, Oryza sativa (indica cultivar-group)
MGGDAAASVVNGKDEEGWAPIHTAASSGKAEIISILLDQGANVDLTTDAGRTALHYAASKGRLNIAETLIAHSANVNKKDKFGCTPLHRAASTGNAELCEFLIEEGADVDAVDKTGQTPLMHAVISEDKAVALLLVRHGADVAIEDKEGYTVLGRASDSFRPALIDAAKAMLEG

SEQ ID NO: 38538 - protein, 507 aa, Kluyveromyces lactis NRRL Y-1140
MSSTIAEKLNLKIVEQDAVSITLPNGLTYQQPTGLFINNQFIKSQDGKTLKVENPSTEEIIVEVQSATSQDVEYAVEAADAAFNSEWSTMDPKKRGSLLFKLADLIEAQKELIASIESADNGKTLALARGDVGLVIDYIRSAAGYADKLGGRTINTGDGYANFTYKEPLGVCGQIIPWNFPLMMLSWKIAPALVAGNTVILKPASPTPLNALFFASLCKEAGIPAGVVNIVPGPGRSVGDTITNHPKIRKIAFTGSTDIGRDVAIKAAQSNLKKVTLELGGKSAHLVFEDANIKKTIPNLVNGIFKNAGQICSSGSRIYVQDTIYDQLLSEFKTYLETEIKVGSPFDESNFQAAINNKAQFETILNYIDIGKKEGASILTGGERVGNKGYFIKPTVFYNVKEDMRIVKEEIFGPVVTISKFSTVDEAVALANDSEFGLGAGIETENISVALKVAKRLKAGTVWINTYNDFDAAVPFGGYKQSGYGREMGEEAFESYTQIKAVRIKLD

SEQ ID NO: 38539 - protein, 300 aa, Prochlorococcus marinus str. NATL1A
MVRLNEIKMQDGKVFLITGANSGLGYETSKFLLERGATVIMSCRDLIKGEKAKQELLKFNFSGKIELVELDLSDLINVKKFAESIKNKFDYLDVLINNAGIMAPPKTFSKQGFEIQFAVNHLAHMFLTLELLPMLEEKNNSRVVTVTSGVQYFGKIQWADLQGNLKYDRWASYAQSKLANVMFGLELDSKLKESNSKTSSLLAHPGFARTNLQPKSVEANQSWQEELAYKLMDPMFQSAKMGALPQITAATLTSASGGEQYGPRFSFRGYPKICSNAPKALNQTSRKKLWEISEKLIKGV

SEQ ID NO: 38540 - protein, 141 aa, Haemophilus influenzae R2846
MMTERTFSIIKPDAVKRNLIGAILTRFEQNGFKIIASKMVRLTREQAEGFYAEHQGKEFFAPLVEYMMSSPIVVSVLEKENAVKDYRTLIGTTNPETAAEGTIRKEFALSQRENSVHGSDSIENANREIAYFFTDCEIFER

SEQ ID NO: 38541 - protein, 123 aa, Glycine max
  misc_feature (58)..(58): Xaa can be any naturally occurring amino acid
  misc_feature (75)..(75): Xaa can be any naturally occurring amino acid
  misc_feature (82)..(82): Xaa can be any naturally occurring amino acid
  misc_feature (116)..(116): Xaa can be any naturally occurring amino acid
MTQLSSLLVIPKCFPISPMVLDPNRADTNANTNAITKKKFDEDLVLKQQLELYVERFXDLDQGLQKVALESIRQXLNFHELXLRSVPKPLKFLCLHYGTLKTYYETMVESDLKNVXDIIPLQW

SEQ ID NO: 38542 - protein, 334 aa, Haemophilus ducreyi 35000HP
MAIKIGINGFGRIGRIVFRAAQLRDDIEVVGINDLIDVDYMAYMLKYDSTHGRFDGTVEVKDGQLVVNGKTIRVTSERDPANLKWDEIGVNIAVEATGLFLTDETARKHITAGAKKVVLTGPSKDATPMFVNGVNFDTYAGQDIVSNASCTTNCLAPLAKVIHNKFGIKEGLMTTVHATTATQKTVDGPSAKDWRGGRGAAQNIIPSSTGAAKAVGKVLPALNGKLTGMAFRVPTTNVSVVDLTVNLEKAASYQEICAEIKRASENEMKGVLGYTEDAVVSTDFNGATETSVFDAAAGIALTDTFVKLVSWYDNETGYSHKVLDLVAHVYNYRG

SEQ ID NO: 38543 - protein, 780 aa, Coccidioides immitis RS
MAAAFDDEDLSISLPSFDRDGKDDRTPHSRPSMPPPSRPFTVPPEQSPATARDMQRLEQYKTVRILGEGSFGKVKLAIHQATGREVALKIISRRKLLSRDMVGRVEREIQYLQLLRHPHIIKLYTVITTKTDIVMVLEYAERELFDYLVSRGKCNDDEARTFFQQIICAVEYCHRHKIVHRDLKPENLLMDREKNVKIADFGLSNIMTDGNFLRTSCGSPNYAAPEVISGKLYAGPEVDVWSCGVILYVLLVGKLPFDDEYIPNLFRKISAGNFYMPSYISTGAANLIRRMLQVHPVHRITIPEIRRDSWFKKDLPQYLQHPAEEFVATGADPNKAIDLRSIAPGKPAAVRERIRENAVSKLERRMGYGKEDIQEALRKPEPSAIKDAFFIVVENEMMQTNSPTELDGCPSSPQPREGQDASSQGPGTAARPGFSTPRDTPITPLTPYRVTPINTPESRVSHVRILPTSLPYVHDQIMDQRTKDMTARAASPPQDYSQHIEVADLSGTPRERSPEEQAATARALKPHSRSVVDLEKLQYEPPEMLTQVPSQPKRSRKWQFGIRSRNLPYEAMLCLYKAIQAEGGVWEIQPAEPDNHDDDRVPEMTSEIPGPLQRKYRDVPSEYYIPKDLWFIRARLLKQGVLAPGPASSAHSSRSDLEELRRRVSLKGGVLHQEDRSVSGSAGFGAGLSAASSLSSHSATLSYGVWVFIDIQLYQLERDNYMVDFKCDGYQNVVRIEGDGSATEWRPISKRFRNKEKEITSPYPFLDVASDLVAQLAAAT

SEQ ID NO: 38544 - protein, 287 aa, Kluyveromyces lactis NRRL Y-1140
MSSTKVPGTLHLFKEKRVAFEFDPIGKSKALIFVGGLTDGLLTVPYLQGLAKALDPLGYSLVQIQITSSYIGFGTGSLKRDDEEIDSLVDYLKKDGREMVLLMGHSTGSQNTIHYLLHHPGKISGGILQAAVSDREFGSTVIPQPLLSKLNAEAKALVDAGKPEELLSSKHAECMLDTPITAYRWCSLLLPDGDDDFFSSDLSDEKLEITFGYIKDPFLIALSEKDECYPNNGKPLELLQRWQCFVDKKLWSKNSGLIKGATHAVPEEDSQKELFKMVTGFIKENGF

SEQ ID NO: 38545 - protein, 437 aa, Brassica nigra
GVDFFHRYKEDIQLMKNLNTDAFRMSIAWPRIFPHGRKEKGVSQAGVQFYHDLIDELKRNGITPFVTVFHWDTPQDLEDEYGGFLSERIVKDFREYADFVFQEYGGKVKHWITFNEPWVFSHAGYDVGKKAPGRCSKYVKEECHDGRSGFEAYLVTHNLLNSHAEAVEAFRQCEKCKGGKIGIAHSPAWFEPHDLADSQDGASIDRALDFILGWHLDTTMYGDYPQIMKDIVGHRLPKFTEAQKAKLKNSADFVGLNYYTSMFSNHLEKPDPAKPRWMQDSLINWETKNAYNYSIGSKPITGALPVFARGFRSLLKYIKDKYGNPEIMIMENGYGEELGAADSIEVGTADHNRKYYLQRHLLSMNEAICIDKVNVTGYFVWSLLDNFEWQDGYKNRFGLYYIDFKNNLTRYEKESGRYYKDFLSQGVRPSMINRDEL

SEQ ID NO: 38546 - protein, 184 aa, Brassica napus
  misc_feature (138)..(138): Xaa can be any naturally occurring amino acid
  misc_feature (159)..(159): Xaa can be any naturally occurring amino acid
  misc_feature (168)..(168): Xaa can be any naturally occurring amino acid
MAAARRLRTLQSQAENKVCVDCSQKNPQWASVSYGIFMCLECSGKHRGLGVHISFVRSVTMDSWSEIQIKKMESGGNERLNKFLALYGISKETDIVAKYNSNAASVYRDRIQALAEGRQWRDPPVVKESVSVSKKKPXPLGNGNNNGGWDDWEADDSFXSSSDMRRNXSLASDFRSSGGRWRPG

SEQ ID NO: 38547 - protein, 378 aa, Pisum sativum
ATQGQVITCKAAVAWEPNKPLTIEDVEVAPPQANEVRIQILFTALCHTDAYTLGGKDPEGLFPCILGHEAAGIVESVGEGVTDVKPGDHVIPSYQAECGECKFCKSPKTNLCGKVRAATGVGVMMADRKSRFSVKGKPIYHFMGTSTFSQYTVVHDVSVAKIHPDAPLDKVCLLGCGVPTGLGAVWNTAKVEPGSIVAIFGLGTVGLAVAEGAKSAGASRIIGIDIDSNKYDTAKNFGVTEFINPKDHEKPIQQVIIDLTDGGVDYSFECLGNVSVMRSALECCHKGWGTSVIVGVAASGQEISTRPFQLVTGRVWKGTAFGGFKSRSQVPWLVEKYLKKEIKVDEYITHNLTLLEINKAFDLLHEGQCLRCVLAVHD

SEQ ID NO: 38548 - protein, 972 aa, Aspergillus nidulans FGSC A4
MDQTKTPTRPSGIPRLVSRIPLPTSTTSSASLRPSPSREKLRIDPGLKATRLRRPSEEPEFKKPLPRTLQPRNTQNGNPQKRLVSQARSDGVGSENEKVPDTMDTRSEDTALQDAEPRGRIRPSLSERTIETLSQIPPSPASSRRPSSFFNATSPIRSPSRPPSSMTSYSRSPSRSSTSRQLSGNDFLSGPPSSIRLPSRPRTSVHKTGPANEHASVDSADSTPKLTKPAPLKTLRSAGSQSKAPESRLALNRAPADSGVAPPALEVKKTRRAQQKASNSRLNSTAPKSPAVSEPAETTSPELKKTSKSSSALRESIAKAKAARKAAAHQPSPLDAWTEADIKDPFNQQPKDQNKVLRKKLDAGRTTGHLNIAAMSLTTFPDEVLTMYDFDPNATTDWYESVDLVKFIAADNEFTELPDAAFPDVDSEQLDPDSEERGNQFGGLEVLDVHGNLLERLPIGFRRLQRLHTLNLSNNKLTMEDIDVIFEMASLRDLKLAKNQLQGPFSQKIGQLDKLEVLDIHENTITALPETVEGLKRLRVLNVGQNQLTELPFEILCTLPLREIIAPKNKLQGVLIPATVDKLDSLQELDVVGNALTSLGEKLTLPALKTLAISMNRIKNLPNVSSWQALLKLSAEDNSISEFPLGFTELKNVRNVDLTGNNISRLDEKIGLMDNLFTFRIANNPLRERKFLNMTVEDIKRDLRSRCEPEPQETDDEEGSVATQFTLAPETPAQNSGWLLKPGGVLDRSYTDMQEFDVEQLEAINPSDVRYLYLQHNSLRSFPVPALSVLAANLTDLDLSHNPLDISSLTATPVMLASLQTLNLSATGITTLEPLMTGLKAPSLTFLDVSSNNLSGSLPYIRRAYSKLTTFLIAENQLDSLDFEAVQGLQVLDVGNNSISSLPPRIGLLRAAGNSANWGGGSALRRFEVAGNSFRVPRWQIVAKGTDSILEWLKDRMPAEELQEYESGGEGD

SEQ ID NO: 38549 - protein, 120 aa, Roseovarius nubinhibens ISM
MSDAKTRIDETVKSNDVVLYMKGTKEMPQCGFSSRVAGVLNYMGVNYADVNVLADEEIRQGIKEYSDWPTIPQLYVKGEFVGGCDIITEMTLSGELDTLFEENGVTYDKDAAEKIREANA

SEQ ID NO: 38550 - protein, 480 aa, Kluyveromyces lactis NRRL Y-1140
MLSIARVSLLRNARMVPVHAMQMRPVVVRRSLHNGSLLLQKKNEKNEAPKSILDDDMLARAGVEVEGNEAGSKDKSGRAGEAGESAEQDDSTGDKGSGKKKRSRKSSTDIKRERYANWFYILSLLGLASGALSMARDWDSDESEELKKEIPNGYTPALMYKRMKRRWESIFTFFQEPPFPDLLPPPPPPPYQRPLTLVLSLEDLLVHSEWTQQSGWRTAKRPGVDYFLGYLSQYYEIVLFSSNYMMYAEKIAEKLDPIHAFITYNLFKEHCLYKDGVHIKDLSKLNRDLGKVLIIDTDENSFKLQPENAIYLEPWDGKADDRLLRLIPFLEYLATQQVSDVRPILKSFPDNKNIPEAFEKRVQVLKEKFERDERVKNDKNLFLKLLGIGLIGTKPKFPLDLIREEGEKNYVRFMKLVEEEKEKIKLQQQAMGQQTFTLKDYVEGNIPTPEEQLKLQMEKQQEIEAQFEEQKKLKAQQGSK

SEQ ID NO: 38551 - protein, 158 aa, Prochlorococcus marinus str. MIT 9313
MTADSKDTSMSEDNTETATAIENSSAMVTDVTSKSAPNVRLSPDALIKEFEASQQKSDLNDIYVGDTVRVGVRISEGNKERIQPYEGVVIAKRHGGIHETITVRRIFQGIGVERVFMLHSPQVASIKVERRGKVRRAKLFYLRERVGKATRVKQRFDR

SEQ ID NO: 38552 - protein, 285 aa, Nectria haematococca mpVI
TLQQEKEEAGDKKGGPNATTTLVEKYGKCQEVVGRGAFGIVRISHKKVGGGGEKLFAVKEFRRRPEETEKKYSKRLTAEFCISSSLRHPNVIHTLDLLKDAKGDYCEVMEFCAGGDLYTLVLSSGKLEVQEADCFFKQMMRGVEYLHEMGVAHRDLKPENLLLTTRGALKITDFGNGECFRMAWETDAHMVSGLCGSAPYIAPEEYTDKEFDARAVDVWACGCYLHGNAHWSSLWRLPRRMTTNSMPAILKVAEMKRVTALSSPFIGLVVVMSSTRFLTPTRLAA

SEQ ID NO: 38553 - protein, 352 aa, Campylobacter jejuni subsp. jejuni NCTC 11168
MSQKILFIDRDGTLIEEPKSDFQIDTLEKLRFEKDAIPTLLKLKKFGFKFVMVSNQDGLGTPSFPKENFEIAHEKMLDILKSCGIEFQDIFICPHFENENCACRKPKTAMLEEYIKHELYDKEQSFVIGDRESDMILASNLGVRGLKYGELSWKEIENEILSSFRSASYQRTTKETDIKVKVCLNGGKVSIKTGIDFFDHMLEQIAVHGGIGLEISCKGDLEIDEHHSVEDVALALGACIKKALGDKIGIARYGFALPMDECLASCAMDFCNRPHLVYKAKFKKSHLGALSTEMIEHFFYSLSYAMGVSLHLKVKGKNDHHKAEGLFKAFAKALKMAVKIESENLASSKGVI

SEQ ID NO: 38554 - protein, 474 aa, Oryza sativa (indica cultivar-group)
MDKAYIAVFSIVILFLLVDYLRRLRGGGTSNGKNKGMRLPPGLPAVPIIGHLHLVKKPMHATLSRLAARHGPVFSLRLGSRRAVVVSSPGCARECFTEHDVAFANRPRFESQLLMSFDGTALAMASYGPHWRNLRRVAAVQLLSARRVGLMSGLIAGESKATRPETTDTDTDMSMEAQEYKQVVEEILERIGTGNLCDYLPALRWFDVFGVRNRILAAVSRRDAFLRRLIYAARWRMDDGEKKSMIAVLLTLQKTQPEVYTDNMITALCSNLLGAGTETTSTTIEWAMSLLLNHPETLKKAQAEIDASVGNSRLITADDVPRITYLQCIVRETLRLYPAAPMLIPHESSADCEVGGYSVPRGTMLLVNAYAIHRDPAAWEEPERFVPERFEGGGCDGNLSMPFGMGRRRCPGETLALHTVGLVLGTLIQCFDWERVDGVEVDMAEGGGLTMPKVVPLEAVCRPRDAMGGVLREL

SEQ ID NO: 38555 - protein, 381 aa, Acidobacteria bacterium Ellin345
MSTAIEVTPSDLENKTFLDSNELVLNMGPQHPSTHGVLRVILKLDGERVLGTECVIGYLHRGVEKIAENRTYVQFNPYVDRMDYVAAVSNGLGYCEAVEKLIDVQAPPRAQFLRVILTELNRLASHMVWLGTHALDIGALTPLFYTFRDREEVLKIFEKYCGARLTTHAFRIGGCIYEAYEGFEKDVLDYCDKLGPRIDEYEGLLTGNRIWLQRTKGIGILNAADCKALGVTGPVLRAAGVKWDLRKAQPYAAYDQVDFDVPTGENGDTFDRYMVRMQEMRQSIRILRQAVEKLPAGPTMAKVPKVLKPPVGRIYHSIEAPKGELGYFIVSDGSLQPYRVRVRPPSFVNLQALDKMVRGALIADVVAVIGTLDIVLGEVDR

SEQ ID NO: 38556 - protein, 152 aa, Acidobacteria bacterium Ellin345
MSIAPLLRKVFLIDLIKGLSITFKYQAPKDCQTEQYPQERPVITDRFRGQPMMKLGENGETLCIGCNLCALACPENLIAMKSDRDPVTKKKVMVTYVYDVSRCMFCGLCEEACPTQSLKLGTGYEMALYSREGMVLDRKVLEHRTAPEPYEK

SEQ ID NO: 38557 - protein, 472 aa, Haemophilus influenzae R2846
MPNANAIANVFKLIEENNVKFVLLRFTDIKGKEHGVSIPVSLVDEEMFEDGKMFDGSSVEGWKTINKADMLLMPMAETAVVDPFAQIPTLSIRCSVYEPTTMQSYDRDPRSIAIRAENYMRSTGIADQAFFGPEPEFFLFDDVRFNVSMNKASFSIDDIEAAWNTNKKYEEGNNAYRPLKKGGYCAVAPIDSAHDIRSEMCLILEEMGLVIEAHHHEVATAGQNEIATKFNTLTLKADETQIYKHVVQNVALEHGKTACFMPKPITGDNGSGMHCNMSLSKDGKNIFQGDKYAGLSETALYYIGGIIKHAKALNAFTNPSTNSYKRLVPGFEAPVLLAYSASNRSASIRIPAVTNPKAIRIEARFPDPLANPYLAFAALLMAGLDGVVNKIHPGDAMDKNLYDLPPEELKDIPAVASSLEEALNSLEKDYEFLTQGGVFAKDFIDVFISIKRKEVERLNMAPHPVEFEMYYA

SEQ ID NO: 38558 - protein, 207 aa, Campylobacter jejuni subsp. jejuni NCTC 11168
MQNFKELNEKIAWQKVDNLLPVIIQDAKTCEVLMLGFMNNEALEKSLESGKVVFFSRTKQRLWMKGEESGNFLNIIDLSLDCDNDTLLILANPVGPTCHTGDISCFEKISKNADFVFLARLEKLINARKNADENTSYTAKLFKSGTKRIAQKVGEEGVETALAATVKDKEELICEAADLMYHLSVLLADANLSFSDVISKLKERHKA

SEQ ID NO: 38559 - protein, 369 aa, Rhodospirillum rubrum ATCC 11170
MSVLSQDRPRERPPMLATDRTTLAQFLVEECRGRAGDDSELLGLLLDVAQACKTISKMTAMGSLAGVHGYNGDVNPQGENQARLDLMSNQAFVRATERTGHAAGLASEEMEEVLGFPESYARGTLLLVFDPLDGSSNIDINGTVGSIFSILPMPRPGEAPQTADFLQSGRQQVAAGYALYGPSTMFVLTIGSGVHGFTLDPLLGDFILTHPSMTVIPESGEFAINSSNSRFWEPPIRAYVDELLAGRSGPRSKDYNMRWIAALVADVHRILLRGGIYLYPRDTKTPDLAGRLRLLYEAAPVAFLMEQAGGRCTTGTRTMLDLVPGSLHERVPLIFGSAVEVERVETLYREPQRREFATPLFNQRGLFRD

SEQ ID NO: 38560 - protein, 313 aa, Blastopirellula marina DSM 3645
MNNLSKQPSMSRRRYLQTAAVAVAGASISLAKQPQEPGYIDAHVHVWTPDTTTYPLGKDYDKSAMKPASFTPSELFAECRPEGVDRIVLIQMSFYQFDNQYMLDSIAQYPDTFRGVAIVDHRKPGVGLTMRNLQDQGVTGFRLYANAESANAWLDSPEMATMWKSAADTGQAICLLSNPDALPAIEKLCRRFPKTNVVVDHFSRIGGSGTIQQADLDNLCKLEKFPQTYVKTSAFYAFGKKQAPYLDLGPMVKRLRDTFGAQRLMWASDCPYQVQNEHSYAASISLIRDKLDFLTAEDKEWMLRKTAQSVYWI

SEQ ID NO: 38561 - protein, 256 aa, Actinobacillus pleuropneumoniae serovar 1 str. 4074
MARRPLVMGNWKLNGSKAFTKELIAGLKAELADVKGCDVAIAPPVMYLAEAEAALAGQSVIALGAQNVDVNVQGAFTGDISTEMLKDFGAKYIIIGHSERRTYHKECDTFIAKKFAALKAAGLVPVLCIGETEAENEAGQTEAVCAKQIDAVIDALGVEAFNGAVIAYEPIWAIGTGKSATPAQAQAVHAFIRGHIAAKSQAVADQVIIQYGGSVNDANAAELFTQPDIDGALVGGASLKAPAFAVIVKAAEKAKA

SEQ ID NO: 38562 - protein, 605 aa, Coccidioides immitis RS
MSTMEFRALSGGTGSSLARATVIVAGVASLIASLLSIVKNYRKPLLQRYVVRILLMVPIYSVSSWTSIISLQASSWTAPIRDIYEAFTIYTFFQLLINFLGGERALIIMTHGRPPVQHTWPLNQCLSKVDISDPLTFLAIKRGILQYVWLKPILTVIAIILKATGTYQEGYLGLSSGYLWTGIVYNISVTVSLYSLALFWVCMHDDLRPFRPVPKFLCVKLVIFASYWQGFFLSILQWLGALSNGPLGYTPDNLAAAIQDSLICFEMPIFAVFHWYAFSWHDYADPTISAARMPIIYALRDAFGIKDLIQDSKETFRGENYEYRKFDSGDNVIAHEESHSRVARVMDGMRYERGGKAKYWIPKPGQANSRTPLLQSPSSRRESLPWSRRDSRGDVRQSYTDCDEITLDDEDERLFTNARALEFGDWHYPVITANEVPRDQLLPSRSRSFTAIKYQHPPEGNQVKRSSRHRCRRIQGEGSQEPSADSIAKKPRRTRRSRQNVESGSSSNSKPTNDQLVDIVDDVESADKERGRARAAGKESHHLAESRLISRSSSGTLVQKDGPNETEAGPSTSLPGEDDDSQDERQRLLGHIEDGIFNEERAAWG

SEQ ID NO: 38563 - protein, 149 aa, Pisum sativum
MAEQTFIMIKPDGVQRGLVGEIISRFEKKGFYLKGLKFVNVERAFAEKHYADLSAKPFFSGLVDYIISGPVVAMIWEGKNVVTTGRKIIGATNPAQSEPGTIRGDFAIDIGRNVIHGSDAVESANKEIALWFPEGAANWQSSLHSWIYE

SEQ ID NO: 38564 - protein, 504 aa, Magnaporthe grisea 70-15
MPRSQHQTTASPVVHIVDLPWDLSGPILSFKWSPSSQYLLVAVAEQIHVFSAQEGSNLHAIIRNPTPPAVKPCFIDFGATDSEVILFSSLGLRLSIFNLKASKTVEISSPKFYSISSAHKSFSIRPISRHLAVLTRTDGKDVVSVHHPETRECQRSWPLDTIDANGITWSPDGRWLAAWESPAHGHKILFYTADGNLFKLWSGPHHKSLDKSLDVASQEEFALAPGVKRLQFSHNSRYLAVADFSRTVYSLDMTMVAETATLCHPPTITPRDDGQVWQEQLITADDGEAVSGGFIKATQAVSPTGRPTSDHQELKTGPFRLSFDGSSALVATALAEWPSTVWIWDASTATLRAVLLFHFSISSLAWHPRIPETLLITCEVSEDSGTAYIWTTGNAPVLINFPQEHIPVKPHSTSRQSVWLALENNRVPVVVHSNGSHYAMAAVLRSNDGLTPWRDELGQDGQAREESPLELVPAFSSARSRPVPSDSGSDLDSSDDTFHFKKKG

SEQ ID NO: 38565 - protein, 75 aa, Glycine max
MRLRHPNRPVDLSKLEMAALWRYWRHFNLVDAVPNPSKEQLVDVVQRHFMSQQMDELQVIVGFVQAAKRLKTVCK

SEQ ID NO: 38566 - protein, 381 aa, Mycobacterium avium 104
MARDYYGLLGVSRGASDAEIKRAYRKLARELHPDVNPDEAAQAKFKEISVAYEVLSDPEKRRIVDLGGDPLEGAAAAGGGFGGFGGLGDVFEAFFGGGFGGGTTSRGPIGRVRPGSDSLLRMRLDLEECATGVTKQVTVDTAVLCDRCHGKGTNGDSAPVPCDTCGGRGEVQTVQRSLLGQVMTSRPCPTCRGVGVVIPDPCHQCMGDGRVRARREISVKIPAGVGDGMRVRLAAQGEVGPGGGPAGDLYVEVHEQPHDVFVREGDDLHCTVSVPMVDAALGATVTVDAILDGVSEITIPPGTQPGSVITLRGHGMPHLRSGTRGDLHVHVEVVVPSRLDARDTELLREFKARRGREVPEVRSTHAGGGLFSRLRETFTGR

SEQ ID NO: 38567 - protein, 1072 aa, Medicago sativa
MPKRTDINSILILGAGPIVIGQACEFDYSGAQACKALREEGYRVILVNSNPATIMTDPAMADATYIEPIEWQTVAKIIEKERPDVILPTMGGQTALNCALALAKNGVLEKYNVELIGAKEEAINMAEDRNLFDQAMKRIGLSCARAKIVHTLEEAKEAPKEFGFPCIIRPSFTMGGSGGGIAYNWDEFEEICTRGLDLSPTNELLIDESLLGWKEYEMEVVRDKNDNCIIVCSIENFDPMGVHTGDSITVAPAQTLTDKEYQIMRNASIAVLREIGVETGGSNVQFAVNPVDGRMVVIEMNPRVSRSSALASKATGFPIAKIAAKLAVGYTLDELKNDITGGATPASFEPSIDYVVTKVPRFTFEKFGDADARLTTQMKSVGEVMAIGRTFQESLQKALRGLEVGSAGFESKVDYTTEEGAAKVRRELTTAGAERIWYVGDAFRMGLSVNDAFNLSKIDPWFLVQVKELIDIEQSLRGKSLNDLDADKLFQLKRKGFSDKRLALLLGSTEKAVRHHRQGLNIRPTYKRVDTCAAEFSTSTAYMYSTYEEECEANPSDKKKILVIGGGPNRIGQGIEFDYCCVHAALAMREDGYETIMVNCNPETVSTDYDTSDRLFFEPVTLEDVLEIVHKEKPVGVIVQFGGQTPLKLARALEAEGVPIIGTSPDAIDKAEDRERFQQMINKLGLLQPPNAIVRSLEEALLAADKVGYPLVVRPSYVLGGRAMEIVYKEDELRTYMRTAVQVSEDAPVLLDHFLNNAIEVDIDSVSDGKQVVIGGIMQHIEQCGVHSGDSACSLPPYSLPADVQDDMREIVKKMAIELGVIGLMNTQLAYQDGKIYVIEVNPRASRTVPFVSKCIGVSLAKVAARCQAGVSLEEQGFTKEIIPDYFSVKEAVFPFNKFPAVDPILGPEMKSTGEVMGVGNTFGEAYGKSQLGANNRIPTSGTAFISVRDMDKDGIVSVGKDLAELGFKLVATRGTAEVLQQAGLTVQIVNKVQEGRPHIVDMIKNDEIDLIINTVEGRQATRDSSSIRRSAENHRVYYNTTLAAGFAVCMSLKEVKDIEVRRLQDLHTRIK

SEQ ID NO: 38568 - protein, 341 aa, Brassica napus
  misc_feature (90)..(90): Xaa can be any naturally occurring amino acid
  misc_feature (122)..(122): Xaa can be any naturally occurring amino acid
  misc_feature (132)..(132): Xaa can be any naturally occurring amino acid
MAGGKIKIGINGFGRIGRLVARVVLQRDDVELVAVNDPFITTEYMTYMFKYDSVHGQWKHHELKVKDEKTLLFGEKPVTVFGIRNPEDIXPWGEAGADFVVESTGVFTDKDKAAAHLKGGAXKKVVISAPSXKDAPMFVVGVNEHEYKSDLDIVSNASCTTNCLAPLAKVINDRFGIVEGLMTTVHSITATQKTVDGPSMKDWRGGRAASFNIIPSSTGAAKAVGKVLPQLNGKLTGMSFRVPTVDVSVVDLTVRLEKAATYDEIKKAIKEESEGKLKGILGYTEDDVVSTDFVGDSRSSIFDAKAGIALSDNFVKLVSWYDNEWGYSTRVVDLIVHMSKA

SEQ ID NO: 38569 - protein, 480 aa, Ehrlichia ruminantium str. Welgevonden
MLNVFSHIFSILGIFSVLVRYNVLPYTYLLAKRSVRKRPKGEKITMALQKLGPIFIKFGQSISSRGDIIGEEIANHLLFLCDKLPAFSYSDVVRTIEEDFKCAISEIFCEFDEVPIAAASISQVHKAKDIDGNIRAVKILRPKIDQIFEKNIKLMFWIAKIAQHFQSLRRFQLLELVQTFHEICKMEIDLRFEAANADELRGNMQDDSACYIPQVDWNRTTRRVLTLEWVDAIPIYNFYNLENNEALVKNLIFCFCNQVYRDRLFHADMHPGNLMVDTNGKIVIIDFGIVGRLDKATCMYVTEILVGFIKRDYQYVADVHYRAGYVDAKYSSFITACRAIGEPIVGKNTDNISIAALLSQLFKVTADFDMKLQPQLFLLQKTTVLVEGVCRQLSPSINMWKVAELWMEKYAVDKNKYLKKLRKSCLYQTMYDVTSFMKKVDRSLDIINNYDEINHSKYSISRDLMWAIIVIVLVIKIIIG

SEQ ID NO: 38570 - protein, 218 aa, Thiobacillus denitrificans ATCC 25259
MTQDEMKRAVARAAVDYAKGGIIGVGTGSTANHFIDALAEVKGRIEGTVASSEATAARLKSHGIQVLDLNSVGELEVYVDGADEITQHFAMIKGGGGALTREKIVAACSKQFVCIADDSKLVDVLGKFPLPVEVIPMARSHVARELVKLGGQPRLREGFTTDNGNVILDVHNLSIIDPVSLETAINQIVGVVTNGLFARRGADVLLLGTSTGVKTFTR

SEQ ID NO: 38571 - protein, 356 aa, Prochlorococcus marinus str. MIT 9313
MPTVLALETSCDESAAAVLRLNNGCLQVIASRIASQVEKHAQWGGVVPEVASRLHVEALPHLVEEVLQEAGQSMARFDAVAATVTPGLAGALMVGSVTGRSLAALHALPFFGIHHLEGHLASVRLAEHPPRPPYLVLLVSGGHTELIRVGAESEMVRLGRSHDDAAGEAFDKVGRLLGLAYPGGPAIQALAATGDSGRFSLPKGRVSKPGGGFHPYDFSFSGLKTAMLRLVQALSEADEDLPRADLAASFEQVVADVLVERSLLCANDQGLKTVVMVGGVAANRRLRELMSKRGQEQGIEVHTAPLRYCTDNAAMIGAAALQRLVSGVNGSSLELGVAARWPLDKTEVLYHSPPPF

SEQ ID NO: 38572 - protein, 296 aa, Ehrlichia ruminantium str. Welgevonden
MNSEKFKGVFTALVTPFKNDFSVDQDAFTQLIEYQISNNVHGLVPCGSTGESTTLTFEEYCEIIKLCIKTTNNRVPIIAGSGSCSTQETIKRTLFVNSLNVDAALVVVPYYNRPTDEGIYQHFKVVHDATNIPIIIYNIPKRTGVDVSDTLLARILSLPRVIGVKDATCDISRPLNLKTLVQKDIVLFSGDDFTCLAFNSHGGSGCISAVSNVAPKICSDMQSAFFSNNIKEAIEISKTILKLSQALFCESNPSPAKYALSLITEYISPIVRLPLVELTQENKLKVENTLKELGFI

SEQ ID NO: 38573 - protein, 682 aa, Rhodospirillum rubrum ATCC 11170
MTVTTAAPPPRADHGDPQIAERAATAIRMLAADAVEKAKSGHPGAPLGMADIAVALWGVNGGGVVHHNPANPSWPDRDRVVLSNGHASMLLYALLHLTGYDLSAADLAAFRQFGSRTPGHPEVDQTPGVETTTGPLGQGLANGVGFALAEKILAETFNRPDHAIVDHHTWVLLGDGCLMEGISHEVASLAGRLGLGKLICLYDDNGISIDGAVEGWFSDDTPARFRAYGWQVIEGVDGHEISAVSLALTEAKADALRPTLICCRTVIGQGAPTKAGGHDVHGAPLGAAEIAAMRESLNWPYAPFEVPEDIRAACDARPAGAALEAAWRARFAAYQSAYPELAAEFERRLASTFPADFAQTEEALFADLIAAGTVASRKASQLAIRRLAPALPELLGASADLTGSNLTDWPGAARINDGPAGRYLSAGVREFGMAAVLNGMALHGGFIPFGGTFLVFSDYSRNAIRLAALMRRRVIHILTHDSIGLGEDGPTHQPVEHAASLRLIPNLAVWRPGDAFETAVAWSAALRRADGPSALLLSRQNLPAQSFDGDRRAAASRGGYTLSARPQPRAIILASGSELGLATAAQALLDGEGIAVNVVSVPCLELFLSQPKDWIDAVLPPDLPRLAVEAAHPDPWWKVVGLEGAVIGMDRFGESAPAPELFAHFGFTPAAVAARLRDLLAK

SEQ ID NO: 38574 - protein, 113 aa, Ehrlichia ruminantium str. Welgevonden
MNNLYDNNNVFAKILRKELPCDIVYEDELVLAFHDIYPQAPIHILVIPKNKHISFDDFIDSSPDIIHFFSIVKKITHKFQLNKNGYRLVTNHGKEGGQVVPHFHVHILGGKQL

SEQ ID NO: 38575 - protein, 413 aa, Rhodospirillum rubrum ATCC 11170
MDHDFYRIKRLPPYVFAEVNAMKARARAAGDDIIDLGMGNPDQPTPQHIVDKLCEAATNPRAHGYSMSRGIPGLRKALAGYYARRFNVELDPETEAIVTLGSKEGLANLAQAITSPGDIVLAPNPSYPIHAFGFIIAGGAVRHIPAKPGPEFLEAMERGVRHSVPKPVAVLINFPSNPTAYVADLDFYGQVVDFCRHHGIWILSDIAYSEIYFDHKPPPSVLQIPGAKEVAIEFTSLSKTYNMPGWRIGFAAGNRHLIGALTRIKSYLDYGAFTPVQVAATAALNGPQDCVEDIRTLYRERRDVLIDGLAQAGWDIPSPPASMFAWAPLPKGFEHLGSLEFSKLLMREAKVAVSPGVGFGEYGDSHVRIALVENKHRIRQAVRNIKAFLGGGQGGETGLGAKGEDKQKADEAV

SEQ ID NO: 38576 - protein, 454 aa, Streptomyces avermitilis MA-4680
MPGDLKDGRIVIVGASLAGLRAAEALREEGFTGSLTVVGDEPHPPYDRPPLSKQVLLGQATADSTGLPMRQDPNADWRLGVRATGVDLLAKQVLLEDGESLPYDRLLIATGTRARPWPNPAEAALDGVFALRTREDAGGLAQRLTAGPERVLVIGGGFTGSEIASACRERGLEVTVAERGPAPLVGALGGTLSKLAAAMQRNHGVDLRTGVTVTALNGNGSFTGAELSDGSRVDADVCVVALGAVRNVEWLAESGLAAGPRGIACDAGCRAFNMYGIVTDDVFVAGDVSRFPHPLFGYQMLSLEHWGNAVEQAEVAAHNMVNPGPLQRPHLAVPSFWSTQFGLNIKSVGVPTYSDHVVIAQGSLEARRLAMVYGYQGRVTAAVTVDMAKALDYYRHLIETAAPFPPPPGAQDRAVAADLAIPSDVPDPKGLSHGPTVALTGYLPDRRLTLVQPG

SEQ ID NO: 38577 - protein, 308 aa, Oryza sativa (japonica cultivar-group)
MAEAVASGAAGRWTLRGKTALVTGGTRGIGYSPQHPSLVLPYRYPVRSETSTAEPLLLFHDQRGEFMRRHAVVDELAALGAAVHTCSRKEAELGERLREWEGKGFRVTGSVCDVSVREQRERMLREVAGLYGGKLDILVNNVGTNFSKQTTEYSADDYSFIMATNLESAYHLCQLAHPLLKSSGSGSVVFISSVSGVVAVSSGSVYAMTKGAMNQLAKNLACEWAKDNIRTNSVAPWYMKTSLVEDELARKDFADSVVRRTALKRVGEPEEVSSLVAFLCMPGASYITGQTISVDGGMTINGLYPTQD

SEQ ID NO: 38578 - protein, 323 aa, Alteromonadales bacterium TW-7
MATLNFIEQGLRVLDIERQALSDIAQYVDENFHQACQLIYDCQGRTIVIGMGKSGHIGNKIAATLASTGSPAFFVHPGEASHGDLGMITKNDVVMLISNSGETSEVLNIIPVLKRLGAKMIAMTGNASSTMATLANVHICIKVQKEACSLGLAPTASTTATLAMGDAMAVALLEARGFTADDFALSHPGGSLGKRLLLTLKDVMHSGKNTPIINVTQTIKDALIEMSAKGLGMTAIVDSQQQLVGLFTDGDLRRILEQRIDIHTTQIDVVMTKSCTTATQDILAAEALNIMEQKRINGLIIVNEQNHPIGALNMQDLLKAGVL

SEQ ID NO: 38579 - protein, 392 aa, Zea mays
MADAGEGRRVCGMPEKAQLHVAMLALQFGYAGFHVVSRLALNMGISKLVFPVYRNIIALCLLVPFAYFLEKKDRPQLTLNFVVQFFFLALCGITANQGFYLLGLDNTSPTFASAIQNSVPAITFAMAAALRIEKVRLDRRDGVAKVAGTLACVAGASVITLYKGPTIFGPGGGGGLELASTSKAVAGDKNWTLGCVYLIGHCLSWSGWLVLQAPVLKKYPARLSVTSYTCFFGVIQFLIIAAFMERDADAWKFHSGSELFTILYAGFIASGVAFAVQIWCIDRGGPVFVAVYQPVQTLVVAIMASLTMGEKFYLGGIIGAVLIIAGLYLVLWGKSEERARFARDAATLVSGSGDREGLLPAGGGGIRSASKAAASAATQPLLLPSSTSTDNV

SEQ ID NO: 38580 - protein, 163 aa, Zea mays
  misc_feature (93)..(96): Xaa can be any naturally occurring amino acid
  misc_feature (100)..(101): Xaa can be any naturally occurring amino acid
  misc_feature (103)..(103): Xaa can be any naturally occurring amino acid
  misc_feature (108)..(111): Xaa can be any naturally occurring amino acid
  misc_feature (113)..(114): Xaa can be any naturally occurring amino acid
  misc_feature (118)..(121): Xaa can be any naturally occurring amino acid
  misc_feature (123)..(124): Xaa can be any naturally occurring amino acid
  misc_feature (127)..(127): Xaa can be any naturally occurring amino acid
  misc_feature (131)..(132): Xaa can be any naturally occurring amino acid
  misc_feature (135)..(136): Xaa can be any naturally occurring amino acid
  misc_feature (138)..(139): Xaa can be any naturally occurring amino acid
  misc_feature (141)..(143): Xaa can be any naturally occurring amino acid
  misc_feature (146)..(151): Xaa can be any naturally occurring amino acid
MELLSSSPAQVGRPNLSSRALLPPLTSIASSHPPPPRFLVMNSQSQHRPSISCASPPPGDNGFPAITTASPIESARIGEVNRDTQETNVSVKXXXXGHGXXDXSTGIXXXXHXXDQLXXXXLXXVHXRRSXXSDXXDXXSXXXCSXXXXXXALGTPPLAQSLP

SEQ ID NO: 38581 - protein, 346 aa, Glycine max
MAHPTSSSGQSHDLKKEDCKETRSLVVCFGEMLIDFVPTVGGVSLAEAPAFKKAPGGAPANVAVGISRLGGSSAFIGKVGADEFGYMLGNILKQNNVETSGMRFDSNARTALAFVTLRADGEREFLFFRNPSADMLLQESELDKDILKQARIFHYGSISLIDEPCKSAHLAAMSIAKNSGCILSYDPNLRLALWPSADSARKGIMDIWDQADVIKISEDEITFLTGGDDPYDDNVVLKKLFHPNLKLLIVTEGSQGCRYYTKAFKGRVAGVKVKPVDTTGAGDAFVSGILYCIASDQTIFQDEKRLRKALYFANVCGALTVTERGAIPALPTKEAILQFLLEAAVI

SEQ ID NO: 38582 - protein, 325 aa, Medicago sativa
MSPDIITAATNITNTQSKATKRAFVTFLAGNGDYVKGVVGLAKGLRKVKTMYPLVVAVLPDVPQEHRNILTSQGCIVREIVPVYPPENQTQFAMAYYVINYSKLRIWAFEDYDKMIYLDGDIQVFENIDHLFDLPNNYFYAVMDCFCEASWRHTKQYEIGYCQQCPDKVQWPTNFGPKPPLYFNAGMFVYEPNMATYHDLLQKLQVTEPTSFAEQDFLNMYFNDKYKPIPNVYNLVLAMLWRHPENVELEKVKVVHYCAAGSKPWRYTGVEENMQREDIKMLVKKWWDVYEDESLDYKQPVNANHLASAILEAYDLKVVPAPSAA

SEQ ID NO: 38583 - protein, 481 aa, Dorotheanthus bellidiformis
MSKIELVLVPTPGMGHLLSAVELSKLIIRRENRISVLILILSFPFDSGLVNAYVDFQSRDPDNSGSLTFITLPPLSNIPDCTSSTFFTTVIELHKPNVKQVVEERVRSGSPKPAGFVIDMLCPAMMDVAEELEVPSYILFTSGANLLNVVFHFLSLADNGVDIATEVNDPDKEVDVPGFRNRVPCKVLPLPFLEKDFLVKRGRRFRRSNGILVNTSNELESYAIQTLLEQAKDNKIPPVYPVGPILELNSKSRCGTKEDEEVSIMRWLDEQPVNSVLFVCFGSMGTFDEDQVKEIANGLEQSGYCFLWSLRQPPPEGKATPSEEAFLDTLPEGFVERTSHKGKIIGWAPQVSILAHKAVGGFVSHCGWNSTLESLWFGVPMATWPISAEQQLNAFELVKEFGMAVEIRMDFWRDCRKNTQSFVVTSEEIENGVKKLMSMDEEMVEKVKKMSDKSRKTLEDGGSSHHSLGRFINDLLENAGF

SEQ ID NO: 38584 - protein, 377 aa, Limnanthes douglasii
MAIPAAAFIVPISLLFFMSGLVVNFIQAVFYVLVRPISKDTYRRINTLVAELLWLELVWVIDWWAGVKVQLYTDTESFRLMGKEHALLICNHRSDIDWLIGWVLAQRCGCLSSSIAVMKKSSKFLPVIGWSMWFSEYLFLERNWAKDENTLKSGLQRLNDFPKPFWLALFVEGTRFTKAKLLAAQEYAASAGLPVPRNVLIPRTKGFVSAVSNMRSFVPAIYDLTVAIPKTTEQPTMLRLFRGKSSVVHVHLKRHLMKDLPKTDDGVAQWCKDQFISKDALLDKHVAEDTFSGLEVQDIGRPMKSLVVVVSWMCLLCLGLVKFLQWSALLSSWKGMMITTFVLGIVTVLMHILIRSSQSEHSTPAKTRARQTAENPK

SEQ ID NO: 38585 - protein, 150 aa, Oryza sativa
RMEQSFIMIKPDGVQRGLIGDIISRFEKKGFYLRGMKFMNVERSFAQQHYADLSDKPFFPGLVEYIISGPVVAMVWEGKDVVATGRRIIGATRPWEAAPGTIRADYAVEVGRNVIHGSDSVDNGKKEIALWFPEGLAEWRSNLHPWIYES

SEQ ID NO: 38586 - protein, 126 aa, Thiobacillus denitrificans ATCC 25259
MNIIEQLEQEEIARLGKTVPDFAPGDTVVVQVKVKEGNRERLQAYEGVVIAKRNRGLNSAFTVRKISAGEGVERTFQTYSPLVASVEVKRRGDVRRAKLYYLRERSGKSARIKEKLPARKASVAAE

SEQ ID NO: 38587 - protein, 432 aa, Phaseolus vulgaris
FVRKTNKNRDMPLDSDVFRVPPGYNAPQQVHITQGDLVGRAMIISWVTMDEPGSSAVRYWSEKNGRKRIAKGKMSTYRFFNYSSGFIHHTTIRKLKYNTKYYYEVGLRNTTRRFSFITPPQTGLDVPYTFGLIGDLGQSFDSNTTLSHYELSPKKGQTVLFVGDLSYADRYPNHDNVRWDTWGRFTERSVAYQPWIWTAGNHEIEFAPEINETEPFKPFSYRYHVPYEASQSTSPFWYSIKRASAHIIVLSSYSAYGRGTPQYTWLKKELRKVKRSETPWLIVLMHSPLYNSYNHHFMEGEAMRTKFEAWFVKYKVDVVFAGHVHAYERSERVSNIAYKITDGLCTPVKDQSAPVYITIGDAGNYGVIDSNMIQPQPEYSAFREASFGHGMFDIKNRTHAHFSWNRNQDGVAVEADSVWFFNRHWYPVDDST

SEQ ID NO: 38588 - protein, 458 aa, Listeria innocua Clip11262
MEEQKEELQRGLKNRHIQLIAIGGAIGTGLFLGAGKSIHLAGPSIMLVYLIIGAILFFVMRALGELLIHNPTTGSFTEFAEQFIGPWAGFITGWTYWFCWIVTGIAEITAVGMYVKFWVPDLPQWIPALGCVLILLLFNLATVKAFGEIEFWFAIIKVVVIIALIVIGFVLVFIGYKHGTSTASFSNLIDYGGFFPNGVAGFLLAFQMATFSFVGIELVGVTAGEADDPERTLPKAINNIPIRILIFYIGALLVLMSIYPWSNIDPDTSPFVSVFTMIGIPAAAGIINFVVLTAAMSSCNSGIFSTSRMLYTLSAEGKAPKKMHHLSSNGVPATALITSTACLLIGVFLNYILPEQVFILVTSIATICFIWVWGIILVAHLRFRHKHPEISAKSKFKMPLSPFMNWVSLIFFAGLLIILGFAADTRIALFVTPVWFLILAIAYQILKASNRKTKIRHN

SEQ ID NO: 38589 - protein, 395 aa, Rhodospirillum rubrum ATCC 11170
MALFCVECGSMALKVARRGLIPPFIVMDVMRAAAEREATGAEVMHLEVGQPSTGLPEQALDEVARRLHSGPMGYTVALGLDALREAIALHYQRTQGVAVDPGRIIVTTGSSAGFILAFLAAFEAGDRVGLAAPGYPAYRHILKALGCEPVILPTGPETRYQPTVAVLEEAGMDLDGLIVASPANPTGTVMPAADLKALVAYCGERGIRLISDEIYHGITYGEAALSTVGLAEHPVVVNSFSKYFCMTGWRLGWLVLPPDLLRPVECLTQNLFISPPALSQYAGLAALRHHGAFEENIRRYARNRQILLDALPAAGFGAFAPADGAFYLYGDVSGLTDDSLGFCARMLAETGVAATPGLDFDDARGAHFVRFSFSGATETIEKAARRLLEWKGGRG

SEQ ID NO: 38590 - protein, 702 aa, Candidatus Desulfococcus oleovorans Hxd3
MTTEDGRMAAFLQKKEVRQVVDNVSREETLRKSFQPERCEAFAGAYTAVRTVSGFKFKKNREAEKQLPDIIDNPVQQIYREDAPAEDFKEKYCRKQTIGIVFSGGPAPGGHNVIAGLFDAARAANPETVIYGFILGPDGVIEGEAVEITPEMVNNYRNTGGFSMIKTGRTKIDTQEKMALSKTTCAKYGLNALVIVGGDDSNTNAAFLAQAMLEDGVQVIGVPKTIDGDIQVRDDEGRVLCAMSFGFHSAARGFARQISNLCTDCSSDVKYWHVCKVMGRVASHLALEVALQTHANITLIGEDLADYVDQRRLDAAEKAGTIDYTAYGMTLRHLSRVICDAIVRRAAVGKNYGVIVIPEGVLEFINEIQVFIIKLNTIIGEYNYTHDTDFHTDFLLLEDKLDYLRRLARRSREEADFSVWNTRDDDLFNDIPPFFQEGLLMERDSHGNFPFSQVETERVIMELVTDYLERLIEQGEYKIGIKNVYYVQTMQKAGMDPDYYGPFLFRNWGQDYLLFHVSMISLKTLTSELTRQGAILDNEKVPGPIEKLFKKSIPKFKTQYHFYGYDGRGNDPTTFDCTYTYNLGMTVFSLIANGATGQMAAIKNLEKGFAKWVPLGIPIAPLMHLEERKGRLELVLEKSLVDVRAPAFQAVKALRAAWLCARSEDDHFRKPAPISLEATTEEDRPLTLTLNAFADEFKQANE

SEQ ID NO: 38591 - protein, 458 aa, Medicago truncatula
MDTTFDDEEGGPSVTLGEYLEEVEERELVRPFHQGIFTLVGLLDLILRDSHPWAWLPGPGFHSQSTDAEEADLVLGGDEGRECTYNKGYMKRQAIFSCITCTPDGNAGVCTACSLSCHDGHQIVELWTKRNFRCDCGNSKFGEFYCKIFPSKDIENVENSYNHNFKGLYCTCARPYPDPDAEEQIEMIQCCLCEDWFHEEHLGLESSDEIPRDEEGEPLYEDFMCKACSEVCFFLKLYPEVILVAGKQPNATAQVSKDKGILEDTPSTCGFEKPLGDTSYNSPKIDVAQASVGSESISNRAGLPPGGSCNSSTCTEGASLHVNCLLGVNIVAASPVIHGKAMFLSKNWRDALCKCKNCLEYYHQKRIAFLLDKEDSIVEYEKMAKQKREEKLQQQEGAELSLFNKLGHVEKVEILKGIEDMKDGLRTFLESADSSKPISAADIHQFFDDIKNKRRRVG

SEQ ID NO: 38592 - protein, 403 aa, Debaryomyces hansenii CBS767
MMALQWFGKEDVAVGKVPIPAITNDTDVIAKVTGTTICGSDLHLYHGEIMELKKGDVLGHEWCGIIEDVGPSVQNFKKGDRVVSSFQIACGECFYCRDNLSSMCDKTSTSRVQELMYGTAVSGIYGYSHFTGGYAGGQAEYVRAPRADYNLLKIPDKVPDEKALYLSDIVPTSYHSVVCADVKKGDTVAIWGLGPIGLCALRWAQLRGAKRVVGIDNVESRLAKAQSMGCKVLNFKDIDVVKEILNIVPGGVDSSIDAAGFRYANKLTHNIQRTLGLETDTSEVINEAIKATRKFGTIALVADYAGFANQFLIGGLMEKGITLRGCGQAPVQKYWHELLEKVEAGLFDPTFILTHRFPIEEFKELYQAFDKKKGGIGKVFVQTRFSSPPSEGTPSLSHVNELL

SEQ ID NO: 38593 - protein, 131 aa, Oryza sativa (japonica cultivar-group)
MSTKTVPEPEPHVLAVDDSIVDRTVISRLLRSSKYRVTTVDSGKRALEVLSLDRNVHMIITDYCMPEMTGFDLLKRVKESAELKEIPVVLMSSENSPTRIRRCLEEGAEDFLIKPVRPSDVSRLCNRVIMK

SEQ ID NO: 38594 - protein, 864 aa, Pisum sativum
MFPNVTGLLNKGHKIRGTVVLMRKNVLDFNTIVSIGGGNVHGVIDSGINIIGSTLDGLTAFLGRSVSLQLISATKSDANGKGKVGKDTFLEGVLASLPTLGAGESAFNIHFEWDHEMGIPGAFYIKNYMQVEFFLKSLTLEDVPNHGTIRFVCNSWVYNSKLYKSPRIFFANKSYLPSETPSPLVKYREEELQTLRGDGTGERKLHERIYDYDVYNDLGNPDHGEHLARPILGGSSTHPYPRRGRTGRYPTRKDPNSEKPATETYVPRDENFGHLKSSDFLAYGIKSVSQCVVPAFESAFDLNFTPNEFDSFQDVRNLFEGGIKLPLDVISTLSPLPVVKEIFRTDGEQVLKFTPPHVIRVSKSAWMTDEEFAREMLAGVNPCMIRGLQEFPPKSNLDPAEYGDHTSKISVDVLNLDGCTIDEALASGRLFILDYHDTFIPFLRRINETSAKAYATRTILFLKENGTLKPVAIELSLPHPDGDKSGFVSKVILPADEGVESTIWLLAKAYVVVNDSCYHQLMSHWLNTHAVIEPFVIATNRQLSVVHPINKLLAPHYRDTMMNINALARDSLINANGLIERSFLPSKYAVEMSSAVYKYWVFTDQALPNDLIKRNMAVKDSSSPYGLRLLIEDYPYAVDGLEIWTAIKTWVQDYVSLYYATDNDIKNDSELQHWWKEVVEKGHGDLKDKPWWPKLQTFDELVEVCTIIIWTASALHAAVNFGQYPYGGLILNRPTLSRRLLPEEGTAEYDEMVKSSQKAYLRTITPKFQTLIDLSVIEILSRHASDEVYLGQRENPHWTSDSKALQAFQKFGNKLAEIEAKLTNKNNDPSLYHRVGPVQLPYTLLHPSSKEGLTFRGIPNSISI

SEQ ID NO: 38595 - protein, 401 aa, Acidobacteria bacterium Ellin345
MAHMNPTPVLEAGQDKTMVLNMGPQHPSTHGVLRLLLEIDGETIVRIMPDIGYLHTGIEKTCEAKFYQQVVPMTDRIDYLCPMTNNLAYVLAVEKLLGLEIPERAQWIRVLCNELTRINSHLVWLGTGAMDLGAMTVFLYCFREREELLKLFEAVAGQRMMTSYFRVGGVSLEPPLGWFDRVKKFADTFPSKMDEYEGLLTQNPIFVMRTKGVAKITKEDALALGASGPTLRGSGIDFDLRRDMPYSGYDKFKFNVPVKTEGDVYARYQCRIAELRESCKIVQQALAGMPEGSIKADAPKVVLPDREKMKTQMESLIYHFKIVTEGFTVPPGEVYSAIESPRGEMGYYIVSDGTAKPYRVHMRSPSFANLQMLPSMCTGQLLADVVAAIGSIDIVLGDCDR

SEQ ID NO: 38596 - protein, 165 aa, Acidobacteria bacterium Ellin345
MPLEPAITDVEQLKDKPALAKLLASDSIVVEQVKWDRDELSIWVSRESLVDAVKLLRDSSETQFTFLSDVTCTDWYPSEPRFEVSYHFLSIPRKDRVRLKVKLLGDDAQVDSLFSVFPSCNFFEREVFDLFGVRFHGHPNLARIMMPEDWKGHPLRKDYPVEGYR

SEQ ID NO: 38597 - protein, 522 aa, Ceratopteris richardii
MGNCCGTDGFKHERPLPAHPNRQGEDKTGAPKVISHTKLSSCGEQSVNEKYHLGRELGRGEFGITYLCTDRETDEVLACKSISKGKLRTPIDIEDVRREVDIMRHLPKHPNIVTLEGVYEDENAVHLVMELCEGGELFDRIVARGHYSERAAAAVMRTILEVVQVCHRHGVMHRDLKPENFLFANKKENSPLKAIDFGLSIFFKPGEKFTEIVGSPYYMAPEVLKRSYGPEVDIWSAGVILYILLCGSPPFWAETEQLVAQAILRGNVDFNRDPWPNVSENAKALVRQMLEPDPSKRLTAQQVLDHSWLVNARKAPDVPLGDAVCARLKQFSAMNKLKKRALRVIAELLTGEEVEGIRAMFNMMDVERTGSLTFGQLKAGLYKLGSQLPESEIQQLMEAADVNGNGTLDYGEFVAITVHLQRMDNDECLRKAFNFFDLNGDGFIDRSELHEMLEADLGEVGTDIIDDIIQEVDIDKDGRISYDEFASMMRTGTDWRKVSRNFSRERYASLSIKLMQEGSLKL

SEQ ID NO: 38598 - protein, 150 aa, Brassica napus
  misc_feature (6)..(6): Xaa can be any naturally occurring amino acid
  misc_feature (21)..(21): Xaa can be any naturally occurring amino acid
  misc_feature (138)..(138): Xaa can be any naturally occurring amino acid
MAHVLXAAEPLTLLKRPPPQXDGFGDDNGSTEEKAPKARRRESDPAAALAAARHGFGEHGGVNMSIEASATFTVMEPDTMRRLFTGELGPERGDLYIYSRHFNPTVLALGRQMAALEGTEAAYCTASGMSAISCVLMXLVGAGGHVVASR

SEQ ID NO: 38599 - protein, 861 aa, Pisum sativum
MFSGVTGILNRGHKIKGTVVLMRKNVLDINSLTTVGGVIGQGFDILGSTVDNLTAFLGRSVSLQLISATKPDATGKGKLGKATFLEGIISSLPTLGAGQSAFKIHFEWDDDMGIPGAFYIKNFMQTEFFLVSLTLDDIPNHGSIYFVCNSWIYNAKHHKIDRIFFANQTYLPSETPAPLVHYREEELNNLRGDGTGERKEWERIYDYDVYNDLGNPDSGENHARPVLGGSETYPYPRRGRTGRKPTRKDPNSESRSDYVYLPRDEAFGHLKSSDFLTYGLKAVSQNVVPALESVFFDLNFTPNEFDSFDEVHGLYEGGIKLPTNILSQISPLPVLKEIFRTDGENTLKYPPPKVIQVSRSGWMTDEEFAREMLAGVNPNVICCLQEFPPRSKLDSQIYGDHTSKISKEHLEPNLEGLTVEEAIQNKKLFLLDHHDSIMPYLRRINSTSTKAYATRTILFLNNNQNLKPLAIELSLPHPQGDEHGAVSYVYQPALEGVESSIWLLAKAYVIVNDSCYHQLVSHWLNTHAVVEPFVIATNRHLSCLHPIYKLLYPHYRDTMNINSLARLSLVNDGGIIEKTFLWGRYSMEMSSKVYKNWVFTEQALPADLIKRGMAIEDPSSPCGVKLVVEDYPYAVDGLEIWAIIKTWVQDYVSLYYTSDEKLRQDSELQAWWKELVEVGHGDKKNEPWWPKMQTREDLIEVCSIVIWTASALHAAVNFGQYSYGGLILNRPTLSRRFMPEKGSAEFEELVKSPQKAYLKTITPKFQTLIDLSVIEILSRHASDELYLGERDNPNWTSDKRALEAFKKFGNKLAEIEKKLTQRNNDEKLRNRHGPVEMPYTLLYPSSKEGLTFRGIPNSISI

SEQ ID NO: 38600 - protein, 389 aa, Solanum lycopersicum
MASTKQYFSAAGKPIRCKAAVARKAGEPLVIEEVIVAPPKAHEVRVKIICTSLCHTDITLWKLKEFPGCFPRILGHEAFGVVESVGEDVDELKEGDSVVPIFLPDCMDCVDCKSKKSNLCSKFPIQVSPLLHRNDTSRFSNAAGETLHHFLYISSFSEYTVVDVVNVTKIDPEIPPNRACLLSCGVSTGVGAAWKTANVEPGSTVVIFGLGSIGLAVAEGARLCGATRIIGVDINSNKFEIGKQFGITEFVNSKSCVDKPISQVIIEMTDGGADYCFECVGLATLVQEAFTCCRKGWGKTVVLGVDKPDAHLNLNSFEVLQSQKTLTGALFGGLKPKSDVPILVKRYLDKELQLNKFVTHEVNFEDINKAFDLLIQGKSLRCVIWMDKL

SEQ ID NO: 38601 - protein, 390 aa, Solanum lycopersicum
MASTVQSGISKTAGKPIRCRAAVARKAGEPLVIEEVIVAPPKAHEVRLKIICTSLCHTDITLWKLKEFPGCFPRILGHEAFGVVESVGEDVDHLKEGDSVVPIFLPDCMDCVDCKSKKSNLCSKFPIQSSLLLHRDDTSRFTNADGETLHHYLYISSFSEYTVVDVVNVTKIDPEIPPNRACLLSCGVSTGVGAAWKTANVEPGSTVVIFGLGSVGLAVAEGARLCGATRIIGVGRNSDKFEIGKQFGVTEFVNSKSCGDKPVSQVIIEMTNGGADYCNECVGLGRVVQEAFACCRKGWGKTIVLGVDKPDARLNLNSFEVLQSNKTLMGSFFGGLKPKSDVHTSLKRYLDKELELDKFVTHEVNLEDINKAFDLLIQLKTLRCVIWMEK

SEQ ID NO: 38602 - protein, 193 aa, Debaryomyces hansenii CBS767
MKKSTKELKSQQEDSVKFGIIDVLQIIGGLIFLNAFLSWWFTSTSTWGYKGKWVDPGYLKLRVTNNYVNLTIDELSLYNGSDSKLPVYIGINGKVYDVSRSRGTYGPKGTYGFFSGKDAARAFVTGCFSKEDEFTYDLRGLDPDEAMHDIEGWQTFFESSSKYWYVGIVQHEELAGEPPSPCEHVKFPTYYNH

SEQ ID NO: 38603 - protein, 862 aa, Phaseolus vulgaris
MFGILNRGHKIKGTVVLMTKNVFDFNEFVSTTRGGIVGAAGGLFGAATDIVGGIVDGATAIFSRNIAIQLISATKTDGLGNGKVGKQTFLEKHLPSLPNLGDRQDAFNVYFEWDENFGIPEAFYIKNFMQSEFFLVSLTLEDIPNHGTIHFVCNSWVYNAKSYKRDRIFFANKTYLPNETPASLVKYRKEELENLRGDGTGERKEYDRIYDYAVYNDLGNPDKNKNLARTTLGGSSDFPYPRRGRTGRKSTRKDPKCEIPTSDTYIPRDENFGHLKSGDFLTYAIKSLTQNVLPTFQKAFGFNNEFDTFEDVRGLFEGGLYLPTDVISKISPIPVLKEILRTDGEQVLKFPPPHVIRVTKSAWMTDEEFGREMLAGVNPCLIQRLQEFPPKSKLDVTVYGDQTSTMTKEHLEINLGGLTVEEALHGNRLFILDHHDAFIPYLERINDLPTAKCYATRTILFLKDDNTLKPLAIELSLPNPGGKGANSRVILPADGGAESTIWLLAKAYVVVNDSCYHQLMSHWLNTHAVMEPFVIATNRHLSVLHPIYKLLLPHYRDTMNINALARQSLINAGGVIERSFLPGEFAVEMSSAVYKSWVFTDQALPADLIKRGMAVEDPSSPYGLRLVVEDYPYAVDGLEIWDTIQTWVKDYVSLYYPTNDAVKKDTELQAWWKEAVEKGHGDLKDKPWWPKLNTPQDLIHTCSIIIWIASALHAAVNFGQYPYGGFILNRPTITRRLLPEPGTKEYGELTSNYQKAYLRTITGKVEAIVDLSVIEILSRHASDEVYLGQRDNPNWTNNIKALQAFKRFGQKLKEIEEKIMGRNKDSSLRNRNGPVKMPYTVLLPTCEDEGLTFRGIPNSISI

SEQ ID NO: 38604 - protein, 425 aa, Oryza sativa (japonica cultivar-group)
MGRSKREVALPPPPSPSQASPGSFASGMMLPGSLGSGAWQGPAPLQPPHPLLYAYGAAASAFPMAQMKQGLDRSAIDLSDLQERGMDFHPPGGFLSYFQDPSILQNHRPFVPPNYYPAEQVAPCSKLHPGAQQPVNIDSGDEEAPNVRTEKRLTWSTEEDIRLVSAWLNNSNDSISGNFKKNDCYWGDVTAEYNSTTPKNRTRQEKQIKDRFHKIKKNVGRFCCVYKEVKSIYVNGQNDMQLREKAEAAYQADYKEGPFSFLHCWNILRDQPKWHAYLEELEKPNKPKMDDEVEVMEQMSTPNSPEDIKRPVGTKTAKAQRNGKGKRKRKAKVYLSDTDDEIDKLKEVQEMANKGRDELLETQRHVASDNLESKKLAHLAAMEHKEAVMLETYRSLMLQDTKDMPDDVRSEHLMALKCMREKLFP

SEQ ID NO: 38605 - protein, 555 aa, Kluyveromyces lactis NRRL Y-1140
MASKNTYSDFKLATELPAWNQLQSLYEQKGKKLNVKDEFAKDNSRYEKFAKTFVNYDGSKILFDFSKNLVDDEILKSLIQLAKEAKVTSLRDAMFNGEPINFTEGRAVYHVALRNRSLKPMYVDGTNVTPEVDAVLQHMKEFTEEVRSGAWKGYTGKSITDVVNIGIGGSDLGPVMVTEALKHYATNLKVHFVSNIDGTHIAETLKDLDHETTLFLIASKTFTTAETITNATSAKNWFLSKNGGDQSHISKHFAALSTNATEVEKFGIDTKNMFGFENWVGGRYSVWSAIGLSVALYIGFDNFEAFLKGAEAVDKHFVETPLEDNIPLLGGLLSVWYNNFFDAQTHLVAPFDQYLHRFPAYLQQLSMESNGKSVTRGNVFANYSTGSILFGEPATNAQHSFFQLIHQGTKLIPSDFILAAQSHNPIENNLHQKMLASNFFAQAEALMVGKDEEQVKSEGATGGLVPHKVFSGNRPTTSILAQKITPATLGALIAYYEHVTFTEGAIWNINSFDQWGVELGKVLAKVIGSELATDNKISSHDSSTNGLINQFKEWI

SEQ ID NO: 38606 - protein, 486 aa, Listeria innocua Clip11262
MKKETHGEIRRDLKTRHLSMIAIGGSIGTGLFLASGNAIHTAGPGGALVAYIAIGIMVYFLMTSLGEMATYMPVSGSFSTYASRFVDPAFGFALGWNYWFNWAITLAVDISTAAIIVQFWLPNTPAWLWSAIFLLLIFGLNALSVKAYGESEYWFSIIKVATVIIFLIVGVLTIVGILGGEVIGFSNFTAGDAPFKGGFFAILGTFLIAGFSFQGTEMVGIAAGESATPEKSVPKAIKQVFWRILLFYIFAIFIIGMIIPYTNPNLLSAEATDVAISPFTLVFEKAGLAFAASVMNAVILTSVLSAGNSGLYASTRMLWAMARDKKAPKFLGKVNRRGIPMAALIVTTIVGAMTFITTLTENGTVIYTWLLSASGLTGFIAWVGIAISHYRFRKAFIKQGHDLNELKYKAKFFPFGPILALILCILVIVGQDYAAFLKPEFTNPAWWQKIGISYIGLPIFLIFWLSFKFTNKTKVIPLEDCKFDQK

SEQ ID NO: 38607 - protein, 146 aa, Arabidopsis thaliana
MTTPAKKRLMWDLKRLQKDPPVGISGAPQDNNIMHWNALIFGPEDTPWDGGTFKLTLHFTEDYPNKPPIVRFVSRMFHPNIYADGSICLDILQNQWSPIYDVAAVLTSIQSLLCDPNPDSPANAEAARLFSENKREYNRKVIEIVE

SEQ ID NO: 38608 - protein, 161 aa, Brassica napus
MEGVGDTTSSEGHLISAAAFVQGGIQDACDDACSICLEAFCESEPSTLTSCKHEYHLQCILEWCQRSSQCPMCWQSISLKDPTSQELLEAVVQERNFHSIPPRNATVFLRSAFGDFELQHLPPNVDNLDLEERIIQHFAAMGRARHGARREGHRSRSSTQG

SEQ ID NO: 38609 - protein, 645 aa, Desulfotalea psychrophila LSv54
MTTYITTPIYYVNAQPHLGHAYTTIVADTYSRFRHLCGEDVRFQTGTDEHGEKIVEAAEKNGEAPKEYVDRISGMFRQTWPILGIEPDNYIRTTDANHIATVQKVLQQVYDKGDIYFDKYTGLYCRGCERFLTEKELVDGKCPDHQTAPQEIAEQNYFFKMSKYQQQLLDHINANEDFITPHRYRNEMLSFLSEPLEDLCISRPKSRLTWGIELPFDDNFVTYVWFDALINYLTGLGFPEDDKYNKFWPVAEHVIAKDILKPHAIFWPTMLMAMELPLYKKLHVHGYWNVDNTKMSKSIGNVVRPKELVDEYGLDTLRYFTLREMSFGLDASFSSDAIVSRKNSDLANDLGNLFSRSTAMIQKYRGGKLPAPIACEADSELIALSKQVVATYKEEMGAFRFHRALQAVWSLVGYANKYIVSNEPWALAKDENAWQRLDTVLYNLAECLRFLALLIRPVMPDTASRMATGLGLATDASILNSLALGGEWGVVPVGTVLGEAITLFPRMETAKSEEKKAGKKDCQGAKKQEAVISEDGLANFADFQKFELRVADIVVAERIKKSDRLLKLTVMAPEERIIVAGIAAHYSPEDVVGLKVIIVANLKPAKLMGVMSQGMVLAAKVSEDGGERLVLSGVQGDVPAGTRVA

SEQ ID NO: 38610 - protein, 173 aa, Coprinopsis cinerea okayama7#130
MSTTCRRRLIRDFKRLTTDPPGGVSGSPCPDNIMLWNAVIFGPGDTPFEDGTFKLTLTFDESYPNKPPTVRFLSRMFHPNVYANGELCLDILQNRWSPTYDVAAILTSIQSLLHDPNPNSPANAEAAQLYRENMKEYVRRVKLTVEESWLDPEERIDDAEGSSSSDSGANAAA

SEQ ID NO: 38611 - protein, 159 aa, Zea mays
MALAAAPASGDSQSGPQRNYQVVEMRKHRIVSLVAALLVLLALAAVSSTRSAQKESAADNAGMLAGGIKDVPANENDLQLQELARFAVNEHNQKANALLGFEKLVKAKTQVVAGTMYYLTIEVKDGEVNKLYEAKVWEKPWENFKQLQEFKPVEEGASA

SEQ ID NO: 38612 - protein, 467 aa, Glycine max
MELSTMFCLCASFLFIVLFRALIKPYYVSKRRDLPLPPGSMGWPYIGETFQMYSQDPNVFFASKIKRFGSMFKSHILGCPCVMISSPEAAKFVLNKAQLFKPTFPASKERMLGKQAIFFHQGEYHANLRRLVLRTFMPEAIKNIVPDIESIAQDCLKSWEGRLITTFLEMKTFTFNVALLSIFGKEEILYRDALKRCYYTLEQGYNSMPINVPGTLFHKAMKARKELAQIVAQIISSRRQRKQDFHKDLLGSIMDEKSGLTDDQIADNVIGVIFAARDTTASVLTWIVKYLGENPSVLEAVNEEQECILKSKEERGEDKGLNWEDAKKMPITSRVIQETLRVASILSFTFREAVEDVEYQGYLIPKGWKVLPLFRNIHHSPDNFKEPEKFDPSRFEAAPKPNTFMPFGSGIHMCPGNELAKLEILVLLHHLTTKYRWSVVGAKNGIQYGPFALPQNGLPITLFPKNK

SEQ ID NO: 38613 - protein, 369 aa, Pyrobaculum aerophilum
HHHHHHSSGLVPRGSGMKETAAAKFERNHMDSPDLGTDDDDKMVAGVVMMANMAKAINMALHEEMERDERVVVLGEDVGKKGGVFLVTEGLYERFGPERVIDTPLNEGGILGFAMGMAMAGLKPVAEIQFVDFIWLGADELLNHIAKLRYRSGGNYKAPLVVRTPVGSGTRGGLYHSNSPEAIFVHTPGLVVVMPSTPYNAKGLLKAAIRGDDPVVFLEPKILYRAPREEVPEGDYVVEIGKARVAREGDDVTLVTYGAVVHKALEAAERVKASVEVVDLQTLNPLDFDTVLKSVSKTGRLIIAHDSPKTGGLGAEVRALVAEKALDRLTAPVIRLAGPDVPQSPIAADAAYAPTVERIIKAIEYVMRY

SEQ ID NO: 38614 - protein, 129 aa, Pisum sativum
MDSRKAMLILGLLAMVLLISSEVSARELTEEVVEKSDEVNDAKYGGYGRGGGYHNGGGYHNGGGGYNGGGGYHNGGGGYNGGGGYHNGGGGYHNGGGGYNGGGGYHNGGGGYHGGGGHGGHGGASNNGN

SEQ ID NO: 38615 - protein, 741 aa, Phaseolus vulgaris
IPGAFYIKNFMQVEFYLKSLTLEDIPNHGTIHFICNSWIYNSKVYKSDRIFFANNTYLPSETPAPLLKYREEELKNVRGDGSGERKEWDRVYDYDVYNDLGNPDKGAALARPVLGGSTLPYPRRGRTGRPKTKKDPNSEKPSDFVYLPRDEAFGHLKSSDFLAYGLKSVSQDVLPVLTDAFDGNLLSLEFDNFAEVHKLYEGGVTLPTNFLSKYAPIPIVKEIFRSDGEQFLKYPPPKVMQVNKSAWMTDEEFARETIAGVNPNVIKSLEEFPPRSKLDTQSFGDHTSIITKEHLEINLGGLTVEQAIQSKKLFILDHHDYLIPYLRRINASATKTYATRTIFFLKSDGTLAPLAIELSKPHPQGDEHGPVSEVYVPAYEGVEAYIWLLAKAYVVVNDSCYHQLVSHWLNTHAVVEPFVLATNRQLSVVHPVYKLLFPHYRDTMNINSLARKSLVNADGIIEKTFLWGRYALELSAVIYKDWSLHDQALPNDLVKRGVAVKDPSAPHGVKLVIEDYPYASDGLEIWDAIKSWVVEYVAFYYKSDEVLQQDSELQAWWKELVQVGHGDLKDKPWWPKMQSRENLVEVSTTLIWIASALHAAVNFGQYPYGGLILNRPTISRRFMPEKGSAEYAALAKNPEKEFLKTITGKKETLIDLTVIEILSRHASDEIYLGERDGGDHWTSDAGPLEAFKRFGKKLAEIEKKLVQKNNDETLRNRTGPAKMPYTLLYPSSEEGLTFRGI

SEQ ID NO: 38616 - protein, 1043 aa, Debaryomyces hansenii CBS767
MPKLISNTTSALASISAHRPIHIIIATALLASIAYLSVVNEYVPENFEFDYSISYYHPPGTSDYKNWMQIDDPNGYPKAERFSVAPLRFKRVHNQQIPLIKSTFSGSNNNERILVTKTDELESTLNSMDKVTYNGMTWKARHANRITRYYEYLRGGLLKIKSAIQGAEKFDVGLIAVAYIAMWYTLIKVFYDMKQVGSNFWLAFSTITSSTFAFLFALVTTTKVLDTKVPLLSITEGIPFLVAIIGFKHKVSIATLVLKASTSPEDVRTIVSNAISSHTVSLLRDHIVVVGALLTCAMYAPHLEGLKNFCILSSIILAFDLLLVYTFFSAILALKVEINRARRTEYLKNALEEDGISSIIAQNVATQSSSIEHPNEASIFSSQETSIVSFKVAMIAGFFGFHAFWLSSSWLYNATGGDSISIFSNARNLSKTTAKHISIGQHGTVVTLLTPTVYMPLGLLVQSEDFILLCLEHISHAIRDSLISKCLLFGFAISISTNAYFLNASRYQVSATNKLIEKEISRPKSGVERRRSSVVASSKALLGSGIENNKITAVDLDESDSSSDEDLEISAPSKNLPLDECVAVMKEGKVKELNNNEISSLVVAGKLPLYALEKQLADNTRAVLVRRKAIAKLANAPVLDTKRLPYAHYDYDRVFGACCENVIGYMPLPVGVAGPLIIDGKPYHIPMATTEGCLVASTMRGCKAINAGGGVESVLTQDGMTRGPCVSFPSLSRAGACKLWLDSEEGQKTIKKAFNSTSRFARLQHIQTALAGTLLFIRFRTTTGDAMGMNMISKGVEYSLKYMSEECDWSDMEVISVSGNYCTDKKPAAINWIEGRGKSVVAEARIPASVVQKVLKSDVDALVELNISKNLVGSAMAGSVGGFNAHAANLVTAVFLACGQDPAQNVESSNCITLMKNVGGDLQISVSMPCIEVGTIGGGTILEPQGAMLDLLGVRGPHPTNPGDNARQLARIVASAVLAAELSLCSALAAGHLVQSHMQHNRKGAGPPANGHAPNGKAPEITDTKNTAELSRLKEGSVNCIRS

SEQ ID NO: 38617 - protein, 218 aa, Oryza sativa
MEVEEAAYRTVWSEPPKRPAGRTKFRETRHPVYRGVRRRGGRPGAAGRWVCEVRVPGARGSRLWLGTFATAEAAARAHDAAALALRGRAACLNFADFAWRMPPVPASAALAGARGVRDAVAVAVEAFQRQSAAPSSPAETFANDGDEEEDNKDVLPVAAAEVFDAGAFELDDGFRFGGMDAGSYYASLAQGLLVEPPAAGAWWEDGELAGSDMPLWSY

SEQ ID NO: 38618 - protein, 410 aa, Mycobacterium avium 104
MASATGFVIIGGGLAAAKAVEALRDNNFDGRIIVFADEEHLPYERPPLSKEFLAGKKSLTDFTVQNSDWYRDNDVDLRLNTRVCALDAAGHTVGLPDGTTVAYDKLLLATGSAARRPPIPGSDCAGVHYLRTYEVAVALNSFLGEGKSLAVVGAGWIGLEVAAAARQRGVEVTVVEAARQPLTAALGETVGEVFATLHREHGVDLRLETQVREITRADGSATGLRTTDGSAIPADAVLVAVGARPNIELAEAAGLSLADGGVLVDASLRTSDPDIYAVGDIAAAEHPLLRTRIRTEHWANALKQPAIAVAGMLGRPGEYDELPYFFTDQYDLGMEYVGHAPRFERVVFRGDVAAREFVAFWLDADDRVLAGMNVNIWDVLDDVKALIRSRAPIDADRLGDPGAPLGELLG

SEQ ID NO: 38619 - protein, 450 aa, Desulfotalea psychrophila LSv54
MLEKEFLGKKRELFQSIEETPLATASIAQVHRARLYDGSKIVLKIIRPGNKKLIEEDMALFETLAQIVDQYFSNLGYSARAVAKEFSRQLSQETNFINEGQSTERLGKYFTDDPQIHFPKVYWEATTRNVLALEEIQGEMLASLNPEELTKAQRRSIVANGTNAVFKQCLEFGLFHADPHPGNIILRKDGSLCFIDCGMVGRLDKRTTDQLINLVTGIIDGDSEKLRRVVIELTDVDPALTTTRDFYIELQHLTSQLQSDNLDNFNISEMLSDFFTMLQRFKIRCPSDLLLLTKALTTIEGVAEQFDPSFDVINHVRPMIEKVIVTRYSMKAIHKRFGRSIVQYLELLEEIPGGLHDILERFRRDRFTFNLELKRIEHLASHIDTSSRIMGMSMIIAALIVGSSILILADRISQQPGFIGTLGLLGLAFAGVSTAGFIVSFLLPKAKVDD

SEQ ID NO: 38620 - protein, 257 aa, Listeria innocua Clip11262
MKKYVVITGASSGIGYATAKQFAKRKKNLILIARRVANLVKLKNEIEKEVPEVEVLIKAIDLTKIDRLEKLFSELDLYFIETWVNNAGLGYYSEVKNQNLTKTLQLLHLNIEALTVLSVLYVRKYHDQSGTQLINVSSAGGYTMVPTATTYCASKFYVSSFTEALSLELRESGSPLQAKVLAPAATKTEFGQKANDVSEYDYDKKFNNYHTSDEMAQFLLDLYDSDKIVGMIDRTTFSLTLTENLFSYANQASSNQK

SEQ ID NO: 38621 - protein, 409 aa, Sinorhizobium meliloti 1021
MTHIVIIGAGECGARAAFALREKGFGGEITLTGAEPHLPYERPPLSKDGLAQASLPKFIAGAARYEEARITVLTGVTAESIDRVHKAVTLSDGVSLDYDRLLLATGARPRAFPRVPENAGRIRTLRTHADALAIRGALTPGARLAVIGGGFIGLELAATARKLGAEVVLVEGLPRVLSRGVPEEIAVLVAERHRREGVEIICGAQIAAIDGAGDGARLLLADGVDIEADLIVVGIGAVPNTELAEAAGLAIENGIAVDERLCTSDPRHLCRPATAAPSLCPHYGGRRVRLEAWRNAQDQGALAAANLMGAGETMVSVPWFWSDQYEFTLQIAGLADGAETTVRRDMEEGAFILFHLDGEGRLIAASGIGPGNAVARDIRLAEMLIAAGAKPEPLALASPETRLKKLLAA

SEQ ID NO: 38622 - protein, 549 aa, Desulfotalea psychrophila LSv54
MALPSEGKNSFWGERMFASYKSIQETCAFEKLSELAQSPYDLTQPGALQADNRLQRYQVAGQAFKLFYATEQVDDRVLAGLQAVADECQLVSQYRAMRTGAVMNKIDGFVSENRRVLHTATRDLFSGEPAEASMNSRAKRELEKLSHFLDALDAGEIVNEAGEAFTTIVQVGIGGSDLGPRAVYEALKSYTIVGRRAAFISNVDPDDVSMALADLDLGKTIFNIVSKSGSTLETVTNEAFVRRALLENGYDSARHCISITGEGSPMDDPDSYLASFYLYDCIGGRYSTTSMVGCVLLGFTLGFEQVMAFLRGAANMDNSADEVDILKNIPLLMALIGIWNRNFLDLSSLAIIPYSQALYRFPAHLQQCDMESNGKSVDRQGRAVQGKTGPIIWGETGSNSQHAFFQHIYQGTSPVPIEFIGFSESQRGKDIEVQGCTSQQKLLANLFAQMVALACGKKDQNLNKFFAGNRPSCLLFAKKLTPYVMGSLLACYEAKIVFQGFAWNINSFDQEGVQLGKELAKRFLREIGGEEEGFHGIESAFLNEVQRGV

SEQ ID NO: 38623 - protein, 209 aa, Oryza sativa (japonica cultivar-group)
MAASSSLRLILGSSSASRRQILAEMGYSFTLLSADIDEKEIRKEKPEELVVALAHAKADAIMEKLRDNGMMKEILDSQETTLLITADQVVVHDGVIREKPSTPEEARKFIKGYSESHAATIGSVLVTNVKSGARKEGWDKAEVYFHKIPDEVVESLIEEGDVFYVAGGLLVEHPLTSPLVEAIVGTIDSVMGLPKSLTEKLIKESLEEP

SEQ ID NO: 38624 - protein, 1060 aa, Streptococcus agalactiae A909
MPKRTDIRKIMVIGSGPIVIGQAAEFDYSGTQACLSLKEEGYQVVLVNSNPATIMTDKDIADKVYIEPITLEFVTRILRKERPDALLPTLGGQTGLNMAMALSKNGILEELNVELLGTKLSAIDKAEDRDLFKQLMEELNQPIPESEIVNSVEEAIQFAEQIGYPLIVRPAFTLGGTGGGMCDNQEQLVDITTKGLKLSPVTQCLIERSIAGFKEIEYEVMRDAADNALVVCNMENFDPVGIHTGDSIVFAPAQTLSDVENQLLRDASLDIIRALKIEGGCNVQLALDPNSFKYYVIEVNPRVSRSSALASKATGYPIAKLAAKIAVGLTLDEVINPITKTTYAMFEPALDYVVAKMPRFPFDKFESGDRKLGTQMKATGEVMAIGRNIEESLLKACRSLEIGVDHIKIADLDNVSDDVLLEKIRKAEDDRLFYLAEALRRHYSIEKLASLTSIDSFFLDKLRVIVELEDLLSKNRLDINILKKVKNKGFSDKAIASLWQINEDQVRNMRKEAGILPVYKMVDTCAAEFDSATPYFYSTYAVENESLISDKASILVLGSGPIRIGQGVEFDYATVHSVKAIRESGFEAIIMNSNPETVSTDFSISDKLYFEPLTFEDVMNVIDLEKPEGVILQFGGQTAINLAKDLNKAGVKILGTQLEDLDRAENRKQFEATLQALNIPQPPGFTATTEEEAVNAAQKIGYPVLVRPSYVLGGRAMKIVENEEDLRHYMTTAVKASPDHPVLIDAYLIGKECEVDAISDGQNILIPGIMEHIERAGVHSGDSMAVYPPQTLSETIIETIVDYTKRLAIGLNCIGMMNIQFVIKDQKVYVIEVNPRASRTLPFLSKVTHIPMAQVATKVILGDKLCNFTYGYDLYPASDMVHIKAPVFSFTKLAKVDSLLGPEMKSTGEVMGSDINLQKALYKAFEAAYLHMPDYGNIVFTVDDTDKEEALELAKVYQSIGYRIYATQGTAIYFDANGLETVLVGKLGENDRNHIPDLIKNGKIQAVINTVGQNNIDNHDALIIRRSAIEQGVPLFTSLDTAHAMFKVLESRAFTLKVLD

SEQ ID NO: 38625 - protein, 128 aa, Arabidopsis thaliana
MSFLAVHQIVRKKLQLVGVTALLLACKYEEVSVPVVDDLILISDKAYSRREVLDMEKLMANTLQFNFSLPTPYVFMKRFLKAAQSDKKGMCEKDGCFSSQGRNREAHRKYNTSKFFHAARSEPAGFLL

SEQ ID NO: 38626 - protein, 466 aa, Zea mays
MDPCPFVRVLVGNLALKMPASASPATPRASGSGVHPTAARCHCRIRLNKMPYQTASAPLLPATEDGPASCTAAFAAAFHVSKADLDRAAARPAAALLLAARRRRTARLKVAVYAGRGGGVSASCGGGGATSGRLLGKVVLPLDLRAAMAKPVVFHSGWVAVGSRRGKAAAAASSSARAQLSITVRAEPDPRFVFQFDGEPECSPQVLQVKGSMKQPMFTCRFSCRSSSDLRSRSVQSDPGARNWLAKLWSERERERAGKERKGWSVTVHDLSGSPVALASMVTPFVASPGTDRVGRSNPGGWLILRRRVDGTWTPWGRLECWRDRGGSAGDAQLGYRFELVPDHNSNVTGSGVCVAESGVPAARGGRFAIDLTAAAQPFWCSSSGELSRHALWPPGGFVMSAAVQGEGRCSRPTVEVGVAHVGCAEDAAAFVALAAAVDLSMDACRLFSCKLRRELSAASRAEFLR

SEQ ID NO: 38627 - protein, 232 aa, Triticum aestivum
MASSSDPWMKEYTEASKLVDDISSMIADRSSLPQSGPEIMRHTSAIRRKITILGTRLDSLVTLLSRIPPKSLTDKEMHKRQDALSNLKSKAKQMGTSFNVSNFANREDLLGQSKKAADDMSRVAGLDNQGIVGLQRQVMREQDEGLERLEETVLSTKHIALAVNEELTLHTRLIDDLEDHVDVTNSRLQRVQKRLAILNKRAKGGCSCMCLMLSVAAIVLLAVIVWLLIKYL

SEQ ID NO: 38628 - protein, 355 aa, Candidatus Desulfococcus oleovorans Hxd3
MGKSYNIAVIPGDGTGPEVVAEGVKVLNAAAARFGFNLDYTDYSLGGEHYKATGEILNDDTIDRLKKADAIFLGAIGHPDVKPGILEKGLLLKLRFTCDQYINLRPVRLYEGVYTPLKDKTPADIDFTVVRENTEGLYAGAGGFLKYGTPDEVAIQESINTRKGVERCIRFAFEYTRNRNKRKKLTLCGKTNVLTFAFDLWERTFHDVAKEYPDIETDYAHVDAICMWMVKNPEWFDVIVTDNMFGDIITDLGAMIQGGMGVAAGGNINPEGVSMFEPIGGSAPKYTGLGVINPIAAIMAGSLMLEHLGESAAADAIEQAAMTAIKKDLKSVEARKMGMSTAEVGARVAAYVAQS

SEQ ID NO: 38629 - protein, 418 aa, Cryptococcus neoformans var. neoformans JEC21
MSPYRLIEYDVGQPLYGVGFSNSVSHPHRVALTSLVTGPTNKLYIADLSHPPDTQPSSPYYPQANNGSSGPSHPPPAYRQLTSTNINLPATKVGWEPEGSVRVDQGGRGELVATTGESLHLWEVAKGWTEGSGHVGHNGWGNERYTLKSRSILSNTKGAHGSLPPVTSFSWNNKSPNKIVTCSIDTTATLWDINTAQAMTQLIAHDRAVYDLCWLPDSSDIFVSVGADGSLRAFDLRQLEHSTILYESSRDAPLARIAFSKKEQHMLACFGLDDSKILILDMRSPGKPVAELIGHQAPLGAIAWGSGGTRGRRESTGGGWLASCGDDSQLLLYDLTAPLPTSRSSSRSNFRNSNATSPYVLSPSATPSSQRTPSPADAVEMMPAKGWTARGEINNLAFTNDGDWVGCVTGTTLKVLHV

SEQ ID NO: 38630 - protein, 505 aa, Yarrowia lipolytica CLIB122
MIRADRHTYKVFNQEFTIDKRFQVTKELGHGAYGIVCAAKYTGTPDGPGVAIKKVTNIFSKNILCKRALRELKLLNHFRGHKNITCLYDMDIVDTNNFNELYLYEELMECDMHQIIRSGQPLTDAHYQSFVYQILAGVKYIHSADVLHRDLKPGNLLVNADCELKICDFGLARGFSSDDEKNAGFLTEYVATRWYRAPEIMLSFQSYTKAIDIWSVGCILAELLGGKPLFKGKNYVDQLNQILHYLGTPSEETLKRIGSPRAQEYVRGLPFMPKIPFSTLFPTANPEALDLLEKMLAFDPAERVTVEEALEHPYLKIWHDPRDEPVCPTPFDFSFEEVNDMEAMKQMILDEVVDFRAMVRKPVDEQTRIRDEQIEEQRREEEKQEVERQQKEAERQKQHQQEAERQQHQQQQHHPQQQDSPSTLSGFSDSDQSANPHFYEYAGFGVGSQTSDMGQPPVIQRKDSLGIPEEDFKYQDPPPKPQESGRQGDGDLELELEYGLDGWRS

SEQ ID NO: 38631 - protein, 979 aa, Yarrowia lipolytica CLIB122
MAAKDVTNKPSDKSAEKTVDKTAPNDKNKKPARKDEEELSEEDEKLKSELEMLVERLTEKDESLYEPSLEALKNFIRTSTSSMTAVPKPLKFLRPHYPQLAELYDTWTDAKHKQQLADVLSVLAMTYSGDGKRDALKFRLKSTTDDLGSWGHEYVRHLALEIGQEYQLQQVETSDDAKEGVTLDTPNSGVGSLTDVRNLGIKLVPFFLKHNAEADAVDLLLEIEAVEHLPKFVDETTYARVCHYMVACVPLLAPPDDVAFLHTAYAIYLAHRQLTQALALAIRLDDMELIKSVMDAASGDDLLQKQLAFILARQKCYFDVADEGVQECMSNALLADHFRYLTKELNLLEPKVPEDIYKSHLENSRDIIMSGAFDSAKQNLAASFVNAFVNCAYSADRLLTNGGAEDDGDATAGGASGAWIYKTKLAGMYSTTASLGSLFQWDLSRGLQQLDKYAYSSEPQIKAGALLGMGIVTAGVYDETDAAVALLADHITEEPSAENNNGNAYNLNQLSAVMGLGVAYAGSRRTDLLDMLLPLVQDTDTSMKTSAMAALALGHIFVGSANGDVVSALLGSLLERDAIQLSDKWARFMALGLALLFIGKYEEIEEAVETVRAIDHPLGRICETLITVCAYAGTGNVLQIQKLLHDCVGENVTEGEADGEGDGEGEGAEGAVATAEGAEGAADAADAIDATAEAVAAEGEAAADATQEVDSEEASSHQAYSVLGLAIVAMGEEIGQEMVLRHFGHLMHYGDAQVKRAVPLAMGLVSASNAQMRVFDTLSRYSHDADMEVALNSIFSMGLVGAGTNNARLAQLLRQLASYYSKDPDGLFTVRIAQGLLYLGKGTLTVSPFHTDRQILSKVSLASLVTLLVTMIDPKSFILADNHWMLFWLTNAIRPRMLITLDEKLEPIKVPVRVGQAVDTVGQAGKPKTITGWVTHSTPVLLSHGERAELEDDEYIPLASSLEGVVILKKNPDRMDESS

SEQ ID NO: 38632 - protein, 255 aa, Phaseolus vulgaris
RDDNSDIVATDTMKNTVYAKAKECSDISVEDFAILLAKHFVSFYKKVTGAIVNIVEKPWERVIVDGQPHQHGFTLGSEKHTTEAILQKSCSLQLTSGIEGLSVLKTTQSGFENFIRDKYTALPDTRERILATEVTALWRYSYESLYNLPQKPLYFTDKYLEVKKVLADTFFGPTKQGVYSPSVQNTLYLMAKATLNRFPDIAYCHLKMPNLHFLPVNISSKDGPIVKFEDDVYLPTDEPHGSIEASLLQLFYILL

SEQ ID NO: 38633 - protein, 632 aa, Campylobacter jejuni subsp. jejuni NCTC 11168
MNIQILQEQANTLRFLSADMVQKANSGHPGAPLGLADILSVLSYHLKHNPKNPTWLNRDRLVFSGGHASALLYSFLHLSGYDLSLEDLKNFRQLHSKTPGHPEISTLGVEIATGPLGQGVANAVGFAMAAKKAQNLLGSDLIDHKIYCLCGDGDLQEGISYEACSLAGLHKLDNFILIYDSNNISIEGDVGLAFNENVKMRFEAQGFEVLSINGHDYEEINKALEQAKKSTKPCLIIAKTTIAKGAGELEGSHKSHGAPLGEEVIKKAKEQAGFDPNISFHIPQASKIRFESAVELGDLEEAKWKDKLEKSAKKELLERLLNPDFNKIAYPDFKGKDLATRDSNGEILNVLAKNLEGFLGGSADLGPSNKTELHSMGDFVEGKNIHFGIREHAMAAINNAFARYGIFLPFSATFFIFSEYLKPAARIAALMKIKHFFIFTHDSIGVGEDGPTHQPIEQLSTFRAMPNFLTFRPADGVENVKAWQIALNADIPSAFVLSRQKLKALNEPVFGDVKNGAYLLKESKEAKFTLLASGSEVWLCLESANELEKQGFACNVVSMPCFELFEKQDKAYQERLLKGEVIGVEAAHSNELYKFCHKVYGIESFGESGKDKDVFERFGFSVSKLVNFILSK

SEQ ID NO: 38634 - protein, 601 aa, Schizosaccharomyces pombe 972h-
MSGRRNETAIRELVQSVSGNNLCADCSTRGVQWASWNLGIFLCLRCATIHRKLGTHVSKVKSISLDEWSNDQIEKMKHWGNINANRYWNPNPLSHPLPTNALSDEHVMEKYIRDKYERKLFLDENHSTNSKPPSLPPRTKSSSQSSPMASTSTSKSRYADSLSTLHDMGFSDDSVNTHALEETNGDVTRAIEKIVQHGSSKPQKPSTLTSTKSTIKLVSARLKKRNKNLSVHFEDGTKPGDAYEVTGDTRAASPTLNPFEQMMAMTNQGMSVSPGVETTSSPFFTAPVEPNQPLQPLRPSMTGPVPSSMGSEATLNMPSTYGIDSNLYTNSNSSSIVQNPLQPARTGPAAINYNYTTNYSVSSPSVTNPFFDVGSSTQNASLMGSTGYPSSANNVYYENSYQGVGTSMSDNYQLPDMSKLSLNEQPAAPSNSNSQYMNTSMPTLDSTNMYGQSNQDPYSMSNGVYGSNYSAQPSTMQMQATGIAPPQPNMSMQMPMSMQSTGYQMPMENTWVDYNGMSQQGNGMQPATMNYSNSMGYDTNVPADNGYYQQGYGNVMMPPDASYTGTGSYVQPMNQPSGGMGAPADSSKADSYIQRIMQGKQ

SEQ ID NO: 38635 - protein, 227 aa, Triticum aestivum
  misc_feature (29)..(29): Xaa can be any naturally occurring amino acid
  misc_feature (40)..(40): Xaa can be any naturally occurring amino acid
  misc_feature (114)..(114): Xaa can be any naturally occurring amino acid
MEKAAGNQAGKVLKKGKKKQAAKDELDRXQKQAEKKRRRXLEKALANSAAIISGAGEERSSRRKRSKERLDEEGASIAEAVALHVLIGEDSDESRHLALNKHRRCNDWDPSAGXDFALDTQGAADIYSPGGLMCANQAYASRGHRWIDWGNAHPLPTWGEVRDLKASYHQGTFHQSTVACPGFMAAQAVSSLQIREDSSSPGQGVAAATVVNRMLGGANGLNLYREM

SEQ ID NO: 38636 - protein, 511 aa, Zea mays
  misc_feature (360)..(360): Xaa can be any naturally occurring amino acid
  misc_feature (430)..(430): Xaa can be any naturally occurring amino acid
MAGGVVVSSGGGKDYPGKLTMFVLFACIVAATGGLIFGYDIGISGGVTSMNPFLMKFFPSVYRKEQEAERNQSNQYCKFDSQLLTMFTSSLYLAALVASFFAATVTRVAGRKWSMFGGGVTFLVGAALNGAAKDVGMLILGRVLLGVGVGFANQSVPVYLSEMAPARLRGMLNIGFQLMVTIGILCANLINYGTAKIRGGWGWRVSLALAAVPAAIIAVGALFLPDTPNSLIDRGYTDAAKRMLKRVRGTDDVEEEYSDLVAASDESKLVAHPWRNILLPRYRPQLVMAIAIPMFQQLTGINVIMFYAPVLFKTLGFADDASLMSAVITGLVNVFATFVSIVTVDRLGRRKLFLQGGTQXLACQIVVGSLIGAKFGFSGVAEIPKGYAAIVVLFICAYVAGFAWSWGPLGWLVPSEIFPLEIRSAGQSIXAFLPMLCRFKFILFFFFGAWVVVMTIFVALFLPETKNVPIEEMVLVWKAHWYWGRFIRDEDVHVGADLEMPSANAKLGGMQ

SEQ ID NO: 38637 - protein, 298 aa, Schizosaccharomyces pombe 972h-
MSVQELSHPLIKDGWFREINNMWPGQAMTLKVKKVLYAGKSKYQDVLVFESETYGHVLVLDGAIQATERDEFSYQEMIAHLALNSHPNPKKVLVIGGGDGGVLREVVKHECVEEAILCDIDEDVIKVSKQYLPEMSAGFNHPKVKVHIGDGFKFLQDYQNTFDVIITDSSDPDGPAEALFQKPYFQLLSDALRGGGVITTQAECMWIHLGVISNVLTAVKTVFPNVRYAYTTIPTYPSGSIGFVVASKDASIDLSKPLRKWSPEEENKLCKYYNSEIHAASFVLPTFARDVVDKATSS

SEQ ID NO: 38638 - protein, 327 aa, Desulfotalea psychrophila LSv54
MVKHMSIEAAKKVLEIEEQGLAAVRENIGEEFLAAVEAIVNCPTRLVITGIGKSGIVGQKISATLNSIGTSSFFLHPVEALHGDLGMVMATDVVLAISYSGETAELNGLLRSLKARGNTIIGMTGGAKSTLAMASDIFLNIRIPAEACPLGLAPTTSTTATMALGDALGVVLLNRKQFKAEDFRFNHPGGSLGERLKVKVAEVMITGSDMPMVAPDQDAIAALAELNSKNVGAVLVVADTGMLAGIITDGDVRRYVLDAEALEGLCAADLMTKHPLTIGDGVLAADALSIMQQHEVTVLPVVSEEMRLVGLLNLHKLLGKGEFRFLI

SEQ ID NO: 38639 - protein, 323 aa, Triticum aestivum
MTIYLAREASKVWRKVCAETTTELPLLREKWPLLLAGIVFQYIHGLAARGVHYLHRPGPLLQDLGFMALPELGQDKNYLSECTFVFIFFSFFLWTFHPFIYHSKRFYTILIWRRVLAFLVASQVLRIITFYSTQLPGPNYHCREGSNMATLPPPNNVLEVLLINFPRGVNLGCGDLIFSSHMIFTLVFVRTYHKYGSKRFIKLLAWVMAIVQSLLIIAARKHYTVDVVVAWYAVNLVVFFVDTKLPEMPDRTNGSPLIPLSNKDKDGRPKDEKDVRLKDEFHKLLNGNHGDPTDRRQRVQMNGRHPEEDMSSMLSDATPNGGT

SEQ ID NO: 38640 - protein, 366 aa, Bacillus anthracis str. Ames
MIRTEEMLLNVGPQHPSTHGVFRLVIKIDGEIIKEATPVIGYLHRGTEKIAESLQYTQIIPYTDRMDYLSAMTNNYVICHAVETMMGLEIPERAEYLRVLAMELGRIASHLVWWGTNLLDIGAVSPFLYAFREREMIINLLNELCGARLTFNYMRVGGVKWDAPDGWIEKVKEFVPYMREQLAGYHDLVSGNEIFLNRVKGVGIYSAEEAISYSLSGANLRCTGVNWDLRKDEPYSIYDRFDFDIPVGSVGDAWDRYVCRMQEIEESLKIVEQAVQQFPKEGAVLAKVPKIIKAPKGEAFVRIESPRGEIGCYIASDGKKEPYRLKFRRPSFYNLQILPKLLKGENIANLITILGGVDIVLGEVDG

SEQ ID NO: 38641 - protein, 317 aa, Bacillus anthracis str. Ames
MSDPNKDLEDLKREAARRAKEEARKRLVAKHGVEISKLEEENREKEKALPKNDDMTIEEAKRRAAAAAKAKAAALAKQKREGIEEVTEEEKVKAKAAAAAKAKAAALAKQKASQGNGDSGDEKAKAIAAAKAKAAAAARAKTKGAEGKKEEELKQEEPSVNEPYLNQYVEVIKGKIGEDILVDFYINKLSKDVPTLVVEPAKYYEVMELLRFHEGLAFDYMSELHATDFVTHMEVYVHLFSYGKKQSVAVKVKLDREAPQVESVTALWKGADWPEREAYDLLGIVFKGHPNLSRILMPDDWVGHPLRKDYEPYDVEV

SEQ ID NO: 38642 - protein, 330 aa, Cryptococcus neoformans var. neoformans JEC21
MTVTINPAASLPIISLAEHNSVDSLARALYDSCTQEGFIYVCDHEIQQDLIDQAFAISANYFTHARPEDKVDLKTNLGYTAVRQESLDSTRPSSGDLKEFFHVADNHWRVRNGESPQELPEALESSRKALDDFIEQINGLADRILRGLSVALKLKPEFLTNQHRGELNRLRMLHYPPVEVEQNGINSDSNEIRAGAHTDYGSITILFQHIVSGLQVHRNGSWIDVAPRKGCVVINIGDALEFWSGGLFKSTLHRVVMPRSQAEMASRYSIAYFVHADNASILEPFTDGIDEDALDEIIARKGLPRGTRRITGGDYVQARLAATYGMKVAA

SEQ ID NO: 38643 - protein, 145 aa, Triticum aestivum
  misc_feature (2)..(2): Xaa can be any naturally occurring amino acid
  misc_feature (17)..(17): Xaa can be any naturally occurring amino acid
  misc_feature (22)..(22): Xaa can be any naturally occurring amino acid
  misc_feature (28)..(28): Xaa can be any naturally occurring amino acid
  misc_feature (33)..(33): Xaa can be any naturally occurring amino acid
  misc_feature (37)..(37): Xaa can be any naturally occurring amino acid
  misc_feature (40)..(40): Xaa can be any naturally occurring amino acid
  misc_feature (44)..(44): Xaa can be any naturally occurring amino acid
  misc_feature (55)..(55): Xaa can be any naturally occurring amino acid
  misc_feature (58)..(58): Xaa can be any naturally occurring amino acid
  misc_feature (91)..(91): Xaa can be any naturally occurring amino acid
  misc_feature (96)..(96): Xaa can be any naturally occurring amino acid
  misc_feature (104)..(104): Xaa can be any naturally occurring amino acid
  misc_feature (114)..(114): Xaa can be any naturally occurring amino acid
  misc_feature (120)..(120): Xaa can be any naturally occurring amino acid
  misc_feature (135)..(135): Xaa can be any naturally occurring amino acid
MXPNVMGSSGTSVAPFXGLKSXAGLPVXRRSNXANLXSVXSNGXRIRCMQVWAIXGIXKFETLSYLPTLNTEALLKQVDYLIRSKWVPCLXEFNKXGFIFREHXNASPGYYDGXRYWTMXETAYVPGCTDPHKVXKPSGRSKKEP

SEQ ID NO: 38644 - protein, 564 aa, Streptomyces sp. AM-7161
MAATPENPTPAAARRKVGRHRGEGQWAVGHFTPLNGNEQFKKDDDGLNVRTRIETVYSKRGFDSIDPNDLRGRMRWWGLYTQRKQGLDGTKTGVLEPEELDDEYFMLRVRIDGGRLTTEQLRVIGEISEEFARGTADITDRQNVQYHWIRIEDVPEIWNRLEAVGLSTTEACGDTPRVILGSPVAGIAADEIIDGTPAIEEIYRRIVGNKDFSNLPRKFKSAVSGSPLLDVAHEINDIAFVGVEHPEHGPGFDVWVGGGLSTNPKLGVRLGTWVSLDEVPDVYEGVISIFRDYGYRRLRNRARLKFLVADWGPEKFRQVLEDEYLNRKLTDGPAPEQPAGRWRDHVGVHRQKDGRFYVGFAPRVGRVDGATLTKIAGIAEEHGSGRVRTTAEQKMLVLDIEEAQVESIVAALEALDCGSPPAFRRGTMACTGIEFCKLAIVETKGRGSSLIDELERRIPEFDEPLTININGCPNACARIQVADIGLKGQLVLDDDGNRVEGYQVHLGGALGLEAGFGRKVRGLKVTAAELPDYVERVLKRFQAERETGERFATWTARASEESLS

SEQ ID NO: 38645 - protein, 652 aa, Schizosaccharomyces pombe 972h-
MENNTASSPYTKLELVGRGSYGAVYRGICNLTKETVAIKILNLDTDEDEVSDIQKEVAVLSELKQSDVENIIKYHGSYLVGTNLWIIMDYCHGGSVRTLMEAGPISEPCISLILRETLQALKFIHHAGIIHRDIKAANILVSMSGNVKLCDFGVAAELNINRRKRITFIGTPYWMAPEVIRDGQEYNVMADIWSLGITAYEIATGSPPHAKEDPFRAVYLIAHTAPPRLNGNFSALLKEFIASCLQDVPQRRLDSSELLKSKFIKQYSRMSISELTNVVKRYDTWQAAGGIPQTLLLGEEADDGSDPDQETSDTAASDDGWEFGTIKQGQSNVSSITGTSTSTTTAATSSTTVTGTVIPKSSTVHEPPSSNDSHPLLQLFKDSKISDDDSPSNAEGASTEDSKGEVSYSQIELPSLDSSNLSSKKSTIQSKHTKQAEDYDLFVGRTRSNSKTSSDQSIKRPLPRVVQRQKTSLGKRGISMSPMKPGLRMPSSFDLQSRSISMGAFEQLSTPLEAPAHKHSAVLQPLEVNRSISIPPPKSISPSILHKPSLESASSTPKISSCSSTPKPFNSKLRAHLPPLSIGSPAVQPLANDNYDSLGVRGLNMELFNDYPGNMHNIKSVLSLEIDIVLGEMDACLKSLECNLLNRKAYNE

SEQ ID NO: 38646 - protein, 140 aa, Thermotoga maritima MSB8
MGSDKIHHHHHHMKRFVETDKAPKAIGPYSQAVVVGNMMFVSGQIPIDPETGELVQGTIEEKTERVLENLKAILEAGGFSLKDVVKVTVFTTSMDYFQRVNEVYSRYFGDHRPARSFVAVAQLPRNVEIEIEAIAVKEGE

SEQ ID NO: 38647 - protein, 337 aa, Sinorhizobium meliloti 1021
MNALTHPTADAHAGGTVLESIGRTLTTATNGIKALADHLTSDQAFAGALVDAVELMGDGDGRVVVSGVGKSGHIGRKIAATLASTGTSAYFVHPTEASHGDLGMITAQDALVLLSWSGETAELANMLTYAKRFKVPIISISSNRESTLARNSEIALVLPKVPEACPHGLAPTTSAMLQLAVGDALAIALLERRGFSAEDFKAFHPGGKLGAQLRLVQELAHGTGQMPLLSVGRPMSEAVIEMSAKGFGVVGITDESGKLIGVITDGDLRRHMAGDLLAQPVQEVMSRNPRVVRSEVLASAAMEFLEEHQVTVLFLVDEAGAPVGILHIHDLLRAGVA

SEQ ID NO: 38648 - protein, 581 aa, Glycine max
MCGILAVLGCSDDSRAKRVRVLELSRRLKHRGPDWSGLHQHGDCFLAHQRLAIVDPASGDQPLFNEDKSVIVTVNGEIYNHEELRKQLPNHNFRTGSDCDVIAHLYEEHGEDFVDMLDGIFSFVLLDTRDNSFIVARDAIGVTSLYIGWGLDGSVWISSEMKGLNDDCEHFECFPPGHLYSSKERGFRRWYNPPWFSEAIPSAPYDPLVLRHAFEQAVIKRLMTDVPFGVLLSGGLDSSLVASITSRYLANTKAAEQWGSKLHSFCVGLEGSPDLKAAKEVADYLGTVHHEFTFTVQDGIDSIEDVIYHIETYDVTTIRASTPMFLMSRKIKSLGVKWVISGEGSDEIFGGYLYFHKAPNKEEFHRETCRKIKALHQYDCLRANKSTFAWGLEARVPFLDKAFINAAMSIDPEWKMIKRDEGRIEKWILRRAFDDEEHPYLPKHILYRQKEQFSDGVGYSWIDALKAHPPKHVTEKMMLNAGNIYPHNTPKTKEAYYYRMIFERFFPQNSARLTVPGGASAACSTAKAVEWDAAWSNNLDPSGRAALGVHISAYENQNNKGVEIEKIIPMDAAPLGVAIQG

SEQ ID NO: 38649 - protein, 221 aa, Medicago truncatula
MSSIHLINTLPLSTPHRIILPHCHSLLPSSVLPKRHRFAQSARFSVVSSQTVNSVPRANGTYTVSDFMTKKHNLHVVKTTTSVDEALEALVKNRISGLPVIDEEWNLVGVVSDYDLLAIDTISGSSDASLFPDVDSTWKTFNEIQKLLSKTNGKVVGDLMTPSPLVVHESTSLEDAARLLLETKYRRLPVVDKDGKLVGLITRGNIVKAALLSKRSGERLT

SEQ ID NO: 38650 - protein, 122 aa, Zea mays
  misc_feature (74)..(75): Xaa can be any naturally occurring amino acid
  misc_feature (77)..(77): Xaa can be any naturally occurring amino acid
  misc_feature (79)..(80): Xaa can be any naturally occurring amino acid
  misc_feature (96)..(96): Xaa can be any naturally occurring amino acid
  misc_feature (111)..(111): Xaa can be any naturally occurring amino acid
MAYSMLSSAAVVTSPAQATMVAPFTGLKSSSAFPVTRKANNDITSIVSNGGRVSCMKVWPPVWKKKFETLSYLXXLXEXXLGKEVDYLSPEQVNPXLNSELKHGFVYRKHXGSPPGNNQGRY

SEQ ID NO: 38651 - protein, 383 aa, Glycine max
MEVPEMEGKTESHMTSAAAFVEGGVQEACDDACSICLEDFCKSDPATVTNCKHEFHLQCILEWCQRSSQCPMCWQPISLRDTTSQELLEAVELERSLRDTPSRNAAIFHHPALGDFELQHLPMAMNEADIEERIIQHLTAAAAMRRSHHLGQREGHRTRSSAHGRPHFLVYSTQPSAPPFAAGGESEPAAIPVGIPSTPLTFDGNEQSSPQQIPYFQTRGSSLTSGSTVATTNLQGVHSNDRRFASHSFPASQDRAQPSEQSFSDSLRSRFNAVSTRYKESISKGTRGWKERLFSPNSSMSELGSEVKRELNAKIASVSRLMERLETTRENNRAAGTSLSNPNHLVNCSIAETSNQNNVEARGENSLRDNSTPTTFSASSDSK

SEQ ID NO: 38652 - protein, 430 aa, Desulfotalea psychrophila LSv54
MESLKSKKLFAEAKKVIPGGVNSPVRACLSVGCDPLFIERAEGSYIYDADGQKYLDFVNSWGPMIMGHAHPDIIKAIQDAAVYGTSYGAPTSSEVDLASMVVEAVPSIEKVRFVSSGTEATMSAVRLARGYTGKNVIVKFDGCYHGHADSFLVKAGSGVLTLGIPGSPGVPEDIVKNTISIPYNSVEALETTLRDADLNIACVIVEPVAGNMGCVPPAPGFLQKLREITAEEGIVLIFDEVITGFRLSYGGAQQYYGVTPDLTCLGKIIGGGLPVGAYGGKADIMNSVAPDGPVYQAGTLSGNPLAMAAGKAALKLLQQDGFYEDLNQKSAAYADGLLEVAGRVGLPMQLNRVGSVMTSFFTATPVTDFETAMKADTGLYGRHYRQMLDSGIYLAPSQFECSFMSSTHSDADLKRALLETEKSFSLLKNA

SEQ ID NO: 38653 - protein, 146 aa, Pisum sativum
MAFCNKLGNLLRQGATQSSHAPVSSMLNYLRHMSSSKLFIGGLSYGVDDQSLKDAFASYGEVVEARVITDRDTGRSRGFGFVNFTSDESATSALSAMDGQDLNGRNIRVSYANDRPSAPRGGGGGYGGGYGDGFSNRGGGGGGGGW

SEQ ID NO: 38654 - protein, 117 aa, Prochlorococcus marinus str. MIT 9312
MKIFKFLIVIPVITLIIIFQTSVQNRYLMASDIRNGETIFRNVCAGCHVRGGSVVLKGSKSLKLSDLEKRGIADEISIAKIANEGIGYMKGYKKKLKDGEDKVLAQWIIQNAENGWE

SEQ ID NO: 38655 - protein, 406 aa, Pisum sativum
MDASGKSRLETCNELRNKPTLPEKSEGYIQVFLDGGLNQQRMGYVIAVVVAKILNATLVIPYLELNPVWKDSSSFEDYIDVDHFIDVLKDDVTIVKELPEEYAWSSREYYTLAIRDTRIKAAPVHATANWYLENVLPVLQSYGIAAISPFSHRLTFDNLPMDIQHLRCKVNFQALVFVPHIRTLGDALISRLRNPQHSTDEMGSNYLQEVTDADDSKNAGKFVVLHLRFDKDMAAHSACDFGGGKAEKLALAKYRQVIWQGRVLNSQFTDEELRSQGRCPMTPEEVGLLLAALGFDNSTRLYLASHKVYGGGARIATLKQLFPLMEDKKSLTSPFERAQIKGKASLLAALDYYISIHSDIFISASPGNMHNALVGHRTYLNLKTIRPNMALMGQLFLNKTMGVVRV

SEQ ID NO: 38656 - protein, 296 aa, Arabidopsis thaliana
MTEEFEIAGISTGAWWSSPTNTAAVFSGYSLPCSTEISPDVTNFGWQNFDNKINDHNDGCMNMHNSFFEGLLIDPNDQLLPDPWSKSTIPNAKSELLENFPFLDNMFLVDSEAESLLDHEIRNHKSSKEQITQDYKNLTSKAQLEENSDEYSPRLLKRPRLETLSPLPSFKVRKEKLGDRITALQQLVSPFGKTDTASVLNEAVEYIKFLQEQVTVLSNPEQNTIGSVQQQQCSNKKSINTQGEVEEDECSPRRYVDLSSRGLCLMPISASYPVAAAAASAAEMNVHLVSGIFHSL

SEQ ID NO: 38657 - protein, 333 aa, Roseovarius nubinhibens ISM
MSLDDAATKPHDRLARQFAPKMEAVNALIRARMASEHAPRIPEVTAHLVEAGGKRLRPMLTLAAAAICGYEGDHDERLAATVEFIHTATLLHDDVVDESGQRRGRPTANLLWDNKSSVLVGDYLFSRSFQLMVETGSLRVLDILANASATIAEGEVLQLTASRDIATTEATYLQVVRGKTAALFSAATEVGGVIAGASDEVTGALYDYGDALGIAFQIADDLLDFQGDSAKTGKNVGDDFRERKLTLPLIKAIAKADETERAFWRRTIEKGAQGEGDLDHAIALLHKHRALEETLADAQGWAARAQAALAKLPAHPVRDMLGDLSDYVVARVS

SEQ ID NO: 38658 - protein, 373 aa, Arabidopsis thaliana
MSESAKPYFAMVCLQFGYAGMNLVTKVVLDRGMSHYVLVAYRNAFATAAIAPFALLSERKVRPKMTFPIFMQIFVLALLGPLIDQNLYYACLKLTSPTFAGAVTNIVPALTFIISIICRMEKVEMRKVRFQAKVVGTLVIVVGAMLMILFKIPLITFLRSHLTGHALSPAGEDYLKATVFLLIASFSWASFFVLQAATLKRYSSHLSLSTMVCFMGTLQSTALTFVMEPNLSAWNIGFDMNLLASAYAGIMSSSIAYYVQGMMTKQKSVIFVTAFNPLVVIIGSIIGFLILNQTLNLGGVLGMAILVVGVCTVLWGKEGDIDEEENIEEKFVEIVKCCNRCDIKVLSMMPRIDEEVDVEMQSAGTAKVAVGFS

SEQ ID NO: 38659 - protein, 468 aa, Oceanicola granulosus HTCC2516
MSNADVLKLIEDEDVQYVDVRFTDPRGKLQHVTIDVSQIDEDFLEEGFMFDGSSIAGWKSIDQSDMKLMPDTDSAYIDPFYAEKTLCLHCTVVEPDTGEPYNRDPRGTALLAEAYLKSSGIGDAAFFGPEAEFFLFDDVRFAVTTNKVSYQVDAIDASWNTDTEYEMGNTGHRPGVKGGYFPVNPIDDAQDIRSEMLSTMKKLGMKVDKHHHEVASCQHELGLVFDSLTKQADEIQKYKYVIHNVAQAYGKTATFMPKPIAGDNGTGMHVNMSIWKDGKPLFAGDKYADLSEEALWFIGGILKHAKALNAFTNPSTNSYKRLIPGFEAPVLRAYSANNRSGCVRIPWAESPKAKRVEARFPDPSANPYLCFAALLMAGLDGIKNKIDPGPASDKDLYDLPPEELAGIPTVCASLREALEELEADHDFLLVGDVFTRDQIEGYMGLKWEEVYAYEHTPHPIEFKLYYSC

SEQ ID NO: 38660 - protein, 520 aa, Oceanicola granulosus HTCC2516
MKVAMGEVLLSAQMREIEAAAMAGDRVTGAELMERAGSEVVAAARAAWPELAAGGRALVLAGPGNNGGDGFVIARLLAEAGWEVAVQVQGDRARLGPDAQAMAAAWRGPVLPPEARPEAPLDLAVDALFGTGLSRTIPDAAAQALRAARARAARLVAVDCPSGLDCDSGRLHLPEDTAADDIAADLTVTFHRPKRGHYLGQGPEVCGRLVIADIGLPAAATAPEALPPPGRIRLVARAPGWPAALIAATRPGVHKYDRGHALVLGGGVGKGGAARMAARAALRIGAGLVTVAVPPAALIENAAQLNAIMLTRLADAGALAEMLGDDRLSALCLGPGLGTGEGTRALVGAALAAERFTVLDADALSSFRDDPPALFSRLHPRCVLTPHEGEFARLFPDLAQGARAAAGRSKADAAAEAAERAGCTVLLKGPDTIIASPGGHLSLSASLYERRTTWLGTAGAGDVLAGMIAGLGAAPGAKAHLVAEAAAWLHVEAALSFGPGLIAEDLPEALPGVLRGLRGL

SEQ ID NO: 38661 - protein, 462 aa, Bacillus cereus ATCC 14579
MTINSKTIEKSSYTYEELAEKNKAYVWHPFTQMKDYLEEDPVIIERGEGRKLYDVNGNEYWDGVSSIWLNVHGHQVPELDEAIREQLNKIAHSTMLGLANVPSILLAEKISEVVPDGLKKVFYSDSGSTAVEIAIKMAFQYWQHKGKPKKQRFVTLKEAYHGDTIGAVSVGAIDLFHQVYSSLLFDAIKMPYPYTYRSPYGNNKEEIVKSHLEEMEELLKEKHEEVAAIIVEPLMQGAGGMITMPKGYLKGLRDLCTKYNVLFITDEVATGFGRTGKMFACEHENVTPDILTAGKGLTGGYLPIAVTVTTDEIYNAFLGEYEEQKTFFHGHSYTGNPLGCAVAIANLELYEKTNLIEEVARKTDYVAAQLEKLFAYKHVGDIRQCGLMVGIELVKNKETKEAFDWTERVGVQVCKRSRELGMILRPLGNTIVFMPPLASTFEEIDDMLRILYKAISDVTEGE

SEQ ID NO: 38662 - protein, 458 aa, Oceanicola granulosus HTCC2516
MIVIGAGPGGYVAAIRGAQLGMNVLCIEREHLGGICLNWGCIPTKALLRSSEVFHLMHRAKEFGLKAEGVGYDLDAVVKRSRGVAKQLSGGIGHLFKKNKVTSLMGEARIAGKGRVVVKTDQGEEEVSAPAIVVATGARARELPGLEADGDLVWTYKHALQPPRMPKKLLVIGSGAIGIEFASFYNTLGAETTVVEVMDRILPVEDAEISAFAKKQFKKQGMKILEKAMVKKLDRAKGKVTAHIESGGKVETQEFDAVISAVGIVGNTEGLGLEELGVKVDRSHVIVDEYCRTGVEGVYAIGDIAGAPWLAHKASHEGVMVAELIHGKNKVHPVRPESIAGCTYCQPQVASVGFTEAQAREKGYDIKVGKFPFIGNGKAIALGEPEGIVKTVFDAKTGELLGAHMVGAEVTELIQGYVVGRQLETTEEDLMETVFPHPTLSEMMHESVLDAYGKAIHF

SEQ ID NO: 38663 - protein, 355 aa, Schizosaccharomyces pombe 972h-
MADIPADRKKIVQEGWSRLFSDIEQPSYIQKFPSQESLYVSFFEQCAFDDFDLTLLRFLKARKFVVTDSSDMLANAIVWRQQANLRSIMVRGENGLNQNFVKASMYFIWGQDKKGRAIVFLNLHNFIPPKNTKDMEELKALILYAMENARLFLDSEQNAAKGVLGLVDLTYFSRKNIDLDFARVFAETFQNYYPEILGQALIVGSGFRMALFEGVWSIGKYFLDPEVRSKVTFCKPAQVSGYVDSKYIPLSMHGQFDETKLYERAPPETAGIGKPENYEELDKEYVDAAKEFIRLTREWIYAAGKPQEAEIEEKRKAFKYECKKLWRKGVALRPPNIYQRLGLIDANGHVDWSKA

SEQ ID NO: 38664 - protein, 414 aa, Campylobacter jejuni subsp. jejuni NCTC 11168 [sequence omitted]

SEQ ID NO: 38665 - protein, 538 aa, Amanita muscaria
MASEELEKQSPVYDKPGPEAESLQGVANDGLSRQLKNRHIAMISIGGVIGTGLFLGTATALRNGGPVGMLLGYALMGLICFCVMISLGEMVAFLPIPGGHIKLAERFVDPAFSFTMGWNYWYNWSIVLPAELSASSVIVGFWNHNINPAVWVIICLVVVVTINMLGAGVYGEAEFWFASIKVITITGLIILGIVLDLGGGPNHDRLGFRYWKNPGPFVQFGGISGTTGQFLGFWAVLTQAAFSYIGTEIVAIAAGETKNPRRNLPRAIKRVYIRILLSYICGTLIIGLLVPSNDSGLNLGDGTAASSPFVIAIERAGINSLPHIINACLLTSAWSAASSDLYTSSRALFGLAVSGNAPKIFLTTTSSGLPYVSIAFECMLLRLLAFMATSSGAGKVFGWFANMTAIAGLMTWFGICVSYIRFYNALKVQGYDRKTLPFSSRLQPFAAYFAAGFILVACFFSGFAVFLKGKWATDTFVTNYLPFVLFPIMYGLARLYYKQGPKPYDEIDLVTGLKEIEQQTYDEPPPNNFLERVWQWVM

SEQ ID NO: 38666 - protein, 182 aa, Synechococcus sp. WH 5701
MLFSVRRPYVALGLALAATLLPFAPILPLQAQGEPPKVLEGSAGTFNLQAVKDLLSRGDAAVARGDLASARKDYDQARDASLKLLGFYRDLSGSFRGLDARIPREMDQKGRESLELLAQSNLRLAALLRRQNQPEVAVPLLVEVVKVMTPTREEGRRAYQTLVELGFATIPYTAVSDSPATP

SEQ ID NO: 38667 - protein, 107 aa, Synechococcus sp. WH 5701
MDSAVKQRIDSLLSSSPIVVFMKGSKLMPQCGFSNNVVQILNSLGLPFETFDVLSDQEIRQGIKEYSEWPTIPQVYVNGEFIGGSDILIEMYNSGELRETLTVALAS

SEQ ID NO: 38668 - protein, 334 aa, Desulfotalea psychrophila LSv54
MTIKIGINGFGRIGRNIFRALSKDEAFADIEIVAINDLSDNATLAHLLKYDSIMGVYDREVGSDADGIIVDGRHIAVSSHRTPADIPWGEVGADYIAECTGIFRDAESAQGHIDAGASKVVISAPAKGAVKTIVMGVNEDEYDATLHHIVSAASCTTNCLAPFAKVILDNFGISRGLMTTIHAYTGDQRLLDSPHADPRRARAAALSMIPTKTGAAAAVSLVIPELKGKFDGLAVRVPTANVSLVDAVMEVEKETSVAEVNQVLKEAANRYLGYTDLPLVSIDFQGNPHSSIIDAQSTKVIGKSVKVMSWYDNEWAYSNRMLDLILHMDARRAL

SEQ ID NO: 38669 - protein, 1421 aa, Desulfotalea psychrophila LSv54
MDRHDVGQVLQSDALKANLLETAGTVEIDSELLLLLSAVKKYRGLHKTLEKLLYEICHPFRNWKLILPQFRSYTLKNTGHYLKDESGPEAVGLFARLFFEAIEDVRRDPVLLAQAVAALLIWLEKLAKDLPEGRQEAFEPVLTDIFSRLTRFDEEDEAAMMQMVYGQCSLAGLVRARLSSSETEGADCSSLVRLYEMVLHRTYAYWLLEDDPLQWFLMRCKMVANDLTARETFKDISHLSMQSRLTELKRIRQETAGVATLRAMLGLASHIDIVRFYRAIPDKLAELDIVSDCFAKEDAASSNFNENRKILFLFKIMDTEGLHLVHEETLREINRSLVQLIRQQTFEEIEEFLLATFELLEVNVRKYPHTSLQCIQVLGGEVFDRSNSRMVEAFLWGVVRFGFQHANVVGVDENWQPLTNPAHLANIRVWLHLIMREPKWCATLFSALIIHIKLSGTCIKDTDLFQRDITELLNHPIKPVYNLCKQFAKLMPVFFNEIGSEGELRDVSTELDEMHRRKDVLIHFLRKQGHVESSNLIVDFIKAIFLFWQTKDKSKLQPHVPDEVYVQVSSEGRYVDEAHRLTLRLWQEQNLKNVSDLLGVDEETMAEFLLRQQDIDPREVRRFELLVRMFKLLHAKYQLSFQDLRPELLAAAKNGFPQMRDLLDRLDQKDVRQSLSALLQSLLALKEIILSEESFEAREDIYYKRHIAVDIPSVYGRYKERKFDALSLSFRLENHANIYLEKLAGTINLAMITQATFYDIIGCLKLYIQALSVDGISSRKLVTSLSLLKNSLKVRRFSYTQYLDIFKGMSEGVKDIIYAFYTNIHQNNLSIIIPQLSREEVMQKYRSLYDEDMGISVHRVSEAFLRELISSTFGLQHLDNFILQILATLENQREMLSERNLDLLMTYNPNRAISELHNPNPLASNLIYLGNKGFNLATLAADNKPIPPAFVITTEVFRCRNIVFGYSEARQQFMGKIRRSLTELEDSQDKFFGSSDRPLLLSVRSGGAISMPGMMATVHNVGFNQEIIREYARKHGEGYFAWDNYRRFLQSWAMICDVDREDFQALMDSAKQRHGVRLKRDFTSAQMEELALSYYQLVCEKGVVIPDNPWLQLVGAIELVLDSWHTTKATDYRRVMDLSESWGTAVIVQTMIYGNKSSRSGSGVVFTSHPYRKVQRVALWGDYAYGSQGEDIVSGLVTSYAISMEQAQLDGRSAENTLERKFPKIYAELLSMSRELVYGKGWNPQEIEFTFEGEEADQLYILQSRDMITIKKKEHLQVFEESVALQEAYLGHGVGVSGSALSGLAVFTEEHIAEIRARDADVPLILIRQDTVPEDIKIVDLADGLLTSRGGQTSHASVVAVRLEKTCVVGCRRLKVFETLGYCEIRGKRIHFADPVSIDGRSGQLLVGIHPIKEEYHILPI

SEQ ID NO: 38670 - protein, 566 aa, Oryza sativa (japonica cultivar-group)
IRRSPTPPTQGEELLAASPAGPRGGRKGRAVVLPLSAAALVACAVVLLLLAGGSAARRGQFVGADPTVLPSRGGGVGDLHLSQSKSNDGENVTIASSEVVNDKLLGGLLTTGFDEQSCLSRYQSVLYRKASSHFPSAYLLERLREHEALQKKCGPHTESYKKAIEQLKAGQGAKVMECNYLVWVAYSGLGNRILTMASAFLYAILTRRVLLVDSDKGTADLFCEPFPETSWLLPPKFPIKQFKNFSNGSPESYGNMLKNKAIRSNPAFLYLHMAHDYSDYDKLFFCEDNQQYLRNIPWLILKSDNYFVPSLFLIPAYQEELTRLFPQRDSVFHHLGRYLFHPSNVVWGMVTRYYDSYLARADERLGIQIRVFDPEPGPFQHVLDQVLACTLKENLLPAINSKQPIVSTRHSRLKSVLITSLNSGYYEKIRSMYWEHPTTNGEMISFHQPSHEEHQNSDKKMHNMKAWAEIYLLSLSDVMVTSAWSTFGYVAQGLSGLRPWLLFKPENRIAPDPPCRQVLSMEPCFHAPPFYDCKAKRGADTGKFVPYVSHCEDMSWGLKLVDQSEW

SEQ ID NO: 38671 - protein, 468 aa, Synechocystis sp. PCC 6803
MNPSSSPSQSTANVKFVLLISGVAALGGFLFGFDTAVINGAVAALQKHFQTDSLLTGLSVSLALLGSALGAFGAGPIADRHGRIKTMILAAVLFTLSSIGSGLPFTIWDFIFWRVLGGIGVGAASVIAPAYIAEVSPAHLRGRLGSLQQLAIVSGIFIALLSNWFIALMAGGSAQNPWLFGAAAWRWMFWTELIPALLYGVCAFLIPESPRYLVAQGQGEKAAAILWKVEGGDVPSRIEEIQATVSLDHKPRFSDLLSRRGGLLPIVWIGMGLSALQQFVGINVIFYYSSVLWRSVGFTEEKSLLITVITGFINILTTIVAIAFVDKFGRKPLLLMGSIGMTITLGILSVVFGGATVVNGQPTLTGAAGIIALVTANLYVFSFGFSWGPIVWVLLGEMFNNKIRAAALSVAAGVQWIANFIISTTFPPLLDTVGLGPAYGLYATSAAISIFFIWFFVKETKGKTLEQM

SEQ ID NO: 38672 - protein, 113 aa, Mycobacterium leprae TN
MNRLDFVDQASLRDDIPAFSPGDTINVHVKVIEGVKERIQVFKGVVIRRQGGGIRETFTVRKESYGVGVERTFPVHSPNIDHIEMVIRGDVRRAKLYYLRELRGKKAKIKEKR

SEQ ID NO: 38673 - protein, 476 aa, Silicibacter pomeroyi DSS-3
MAPKNEPSFRQSVDMMFNRAVALMDLPPGLEEKIRVCNATYTVRFGVRLRGQIQTFVGYRSVHSEHMEPVKGGIRYAMSVNQDEVEALAALMTYKCALVEAPFGGSKGGLCIDPRQYEEHELEQITRRFAYELAKRDLINPSQNVPAPDMGTGEREMAWIADQYARMNTTDINARACVTGKPLNAGGIHGRVEATGRGVQYALQEFFRDRVGVGKSGLDGKLDGKRVIVQGLGNVGYHAAKFLSEEDGCVITGIIERDGALVSDEGLDVEAVHNWIVKHGGVTGFPDGTFVAEGAKVLEEPCDILIPAAMEGVINLANADRIKAPLIIEAANGPVTAGADEILRKKGCVIIPDMYANAGGVTVSYFEWVKNLSHIRFGRMQRRQEEARHQLVIDELERLDRYLGDAWSMTPQFKEKYLRGADELELVRSGLDDTMRIAYQAMRDVWHERGDVEDLRTAAYLVSIDRVAKSYRAKGL

SEQ ID NO: 38674 - protein, 350 aa, Medicago sativa
MLDAVNEPENTELRHHDRRKCTHDRFMGSNFQLKDSDRPSSSIDSITNRADQILDDADVGECEIPWEDLVIGERIGLGSYGEVYRADWNGTEVAVKKFLDQDFSGAALSEFKREVRIMRRLRHPNVVLFMGAVTRPPNLSIISEFLPRGSLYRILHRPNCQIDEKQRIKMALDVARGMNCLHASTPTIVHRDLKSPNLLVDNNWNVKECDFGLSRLKHNTFLSSKSTAGTPEWMAPEVLRNEPSNEKCDVYSFGVILWELATLRLPWSGMNPMQVVGAVGFQNRRLEIPKELDPLVARIIWECWQQDPNLRPSFAQLTVAFKPLQGLVIPSHQDQVASPLPQEISVNSTP

SEQ ID NO: 38675 - protein, 103 aa, Triticum aestivum
  misc_feature (6)..(6): Xaa can be any naturally occurring amino acid
MGVYLXTPKTEKLSEDGENDKLKFGLSSMQGWRASMEDAHSALLDIDEDTSFFGVFDGHGGKVVAKFCAKYLHREVLKSEVYLAGDLGAAVHGAFFRMDEMMR

SEQ ID NO: 38676 - protein, 320 aa, Yarrowia lipolytica CLIB122
MSSLQKHLPMESKTKPAEIPLSAVPPSAKIHYPFWYGGFASVVAGVFTHPLDLAKVRLQTAKTRGQGLFGTLVNVVKHEGITGVYSGLSASMLRLSTYSTMRFGMYEYLKESIAPYYYNPNKRDQNPPMYVLLPISIIAGISGGIVGNPADIINIRMQNDQSLPKDQRRNYKHAFDGLIRMYKEEGVRAMFRGLGPNCTRGVLMTSSQMVSYDSFKALLVNHLGMNPDKKATHFSASLLAGLMATTVCSPVDVVKTRIMNAHAHHSKDSAFTIFFNALKQEGPLFMFRGWLPSFVRLGPQTILTYIVLEQLKFYKIGMRH

SEQ ID NO: 38677 - protein, 543 aa, Synechococcus sp. WH 7805
MNAVDRLAGHHKQRLSVAPVVLAILDGWGDCDGSDFNAIRSAETPVMDALKHAYPNTLIQASGSHVGLPDGQMGNSEVGHLTIGAGRIIRQELVRIGDTVRTNQLPAVPALRSLAERLRESGRTLHLFGLCSDGGVHSHVDHLCGLLRWAAAEGIQTVAIHAITDGRDTPRQSAPRYIHAIEEAMQASGIGEIVSLCGRYWAMDRDQRWERTSRAHSLLTDPEFPVSTESPTAVLEASYAAGTTDEFLEPTRLSACHVQEGDSLLMFNFRPDRARQIIQSLTLEDFEGFSRPHHPKLDVVTFTQYESGLPVKVAFPPESLDDLLGQVVAADGLKQYRTAETEKYPHVTYFMNGGIEQPLEGEDRHLVPSPRVATYDQAPAMAAETLTDSCIAAIEKGVYSLVVINYANPDMVGHTGVMEAATKAIETVDHCIGRLLDAVGRAGGTLMITADHGNAECMRGDDGQAWTAHTTNPVPVILVEGEKRKMVGMGNSLRLRNEGGLADIAPTLLQLLGLEKPDAMTGHSLIEAIDAAAPSTARLPQPV

SEQ ID NO: 38678 - protein, 323 aa, Oceanicola granulosus HTCC2516
MPHPPNKLSLVADIGGTNTRVALADGRRVLEPTIRRYRNAEFAGLESVLRRFIADEGDVDCVAACVAVAGPVRDGRATMTNLDWTMDRSTVSRATRAETVAVLNDLQAQGHALGHVAEGNIRTIVSGPDTQPHETKLVIGVGTGFNAAPVHETRVGRVVAPSECGHANLPIRSEAELKLCQFVSTAHGFPAIEDVLSGRGLERVYAWLGAEAGSPAEAKAADIMAACADGSDPRATEAARTFAQILGTVCGNLALIHLPFGGVFLVGGVARAIAPYLDGFDFDAAFRDKGRFAGFMANFAVCVVEDDYAALTGCAAHLVELSD

SEQ ID NO: 38679 - protein, 422 aa, Campylobacter jejuni subsp. jejuni NCTC 11168
MSNSVTITDNRNGKSYEFPIYDGTTGPSVVDMSSFYKQTGMFSYDEGLTSTATCKSKITYIDGENGILMHRGYPIEWLAENKLYLDVVHLLLYKELPDATRLEAFRYEMKKRSFIHEGMHRLFDSFPDNAHPMAVLQGAVSSLSAFYPDHLNMNVKEEYMEMAARIVAKIPTIVATAYRYKHGFPMAYPNLDRGFTENFLYMLRTYPYDHVELKPIEVKALDTVFMLHADHEQNASTSTVRAVGSTHAHPYACIAAGIGALWGHAHGGANEGVIRMLEQIGSVDRVDEFIKRAKDKNDPFRLMGFGHRVYKNFDPRAKVLKKLRDQLIDELGIDTNLIKVATRIEEIALSDDYFVQRGLYPNVDFHSGLILKALGIPNEMFATLFVIGRTPGWIAQWIEQKEQESLKIVRPRQLYLGETSKI

SEQ ID NO: 38680 - protein, 481 aa, Bacillus halodurans C-125; identical to SEQ ID NO: 1085

SEQ ID NO: 38681 - protein, 321 aa, Triticum aestivum
MAKKRKRSSDAPAPASVEKPDDSAPERPERTLFGFKDQPDSAAEPASKDAGPFFRNKEKVLITCSRRIIYRYRHLMQNVVSLLPHAKKDSKVESKQSKGSALNELVELRSCSSCLFFECRKQKDLYLWMVKSPAGPSVKFLVNAVHTMEELKLTGNHLKGSRPLLTFSSNFDQQPHWKLLKEMITQIFATPKDHRKAKPFHDHVFVFSIVDDHIWFRNYQISVPHNEIDKVDKGGLDKMTLVEVGPRFCLNPIKMFGGSFGGPTLFENPFYMSPNQIRALEKRKKAGKYAKKVKAKVRRKMHEMENTLEPDEFADLWKGED

SEQ ID NO: 38682 - protein, 416 aa, Arabidopsis thaliana
MSSTFRAPAGAATVFTADQKIRLGRLDALRSSHSVFLGRYGRGGVPVPPSASSSSSSPIQAVSTPAKPETATKRSKVEIIKEKSNFIRYPLNEELLTEAPNVNESAVQLIKFHGSYQQYNREERGGRSYSFMLRTKNPSGKVPNQLYLTMDDLADEFGIGTLRLTTRQTFQLHGVLKQNLKTVMSSIIKNMGSTLGACGDLNKNVLAPAAPYVKKDYLFAQETADNIAALLSPQSGFYYDMWVDGEQFMTAEPPEVVKARNDNSHGTNFVDSPEPIYGTQFLPRKFKVAVTVPTDNSVDLLTNDIGVVVVSDENGEPQGFNIYVGGGMGRTHRMESTFARLAEPIGYVPKEDILYAVKAIVVTQREHGRRDDRKYSRMKYLISSWGIEKFRDVVEQYYGKKFEPSRELPEWEFKSY

SEQ ID NO: 38683 - protein, 334 aa, Arabidopsis thaliana
MSNYAAGLGKPGSGKRRIRDLLNQPDNRVCADCGASDPKWASANIGVFICLKCCGVHRSLGTHISKVLSVTLDEWSDEEVDSMIEIGGNASANSIYEAFLPDTCSKPGPDVNHDQRMRFIRAKYELQEFLKPSLRITSGKGSTKSSAFLTSSLSRKIMDSFRTNSSSQTMEGMVEFIGLLKVTIKKGTNLAIRDMMSSDPYVVLNLGKQKLQTTVMNSNLNPVWNQELMLSVPESYGPVKLQVYDYDTFSADDIMGEADIDIQPLITSAMAFGDPEMFGDMQIGKWLKSHDNPLIDDSIINIVDGKVKQEVQIKLQNVESGELELEMEWLPLDQ

SEQ ID NO: 38684 - protein, 904 aa, Candida albicans SC5314
MEDKNAATQLNLPNVQSIGSHLSIQDHEIALQQVIDNPLSIGEVATTLTESQKWFVLKRLHFDALVSLEELPPQASFIFEKIEQMTTEEAVEILEKNIEEHETDVNIPENDLVLWKELVENSHKFTKVQLQEKLGSNSSSSVEGEKTADVEKGHEIVDWDLQVRLEAVLVAYWSPYPEVRAVTFPYDDPTIPVETFRVYLIGIIWTAIGAVINQFFTERQPAITLAMAVVQVFLYPSGLLCEWFLPKWKFKIWKYTIDLNPGPYTYKEQMLATIFCGVTGGSTSYVSSNILMQKSEIFYDNKWVDFGYQVLLILSTNFLGVGFAGIMRKFAVYPTKAVWPSILPGLALNKTLLTPAKKEVINGWKISGYNFFFITFVASFLYFWIPDYLFQALSTFNWMTWIKPDNQNLAVITGSVGGLGLNPITTFDWNYFSSMLQPLQVPFFYPLNNIIGMFFAFFCIIGVWYSNYKWTGYLPINDNGLFTNTGERYSVASVVNKDSLFDNAKYQEIGPPFYSAANLVVYGAFFAIYPFHFVYEIGMNYDQMWDACTSFWRVIKDFRKSTYDGFDDPHSTMMRAYPEVPEWAYLIIVVISLVLAILCVKLYPAQTPVWGIFFALGINFVFLIPLTTIYARTGFAFGLNVLVELIVGYAIPGNGLALAFIKALGYNIDAQAQNFVNDLKQGHYAKLPPRAVYRVQLLSIFVSSFIQLGILNFQINGIKDYCKPGNTQKFTCPGGRTFFSASVLWGVIGPKKVFNGLYPVLAWCFLIGFLLAFPCIAIKKYAPRKYVKYFEPSIVIGGFLKYAPYNLSYYIPGVYVSYAFMSYIKRKYEAWWQKYTYVLSTGLNAGIAFSSIIIFFAVMYHEKDINWWGNTVMYSGVDYAMTGWLDATVDAPDGYFGPRRGNFP

SEQ ID NO: 38685 - protein, 345 aa, Arabidopsis thaliana
MDGKASNGNGLEKTVPSCCLKAMACVPEDDAKCHSTVVSGWFSEPHPRSGKKGGKAVYFNNPMWPGEAHSLKVEKVLFKDKSDFQEVLVFESATYGKVLVLDGIVQLTEKDECAYQEMIAHLPLCSISSPKNVLVVGGGDGGVLREISRHSSVEVIDICEIDKMVIDVSKKFFPELAVGFDDPRVQLHISDAAEFLRKSPEGKYDAIIVDSSDPVGPALALVEKPFFETLARALKPGGVLCNMAESMWLHTHLIEDMISICRQTFKSVHYAWSSVPTYPSGVIGFVLCSTEGPAVDFKNPINPIEKLDGAMTHKRELKFYNSDMHRAAFALPTFLRREVASLLAS

SEQ ID NO: 38686 - protein, 751 aa, Cryptococcus neoformans var. neoformans JEC21
MPINPLEAEAYELPPLSQAAISPAEQYFEDLVAEEESAKLLDTEGQLKQDVEDELVDDSALYMRRTQDEEVIGRGSKVEELIARTVPSHDDPTLPTLTLRVIFLGSSFCILGACASQIFYFKSNAPSFSSYFVVLATYPLGHLLANERLVPRGNKIFGWEINPGRFSIKEAILISVLSSSGASSAYAADILAIMDLYFDTPLSPLPSILLLLTTQCIGFGLAGMLQNLLVSPPAMYWPSTLVTVQLFTTLYSTTSSTLSLTQQQLTFTRLRVFLVIFLAIFLYQFLPFLFFPTLTSVSLLCLVNNRSWWMRTLGSAYQGLGIMDFSFDWSSIGSSGPLYTPYWALGNYFGGLVGMLWIILPLLLMLNFWDARSFPSPVSAGLFNATFQKFDVASILKPDLSLDEAAWEEKKPLLLTPYFALTYGLSFAALSSVLVHVWLWHRDEIKQGNKLMRSYLPVPSVWYVGLLAVNFGAAVILVKTTSLQMPIWALVLAMAIATVSARDVGIIAAVSNTQIGLPIGNVTFKCYGYMAMSQALALTADLKLGWYTSIPPREMFTCQIIGTVLGALTNYATLVSVMAAKRPYLNGSLTDPTGQWTGRAPSIFYSASIIWGAVAPARFFSGGYEVLYLGFLVGALVPVGFWLAHKKWPGYKLNKVVFPIICSGATVVPQYPSNIILTSLLTAVLVNSWFAKRHPKLHRQYVYVASSALDAGTSITALAIYVLFGGVFWSWNGWEWWGNSGVDSEHCVPGS

SEQ ID NO: 38687 - protein, 626 aa, Oryza sativa (japonica cultivar-group)
MAYSLETSALLNSPRANNSALVPPPSSAINNHTRRTHGHPHRNSAPPPPPSPAMASSASLQRFLPPSSHVAASRRRPPAVRTRPVQSLTVSAPSSSTPVADDAVSAERLEPREKVKLGKEPISLFMEGGIKELAKMPMEEIEADKLSKEDIDVRLKWLGLFHCHKHQYGRFMMRLKLPNGVTTSEQTRYLASVIEAYGKDGCADVTTRQNWQIRGVTLPDVPAILDGLNAVGLTSLQSGMDNVRNPVGNPLAGIDPDEIVDTRSYTNLLSYITSNFQGNPTITNLPRKWNVCVIGSHDLYEHPHINDLAYMPAVKDGKFGFNLLVGGFISPKRWEEALPLDAWVPGDDIIPVCKAVLEAYCDLGTRGNRQKTRMMWLIDELGMEVFWSEVEKRMPNGVLERAAPEDLIDKKWQRRDYLGVHPQKQEGLSYVGLHVPVGRVQAADMFELARLADEYGSGELRLTVEQNIVIPNVKDEKVEALLAEPLLQKFSPQPSLLLKGLVACTGNQFCGQAIIETKQRALLVTSQVEKLVSVPRAVRMHWTGCPNSCGQVQVADIGFMGCLTKDSAGKIVEAADIFVGGRVGSDSHLAGVYKKSVPCDELAPIVADILVERFGAVRREREENEE

SEQ ID NO: 38688 - protein, 254 aa, Rhodobacter sphaeroides 2.4.1
MDYRTVFRLDGACAAVTGAGSGIGLEICRAFAASGARLILIDREGAALDRAAEELGAAVASRIVADVTDAEAMTAAAAAAEAVAPVSILVNSAGIARLHDALETDDATWRQVMAVNVDGMFWASRAFGRAMVARGAGAIVNLGSMSGTIVNRPQFASSYMASKGAVHQLTRALAAEWAGRGVRVNALAPGYVATEMTLKMRERPELFGTWLDMTPMGRCGEPSEIAAAALFLASPAASYVTGAILAVDGGYTVW

SEQ ID NO: 38689 - protein, 194 aa, Yarrowia lipolytica CLIB122
MPLITISAALTEGFKKHEVVPDVIDEFDPNTLLEITYGGENVVAVGNTLAVADTQHKPSIHASFPKDTEGTYTLVLTDPDAPSRTDNKWSEYCHYIVTGLKPGVVAEAEGAAVELDLSKGKELIPYMGPGPPPKTGKHRYVFVLYKEGAKSPEAPADRPTWGTNVPGSGTREWAKKNDLTLVTSNFFFAQNTEQ

SEQ ID NO: 38690 - protein, 840 aa, Candidatus Desulfococcus oleovorans Hxd3
MTNHWIDIKNADYILAMGSNPVKNHPISFKWILKAIEKGATLISVDPRYTRTSKKAHLYAPLRSGSDIAFLGGMIKYILEKRLYFEAYVREYTNASFLISPDFKMPGENEGVFSGLTALKTAEGYVDGKYDKTTWAYQKDENGIIKKDKTMKDPNCVLQLLKKHFSRYTLDTVSSITGTPKDKLEAVYATYAKSGAPDKTGTVLYAMGWTQHTVGVQNIRTMSIIQLLLGNMGMAGGGVNALRGESNVQGSTDHCLLYHIIPGYLKTPKASQPTFKAYNEASTPKTTDPMSANWWSNYPKYSASLLREMYGKEVPLEDAYRYLPKLDDGVDYSWLTIFDQLYQEKFTGFFSWGQNPTCSGANANKTRQALTKLDWLVNVNLFDNETGSFWRGPGMEPEKIKTEVFLLPCAASYEKEGSITNSGRWMQWRYKAVEPPGQARPDGDIINDLYVRLKKLYSGKGWFAGEGVFADPIVKLRWEYGPKDRNGNVKHIDPHMVAKEINGYFLENRVVKGRLFNSGDLVPDFTYLSADGSTSSGNWLYCNSYTKEGNMAARRRKEDPSGIGLYPGWSWCWPLNRRIIYNRASVDLNGKPWAPNKPVIEWHLNVWRGDVPDGGWPPLSAGGKSRYPFIMKTEGHGHIFGPGLTDGPFPEHYEPLESPLDRNPLSPQFVSPTIKRWDRDGLTNNMNMRATNDPNYPIICTTYRVTEHWQTGLMTRWQPWLAELEPAMFVEISKELADQKGIKNGEIVIVKSARGELEAVAMVTVRWLPFTVMGKTLHQVGIPYHYGWATTATRPYDPKDKKPEVFTFGDSANIVTPNIGDANTMIPESKVFMVDVVKKA

SEQ ID NO: 38691 - protein, 749 aa, Spiroplasma citri
MDRDIKYEEVLAQIKLYIKDEATLKEIQKAYEYAEEKHHGQVRNSGARYIIHPLWTTFFLAQWRMGPKTLIAGLLHDVLEDTPATFEELQELFGIEIANLVEGVTKVSYFAKENRTQIKAQYLRKLYLSMAKDIRVIIVKLADRLHNLKTIGYLKPERQQIIARESLEIYSAIAHRLGMKAVKQEIEDISFKIINPVQYNKIVSLLESSNKERENTINQKIEELKKILITEKKMSVKVYGRSKSIYSIYRKMNQFGKNFDDIHDILAVRIITNSVDDCYKVLGFVHQHYTPLNNRFKDYIATPKHNLYQSLHTTIVADDGLIFEVQIRTEEMDELAEQGVAAHWRYKEGENYDIAKKQKDIDERLDIFKRILDLENISVQERDEIQQEVYKPDHLMEQIIQNDIFSSLIYVLTPNGKVVTLPFGSTVLDFAYKIHSEIGEKTIGAKINGLFSPISTVLKSGDVVDIKTAATQKPNHSWLVVSKTSSALEKIKKYLKKELVEVTSDAKSVNLEKIKQTKSQIEEYIAKKDLKWKLVNSETQLERLHAINFNNIEDFLLDVANDEYTLEEAINLVYLDHETSQNEKILKKLQDKQYKKAQLKDDIIVQGISNIKVVISQCCLPIPYEDITGYVSKAEGIKVHLKTCRNIQSGDKQDRQVEVSWNEAVCKNKQYDCAIRIEAIDRPALLVDVTKVLSHLNASVQMMSANVSGDLMNLTIKTIIKVSNADRLQQIRSSLLTIPDIKVVERVMM

SEQ ID NO: 38692 - protein, 189 aa, Candidatus Desulfococcus oleovorans Hxd3
MDINRRQFLKFSGASIAGIAFGTLGLDLSPIEAYAYSLRTLHAKQTTTICPYCAVGCGILVHTINDKVVNTEGDPDHPINEGSLCSKGMAVYQLSHNNPNRLTVPLYRKPYGTRWEEVSWDFALDKIAKNIKTSRDASFEAVNAKGQEVNRTMGIASLGSAALDNEECYIYQKLLRAMGLVYIEHQARI

SEQ ID NO: 38693 - protein, 422 aa, Methanococcoides burtonii DSM 6242
MVTLDKSKDLFDKARKILPGGVSSPVRAIKPYPFYTESANGCRIKDVDGNEYIDYCLAYGPNILGHANPVIKQAIIDQLDKGWLYGTPTGLEVTLGEKIASLYPSIDMLRFVSTGTEATMSALRAARGFTCKNKFVKIEGGFHGAHDAVLVKAGSGATTHGKPDSLGIPEDFTKNTLQVAYNDIEAMTEVIESNQDDMAAVIMEPVLGNIGPILPEGDYLKEVRKVTEENDVVLIFDEVITGFRLAMGGAQEYFGVTPDMTTLGKIVGGGLPIGVFGGKREILEMISPSGSVYQAGTFSGSPASVAAGIAAVDVLEKEKVHEKLEATGNMLRAGLNDIIADKRLDFHVGGIASMFKVFFGDKPLNYQDVLKCDKEGYLQFFHDMLDSNVFLPPSQFETNFLSTAHTEADLETTLEAYAVNLK

SEQ ID NO: 38694 - protein, 629 aa, Pseudomonas syringae pv. syringae B728a
MSIKAKNAAHLRESAQVDSGSVQPFTRSQKIYVQGSRPDIRVPMREITLDVTPTDFGGEINAPVTVYDTSGPYTDPNVIIDVRKGLADVRSPWIDSRNDTERLPGLSSNFGQQRLSDAELTALRFAHVRNPRRAKAGANVSQMHYARQGIITAEMEYVAIRENMKLQEARAAGLLTQQHAGHSFGASIPKEITAEFVREEIARGRAIIPANINHVELEPMIIGRNFLVKINGNIGNSALGSSIEEEVAKLTWGIRWGSDTVMDLSTGKHIHETREWIIRNSPVPIGTVPIYQALEKVGGAAEDLTWELFRDTLIEQAEQGVDYFTIHAGVLLRYVPLTAKRVTGIVSRGGSIMAKWCLAHHKENFLYTHFEDICEIMKAYDVSFSLGDGLRPGSIADANDAAQFGELETLGELTKIAWKHDVQTMIEGPGHVPMQLIKENMDKQLECCDEAPFYTLGPLTTDIAPGYDHITSGIGAAMIGWFGCAMLCYVTPKEHLGLPNKDDVKTGIITYKIAAHAADLAKGHPGAQIRDNALSKARFEFRWEDQFNLGLDPDTARSYHDETLPKDSAKVAHFCSMCGPKFCSMKITQEVREYAANQRIEAVDVDVAKGLAEQAERFKQEGSQLYKKV

SEQ ID NO: 38695 - protein, 702 aa, Kluyveromyces lactis NRRL Y-1140
MTESGNGIVNTRQPKLFLDVPDMTSEAKKTYAELDVCTYTPKNLGDSKHEFMECDCFEEFRDGLNHACGEDSDCINRATLIECVNGLCKHSCGTDCQNQRFQKKAYADISVFKTERKGFGVRANSDIEPHNFIYEYIGEVIQEEEFRNRMVKYDQMGFKHFYFMMLQTGQFIDATLKGCIARFCNHSCNPNAYVNKWVVNGKLKMGIFANRHISKGEEVTFDYNVDRYGANAQPCYCEEPNCIGFLGGKTQTDAASLLPQSFADALGIRPSMEKKWINMMKAKGEKIAKSDTTTVNVDFVNSLSLEPCTKTEDVNRVMSVLLQIDDAFIAEKLLERITLTEDEAMHYQFIKLHGYLIFSRLITMFEDKPDIIWKILNFLLVLPKTTKNGIIHSGIDKKVEQLKNTPKFEVICEDLLEKWSKYETYTRISKKDISENSKVIDLRRIRLPIGWEIIHENGRPVYYNAQRQIKQANPPTDSAYRSNSSHNLSGVSDPKSRSATPSSNTSRYSGSVKYIPTPTYGQMQQKRTLSPEEYEKRKKSRIEWEQKELELRKLMEQETLKAKLDQETQKKSELERIIEEANKQKELERLQKLKQQQEDEERKKVKKQASHVNAIENKWVKFFAQHVPNLIKNYQKDVGKDVLKESARNIVKSLAQKELKKDSSRSPPEELSKEKRAKVKTFSMQYMDRLVAKMKEKKEKKR

SEQ ID NO: 38696 - protein, 685 aa, Ostreococcus tauri
MLRLHHGASALRFARPRPRFGRSARAVTPTKAGLLDSFRNVSKRSQNGAKSATGTTSEVDVAALERAVKLETAPVRQGEKNEANTKRRAVMAGNWKLNPKTAADAKTLAALVGAARRDVDADVDVFVCPPAPFLADVNSSSSEFLEGSGVAVGCQNIYWKDSGAFTGEMTAEMAKSVGCTHVLVGHSERRELFGETDEHTRLKTRKAIDCGMTAVLCIGETKTEYEAGQARRVCSRQLEAALEGVQADELSQVIVAYEPVWAIGTGLTATPAIAQSVHAGIRQWFREKYGDGAASKIRIQYGGSVKPETVDELMQAPDVDGCLVGGASLVAEQFGRIFNFDPTPEGPRKLWAEEVVPCGNQLGESPIWSEERQTLYWVDAPAGTLFSWDLKSAPVRTNFGEVLGCVGLRSGGTLILGLESGLHAFDPATKKLKLLSEFEPGLNTRPNDGRVDRFGNFVIGSYNNAHRVDAAPIGGLWRLRAKGQELEEILDYKFRCSNCICFTKSGTTMFFCDTPTRKIYQFDYDPRVGPMNRRLLYELPSSVPGGPDGAQCDDDGNLWAAISGAGKVIRITPEGKVNLEIELPVKQPTSVTIGGPMLDTVFITTRAENGRNDAGSLFACRVDDTRGIPEPEYADSTSLANAETLTPGLTRAEQSAAKSKFCSDCGVAFASKTARFCANCGARRS

SEQ ID NO: 38697 - protein, 280 aa, Arabidopsis thaliana
MPPSALDRLASLHIEYPMLFQLSNVSVEKTSHCGVLEFTADEGLVYLPYWMMQNMSLEEGDVMQVKNISLVKGTYIKLQPHTQDFLDISNPKAILETTLRSYSCLTTGDTIMVPYNNKQYYINVVEAKPSSAVSIIETDCEVDFAPPLDYKEPEKPQKLTPSNKRPLQVKEEEEPASKVPKFTPFTGSGKRLDGKAQTQTEPEDTKQQEKPTENGKDDEKLSVTTPRQISGKLVFGSNSKSAAKETAKVDDPKNIVQESSTKSDEAKFKVFTGKKYSLNG

SEQ ID NO: 38698 - protein, 293 aa, Saccharomyces cerevisiae
MAQEITHPTIVDGWFREISDTMWPGQAMTLKVEKVLHHEKSKYQDVLIFKSTTYGNVLVLDNVIQATERDEFAYQEMIAHLALNSHPNPKKVLVIGGGDGGVLREVVKHDSVEEAWLCDIDEAVIRLSKEYLPEMAASYSHPKVKTHIGDGFQFLRDYQNTFDVIITDSSDPEGPAETLFQKEYFQLLNSALTEKGVITTQAESMWIHLPIIKDLKKACSEVFPVAEYSFVTIPTYPTGTIGFMVCSKDKTCNVKKPLREISDEKEAELYRYYNKKIHEASFVLPTWAAKELN

SEQ ID NO: 38699 - protein, 385 aa, Bacillus halodurans C-125
MIRIFQTVLLAIVSAIVGFMIISITFVEYWSHTEAGKVPPKTAVLLHAIHHNLVTPDMRPPKFLTQSNGHSRFKTELIQIPVSDGASIPARVYQPKASGPHPIILYYHGGAFLEGYGDINTHDNIVRALAVRTGSIVVAVGYRVAPGHPFPTAIEDSYDALDWISKNAELFNGDPANVAVVGDSAGGNIATVVSLMARDREGPEISAQVLLYPLTTFQDVAFPSRDHYDSGYYLLSRAVMVQAREKYTPQQESWLNPYTSPLNADLEGVPPAFVVTAEFDPLRDEGEMYAQSLADAGVPVQAIRYNGVMHGFVSFYEVMERGDDALHQASMFLKKSFYDDMDAKPYELVIDDVPSAQVAIKDRLEAYAIGGFLIGKQSLSLFSGW

SEQ ID NO: 38700 - protein, 560 aa, Saccharomyces cerevisiae
MSQRKLQQDIDKLLKKVKEGIEDFDDIYEKFQSTDPSNSSHREKLESDLKREIKKLQKHRDQIKTWLSKEDVKDKQSVLMTNRRLIENGMERFKSVEKLMKTKQFSKEALTNPDIIKDPKELKKRDQVLFIHDCLDELQKQLEQYEAQENEEQTERHEFHIANLENILKKLQNNEMDPEPVEEFQDDIKYYVENNDDPDFIEYDTIYEDMGCEIQPSSSNNEAPKEGNNQTSLSSIRSSKKQERSPKKKAPQRDVSISDRATTPIAPGVESASQSISSTPTPVSTDTPLHTVKDDSIKFDNSTLGTPTTHVSMKKKESENDSEQQLNFPPDRTDEIRKTIQHDVETNAAFQNPLFNDELKYWLDSKRYLMQPLQEMSPKMVSQLESSLLNCPDSLDADSPCLYTKPLSLPHPTSIFFPNEPIRFVYPYDVPLNLTNNENDTDNKFGKDSKAKSKKDDDIYSRTSLARIFMKFDLDTLFFIFYHYQGSYEQFLAARELFKNRNWLFNKVDRCWYYKEIEKLPPGMGKSEEESWRYFDYKKSWLARRCGNDFVYNEEDFEKL

SEQ ID NO: 38701 - protein, 195 aa, Zea mays
  misc_feature (36)..(36): Xaa can be any naturally occurring amino acid
  misc_feature (54)..(54): Xaa can be any naturally occurring amino acid
  misc_feature (72)..(72): Xaa can be any naturally occurring amino acid
  misc_feature (80)..(81): Xaa can be any naturally occurring amino acid
  misc_feature (87)..(87): Xaa can be any naturally occurring amino acid
  misc_feature (94)..(94): Xaa can be any naturally occurring amino acid
  misc_feature (106)..(106): Xaa can be any naturally occurring amino acid
  misc_feature (108)..(108): Xaa can be any naturally occurring amino acid
  misc_feature (126)..(126): Xaa can be any naturally occurring amino acid
  misc_feature (143)..(143): Xaa can be any naturally occurring amino acid
  misc_feature (167)..(167): Xaa can be any naturally occurring amino acid
MASASMLARSLLRTPDPTQTSHPNRRSAAVVSFPRXPPPLSVRASVSTASPSPXPQPAAAAAGVPKHCFRRXADGYLYCXXVRVEDXMTAAERXPFYLYSKAQILXQXPLYRDALQGLRSIIGGCXKANNTLPVLPVLGELGXAAPFLAGGKELRLPLQGGIPPPPXFFNGNGKTPQNFKITWGKGGIFKKGETQ

SEQ ID NO: 38702 - protein, 433 aa, Triticum aestivum
FVAAEVFHGMVGGGGKGMQENEFNGFFSMPYYQKIGEGSHMSVDSTDNYNLAGSHMSVDSTDNYNLAGGSVTMSVDNSSVGSNESRTVILKHPGLRDAPTASYSVGNSVFRPNRVAAHTLNEDALARVLMDPNHPTEILSKYQQWAIDLGRLDMGVPFAQGAFGKLYRGTYIGEDVAIKLLEKPENDIERAQSLEQQFVQEVMMLSTLRHPNIVRFIGACRKSIVWCIITEYAKGGSVRQFLAKRQNKSVPLRLAVKQALDVARGMAYVHALGFIHRDLKSDNLLIAADRSIKIADFGVARIEVKTEGMTPETGTYRWMAPEMIQHRPYDHKVDVYSFGIVLWELITGMLPFTNMTAVQAAFAVVNKGARPAIPHDCLPSLTHIMTRCWDANPEVRPPFTEIVCMLENAEMEVVSHVRKARFRCCVAEPMTTD

SEQ ID NO: 38703 - protein, 178 aa, Synechocystis sp. PCC 6803
MVRLLMVFPQRFSPSHLLSRHWGWLAVAMASLGSLSSLPVNVNSSVVAQTAPSSPMTVRSDIQEANSQTGVVTARGNVQVYYPARNLQATAAQAQYFSQERRLVLSGNVYVLQDGNSMRAETMTYLVDEGRFVANPQANQQVESIYLVEESQSPAGPAPTGPNPLPGDTLPDLPPLGS

SEQ ID NO: 38704 - protein, 263 aa, Streptococcus pneumoniae TIGR4
MVRPEQGLMALRKELNLYANIRPVKIFDSLKHLSPLKLERIAGVDFVVVRELTGGIYFGYHILEERNARDINDYSYEEVERIIRKAFEIARNRRKIVTSIDKQNVLATSKLWRKVAEEVAQDFPDVTLEHQLVDSAAMLMITNPAKFDVIVTENLFGDILSDESSVLSGTLGVMPSASHSENGPSLYEPIHGSAPDIAGQGIANPISMILSVSMMLRDSFGRYEDAERIKRAVETSLAAGILTRDIGGQASTKEMTEAIIARL

SEQ ID NO: 38705 - protein, 448 aa, Mycobacterium leprae TN
MDRQKEFVLRTLEERDIRFVRLWFTDVLGYLKSVAIAPAELEGAFEEGIGFDGSSIEGFARVSESDTVAHPDPSTFQILPWATTAGHHHSARMFCDITMPDGSSSWADPRHVLRRQLTKANDLGFSCYVHPEIEFFLLKAGPEDGSMPIPVPVDNAGYFDQAVHDSALNFRRHAIEALEFMGISVEFSHHEGAPGQQEIDLRFADALSMADNVMTFRYVIKEVAIENGARASFMPKPFAQHPGSAMHTHMSLFEGDVNAFHSDDDPLQLSDVGKSFIAGILEHASEISAVTNQWVNSYKRLVVGGEAPTTASWGAANRSALVRVPMYTPHKTSSRRVEVRSPDSACNPYLAFAVLLAAGLRGVEKGYVLGPQAEDNVWDLTPEERLAMGYRELPTSLDSALGAMEVSEFVAEALGEHVFDFFLRNKRAEWANYRSHVSLYELKTYLSL

SEQ ID NO: 38706 - protein, 344 aa, Magnetospirillum magnetotacticum MS-1
MGIESSCDETAAALVNDHREILGEVVLSQLDEHRPFGGVVPEIAARSHLTHLDRLVAEAMRRAGAGFADLDAVAATGGPGLIGGVMVGVMTGKAIALASGKPFLAINHLEGHALTARLTHDIAFPYLLLLASGGHCQLLAVEGVGQYTRLGTTIDDAAGEAFDKLAKMAALGYPGGPAVEAAAAGGDPARFTLPRPLKGKPGCDFSFSGLKNAARLLIESLPQPLSAQDQADVARAFQDAVADSMADRVRRGVREMKTRWPATRHLVVAGGVAANTALRQILVRIGAETGLEFLAPPLKLCTDNAAMIAWAGIERLRLGQCDDLSFAPRPRWPLDPNARKGAKA

SEQ ID NO: 38707 - protein, 138 aa, Cucurbita maxima
MGMGMMEVHLISGKGLQAHDPLNKPIDPYAEINFKGQERMSKVAKNAGPDPIWNEKFKFLVEYPGSGGDFHILFKVMDHDAIDGDDYIGDVKIDVQNLLAEGVRKGWSELPPRMYQVLAHKIYFKGEIEVGVFFQRQG

SEQ ID NO: 38708 - protein, 386 aa, Triticum aestivum
  misc_feature (105)..(105): Xaa can be any naturally occurring amino acid
SAPHRVRSPRPHHHERERETDGRRPVAAARRPGSTRARGGLVARAVVAAKGEVASSDTGGHEVLMFEALREAMIEEMTLDPTVCMIGEDVGDYGGSYKVSKGLSXHFADLDLRVLDTPIAENSFTGMGIGAAMKGLRPVVEGMNMGFLLLAYNQISNNCGMLPYTSGGQFKIPIVIRGPGGVGRQLGAEHSQRLESYFQSIPGIQMVACSTPYNAKGLRKAARGSDNPVVLFEHVLLYNLKEKIPDEEYICCLEEAEMVRPGSQLTILTYSRMRYHVMQAVKTLVNKGYDPEVIDIRSLKPFDLHTIGNSIKKTHRVLIVEECMRTGGIGASLRSAIIDNFWDELDARPVCLSSQDVPTPYAATLEDATVVQPAQIVAAVEEICQS

SEQ ID NO: 38709 - protein, 472 aa, Rhodobacter sphaeroides 2.4.1
MRNIDRFFIGGAWTAPLGTDRHRLVNPATEEEIAAIPMASTEDVDRAVTAARAAFEGWQASSKEERLLLLRRLLDLYNEAYDELAELMTREMGTVARFSREAQAWVGRAHLEAAIEALEAESFEEMRGSTLISKEPIGVCALITPWNWPMNQLVVKVAPALAAGCTVVAKPSEFSPLSSIRFAELVEAAGFPPGVYNHITGAGPVAGEALARHPDVDMISITGSTRAGIAVARAAADTVKRVTQELGGKSANIILPDADLATAVRQGVLDCFGNAGQACKAPARMLVPAERMEEAAALAGAAAEALTVGAPEGEVDLGPVVNESQWRRIQSLIEAGIAEGARLVTGGPGRPDHLPRGWYVRPTVFADVAHGSTIATEEIFGPVVALIPYRDEEEAVRIANDSIYGLAGYIQTGDPETARRIARKLRVGMVYINGAGWDARAPFGGYKQSGNGREHGAWGLADYLETKATAGL

SEQ ID NO: 38710 - protein, 150 aa, Cucurbita maxima
MGMGMMEVHLISGKGLQAHDPLNKPIDPYAEINFKGQERMSKVAKNAGPNPLWDEKFKFLAEYPGSGGDFHILFKVMDHDAIDGDDYIGDVKIDVKNLLAEGVRKGKSEMPPRMYHVLAHKIHFKGEIEVGVSFKLQGGGGCGGCYPWEN

SEQ ID NO: 38711 - protein, 936 aa, Mycobacterium leprae TN
MTIEFARPDLAKNPSSTNESNSVRVIREGVASYLPDIDPEETAEWLESFDELLKHSGPSRARYLILRLLERAGEQRVTIPALTWTDYVNTIPTELEPWFPGDEDIERRYRTWIRWNAAIMVHRAQRPGVGVGGHISTYASSAALYEVGFNHFFRGKSHPSGGDQVFIQGHASPGIYARAFLEGRLSADQLDGFRQEHSHPGGGLPSYPHPRLMPDFWEFPTVSMGLGPLNAIYQARFNRYLHDRGIKDTSDQHVWCFLGDGEMDEPESRGLAHVASLEDLDNLIFVINCNLQRLDGPVRGNGKIIQELESFFRGAGWNVIKVVWGREWDALLHADRDGALVDLMNATPDGDYQTYKANDGRFVRDHFFGRDPRTKALVEHMSDQEIWNLKRGGHDYRKVYASYRAAVDHKGQPTVILAKTIKGYALGKHFESRNATHQMKKLTLEDLKEFRDTQRIPISDTELEENPYLPPYYHPGPDSPEIRYLLDRRRALGGFLPERRTKSGALTLPGRDTYAALKTGSGQQEVATTMAIVRTFKEVLRHKEVGPRIVPIIPDEARTFGMDSWFPSLKIYNHNGQLYTAVDAQLMLAYKESEVGQILHEGIDEAGSVGSFIAAGTSYSTHNEPMIPIYIFYSMFGFQRTGDGLWAAADQMARGFLLGATAGRTTLTGEGLQHADGHSLLLAATNPAVVTYDPAFAYEIAYIVESGLTRMFGEDPENVFFYITVYNEPYPQPPEPENFDPDGVLRGMYRYYTAKEQRSNKAHILASGVSMPAALTAAEMLSTQWDVAADVWSVTSWGELNRDGMSIETARLRYPDQPTSVPYVTQVLSEARSDNAGPVIAVSDWMRAVPEQIRPWVPGTYVTLGTDGFGFSDTRTATRRYFNTDAESQVVAVLEALARDGEIDPSVPVAATRQYQIDDVQAAPEQTSDPGPGVQN

SEQ ID NO: 38712 - protein, 348 aa, Hyphomonas neptunium ATCC 15444
MPVRINPHWILARTPIKGWPVDEDFSWREAPAILPQLGQMLTRTIYLSLDPYQWGRRRRGVEIPGEVCHGRTVSQVLQSRIKGFEAGDYVFNTNGWQTYGLTGEGISDFGYMLPRKIDPNMAPISSALGILGMLGLTAYAGIVVQCAPQPGETVVISAASGGVGQVAGQLAKLRGCRVVGIAGREEKCAYVRDTLGLDACISHLDSDFSERLRAACPDGVDVYFENVGGRVFEAVLNLFNINARITLCGLASQYGAMNEDIMQVWNETGADIFSRRNVIVHPLFVGNFVVSHQDQFLAEMAEWLRGGHMHYLEDISDGLESAPQAFREMLAGGTFGKTLVQVSADPTL

SEQ ID NO: 38713 - protein, 382 aa, Arabidopsis thaliana
MDICCKDIISDHSKKDIISDLPEALICHILSFLPIEDSALTSVLSKKWQHLFAFRPNLEFDDAVVYLNPDGERNETIFENFVDRVLSLQGDYPINKFSLTCRDFTDPTCVSRWISNVMERGVSDLDLRCIVYWDNGTMPPDIFVSKALVHLRIETGNGAFIDVEDVFLPNLKTLYLNKVLLRHSDNGFVKLITSCHVLEDLFIMNICWDGYLKRSLSSKTLKRLTFFCEDVHAVNPESVSFDTPNLVYFVYHDCVADKYKNMNFDSLVYASICLQMTSHQRTHASYEHLVGNATDFLLGISNVQILELFANTIEVLTFCCEQIPVFKNLVCLIIKTDQKAGWESLPVLLKNCPDLESLIFDGLETHFVSQILIQCSLLPTIL

SEQ ID NO: 38714 - protein, 505 aa, Oryza sativa (japonica cultivar-group)
MWWLAAVASATTGNMGDGRSGGVGVGVRREQRWLWRYVAGVATLGMAAAAATAGKRGGGGSSRGVGSRGTDVAKGDAVVVVESDKADMDVETFHDGIVAAVLVPAGESAPVGAPIALLAESEDDLQAALAKAQELSKAHPQQAPPPSDAAAPPPPPPPPAAAPAAPAPVAAGTKGIATPQAKKLAKQHRVDLAKVAGTGPFGRITPADVEAAAGIEPKPKVVPAASAAPVPLSAPAIGAVPQAAELPPVPGATVVPFTGMQAAVSKNMVESLAVPAFRVGYPIVTDKLDELYEKVKSKGVTMTVLLAKAAAMALAQHPVVNASCRDGKSFTYNTNINIAVAVAIDGGLITPVLEDADKLDIYLLSQKWKELVKKARAKQLQPNEYSSGTFTLSNLGMFGVDRFDAILPPGQGGIMAVGASKPTVVADKDGFFSVKSKMLTPCITDSQWQRQELCLVINELPHVYNLGWLGVVNVTADHRIVYGADLAAFLQTFAKIIEDPESLTL

SEQ ID NO: 38715 - protein, 509 aa, Triticum aestivum
MEVWSIRAAQLLLFFFLLSERHGSCAALGEEGRAMGFREEHPSGWLWNLEEKKVFSAAATPLVKGKKLSIEIPNELQERIMISEVLTDGRQESCRKCLTKTIESNTLRQLLQARGLQESAPSSKAPDQFHESQAPMSSPPSHSQAETNDSSSVLHWVIYALCVSGALGLVIIASVVYLLVSRRKKDNTVNPWATGLSGQLRKAFVTGVPSLGRAELEAACENFSNVIGTVSDSALYKGTLSSGVEIAVASSPVKSAKEWSDRSEEQFRNKISELSKVNHKNFMNLLGYCTCDDPFTRMMVFEYAPCGSLFEHLHVREAEHLDWPTRLRIIMGVTYCLEHMNQLDPPVTPRTLNSSSIYLTEDYAAKFSDTEFWKDDDADASAPTRSAGQDSIVYKFGILLLEVISGRLPFSEDHGLLVLWASSYLDGKRPIGSMADPVLRASSPVPEEDLAALCDVVRLCINREAAKRPSMGEVAGLMKGAVRLSPEQTTPRNNPLWWAELEIMSTAST

SEQ ID NO: 38716 - protein, 519 aa, Oceanicola granulosus HTCC2516
MDQHDTLLIIDFGSQVTQLIARRLRELNVYCEIHPFQNVTPALLAETAPKAVILSGGPASVIDAGSPRPPAEVFELGVPVLGICYGQQVMMEMLGGRVERGDGTSEFGRAWVERKGDKHPDLLTGWFLEAREQVWMSHGDHVAKLAPGFEVLGTSPGAPFAITGDRARHFYAVQFHPEVHHTPNGRTFLENFVKIAGFTGDWTMAAYKDEAIRLIREQVGDARVICGLSGGVDSSVAAVLIHEAIGDQLTCVFVDHGLLRQNEAEEVVGMFRDAYNIPLIHADEADLFLGELEGVSDPEVKRKTIGRLFIDVFQREANKIEGASFLAQGTLYPDVIESVSFSGGPSVTIKSHHNVGGLPEKMGLKLVEPLRELFKDEVRALGHELGLPASFIGRHPFPGPGLAIRCPGEITRDKLEILRKADAVYIDQIRKHGLYDEIWQAFVALLPVRTVGVMGDGRTYDYACALRAVTSVDGMTADYYPFSHDFLGETATRIINEVRGINRVTYDITSKPPGTIEWE

SEQ ID NO: 38717 - protein, 315 aa, Glycine max
MAPPRGRGGSRGGGGGGFRGGGRGDRGRGRGGGGRGGDRGTPFKARGGGRGGGGRGGGRGGGRGGGRGGMKGGSKVVVQPHRHDGIFIAKGKEDALVTKNLVPGEAVYNEKRITVQNEDGTKEEYRVWNPFRSKLAAAILGGVDNIWIKPGARVLYLGAASGTTVSHVSDVVGPTGVVYAVEFSHRSGRDLVNMAKKRTNVIPIIEDARHPAKYRMLVGMVDVIFSDVAQPDQARILGLNASYYLKTGGHFVISIKANCIDSTVPAEAVFESEVNKLKADQFKPFEQVTLEPFERDHACVVGGYRMPKKKKDAAE

SEQ ID NO: 38718 - protein, 680 aa, Saccharomyces cerevisiae
MTQFTDIDKLAVSTIRILAVDTVSKANSGHPGAPLGMAPAAHVLWSQMRMNPTNPDWINRDRFVLSNGHAVALLYSMLHLTGYDLSIEDLKQFRQLGSRTPGHPEFELPGVEVTTGPLGQGISNAVGMAMAQANLAATYNKPGFTLSDNYTYVFLGDGCLQEGISSEASSLAGHLKLGNLIAIYDDNKITIDGATSISFDEDVAKRYEAYGWEVLYVENGNEDLAGIAKAIAQAKLSKDKPTLIKMTTTIGYGSLHAGSHSVHGAPLKADDVKQLKSKFGFNPDKSFVVPQEVYDHYQKTILKPGVEANNKWNKLFSEYQKKFPELGAELARRLSGQLPANWESKLPTYTAKDSAVATRKLSETVLEDVYNQLPELIGGSADLTPSNLTRWKEALDFQPPSSGSGNYSGRYIRYGIREHAMGAIMNGISAFGANYKPYGGTFLNFVSYAAGAVRLSALSGHPVIWVATHDSIGVGEDGPTHQPIETLAHFRSLPNIQVWRPADGNEVSAAYKNSLESKHTPSIIALSRQNLPQLEGSSIESASKGGYVLQDVANPDIILVATGSEVSLSVEAAKTLAAKNIKARVVSLPDFFTFDKQPLEYRLSVLPDNVPIMSVEVLATTCWGKYAHQSFGIDRFGASGKAPEVFKFFGFTPEGVAERAQKTIAFYKGDKLISPLKKAF

SEQ ID NO: 38719 - protein, 162 aa, Ostreococcus tauri
MTRDFFNSPAFGNILALAAAGLYASYTATMKLHLREDERTDMTLFFSLMGLVNFFGYGAVLVIGRALGGFTHLYHAFDARAFWLACTKAFFDNVLSDYLWARAVLLTSPTIASIGLSLQIPLAASVEVVIGHPIWASKLKNALIMTGGTVFILLGFAGVTAN

SEQ ID NO: 38720 - protein, 333 aa, Streptococcus pyogenes SSI-1
MMSETKLMALREAVNLAMTEEMRKDENIFLMGEDVGVYGGDFGTSVGMIEEFGPKRVKDTPISEAAISGAAIGAAITGLRPIVDVTFMDFLTIMMDAIVNNGAKNNYMFGGGLITPVTFRVASGSGIGSAAQHSQSLEAWLTHIPGIKVVAPGNANDAKGLLKSAIRDNNIVLFMEPKALYGKKEEVNQDPDFYIPLGKGDIKREGTDLTIVSYGRMLERVLQAAEEVAADGINVEVVDPRTLIPLDKELIIESVKKTGKLMLVNDAYKTGGFIGEIATMITESEAFDYLDHPIVRLASEDVPVPYARVLEQAILPDVEKIKAAIVKMANKGN

SEQ ID NO: 38721 - protein, 445 aa, Bacillus halodurans C-125
MAKDESYLIKPLLDRNYPCVSYGKGAALYDMDGKRYLDACSGAVTASIGHGVDEVVQAMYEQARKVSFVYRSQFTNEPAERLAMKLAEQLPGQLNHSFFVNSGSEATETAIKISIQYWQERGRPEKTLILSRWMSYHGITQGALSLSGHYERRQRFEGMLDRLPFLSPPYPYRQVREMSGVDYAEELDHLIEQIGPHRIAAFIAEPIVGAAGTALVPGEWYYEALKQVLDQHDILFICDEVMTGMGRTGKDLAIEHWDATPDIVTLGKGLSAGYAPLAATVVADHVLEPIQAGSNLIMSGHTFSANPLSCAAGLAVLHYVKKHDLVKRAATIGEKLIEDLQEIQTASAIVGDVRGKGLLIGLEFVKNKATKAPFPKDAQVAAVIVNEAQRQGLLLYPSAAGLKGEGAGCLIAPPFTLTKEERCELLGKLARTLERVEKQLLGAEK

SEQ ID NO: 38722 - protein, 339 aa, Lactococcus lactis
MKRIAVLTSGGDAPGMNAAIRAVVRKAISEGIEVYGINHGYAGMVAGDIFPLTSASVGDKIGRGGTFLYSARYPEFAQVEGQLAGIEQLKKFGIEGVVVIGGDGSYHGAMRLTEHGFPAVGLPGTIDNDIVGTDFTIGFDTAVSTVVDALDKIRDTSSSHNRTFVVEVMGRNAGDIALNAGIAAGADDISIPELEFKFENVVNNINKGYEKGKNHHIIIVAEGVMTGEEFATKLKEAGYKGDLRVSVLGHIQRGGSPTARDRVLASRMGARAVELLRDGIGGVAVGIRNEELVESPILGTAEEGALFSLTTEGGIKVNNPHKAGLELYRLNSALNNLNL

SEQ ID NO: 38723 - protein, 326 aa, Streptococcus pyogenes SSI-1
MEAEMVTVSKEQHLDMFLKMERIREFDSRINKLVRRGFVQGMTHFSVGEEAANVGAVAHLSYDDIIFSNHRGHGQSIAKDMDLNKMMAELAGKATGVSKGRGGSMHLADFEKGNYGTNGIVGGGYALAVGAALTQQYKGTNNIAVAFSGDGATNEGSFHESVNMAATWKLPVIFFIINNRYGISMSINNATNTPHLYTRAEAYGIPGFYCEDGNDVMAVYETMGKAVEHVRGGNGPAIVEVESYRWFGHSTADAGKYRTKEEVDEWKEKDPMIKYRTYLTSEGIATDDELDAIQAQVKKEVDDAYEFAQNSPDPELSVAFEDVWVD

SEQ ID NO: 38724 - protein, 685 aa, Schizosaccharomyces pombe 972h-
MTSSSYTDIDTLAINTIRTLAVDTTAHAKSGHPGAPMGLAPAAHVLFSRIMKFNPAHPKWLNRDRFILSNGHACVLQYIMCHLLGYKLTIEDLKQFRQVGSKTPGHPETHNPDLNIETGAGPLGQGIASAVGLAIGKAHSAAVYNKPGFDLFSNYTFCFLGDGCLQEGVSSEACSLAGHLKLSNLIAVWDNNKITIDGATSMSFDEDVEKRFEAYGWNIVRVANGDTDLDGIEKGFREAMSCTDKPTLINLKTTIGYGSELQGTHSVHGSPLKPEDCVHVKKLFGFDPTKTFQVPPEVYAYYKERVAIASSAEEEYKKMYASYKQSYPDLSNQLERILSRKFPEGWEKHLPVYKPGDKAVATRKLSEIVLDALCPVLPELVGGSADLTPSNLTRWEGAADFQPPSSKLGTYAGRYIRYGIREHGMAGIMNGLAVYGPIIPYGGTFLNFVSYAAGAVRMAALNNSRVIYVATHDSIGLGEDGPTHQPIETFAHFRAMPNINCWRPADGNETSAAYYSALTSDSTPSILALTRQNLPQLENSTIENALKGGYVMLENKEADITLVGTGSEVSLCIDTVKTLETEYNLKARVVSLPCWEVFEQQPESYRLSVIPDGIPAMSVEVWATNGWRRYVHEAFGMHTFGDSGPAPKLYEKFHFTTSGVAQRAKKTVDAYKDIPYIRSPVRRAF

SEQ ID NO: 38725 - protein, 517 aa, Synechococcus sp. WH 5701
MESLETQVERHWQAFLSLRNDLERFRFAVALRQANLTLFHRFLADHIEAVMPIVYTPTVGAAIQRFSLDYRTPSGGVFLAAPDLERIESVLSQAATGPVDLILITDSQGILGIGDQGIGGIEICLGKLAVYTLCAGLDPARVLPLVLDVGTDRVELLENPLYPGWRHPRLDGLDYDRFLARSVEALQRQFPGALLHWEDFGTGHAHQLLERYRLQLPSFNDDIQGTRGVACAVVKAASHGAGLPLEDHRIVVFGAGTAGCGIAEGLVRLLTRAGLSEPEARRRIWAIDREGLVLADQPGLSPMALALARDPSERSLFEHDTQGRIGLLEVVRAIQPTVLIGTSTVTGAFSREVVDTMAAAVERPIILPLSNPTRLAEATPADLYAWTGGRALVASGSPFEPVSWQGSLRRIGQCNNCFLFPGLGFASVAVGATQVSEGMIDAGLDALADRIPAFRDPEAPLMPELTQVQAVSRAVAEAVALAAVHEGLASRAASAEEAIERLDQATWTAAYRELEAI

SEQ ID NO: 38726 - protein, 115 aa, uncultured crenarchaeote
MLVKIQDEFIDKLDFVKRDGLIPVVVQDIKTKDILMLAYANRVAIENTVKTGNAWFWSVSRNKLWMKGEESGNVQEVKDILVDCDQDSVLYLVDSKNPACHTGNRTCFHNRLYPN

SEQ ID NO: 38727 - protein, 425 aa, Oryza sativa (japonica cultivar-group)
MKRKYYSFEECMSLREVKSLRRMNHPNIVKLKEVIRENDILYFIMEYMECNLYQLMKDRVKPFSEAEVRNWCFQIFQALAYMHQRGYFHRDLKPENLLVSKDVIKLADFGLAREVTSVPPYTEYVSTRWYRAPEVLLQSSIYDSAVDMWAMGAIMAELLTLHPLFPGTSEADEILKICNVIGSPDEQSWPQGLSLAETMKFQFPQVSGNQLAEVMTSVSSEAVDLISSLCSWDPCKRPKAAEVLQHTFFQGCTFVPPTVRSKAGVLPKTPPCVGVKGVSEHGMPRRYSTGTLSTTKPHSNASLKSSGLSKTGVQRKLQMDRQAPQKIKKPTESNNKLTTNRVPARNSPGHPVLRHSRSLPETGRATMHKVSTLTERLTHMSVTSRTRTTPKPAAPLLKAGLGKSDLLGKTDEIPPAKRLTRKLVS

SEQ ID NO: 38728 - protein, 311 aa, Magnaporthe grisea 70-15
MAAVISSATPDAPLQSRIVDDKSPICIPFILERLSVWRKARDENDRRPFFIGLNGVQGVGKTTLVRALAETLQQREMLETIVVSIDDFYLGHQTQLALAESQPDNSLVQYRGEPGTHDIELMQSFFTAVINGQPAKIPQYDKGAYSGLGDRAPESTWPSINGLDQRPVEVVLVEGWCVGFRALEPEAVVEKWRSPDTRTLRNHRTEHLLFVNEKLGAYDVLTNQLDALVHIDAQKLEYVYDWRQEQEAQLRKERGTGMSDEQVVRFVDAYYPAYELYSDGVRAGVLLPERPGCQLTLIVDRHRRVVEHFVL

SEQ ID NO: 38729 - protein, 332 aa, Flavobacteria bacterium BBFL7
MKKVTKDVLLNWYEEMLFWRKFEDKLAQVYIQQKVRGFLHLYNGQEAILAGSLHAMDLTKDKMITAYRNHVQPIGMGVDPKRVMAELYGKATGTSQGLGGSMHIFSKEHRFYGGHGIVGGQIPLGAGIAFGDKYHNVDAVTLTFFGDGAARQGSLHEAFNLAMLWNLPVVFCVENNGYAMGTSVERTANHTDIWKLGLGYEMPCGPVDAMDPEKVAEAMSEAIERARSGGGPTFLELKTYRYRGHSMSDAQHYRTKDEVAEYQKIDPITQVKDRLVKDHGLSEDEINVIDKRVKARVAECEKFAEDSPYPEKSVMYDAVYEQEDYPFLPAKS

SEQ ID NO: 38730 - protein, 539 aa, Flavobacteria bacterium BBFL7
MAEIVNMPRLSDTMEEGVVAAWLKNVGDKVEEGDILAEIETDKATMEFESFQEGVLLHIGVQEGETAPVDQLLCIIGEEGEDISSLLNGDNSTSESKEDTSKKEESNDSSENDSSNDELPEGVIIVTMPRLSDTMEEGTVASWLKSEGDTVEEGDILAEIETDKATMEFESFNEGTLLKIGIQEGETAKVDALLAIIGPAGTDVSGINLEASAKAPAPKKEEKKVEAPKAEPKKDKAPVAASSSSNANSSSSSKGGRIFASPLAKKMADDKGIDLSQVSGSGENGRIVKSDIVNFKPSAGGSASASSFVAVGTETFEEVPNSQMRKTIAKRLGESKFTAPHYYLGLDLDMDNAIASRKAINELPDTKISFNDMVIKAAAMALRLHPKVNTQWTDKNTIVAKHIHVGVAVAVDDGLLVPVLPFADQMSMQQIGAKVRELAGKARNKKLQPDEMQGSTFTISNLGMFGITEFTSIINQPNSAIMSVGAIVQKPVVKNGQIVVGNVMKITLACDHRTVDGATGAAFLQTFKSYIENPIVMYV

SEQ ID NO: 38731 - protein, 371 aa, Arabidopsis thaliana
MKLTVKTLKGSHFEIRVLPSDTIMAVKKNIEDSQGKDNYPCGQQLLIHNGKVLKDETSLVENKVTEEGFLVVMLSKSKSGGSAGQASVQTSSVSQPVSATTSSTKPAAPSTTQSSPVPASPIPAQEQPAAQTDTYGQAASTLVSGSSLEQMVQQIMEMGGGSWDKETVTRALRAAYNNPERAVDYLYSGIPQTAEVAVPVPEAQIAGSGAAPVAPASGGPNSSPLDLFPQETVAAAGSGDLGTLEFLRNNDQLEQLRTMVHSNPQILQPMLQELGKQNPQLLRLIQENQAEFLQLVNEPYEGSDGEGDMFDQPEQEMPHAINVTPAEQEAIQRLEAMGFDRALVIEAFLACDRNEELAANYLLENSGDFED

SEQ ID NO: 38732 - protein, 1049 aa, Oryza sativa
  misc_feature (414)..(414): Xaa can be any naturally occurring amino acid
  misc_feature (438)..(438): Xaa can be any naturally occurring amino acid
MVAARRSAASSSFFLLLLVLAVRVRASSDRVQERDRSALLELRGAAGLLGRWPTGSAVADHCSWPGVTCDASRRVVAVAVAAPPASGSSELAGELSPAVGLLTELRELSLPSRGLRGEIPAEIWRLEKLEVVNLAGNSLHGALPLAFPPRMRVLDLASNRLHGEIQGTLSDCKSLMRLNLSGNRLTGSVPGVLGSLPKLKLLDLSRNLLTGRIPSELGDCRELRSLQLFSNLLEGSIPPEIGRLRRLQVLDISSNRLNGPVPMELGNCMDLSVLVLTSQFDAVNLSEFNMFIGGIPESVTALPKLRMLWAPRAGFEGNIPSNWGRCHSLEMVNLAENLLSGVIPMELGQCSNLKFLNLSSNKLSGSIDNGLCPHCIAVFDVSRNELSGTIPACANKGCTPQLLDDMPSRYPSFXGSPGCRQPSSGYCKSGNCSVVYHXFANNNLGGHLTSLPFSADRFGNKILYAFHVDYNNFTGSLHEILLAQCNNVEGLIVSFRDNKISGGLTEEMSTKCSAIRALDLAGNRITGVMPGNIGLLSALVKMDISRNLLEGQIPSSFKELKSLKFLSLAENNLSGTIPSCLGKLRSLEVLDLSSNSLSGKIPRNLVTLTYLTSLLLNNNKLSGNIPDIAPSASLSIFNISFNNLSGPLPLNMHSLACNSIQGNPSLQPCGLSTLANTVMKARSLAEGDVPPSDSATVDSGGGFSKIEIASITSASAIVAVLLALIILYIYTRKCASRQSRRSIRRREVTVFVDIGAPLTYETVVRATGSFNASNCIGSGGFGATYKAEIAPGVLVAIKRLAIGRFQGIQQFQAEVKTLGRCRHPNLVTLIGYHLSDSEMFLIYNFLPGGNLERFIQERAKRPIDWRMLHKIALDIARALGFLHDSCVPRILHRDVKPSNILLDNEYNAYLSDFGLARLLGNSETHATTGVAGTFGYVAPEYAMTCRVSDKADVYSYGVVLLELISDKKALDPSFSPYGNGFNIVAWACMLLQKGRAREFFIEGLWDVAPHDDLVEILHLGIKCTVDSLSSRPTMKQVVRRLKELRPPSY

SEQ ID NO: 38733 - protein, 405 aa, Helicobacter pylori 26695
MFNYEELFQTHKTPFYLYDFDKIKQAFLNYKEAFKGRKSLICYALKANSNLSILSLLAHLESGADCVSIGEIYRALKAGIKPYRIVFSGVGKSGFEIEQALKLNILFLNVESFMELTTIETIAQSLGIKARISIRINPNIDAKTHPYISTGLKENKFGVGEKEALEMFLWAKKSAFLEPVSVHFHIGSQLSDLEPIIEASQKVAKIAKSLIALGIDLRFFDVGGGIGVSYENEETIKLYDYAQGILNSLQGLDLTIICEPGRSIVAESGELITQVLYEKKAQNKRFVVVDAGMNDFLRPSLYHAKHAIRVITPSKGREISPCDVVGPVCESSDTFLKDAHLPELEPGDKLVIEKVGAYGSSMASQYNSRPKLLELALEDHKIRVIRKREALEDLWRLEEEGLKGV

SEQ ID NO: 38734 - protein, 439 aa, Bacillus cereus ATCC 14579
MAVENITMPQLGESVTEGTISKWLVNVGDHVNKYDPLAEVMTDKVNAEVPSSFTGIVKELIAGEGDTLAVGEVVCVIQVEGADEVAATAVEEKTKEEPKAEVATSEKAPKVKQPTDGKPRFSPAVLKLAGEHNVDLDLVEGTGANGRITRKDILKLVESGNIPQAGAAKKEEAVAAVVEARPEAPKAAPVAQKVEAAKPVSVPTMPGDIEIPVTGVRKAIAANMLRSKHEAPHAWMMIEVDVTNLVSYRNSIKGDFKKREGFNLTFFAFFVKAVAQALKEYPQINSMWAGDKIVQKKDINLSIAVATEEELFVPVIKQADEKTIKGIAREITELAGKVRTKSLKADEMQGGTFTINNTGSFGSVQSMGIINYPQAAILQVESIVKRPVIMDNGMFGARDMVNLCLSLDHRVLDGLICGKFLGRVKEILENMSENNTSVY

SEQ ID NO: 38735 - protein, 327 aa, Bacillus cereus ATCC 14579
MAVMSYIDAITLAMREEMERDEKVFVLGEDVGKKGGVFKATHGLYDQFGEDRALDAPLAESAIAGVAIGAAMYGMRPIAEMQFADFIMPAVNQIVSEAAKIRYRSNNDWTCPVTIRAPFGGGVHGALYHSQSVEAMFANQPGLKIVIPSTPYDAKGLLKAAIRDEDPVLFFEHKRAYRLIKGEVPEDDYVLPIGKADVKREGDDITVITYGLCVHFALQAAEKLAQDGISAHILDLRTVYPLDKEAIIEAASKTGKVLLVTEDNKEGSIMSEVAAIIAENCLFDLDAPIARLAGPDVPAMPYAPTMEKFFMVNPDKVEKAMRELAEF

SEQ ID NO: 38736 - protein, 473 aa, Bacillus cereus ATCC 14579
MAKEYDLVIVGGGTGGYVAAIRASQLGLKTALVEKENLGGTCLHKGCIPSKALLRSAEVYATAKKSEEFGVIASNVELNFAKVQERKEKIVTQLHKGVQHLMKQGKIDVFEGIGRILGPSIFSPMPGTISVELASGEENEMLIPKNVLIATGSRPNSLPGLELDGEYVMSSDHALKMETLPSSIIIVGGGVIGIEWASMLADFGVEVTVLEYAKTILPLEDQDVSKEMQRLFKKKGIKVVTGAKVLPETLVKDNGVTIQAEHNGENKEFKAEKMLVSVGRQANTQNIGLENTDIVVEKGYIQTNEFYQTKESHIYAIGDVIGGLQLAHVASHEGIAAVEHIAGKEVTPIDYSMVSKCVYSSPEVASVGLTEQEAKEKGYKLKVGKFSFRAIGKALVYGESDGFVKLVVDEETNDILGVHMIGPHVTDMISEAGLARVLDATPWEVAHTIHPHPSLSEAIGEAALAVDGRALHA

SEQ ID NO: 38737 - protein, 496 aa, Pseudomonas syringae pv. syringae B728a
MFDTKPHLPDALYSAAQVRDLDARLIAAGTPGLELMLRAAQALWHTLLRRWPQANELTVLTGRGNNAGDGYLVAAMAHKAGWQVRVLAVGDPAALTGDAAAAHAAAFGIDIQAWAGQSLAGVVLDALLGTGLDGEVREPYVSAIKAVNDSGLPVVAADIPSGLSADTGQTLGVAVRADVTVTFIGLKLGLLTGDAADLVGELIFDDLRADPALVAQMPFSAKRLDKHNLPQLAARPRTAHKGMFGRVLVIGGDHGFGGAALLSAESALRSGAGMLTLATRPEHVAAALTRMPEIMSAAIHSANQLMGLIEPASVLVVGPGLGQSAWGRSLLSAAANADRPQVWDADALNMLAAGLVSLPKGSVITPHPGEAARLLGVGIKEVQADRAAAVRALARKFDTVCVLKGSGSLIADAHGQLALCDRGHPAMATAGLGDVLAGLIGALMAQHLKPFDAACLAVWLHASAGQKVGEYGRGLAASDIIPAIRQLLEELQPCLI

SEQ ID NO: 38738 - protein, 342 aa, Brassica rapa
MLASSPMLLFLLSLLMAYNFDTTAGQIGVCFGQMGNNIPNPSEVVAMFKQYSIPRMRMYGPNPDALNALRGSNIEFILDVPNGDLKRLADSQAEANTWVRDNVQKYNDVRFKYISVGNEVKPGEPGAAALIQAMQNIDRALSAAGLSNIKVSTTTFMGPSRNTYPPSRGRFKDEYRNFLQPVIGFLVNKRSPLLVNIYTYFGYMNRDVSLQFALLQPNSNNEFTDPNNQLRYLNFFDANLDSVYAALEKSGGGSLDVVVSESGWPTQGGPGASVPNAEAYVNNLRLHVNKNGSPKRQEAIETYIFAMFDEAPRQTSPNDEYEKYWGMFSPTTRQLKYGVKFN

SEQ ID NO: 38739 - protein, 373 aa, Triticum aestivum
MSGSAAKRVGTPLADAEGSPKRPRSSRHPSLSPSPSQARSQAPSQSRSRSRSRSRLPLARTSPPPYIGSPSYAPYDDRESQPAATARSRRRSRSRRVTRMTDGNGRPVWRPHSYREHSGEHGDGEYSVRIGDYDRLFICRSCHRMLSTPVYECPDGHVTCSRCRDNIGDNRCNYCAANGCVRSRAVEEFLGRISFSCRNQQYGCEVFLLHHEMRAHERTCHYDPCFCPVHRCGFAGPAYDLESHLATIHRWEVINFRYGESFQAPAFDSAIFRCEDYGELFHISSSREGLGTALSMICIRPDNAFEEEFTYELKMPAGGRRHRLQIQSTVWNTSLRYGIGEGSDVFLLVPDKLPGVENGCAVEVCIRKVVAGN

SEQ ID NO: 38740 - protein, 486 aa, Ostreococcus tauri
MPREVSRVGAYALKRSLGKGAFGFVKLGVQDKTGRKVAVKDGARETDASCATWGQILDRENLLRVDEQEQLKAEIKALADLFHPCIVDLIEVLTNETSVFMVMTYCPGGELYDVIRAKGALNEEQARRHFQRLIQGVDFCHKKRIYHRDLKPENLFLDENGDLCIGDFGLAALREDEEDNNLRTICGTPHFAAPEVMGGSRRLVGNKNFKTVNTKTRTEGYDGAPADVWSCGCILYFLLTGVFPFDGQNFVQLQMLVQKTEPYFAPQRISKPCEKLIRGMLVKDPAKRWTIEQVMKSSWFKTDYEPVQVQESKKDSRHYDDEDPALEEFWSPDTGLVVKTAGESSMSEVDKMRPIKQLNAFELINLAAFDVESIFDEDENTVSNATRFMSKESIDKVQAAVIKRAEQDLNTVAKRKTLSRVTFEDVNNGVVVTMRTYQVIPGVCVYDFSRDEGGRDRFHAWFQKLRDPSGPVGALINIDDAQHTAP

SEQ ID NO: 38741 - protein, 275 aa, Ostreococcus tauri
MTITTRQQPRADGVIFALDFDGVVCDSVGESSLSAWKHGVELWPEVFDTPEATTAKPRVLDELRAVRPVVETGYENTTLARALLEKLDGYGVEDILNEWDQISGGLMQRWGLDRAMMVEAFGRIRDDWIEEDFDGWLEPNALYPGVAEAVKRAQARSDAAVKIVTTKQGRFALAIMERMGGLVIPEEDMFSTTVSGIPKTDVLRTFGTEGKWRKIFVEDKLSTLEKVSKADDLNEWELYLVNWGYNTPEERARANANPRIKVIGVDAFINMLEAA

SEQ ID NO: 38742 - protein, 467 aa, Pseudomonas aeruginosa PAO1
MGLNADWMQRDLNVLWHPCTQMKDHERLPVIPIRRGEGVWLEDFEGKRYIDAVSSWWVNVFGHANPRINQRIKDQVDQLEHVILAGFSHQPVIELSERLVKITPPGLDRVFYADSGSAGIEVALKMSYHFWLNSGRPRKKRFVTLTNSYHGETIAAMSVGDVALFTETYKSLLLDTIKVPSPDCFLRPDGMCWEEHSRNMFAHMERTLAEGHDEIAAVIVEPLIQGAGGMRMYHPVYLKLLREACDRYGVHLIHDEIAVGFGRTGTMFACEQAGIAPDFLCLSKALTGGYLPMSAVLTSETIYRGFYDDYQTLRAFLHSHTYTGNPLACAAALATLDIFEEDKVIEANRALSTHMARATAHLADHPHVAEVRQTGMVLAIEMVQDKASRTPYPWQERRGLKVFQHGLERGALLRPLGSVVYFLPPYVITPEQIDFLAEVASEGIDIATRDAVSVAVSDFHPDHRDPG

SEQ ID NO: 38743 - protein, 510 aa, uncultured crenarchaeote
MDKIVVLDFGSQYSHLICRRIRESNVYCELLPYNSPISLIKKLEPKGIVLSGGPSSVYLEGSPKPDKKIFDMGIPVLGICYGHQLIVNEFDGKIKRFDNREYGLADLEIDDNSDLFKGINKKIRCWMSHADAAETIPNDFNILAHTNNSNSAAIANRNRGFYGIQFHPEVSHTEEGNRILRNFSHSISNAKPDWTMEGFVDFSIKDIRSKVQEDRVLCAISGGIDSTTLAVLLNKAISKNLACVFVNNGLLRQDEETLVPELISKHLGIDTITIDAEQRFLSRLNGITDPEQKRKIIGEEFAQVFLKVTKDYGPFQWLAQGTLYPDVIESGFSKGPAAVIKTHHNVGGLPDWLNLKVLEPFRSLYKDEVRKIALLLDIPNEFIKRHPFPGPGLAVRIIGEVTNEKIRIVRHASSLVESELMAAGWYDKVWQAYAAVGDDLAVGVLGDERVYGHIVTIRIVESLDAMTADWSRIPHELISKISNRITNEVNGVTWVTYSVSSKPPATIEPQ

SEQ ID NO: 38744 - protein, 443 aa, Rubrobacter xylanophilus DSM 9941
MTTTMRGAGGYYYYGGRYDAIVVGVGAMGSAALYHLARRGKRVLGLERFGIPHAMGSSHGHTRIIRLAYYEHPSYVVLLRRAYELWRELEREAGEQLLHITGSIDAGPEDSWVFRGSWESARMHELPHEVLTGSELHRRYPAYRLPKDHLALLQPEGGFLKPERCIVAHVMAAQARGAEVHAHEKVLEWGPSEGGGGVRVRTERGTYEAEKLILSAGAWMGELAPEALGGVAVAERQVLAWLQPQKPELFRPQNFPVFNLLVEEGRFYGFPVFGVPGFKFGKYHHLLEELGEPDRLDRQVHWRDEQMLREFAERYFPEGCGPTMDLQVCMFTNTQDNHFIIDLYPGLEQVVIASPCSGHGFKFASVVGEILADLADSGASRHDISLFRVGRFAPQRGFLSARASSRPPAGTAARLERRTVEAVAGKNGRLHRFPEAGEISAPW

SEQ ID NO: 38745 - protein, 473 aa, uncultured crenarchaeote
NEVGDGTTSSVVFAGALLEKAEELVNKDVHPSVIVDGYTAAAERALELLQKIAIKVDVNDKSVLTNIARTSMYSKLVSDDGPSLAKMVVDAAKLVAESVDDGKKLRVDLDNIKVEKKPGTSIRDSKLVKGIVLDKEVVHAGMPKKIEKAKIALVNSALEIEKTEMSAEIRINDPQQMQMFLEEENRMLKAMVDKVNGVGANVVLCQKGIDDLAQHYLAKEGILAVRRVKESDMSKLSKATGARIVNNLDDFTTKDLGSADLVEERKVETDKWVFIEGCRNPKAVTILVRGGSQRVVDEADRSIHDALMVVKDVLENPFAVAGGGAPEAYVANELRQWSSNMEGRGQLAIQKFADALDTIPLSLAVNAGMDPIDTMTTLRAKQSKGAKWTGIDVLNTVVADMQKQNVIEPLAVKQQIIKSATEAANMILRIDDVIASSKSKMPAGPPGGMGGMGGMGGMGGMGGMGGMGGMDME

SEQ ID NO: 38746 - protein, 515 aa, Candida albicans SC5314
MLEEISFESWYLYLIICGVLYFCTNYLYIQYLNKKLGAKSPGSCKSDGCFGFRSGFEMLKAKKIGRQVDLLHERFNDLSNPEVNDTFTSYNFGFPMIITKDPENIKALLATQFNDFSLGRRYDFFKPLLGKGIFTLDGEGWKHSRSMLRPQFAREQIAHVKALEPHFQLLKKHITKNKGQFFDIQELFFRFTVDSATEFLFGESVSSLKDESIGYNQDEFDFAGRKDFPEAFNKSQIYLSTRSLLQNLYWLVNPKDFQNCNAIVHKFSDYYVNKALNATPEELEKNSGYVFLYELVKQTRDPQVLRDQALNILLAGRDTTAGLLSFAVFELARNPQVWKKLREEIIERYADGATEISFETLKQCEYLKAVINETLRLYPSVPRNGRFANKNTTLPRGGGPDGMSPILIKQGQAVMYSIYSTQRDPKYYGKDADVFRPERWFEPETRKLGWAFLPFNGGPRICLGQQFALTEASYVLVRLAQCCENLQLTEGIEYPPAKLTHLTMCMFDGVPIKVD

SEQ ID NO: 38747 - protein, 391 aa, Streptococcus agalactiae A909
MTLEKRFNKYLDRIEVSLIRQFDQSISDIPGMVKLTLGEPDFTTPDHVKEAAKSAIDANQSYYTGMSGLLALRQAAADFAKDKYNLTYNPDSEILVTIGATEALSASLIAILEAGDVVLLPAPAYPGYEPIVNLVGADIVEIDTRENDFRLTPEMLETAIIQQGEKLKAVLLNYPTNPTGITYSRQEIAALAEVLKKYDIFVISDEVYSELTYTGQQHVSIAEYLPNQTILINGLSKSHAMTGWRVGLVYAPEAFTAQIIKSHQYMVTAASTISQFAGVEALSVGKNDTLPMRQEYIKRRDYIIDKMSKLGFKIIKPSGAFYIFAKIPDSYPQDSFKFCQDFAYQQAVAIIPGVAFGKYGEGYIRLSYAASMEVIETAMARLKVFMESYEG

SEQ ID NO: 38748 - protein, 442 aa, Triticum aestivum
  misc_feature (313)..(313): Xaa can be any naturally occurring amino acid
MPSGSTQFRYTQTPSKVLHLRNMPWESSEEELVELCKPFGRVVNTMCNVGANRNQAFVEFADQNQAISMVSYYASSSEPAQVRGKTVYIQYSNRQEITNNKGTGDSSGNVLLVTFEGVQPNDVSIDVIHLVFSAFGFVHKIATFEKAAGFQALIQYTDAPTALEAKNSLDGRSIPRYLLAEHVSICHLRITFSAHKDLNIKFQSHRSRDYTNPYLPVNPTAIEGIAQPILGSDGKIKEPESNVLLASIENMQYAVGVDVLHTVFSSFGAVRKIAMFEKNGGMQALIQYPDITTAGVAKQALEGHCIYDGGYCXDERSRDYTVSDPSAQVQAAGQAPGLSTTGAAWQSTTPAAFYGSSAGATSIGQVPAWNPNMQRGAFAPASTSYPTQLLMANPGPHFPAVGSSSGAPPMLYQASQQMAQYGTAPTALPHAALSGEPMYFPK

SEQ ID NO: 38749 - protein, 365 aa, Arabidopsis thaliana
MKLTVKTLKGSHFEIRVLPSDTIMAVKKNIEDSQGKDNYPCGQQLLIHNGKVLKDETSLVENKVTEEGFLVVMLSKSKSGGSAGQASVQPVSATTSSTKPAAPSTTQSSPVPASPIPAQEQPAAQTDTYGQAASTLVSGSSLEQMVQQIMEMGGGSWDKETVTRALRAAYNNPERAVDYLYSGIPQTAEVAVPVPEAQIAGSGAAPVAPASGGPNSSPLDLFPQETVAAAGSGDLGTLEFLRNNDQLEQLRTMVHSNPQILQPMLQELGKQNPQLLRLIQENQAEFLQLVNEPYEGSDGEGDMFDQPEQEMPHAINVTPAEQEAIQRLEAMGFDRALVIEAFLACDRNEELAANYLLENSGDFED

SEQ ID NO: 38750 - protein, 595 aa, Prochlorococcus marinus str. MIT 9312
MIKVEKVKKKKDSAKEETVCLANGLEVSKFENFKKSSQFLKEPLATELVNESDHFTNDAVQLLKFHGSYQQDNRENRKPGKSKDWQMMLRLRSPGGEIPGKLFLALNELSDKLGNGSLRATTRQAFQMHGIRKENLKEVIQTIVNSMGSTLAACGDINRNVMAPAAPIDSPEYNIARALAKKVADLLTPLAGQGTFLELWADGDLEYTIKPDKDIEAIRRLQFKDNVFSGIKDEPLYGSTYLPRKFKCAVTVPGDNSVDLLTNDIGIVAFTSEEGKLEGCNFYVGGGMGRTHNNEETFARIADPLGYVEEQDIYELIQCIVAIQRDYGDRKSRKNSRMKYLIHRKGIKWFKKLLLGKYFKKEIKKIRKEPNQVLIDYLGWHKQNKTSYFVGLPLLSGRLSGEKKNTITSIVKKYNLDLRLTPNQDILLCNIANKNKSEIKKALSKIGYDNLEDINEIQRHALACPALPLCGLAMTEAERILPDVLKRIEKLLLDLKIEKTILFRMTGCPNGCTRPYMAELALVGSGQNKYQLWLGGSKNLQRLAKPFLQRMELNDLEKTLQPLFDHWKSSSDLDFGDFINKQEESSILNLINEIH

SEQ ID NO: 38751 - protein, 366 aa, Arabidopsis thaliana
MKLTVKTLKGSHFEIRVLPTIMAVKKNIEDSQSKDNYPCGQQLLIHNGKVLKDETTLVENKVTEEGFLVVMLSKSKTASSAGPSSTQPTSTTTSTISSTTLAAPSTTQSIAVPASNSTPVQEQPTAQSDTYGQAASTLVSGSSIEQMVQQIMEMGGGSWDKETVTRALRAAYNNPERAVDYLYSGIPETVTIPATNLSGVGSGRELTAPPPSGGPNSSPLDLFPQEAVSDAAGGDLGTLEFLRGNDQFQQLRSMVNSNPQILQPMLQELGKQNPQLLRLIQENQAEFLQLLNEPYEGSDGDVDIFDQPDQEMPHSVNVTPEEQESIERLEAMGFDRAIVIEAFLSCDRNEELAANYLLEHSADFED

SEQ ID NO: 38752 - protein, 182 aa, Streptomyces coelicolor A3(2)
MTEPTGITELLLSRIRDVADYPEPGVVFKDITPLLADPGAFAALTDALAEAAGRTGATKVVGLEARGFILGAPVALRAGLGFIPVRKAGKLPGATLSQAYDLEVSSAEIEVHAEDLTAGDRVLVVDDVLATGGTAKASLELIRRAGAEVAGLAVLMELGFLGGRARLEPALAGAPLEALLTV

SEQ ID NO: 38753 - protein, 316 aa, Arabidopsis thaliana
  misc_feature (141)..(141): Xaa can be any naturally occurring amino acid
MGRKRKHSETVTAAPVKDSAPERPQRTLLGWKDKKEDAENSKPAYASVFRNKEKVLVTCSRRINFRYRHLMLNMVSLLPHCKKDSKVEAKSSRGATLNELIELKGSSSCLFFECRKHKDLYMWMVKSPGGPSVKFLVNAVXHTMEELKLTGNHLKGSRPLLTFSSNFENDAHWKLLKEMLTQIFGIPEGHRKSKPYHDHVFVFSIVDDHIWFRNYQISVPHNESDKIARGDLDKMTLIEVGPRFCLNPIKIFGGSFGGTTLYENPFYVSPNQIRALEKRNKAGKFAKKIKAKTRRKMHELSNPLEPDEFTDMWNDE

SEQ ID NO: 38754 - protein, 933 aa, Ostreococcus tauri
MARRGRRRGRRARWPCAGASADGDGTSTAIFHFERGCAYGTKEMKDLLGSKGSGLAEMALLGLNVPAGFTISAACNERFAARGSTYVQSELWPDVLEAVSSLERTAKRTVFRSGCSLVGRAPLLLSVRSGAAASMPGMMDTVLNLGLSDACVAACVEAGFDERWVYDSYRRLLAMFGDVVEGIPKMDFEVALSQARSANEVRFDSELPAEALKKLCDEYKDIYVKHGKTFEQDPMNQLSKSILAVFSSWNNPRAVEYRDINRLSGLLGTAVNVQQMVFGNFNDNSGSGVCFSRNPADGTDKVYGEFLQKAQGEDVVSGVRTPMMISDLAGTQASAAEELNEVCKELEKDYKDMMDIEWTIEDGNLYILQCRVGKRTGTAAVRIATEMAAEGIITRDEALMQVNAKQIEQVLHPVFVIDETSAEYSGKIVAKGKPASPGAAVGAICFSAKEAKEMKAKGTPVILVREETCADDIGGMFAAEGILTARGGMTSHAAVVARGWGKPCVSGCGDIVFKNDREIRFGSSDKTFRSGNVISINGTTGEVLNASFPVAPSTIETFLPLKTFMQWVDQKRGIEIRANADTPEDADAAIRNGASGIGLVRTEHMFFSTTDRVHAIREFIMAQDETSSTIALEKLEKYHYEDFRGILKAAAGRKVTVRLIDPPLHEFLPSEKQLREGGAQEMSRYIGKSTHDIMEIAENMREHNPMLGLRGCRLGILRPSMSKMQVRAFAQAAIDLTSEGFPVTPSIMVPLVSTVDEFHNQRDLVWGVMKELAKENQQPPIRMEIGAMIETPRCALIAGDLARAGASFFSFGTNDLTQMTYGFSRDDSDAFIKPYIAKGLLRDDPFVTLDPVAVAELMDIAIHRARDIRNDIEVGVCGEHGGDPASLRTIDALDVDYASCSPSRVLVARLAAAQAACSRKEKVKTKPFAVTAA

SEQ ID NO: 38755 - protein, 409 aa, Sulfolobus solfataricus
MKIDEVVEKLVKGEISFHEVDNLLEANAAMVARRLALEKIVGVGLPSIGSTVIDYSEIKNKNAENVIGAIQIPLGIVGPIRVNGDYAKGDFYVPMATTEGALIASVNRGIKAVTLSGGVRAKVLKDEMTRAPVFKFDSIEQIPNFLKFIEENLEKIRNIANSTSHHGKLKSITPFVLGNNVWLRFSFETGDAMGMNMVTIAVEKVCEFIEENFPSADCLAVSGNMCSDKKQTNVNSLFGRGKTVLAEALIKKDVIRNILHSNAQLIHDINLRKNWLGTARAGSLSQFNAHFANIVTAIFIATGQDVAQIVESSSGYTWTEVRGEDLYISVTLPSLEVGTVGGGTRLPTQKEALSIMGVYGSGNPPGSNAKKLAEIIASTVLSGELNLLAALSNKELGKAHAKLGRAMKV

SEQ ID NO: 38756 - protein, 909 aa, Ostreococcus tauri
MLARASNSQDSLHARDAEPTNYVPSAPALVGQVVGGNETDAAHLRLQRMAAFESHDYDPIDNDLEEDALRARDREDYRREIWWKWATSAMIGMVMGFIAFVVDGLVDKLNLFRYGVIGDKVGTDGYARFVAWLLHVIVSCLFASVAGGLVSYVEPLAAGSGIPELKTYLNGVHLKGLLRLKTAVAKLGGIAFSIGAGLIAGKEGPFVHGGGLVGGGLSAFGSNTLGFRLKKPAWFRDDRNKRDFVAIGTATGVAVAFAAPIGGMLFTVEEGASFYNSDMLWRGFLATCTGVLTMHWLEQLDFDANDFARARFGTHRDFGLYTDNEADYSRNYWWYFWEVPIFILIGACGGLLGAAFVKMNVRITKWRALHIPVTDKRKRLLEVITIAGITSTLFFFFMSVSPCKDVPTPLMPGSIDDLGVISNTTFEYGEETRDEIRKDFFKQLYCPDGQYSVYGQLFYNPLSTSFKFLLHLGEVGEFGVDGEHPFPISALIWYFLLTFSLMTITYGIGAPTGLFVPSLAVGASFGQLVGRIVASIASHRGSEVRINLHAYAIIGAAANLGGATRMTISITVLVMETTGSMQLIIPLMLTIFTAKAVGDKYTHGIYDTHIKIRGAPFLEEPELAGPAADKLRVNEAMADDLVTLQPVMPISDLLQVLTTTSHGAYPVTEQPPAYAGEEFELHGSITRNLLLKMLLHRISFVPTVGGRSDDGRLFSTQRERDELLEQLKQIPFKVPSAREVAHRVSDEDIQTMSVDLRSFMQRHPFVVHGDARLSRAYRQFRTMGLRHMYVMPSRPRVVGLLTRKDIIDERSSLTLGLYARGLAHPRARTVSRSFEPEFDPRDASARDVDGADDAKDERQTHLPYIPYYSNNANTGDDDGVEPSRVDASANPFEASSARRRPHGGARPRP

SEQ ID NO: 38757 - protein, 360 aa, Ostreococcus tauri
  misc_feature (1)..(2): Xaa can be any naturally occurring amino acid
XXARDAHATIPELDGRTAFFAVFDGHGGKEVALYAARHLHESLKETEGFEGDGDALKGALEESFLALDRRMLSKEAASELRALRSGSGEEEDGALGGLVRTGANAEEQRNRRAEINAKLRAALIEQMKEQDPNIDERDIKFDFELEDSDFDEPQPSSSEDGGVDALDRWSGPQAGATSVVVCIRGNNAYCANAGDSRAVFSRKGGVAEDMSNDHKPMNEEERKRIMNAGGFVSEGRVNGSLALSRALGDFEYKRNKDLSEKEQAVTAFPEIREFELREGDEFMILACDGIWDVMSSQECVTFVRERLIAGAKSETFKISRVCEELCDACLAPDTRGSGLGCDNMSVVIVLLQKFWQPTSA

SEQ ID NO: 38758 - protein, 463 aa, Zea mays
MGDHAEMLHAAPAMYNGAGAAPHGGWWNTAVPATTCSTTELAGFTTWSSALAASYDLAAEGTKAKSAAASSESPGNNSSVTFQEPACVTDPPGVGTAVVQVQQPLATGYADWTHPYMSSGATTLHGFLQDGHQQDMSSATEQSSMTASSLMNPSSNNLALALQGHHHHHQEHEHQQQMLSSFGSELLLSPTTSPYGFRSSLLRSLMEPAAATKQALPGYQQQQYDQYQQQMGMGQARFAPPPAGAASREALQFSNDAPFTSNPSAAGFGFGLGVPPAPDQASSVRSVVKPSPAAARATATLALKTALEGVGESASSIITKKKANGEPALKKPRLETPSPLPTFKVRKEKLGDRITALQQLVAPFGKTDTASVLHETIEYIKFLHDQVGVLSAPYLKNNGHHQVLRHLKSSSPDKSSKDDDSHASEISLKGRGLCLVPISSTFAVASEVPVDFVWSTPFAANFR

SEQ ID NO: 38759 - protein, 557 aa, Burkholderia vietnamiensis G4
MEKIWLKSYPPGVPAEIDASPYPSIPDLLDESFRQYRDRSAFVCMGKRITYGELDALSRHFGAWLQSRGLKRGARVALMMPNVLQYPVAIVAVLRAGYTVVNVNPLYTPRELEHQLKDSGAEAIVILENFASTLQAVVANTGIKHVVVASMGDLLGIKGWLVNYVVRRVKKMVPPWQLPSYTRFNAALSEGARQTFKPPKLAPDDVAFLQYTGGTTGVAKGATLLHRNIVSNVLQAGAWHHPAHEKFPDVKQFITVVALPLYHVFALTVCGFLTMRTGGMGILIPNPRDIGGMIKELKGYQISTIPAVNTLYNALLNHPDFGQLDLSKLAIANGGGMAIQEGVAKRWYEKTHTAIVEGYGLSETSPVATCNPVTATEYSGTIGLPLPSTEIAIRDDAGNDVALGEPGEICIRGPQVMAGYWNRPDETAKVMFPDGFFKTGDIGVMDARGYVKIVDRKKDMILVSGFNVYPNEVEDVVASHPGVFEVAAVGVPDEHSGEAVKLFVVKKDPALTDKDILAYCKERLTGYKRPKLVEFRTELPKTNVGKILRRELRDGRA

SEQ ID NO: 38760 - protein, 348 aa, Ostreococcus tauri
MSENEEARRQTDAILTQAAEICARSAPPGTTPIEQLLDAFFGFLDARTDFFDDVERAGRAVGDALGRTSRGRDARAAMRAAEREAREASERTTKAAREAARAREARESEKQRVEALKQRQLEMAMKKSEGKLTEIAEGDAAAANEAKADDDDEEEDPNALKPGTMMPNKGNGGDAEKYVWTQTLDDVDVRVAVPPGTKSKQVRCDFTMDTFSFHLVDASGKRIEPAFEGKFHAPIAPDDCYWTLEDNAYVVCFLQKLKTSEWWPCVLVGDPEIDTRRAEPETSRLADLDGDTRATVEKMMYDQRQKSLGLPTADEQSKHDALKNFMAAHPEMNFDNCKFDGVDNFRPN

SEQ ID NO: 38761 - protein, 499 aa, Zea mays
MSGSSSLWETGAPSLDTLAESAATYAVMMSSQQQQQQQTAGPSRQAVYGAPVLPEIPTRFVYRPQVATDVMSGSSSLWKTGAPPHDTLAESAAMYAATLSSHQQQQQMARPDRQAMYGAPVLPEIPTRFVYRPQTATDVMSSFSSLWETGAPPPAAYAAMLSSQQQQMPTTRPGWQAAPRGAPVPPPMNMRFVPNTMPAADAMDVGSSAPMAPSDSSSERTPSPLQRVEVRQVWAHNFDSEAKLIESLLPKFRYVAVDTEFPGTVYRPAGPAYKLEPAERYRLLRCNVDALHPVQLGLTLFDAGCVLPGGHGGATRYVWQFNFSDFDVRRHRHVVESVAALRSRGVDLDRTRQYGVAAAAVFGPRLRKWTRAGLGRAGVVTSHGGYDLAYLVKMMFGTGFRMSGSAAEFNAVVKSVLHRRRVFDIGEMARLCPHEHLHRGLDSIAGQLNAARFAADAARQAGYDSLRTCYTFMKLREIYFDDDGKLAGVDGILAEVTAF

SEQ ID NO: 38762 - protein, 255 aa, Methanosarcina acetivorans C2A
MKNLFDLTGKVAIVTGASSGLGVEFARALANQGANIAIIARREEKLKEVQKEIEKLGVTCRYYLCDVMKTEQIKNAVEQVVKDFGRIDILVNNAGLGLVDAADKTTDEMWHNMIDTNLNGVYFFAREVGKIMLRQKHGRIINIGSIHSTVSMKGLPVTAYCSTKGGVLMLTKSLATEWAKEGITVNAIGPGYFALGMAEGVVADPEFAKIIEFMCPMGRAGQSGDLDTTVVYLASDESKYITGQIITVDGGWTAL

SEQ ID NO: 38763 - protein, 587 aa, Brassica napus
  misc_feature (381)..(381): Xaa can be any naturally occurring amino acid
MAMVDEPLYPIAVLIDELKNDDIQLRLNSIRRLSTIARALGEERTRKELIPFLSENSDDDDEVLLAMAGELGVFIPFVGGVEHAHVLLPPLESLCTVEETCVREKAVDSLCKIGSEMRESDLVDSFVPLVKRLAAGEWFAARVSACGLFHVAYQGCTDVLKTELRSIYNQLCQDDMPMVRRAAATNLGKFATTLESSYLNAEIMTMFDDLTKDEQDSVRLLAVEGCAALGKLLEPQDCVARVLPVIVNFSQDKSWRVRYMVANQLYELCEAVGPDCTKTDLVPAYVRLLQDNEAEVRIAAAGKVTKFCQLLNPELSIQHILPCVKDLSSDSSQHVRSALASVIMGMAPILGKDSTIEHLLPIFLSLLKDEFPDVRLNIISXKLDQVNQVIGIDLLSQSLLPAIVELAEDRHWRVRLAIIEYVPLLASQLGIGFFDDKLGALCMQWLQDKVYSIREAGANNLKRLAEEFGSEWAMQHLVPQVLEMVNNPHYLHRMMALRAISLMAPVMGSEITCSKFLPVVVEASKDRVPNIKFNVAKLLQSLIPIVDQSVVDKTIRQCLVDLSEDPDVDVRYFANQALKSINGAAVA

SEQ ID NO: 38764 - protein, 639 aa, Pseudomonas aeruginosa PAO1
MSFSSLGLSEALARAVEAAGYSQPTPVQQRAIPAVLQGRDLMVAAQTGTGKTGGFALPVLERLFPAGHPDREHRHGPRQARVLVLTPTRELAAQVHDSFKVYARDLPLNSTCIFGGVGMNPQIQALAKGVDVLVACPGRLLDLAGQNKVDLSHVEILVLDEADRMLDMGFIHDVKKVLAKLPPKRQNLLFSATFSKDIVDLANKLLHNPERIEVTPPNTTVERIEQRVFRLPAPQKRALLAHLVTVGAWEQVLVFTRTKHGANRLAEYLTKHGLPAAAIHGNKSQNARTKALADFKANDVRILVATDIAARGLDIDQLPHVVNYELPNVEEDYVHRIGRTGRAGRSGEAISLVAPDEEKLLKAIEKMTRQRIPDGDAQGFDPEAVLPEVAQPEPREAPQKQPRRDKERRSSRERKPKDAQASNPDSNVAAAQDGTEKPAGKRRRRGGKNKENREAGQAQQPRQSREARPAKPNRPPEVDGNRDPEEFLDDDFDNFGNRADYVSPYQGQENKGRGRRGGQQKPQGGTGQQGRGQGQGQARGKSQGAAQGGARGQGAGQGKAKKPRAGKPRGQGRENASRMSDAPLREPSEYGTGKQPSRQPVVINKRDLVRMDRFPTAEQLDELEPRRKGERPALLTRNR

SEQ ID NO: 38765 - protein, 800 aa, Staphylococcus aureus subsp. aureus Mu50
MLISNEWLKEYVTIDDSVSDLAERITRTGIEVDDLIDYTKDIKNLVVGFVKSKEKHPDADKLNVCQVDIGEDEPVQIVCGAPNVDAGQYVIVAKVGGRLPGGIKIKRAKLRGERSEGMICSLQEIGISSNYIPKSFESGIYVFSESQVPGTDALQALYLDDQVMEFDLTPNRADALSMIGTAYEVAALYNTKMTKPETTSNELELSANDELTVTIENEDKVPYYSARVVHDVTIEPSPIWMQARLIKAGIRPINNVVDISNYVLLEYGQPLHMFDQDAIGSQQIVVRQANEGEKMTTLDDTERELLTSDIVITNGQTPIALAGVMGGDFSEVKEQTSNIVIEGAIFDPVSIRHTSRRLNLRSESSSRFEKGIATEFVDEAVDRACYLLQTYANGKVLKDRVSSGELGAFITPIDITADKINRTIGFDLSQNDIVTIFNQLGFDTEINDDVITVLVPSRRKDITIKEDLIEEVARIYGYDDIPSTLPVFDKVTSGQLTDRQYKTRMVKEVLEGAGLDQAITYSLVSKEDATAFSMQQRQTIDLLMPMSEAHASLRQSLLPHLIEAASYNVARKNKDVKLFEIGNVFFANGEGELPDQVEYLSGILTGDYVVNQWQGKKETVDFYLAKGVVDRVSEKLNLEFSYRRADIDGLHPGRTAEILLENKVVGFIGELHPTLAADNDLKRTYVFELNFDALMAVSVGYINYQPIPRFPGMSRDIALEVDQNIPAADLLSTIHAHGGNILKDTLVFDVYQGEHLEKGKKSIAIRLNYLDTEETLTDERVSKVQAEIEAALIEQGAVIR

SEQ ID NO: 38766 - protein, 514 aa, Camptotheca acuminata
MEMDALRQVLHPMPTALFFIAPLFFLFILSRLRRKLPYPPGPNGLPLVGNMMMMDQLTHRGLAKLAKQYGGIFHLRMGFLHMVAVSSPEIARQVLQVQDNIFSNRPATIAISYLTYDRADMAFAHYGPFWRQMRKLCVMKLFSRKRAESWESVRDEVDSMVRVVVSHTGKSVNIGELVFSLTRDIIYRAAFGSSSHEGQDEFIKILQEFSKLFGAFNIADFIPGLGWVDPQGLNARLVQARASLDGFIDSIIDDHIEKHRRRNVVDSDGDMVDDLLAFYSDEAKVTESDDLQNAIRLTRDNIKAIIMDVMFGGTETVASAIEWAMAELMKSPEDLKRVQQELAEVVGLDRRLEESDFDKLTYLKCALKETLRLHPPIPLLLHETAEDTEVAGYYIPARSRVMINAWAIGRDKNSWDEPETFKPSRFLKEGVPDFKGSNFEFIPFGSGRRSCPGMQLGLYALEMAVAHLLHCFTWTLPDGMKPSELDTDDVFGLTAPRATLFVAVPSPRLLCPLY

SEQ ID NO: 38767 - protein, 499 aa, Oryza sativa (japonica cultivar-group)
MAFFLVACLPWVCFILLSLYVFQLFADARRRLPPGPWPPKPLIGDLLALGKGDQQHRSLARLADRYGPVMSLRLGTVLTVVVSTPDAMREIFHKNKDNLAGRPTADAFNAMGHSANSLLGLEHPGVRWRAIRRFSTAELLAPRRLAALQPLCRDKVRGLVRGVSELAARGEPVHVRRVALDMALSLMLSAIYSVDLDPESTAVFRSVVEEAMLLIGTANLSDLFPAIAALDLQGVRRRVAELFTITYRQYDEQVARRRPERDAGEAGKNDLLNVVLDMEREWQQKGSVLSHDAMRVLFTDLYGAGASTTSVLIEWAIADLLQNPESMRKIKEEITNVIGTNAQIQEFDIARLPYLQAVVKETLRLRAVAPLVPRRAEATIEVQGFTIPKGTNVILNLWAINRDARAWNDPDKFMPERFIGNDINYLGQNFQFVPFGVGRRICLGLPLAQKVMYLVLGTLVHQFEWTLPEELKETGIDMTEKCGMVLCLANPLKVMAKKM

SEQ ID NO: 38768 - protein, 405 aa, Cryptococcus neoformans var. neoformans JEC21
MTSLTQALKRAQQTYANRNRKSYEAHQAASRHLPGGSTRSSIFIHPFPLCIQKGQGVKITDLDGHEYVDFVSDFTSGIYGKSHPVLIDAIKEALDNGLQLGAHTLAETTLASHFTSRFPSIELVRFANSGTEANILAISTAIKHTGRKKVLVFEGGYHGSVMSHFHMKGGDGDDLKVPFDFVVCSYNDRKATDALISQHPSEIGAILVEPMLGAGGCIPGDPAFLQFLREKASSIGAVLIFDEVQTARLSTGGRQKILGITPDLTTVGKFFGGGFAFGAFGGKKEIMEKFDARKGGAISHGGTFNNSPLTMVAGATAMEKILTEDALKNLNKLGDWMREEINRMFTSDGSPFLVLDLLFFYLLERGFWIAQRGLVSLSFAMTKEDVQRFIEAAIEATQKVKATLK

SEQ ID NO: 38769 - protein, 431 aa, Prochlorococcus marinus str. MIT 9312
MKRVLAIILGGGKGSRLYPLTKMRAKPAVPLAGKYRLIDIPISNCINSGIEKMYVLTQFNSASLNRHIGRTYNLNGPFGQGFVEVLAAQQTPDSPKWFEGTADAVRKYQWLFQEWDVDEYLILSGDQLYRMDYSLFVQHHRDNGADLTVAALPVDEAQAEGFGLMRTDDLGNIKEFSEKPTGEKLKAMAVDTSKFGLTKESAAEKPYLASMGIYVFSRNTLFDLLNKFPNYTDFGKDIIPEALKRGDTLKSYVFDDYWEDIGTIGAFFESNLALTEQPKPPFSFYDEKFPIYTRPRFLPPSKLVDAQITDSIVCEGTILKSCSILHCVLGVRSRIESDSILEDTLVMGADFFESPEERIELRKGGGTPLGVGEGTTVKRAILDKNTRIGDNVVIINKDRVEEADKPELGFYIRNGIVVVVKNATIANGTVI

SEQ ID NO: 38770 - protein, 337 aa, Arabidopsis thaliana
  misc_feature (224)..(224): Xaa can be any naturally occurring amino acid
MHSLPVNLVLTVLTVFLTSPAQVIGYRPYPPKTNGSDQIFDASKKFEGSSNLVRLRYHMGPVLTNNITVHPIWYGTWQKSQKKIIREFINSISAVGSKHPSVSGWWKTVQLYTDQTGSNITGTVRLGEEKNDRFYSHGKSLTRLSIQSVIKSAVTSRSRPLPVNPKSGLYLLLTADDVYVQDFCGQVCGFHYFTFPSIVGFTLPYAWVGNSAKLCPGVCAYPFXVPAFIPGLKPVKSPNGDVGVDGMISVIAHEIAELATNPLVNAWYAGPDPVAPVEIADLCEGIYGTGGGGSYTGQMLNDHSGATYNVNGIRRRYLIQWLWSHVVSYCTGPNALD

SEQ ID NO: 38771 - protein, 275 aa, Bacillus anthracis str. Ames
MELWFTEKQTKHFGITARINRTLHTEQTEFQKLDMVETEEFGNMLILDGMVMTTEKDEFVYHEMVAHVPLFTHPNPENVLVVGGGDGGVIREVLKHPSVKKATLVEIDGKVIEYSKQYLPSIAGALDNERVEVKVGDGFLHIAESENEYDVIMVDSTEPVGPAVNLFTKGFYAGISKALKEDGIFVAQTDNPWFTPELITTVFKDVKEIFPITRLYTANIPTYPSGLWTFTIGSKKHDPLEVSEERFHEIETKYYTKELHNAAFALPKFVGDLIK

SEQ ID NO: 38772 - protein, 268 aa, Thermoplasma acidophilum DSM 1728
MNGNSIIGLIGHPVSHSIGQILYNRIFQDMGIDAFYLAMDVHMNVLPAFLKNSFFLKAFNVTIPHKVSIIPFLDDLDEIASQTRSVNLVIREQSRMKGYNTDYYGLDYALSFNQVEIEEKRIVIAGSGGIARTVIRYMLDHGAHRVDVLTRNAQNARRNLDIPGIGLHENIDEDYDIYVNCTPLGTLGDGDPFSTVDFRSGRTGIDLVYNPPDTPFLKRMRNAGGRTVSGLDVFIGQGLRTLELVFGIRPDSIFREYAVEALNEIRKG

SEQ ID NO: 38773 - protein, 336 aa, Mycobacterium leprae TN
MKLAIIGGDGIGPEVVAQAVKILDVVLPGVQKTTYDLGARRYHTTGELLPESVLAELREHDAILLGAVGDPSVPSGVLERGLLLRLRFELDHHINLRPARLYPGVNSLLAGKPDIDFVVVREGTEGPYTGTGGAIRVGTPNEVATEVSVNTAFGVRRVVQDAFERARQRRKHLTLVHKNNVLTYAGTLWCRIVQEVGEKYPDVEVVYQHIDAATIYLVTEPSRFDVIVTDNLFGDIITDLAAAVCGGIALAASGNIDATRTNPSMFEPVHGSAPDIAGQGIADPTAAIMSLALLLAHLGEDEPAARLDQAVASYLATRGNGRFSTGEVGERIAAAL

SEQ ID NO: 38774 - protein, 430 aa, Helicobacter pylori 26695
MELLHSINDFNEAKQVIAGGVNSPVRAFKSVKGTPPFILKGKGAYLYDVDNNHYIDFVQSWGPLIFGHADEEIEENIINALKKGTSFGAPTELETTLAKEIISCYEGLDKVRLVSSGTEATMSAIRLARAYSQKDDLIKFEGCYHGHSDSLLVKAGSGCATFGSPSSLGVPNDFSKHTLVARYNDLNSTEECFKKGNVGCVIIEPIAGNMGLVPAQKEFLLGLKALCEKYQAVLILDEVMSGFRASLSGSQEFYGVVPDLVTFGKVIGAGLPLACFGGRAEIMDLLSPIGSVYQAGTLSGNPLAVCAGLSALYKIKRDKTLYTRLDALAIRLTQGLQKSAQNYNIALETLNMGSMFGFFFNENAVHDFDDALKSDTEMFAKFHQKMLFKGVYLACSSFETGFICEPMTEEMIDLTIAKADESFDEIIKGV

SEQ ID NO: 38775 - protein, 442 aa, Salmonella enterica subsp. enterica serovar Typhi str. CT18
MLSFLKAPANAPLITDKHEVDARYRYWRRYILITIWLGYALFYFTRKSFNAAAPEILASGILTRSDIGLLATLFYITYGVSKFVSGIVSDRSNARYFMGIGLIATGVVNILFGFSTSLWAFALLWALNAFFQGFGSPVCARLLTAWYSRTERGGWWALWNTAHNVGGALIPLVMAAVALHYGWRVGMMVAGLLAIGVGMVLCWRLRDRPQAIGLPPVGDWRHDALEVAQQQEGAGLSRKEILAKYVLSNPYIWLLSLCYVLVYVVRAAINDWGNLYMSETLGVDLVTANTAVSMFELGGFIGALVAGWGSDKLFNGNRGPMNLIFAAGILLSVGSLWLMPFASYVMQAACFFTTGFFVFGPQMLIGMAAAECSHKEAAGAATGFVGLFAYLGASLSGWPLAKVLEIWHWTGFFAVIAIAAGISALLLLPFLNAQAPRETHEA

SEQ ID NO: 38776 - protein, 348 aa, Oryza sativa (japonica cultivar-group)
MAMAMHRFSLCCVVLLVLAPLAAVAWRPWPPRNGSGEVEGIGASKKFEGSSDFVKLQYHMGPVLAADITVHPIWYGRWPAEQKRTIRAFLRSLSPPGSGSGDGGIPSPSVAAWWRTVRLYTDQTSANVSGVVRLGREKCDARASRGGRLTRLDIQSVVRDAVTARTRPLPVDSSGVYLVLTSPEVVVENFCGQVCGFHYFTFPSVVGYTLPYAWVGNSAARCPEVCAYPFAIPSYVGGGRRAEAPPNGDVGVDGMVSVIAHELAELASNPLANAWYAGEDPSFPTEIADLCEGIYGTGGGGAYTGQLLTDGRSGASYNVNGVGGRKFLVQWVWNPILSYCSGPNALDQ

SEQ ID NO: 38777 - protein, 463 aa, Salmonella enterica subsp. enterica serovar Typhi str. CT18
MLAFLNQVRKPTLDLPLNVRRKMWFKSFMQSYLVVFIGYLTMYLIRKNFNIAQNDMISTYRLSMTELGMIGLGFSITYGVGKTLVSYYADGKNTKQFLPFMLILSAICMLGFSASMGAGSTSLFLMIAFYALSGFFQSTGGSCSYSTITKWTPRRKRGTFLGFWNISHNLGGAGAAGVALFGANYLFDGHVIGMFIFPSIIALIVGFIGLRFGSDSPESYGLGKAEELFGEEISEEDKETEENEMTKWQIFVEYVLKNKVIWLLCFSNIFLYVVRIGIDQWSTVYAFQELKLSKEVAIQGFTLFEVGALVGTLLWGWLSDLANGRRALVACVALALIIATLGVYQHASNQYVYLASLFALGFLVFGPQLLIGVAAVGFVPKKAIGAADGIKGTFDYLIGDSFAKLGLGMIADGTPVFGLTGWAGTFAALDAAAIGCICLMAMVAVMEERKIRREKKIQQVNIA

SEQ ID NO: 38778 - protein, 964 aa, Silicibacter pomeroyi DSS-3
MLRKKTNGVARRPQRNSILSQVGDSHVDRRAFLRGSGLAIGGLAAISATGGTVTQASAQTAAGSAVETVKSVCTHCSVGCTVVAEVKNGVWIGQEPGWDSPFNLGAHCAKGASVREHAHGERRLKYPMKKEGGEWKQISWEQAIDEIGDGMMKIRAESGPDSVYWLGSAKHNNEQAYLFRKFAAYWGTNNVDHQARICHSTTVAGVANTWGYGAMTNSYNDIHNSKAIFIIGGNPAEAHPVSLLHVLKAKEQNNAPLIVCDPRFTRTAAHADEYVRFRPGTDVALIWGILWHIFENGWEDKEFIRTRVWGMDQIKAEVANWTPEETERVTGVPGSQLKRVARTMANNRPGTVIWCMGGTQHTNGNNNTRAYCVLQLALGNMGTSGGGTNIFRGHDNVQGATDLGVLSHTLPGYYGLTAGAWAHWARVWGEDLDWLKGQFASIKDKDGKDKPLMNESGIPVSRWIDGVLEDPANMDQDNNVRAMVLWGHAPNSQTRGPEMKTAMEKLDMLVVIDPYPTVSAVMHDRTDGVYLLPACTQFETRGSVTASNRSLQWRDKVVDPLFESLPDEVIIAKFANKFGWADRLFRNIEMDDAETPNVESITREFNAGLWTIGYTGQSPERLKSHMANQHTFDRTTLQAVGGPNDGEYYGLPWPCWGTAEMGHPGTPNLYDMSKPVAEGGLCFRARFGVERDGDNLLAEGVSNPGAEIQDGYPEFTMQMLMDLGWDGDLTGEERAAIDAVAGPKTNWKTDLSGGIQRVAIKHGCAPFGNAKARAVVWTFPDPIPLHREPLYTNRRDLVADYPTYEDRHAYRLPTLYASIQKNDFSKDYPIILTSGRLVEYEGGGEETRSNPWLAELQQDMFVEINPRDANNLGIRDGQQVWVEGPEGGKVKVMAMLTERVGAGVAFMPFHFGGHFQGADLREKYPKGADPYVLGEASNTAQTYGYDSVTQMQETKATLCKISAA

SEQ ID NO: 38779 - protein, 520 aa, Glycine max
MEAAWATILTLILILALICAWKVLIWLWLRPKRLEKLLREQGLQGNPYTLFVGDSKEFLKMRKEALSKPMNLSDDIIPRVSSYEQHSVNKHGKNSFIWLGPIPRVTILDPEQIKDVFNKIYDFPKPNMNPLVKLLATGLAGYEGEKWSKHRRIINPAFNLEKLKIMLPLFFKSCNDLVSKWEGMLSSEGSCEMDAWPFLQNLASDVIARSAFGSSYEEGRRIFQLQREQAELLIKVLLKIQIPGWRFLPTNTHRRMKEIDRDIKASLKDMINKREKALKAGEATKNDLLGILLESNHKEIQEHGNRNNKNVGMSLEEVIEECKLFYFAGQETTSVLLVWTMVLLSRYPDWQARAREEVFQVFGYQKPDFDGLSRLKIVTMILYEVLRLYPPVAGMTRSIEKDVKLGTLTLPAGVHVLLPTILIHHDRKFWGEDAKQFNPERFSEGVLKATNGRVSFFPFGWGPRICIGQNFSLLEAKMALSMILQHFSFELSPAYAHAPTALITIQPQYGAHIILRKVPI

SEQ ID NO: 38780 - protein, 279 aa, Ostreococcus tauri
MSTTYRGARAIDVRGAEGSRATLTEHGAHVVRWVGPDGDERVFTSRAAVLDGARAIRGGIPICFPQFSDLGPCATSHGFARCVRWETKETRDGRCAMTTRATSEEFKAPHETTYEVELLDDGSMRTTLRVRNAGAEAFGFTTALHTYFRVGDAERTRVELGRRGLTYLDNLDGRRAKVDEGDTVVFEGEVDRIYKSAPGTIRIVDEASSNGPRTFHIEKSESFPDAVVWNPWIEKARKMSDFDDDEYREMVCVEVACVDEIVVAPGSTWVGSQTISVSK

SEQ ID NO: 38781 - protein, 335 aa, Colwellia psychrerythraea 34H
MTKQTITVIPGDGIGPSIIDATIKILDKAGCGFDYEFADAGLTALEKHGELVPEETINLIEKNKITLKGPLTTPVGEGFTSINVTLRKQFKLYANLRPVLSFKGTKARYENIDILTVRENTQGMYSGAGQVTSEDGTEAQAMSIVTREGAEKILTFAYETAIKEGRKKITAVHKANILKSTSGLFLKVAREVAQRYPQIESTEMIVDNCCMQLVMNPEQFDVIVTTNLFGDILSDLCAGLVGGLGMAPGANIGEDCAIFEAVHGSAPDIAGKNLANPTSVILAAIQMLEYLDMGDKAEKIRAAITDVIASGDRTTGDLGGTHGTTDFTEAVLERL

SEQ ID NO: 38782 - protein, 252 aa, Geobacillus stearothermophilus
RKPIIAGNWKMHKTLAEAVQFVEDVKGHVPPADEVISVVCAPFLFLDRLVQAADGTDLKIGAQTMHFADQGAYTGEVSPVMLKDLGVTYVILGHSERRQMFAETDETVNKKVLAAFTRGLIPIICCGESLEEREAGQTNAVVASQVEKALAGLTPEQVKQAVIAYEPIWAIGTGKSSTPEDANSVCGHIRSVVSRLFGPEAAEAIRIQYGGSVKPDNIRDFLAQQQIDGPLVGGASLEPASFLQLVEAGRHE

SEQ ID NO: 38783 - protein, 335 aa, Saccharomyces cerevisiae
MSNIVGIEYNRVTNTTSTDFPGFSKDAENEWNVEKFKKDFEVNISSLDAREANFDLINIDTSIANAFRRIMISEVPSVAAEYVYFFNNTSVIQDEVLAHRIGLVPLKVDPDMLTWVDSNLPDDEKFTDENTIVLSLNVKCTRNPDAPKGSTDPKELYNNAHVYARDLKFEPQGRQSTTFADCPVVPADPDILLAKLRPGQEISLKAHCILGIGGDHAKFSPVSTASYRLLPQINILQPIKGESARRFQKCFPPGVIGIDEGSDEAYVKDARKDTVSREVLRYEEFADKVKLGRVRNHFIFNVESAGAMTPEEIFFKSVRILKNKAEYLKNCPITQ

SEQ ID NO: 38784 - protein, 303 aa, Rubrobacter xylanophilus DSM 9941
MSAPRVIVVGDVLYDMVARVEGGLPVGADSFVRIQDSPGGSGANVAAWLASLGVEAHLVGRVGEDPLGDHLEAGLREAGVRTHLPRDPSLPTGRVFVLVDGSGERTMITDRGAGEALGPRDIPARLFAPGAHLHLTGYLFSGGGRREAALEALRLARSAAMSFSVDPSSVTLLRAVGVERFAGWTSGADLLFPNLSEAALLSGRAEPEEAARRLLERYRAVVLKLGPEGALYADREGRRARLPAPRVRRADATGAGDALCAAFLASWVRGEPPARALREGVRLAARVVGRTGARGFRRTRGPC

SEQ ID NO: 38785 - protein, 510 aa, Zea mays
MDLRRLAVFAAALAAGWWSRGAEASIHTYDREPFREVGNAFLLSGGSEGIVADGADPAAPASSFIKFVNVTFWRTPEAAESHAKMAHSTGLVQAILFEVVDRDNIGGSAYGGQRSICCTPDLAKLEGCKQGEVIRRPSSDDPDWPFVLDTHFSANHLSVKLEDEPVRITKTGMYNLFFISCDPKLRGLTMSGKTIWKNPGGYLPGRMAPLMKFYVLMSLAYLLVMIVWFSQYVRFWRDILPIQNWITLIIALGLFEMTLWYFEYLNFNSSGVRPVGITTWVVTVGAIRKTVSRLLILSISMGYGVVRPTLGGLTSKVLLLGLTYFLASELLDIAENVGTINDISGKARLFLVLPDAFLDAFLILWIFTSLSRTLEKLQARRSSVKLDIYRKFTNALAVSVIASVAWIGYEVYFKATDPFSERWQSAWIITAFWDVLAFVLLLVICYLWAPSQSSQRYAYSGEAADDDDEESQSLTKGDGEVGMVKIDKDRNAGVRSAFGLEDEAEEDKRE

SEQ ID NO: 38786 - protein, 223 aa, Triticum aestivum
  misc_feature (175)..(175): Xaa can be any naturally occurring amino acid
  misc_feature (198)..(198): Xaa can be any naturally occurring amino acid
ISDDVPNERNTIVYKLHVSCEKGSQRLTVKSGQLEWLPEGSQLTMASPAQSGDNQRTYTSFGQSQQNTSERPLGVKYNDITIARLGPGQAIELEAHAVKGVGKVHAKWSPVATAWYRMLPEVVLLKEIKNGDAEELVKRCPVNVFDIEDLGKGEKRAVVAKPRSCTLLKEMGQTXDDQEELRRVKNHSMLTIESTGSXPPEVLFTEAVKILEEKCERVISELS

SEQ ID NO: 38787 - protein, 530 aa, Thermoplasma acidophilum DSM 1728
MEYKYELTIDKLLQSGVSSNPDQIINYTGKREFTFKDFSKRVNTLAKALISIGVKKGDRVAVIDWDTYVYLEAYFAVPMVDAVLHTVNVRYPQDLIYYTMDHAEDKYVIVRDEFVPILSKNREAFYFIKGWIVYSETGQIPDSLSPKYVYDDLMKESYSDIELPQLSENDLATTFYTSGTTGIPKGVQFTHRQIVLHSISSGLALADDPINLTSRDVIMPLVPMFHVHAWGVPYMSIMSGRRYVLPGRYDFDHIIDLIDKYNVSVIAMVPSILYLIVTNPNVKKIAGRGIKAIVGGGALPEGLANAAEKLGITAISGYGLSETAPILTLATYNERVKAMPESEKKKFRLKTGIPIPLVQLRVVDDKMNDVPKDEKTIGEIVVRAPWLTSVYVKNKEGTEALWRGDWMHTGDLAVMDEYGYIRIVDREKDAVKSGGEFIPSLVLEDAISSCSGVVENAVVGRPDEKWGERPVAFYTGTAKPDEIRKHLIEMVNAGRIAKFWIPDDFINIKEFAKTSTGKIDKKVLREMIKK

SEQ ID NO: 38788 - protein, 284 aa, Aegiceras corniculatum
MAKDIEVGPGANAPKDYQDPPPAPLIDAEELTKWSLYRAVIAEFIATLLFLYITVLTVIGYSSQTDPDKNPDDCGGVGILGIAWAFGGMIFVLVYCTAGISGGHINPAVTLGLFLAQKVSLVRAMLYMMAQCLGAICGCGLVKAFQKSYYTKYGGGANYLHDGYNKGTGLGAEIIGTFVLVYTVFSATDPKRSARDSHVPVLAPLPIGFAVFMVHLATIPITGTGINPARSLGAAVIYGKKKTWDDQWIFWGGPFIGAPIAAFYHQFILRAGAIKALGSYRSNA

SEQ ID NO: 38789 - protein, 206 aa, Magnaporthe grisea 70-15
MANRNYDVLIKLLLIGDSGVGKSCCLLRFSEDSFTPSFITTIGIDFKIRTIELDGKRVKLQIWDTAGQERFRTITTAYYRGAMGILLVYDVTDERSFNNIRTWFANVEQHASEGVNKILIGNKCDWEEKRAVSTEQGQALADELGIPFLEVSAKGNINIDKAFYSLASDIKKRTIDTQKDFQNPGSVNVNAGAQGNSAGGMGGKCC

SEQ ID NO: 38790 - protein, 509 aa, Oryza sativa
MRITNGLAMVSLVLSSCDLVRLCSDRERPLGGREFATVVCQLASVVYLLSLFAHPDAPATTTGDDDDGQGGSRRAAPPEPAPMHGHGGGMMEGDDEEIVAAVASGALPSHRLESRLGDCRRAARLRREALRRVTGRGVEGLPFDGMDYQAILGQCCEMPVGYVQLPVGVAGPLLLDGREYHVPMATTEGCLVASVNRRVQGHLVSGGAFSVLLRDAMSRAPAVKLPCPMRAAELKAFAEAPANFELLAAVFNRSSRFGRLQDIRCALAGRNLYMRFSCITGDAMGMNMVSKGVENVLGYLQNVFPDMDVISVSGNYCSDKKPTAVNWIEGRGKSVVCEAIIKGDVVQKVLKTTVEKLVELNIIKNLAGSAVAGALGGFNAHASNIVTALFIATGQDPAQNVESSQCITMLEEVNDGDDLHISVTMPSIEVGTIGGGTCLASQAACLNLLGVKGSNHGSPGANAGRLATIVAGSVVAGRALLLAALASGHLVKSHMMYNRSSKDVAKAAS

SEQ ID NO: 38791 - protein, 428 aa, Staphylococcus aureus subsp. aureus COL
MRYTKSEEAMKVAETLMPGGVNSPVRAFKSVDTPAIFMDHGKGSKIYDIDGNEYIDYVLSWGPLILGHRDPQVISHLHEAIDKGTSFGASTLLENKLAQLVIDRVPSIEKVRMVSSGTEATLDTLRLARGYTGRNKIVKFEGCYHGHSDSLLIKAGSGVATLGLPDSPGVPEGIAKNTITVPYNDLDALKIAFEKFGNDIAGVIVEPVAGNMGVVPPIEGFLQGLRDITTEYGALLIFDEVMTGFRVGYHCAQGYFGVTPDLTCLGKVIGGGLPVGAFGGKKEIMDHIAPLGNIYQAGTLSGNPLAMTSGYETLSQLTPETYEYFNMLGDILEDGLKRVFAKHNVPITVNRAGSMIGYFLNEGPVTNFEQANKSDLKLFAEMYREMAKEGVFLPPSQFEGTFLSTAHTKEDIEKTIQAFDTALSRIVK

SEQ ID NO: 38792 - protein, 443 aa, Guillardia theta
MRAVLLAVAATCASAFMAPSPVSLSRRPLRLSQSRSAAVRVPRASPVMMANIKERTVRAPVFDEVCEQTGITLTRYMMEVSRANPELRDLESLISGIQQACKTISSLVDRATITGMVGYANGGGSINVQGEEQKKLDVVTNDVLKRALRFTGKVGIIASEEEDVPVFNKDAYKVPGGEGKYQDVTVDIGSKYVTVFDPLDGSSNVDANIPTGTIFGVYEEAESMENCMVNDDSVEGSCLLNTLQPGDALVASGYCLYSSSCMFVFTIGAGVNGFTYDRSIGEFVLTHPNIQLPKRGKIYSMNEANRWDWDKPLQDYVTAIQTGQGQTKAKYSSRYIGSMVGDVHRTLLYGGIFGYPADKKNKDGKLRLLYEAAPMSFLMEQAGGLSLTGKTRIMDLVPQKVHQRVPFLAGSYDDVMEMRSYYDACDDPEIIKRCLARLEGSAK

SEQ ID NO: 38793 - protein, 154 aa, Brassica napus
MDCSFISINDLQRMFHKLDKNQDGLVTLDELHWILERLGWSEHTPEELELFVGKQSLDLDEFLRFYDDAVSDRKETKNDSVVDNDDAIVGAFNVFDVNGDGYISSEELRTVLERIGFEEETKRWDCGRMIRAHDKNLDGVIDFEEFKNMMLHVQ

SEQ ID NO: 38794 - protein, 459 aa, Ostreococcus tauri
MSTTEDEDSACGSESSSAATGTTDGSESDDWDGSDADGGRRRSRRREHAGGDDDVVRAARTKRRKARKERERRRESGGEAKKAVTSKFAVCGTVFEVDAKYAPIKPVGKGAYGVVCSAREVETNRKVAIKKIVNVFENVVDAKRTLREIKLLRHLRHENVIDIIDCVRPEAMDAFEDVYLMYDLMDTDLYQIIRSSQSLTDEHCQYFLYQILRGLKYIHSADVLHRDLKPGNLLLNANCDLKICDFGLARTALVDAEASEFMTEYVVTRWYRAPELLLSCAEYTSAIDVWSVGCIFAELLGRKTLFPGKDYVHQLNLIMRVIGTPRDDSELDFINNEKARRYIKSLPVTARCNFRKLFPNASPKAVDLVDKMLVLDPARRITVEDALAHPYLESLHDEVDEPCAETPFTFNFEEDGRYLTGTDIRELIYTELCSLSDEFEVKMQQLSLRSDTDSSTFAV

SEQ ID NO: 38795 - protein, 179 aa, Hordeum vulgare subsp. vulgare
MARRSGCSVGAALLALAALLAASAVPGAAGFHLGGDESGLVRGMLAAVRERAEAEDAARFAVAEHNRKQGSALEFTRVVDAKRQVVAGTLHNLMVEVVDSGKKSMYKAKVWVKPWQNFKAVVEFRHAGDFQSESSVASDGSTGQAILKLSLQTDMAPKMHSNDNTGLSVDSSSSQAHKA

SEQ ID NO: 38796 - protein, 327 aa, Prochlorococcus marinus subsp. marinus str. CCMP1375
MAGTLLFNALREAIDEEMARDPHVCVMGEDVGQYGGSYKVTKDLYEKYGELRVLDTPIAENSFTGMAVGAAMTGLRPIVEGMNMGFLLLAFNQISNNMGMLRYTSGGNFKIPTVVRGPGGVGRQLGAEHSQRLEAYFHAVPGIKIVACSTPTNAKGLMKAAIRDDNPVLFFEHVLLYNLTEELPEGDYLCSLDQADLVREGKDVTILTYSRMRHHCLKAVEQLTKKDIDVELIDLISLKPFDIKTICNSIRKTHRVIIVEECMKTGGIGAELMALINEHCFDDLDCRPIRLSSQDIPTPYNGQLENLTIIQPHQIVETVEQVVNLGV

SEQ ID NO: 38797 - protein, 357 aa, Prochlorococcus marinus str. MIT 9312
MKNYKIVLLSGDGIGPEISEVSKKVLKKLSRKHNFNIEIIEKLFGGIAYEKYGTPAPDETLDQCKKCDAVLLACVGDIKYDSLARELRPESGLLKLRSALGLFANIRPVKIRKSLVNTSTLKKEIVENVDLIVVRELIGGIYFGKPRGHITNTKIPKAFNTMVYDSAEIERITEIAIKIANQRNKKICSVDKSNVLEVSQLWRDTVLNITLKDKNISLSNMYVDNAAMQLVRDPSQFDVILTSNLFGDILSDLAAMLTGSIGMLPSASLNNNGPGVFEPVHGSAPDIAGKNIANPIAMLLSASMMLKIGLNEEEAAKNLETAVDKVLAEGFRTADLADGSSEVLSCSEIGDKIIDEI

SEQ ID NO: 38798 - protein, 460 aa, Salmonella enterica subsp. enterica serovar Typhi str. CT18
MRYRFPDNFWWGSACSALQTEGDSLNGGKSQTTWDVWFERQPDRFHQGIGPAETSTFYRHWKQDIALLKQLKHNSFRTSLSWARLIPDGVGEVNPQAVSFYNHVIDELLAQGITPFITLFHFDMPMVMQEKGGWENRDVVEAFGRYAQTCFTLFGDRVKHWFTFNEPIVPVEGGYLYDFHYPNVVDFKRAATVAYHTVLAHSTAVRAWRAGRYDGEIGVVLNLTPSYPRSQHPADVQAAHHADLLFNRSFLDPVLKGEYPAELVALLKTYDQLPACQPGDRQLIADGKIDLLGINYYQPRRVKCRDTAVNPQAPFMPEWLFDYYDMPGRKMNPYRGWEIYAPGIYDIITNLRDNYGNPRCFISENGMGVENEQRFVQAGQIHDDYRIDFISEHLKWLHKGISEGCHCLGYHMWTFIDNWSWLNGYKNRYGFVQLDLATQTRTVKKSGEWFAATAEHNGFD

SEQ ID NO: 38799 - protein, 475 aa, Zea mays
  misc_feature (377)..(377): Xaa can be any naturally occurring amino acid
  misc_feature (386)..(386): Xaa can be any naturally occurring amino acid
MQFALALDTNSGPHQIRSCEGDGIDRLEKLSIGGRKQEKALRNRCFGGRVAATTQCILTSDACPETLVPVGGCYRLIDIPMSNCFNSGINKIFVMSQFNSTSLNRHIHRTYLEGGINFADGSVQVLAATQMPEEPAGWFQGTADSIRKFIWALEDHYSHKSIDNIAILSGDQLYRMNYMELVQKHVEDDADITISCAPVDESRASKNGLLKIDHTGRVLQFFEKPKGADLNSMRVETNFLSYAIDDAQKYPYLASMGIYVFKKDALLDLLKSKYTLLHDFGSEILPRAVLDHIVQVCIFAGYWEDVGTIKSFFDANLALTEQSNKIDFYDPKTPFFTALRCLPPTQLDKCKMKYAFISDGCLLRECSIEHSVIGVCXRVSSGCESXASVMMGAGIYEFVEEVSKLMLVGKVPVGIGRTTKIRDCIMDMNARLGKHVVIPNSKGIQEADHPEEGYYIRSGIVVILKNATINDGYVI

SEQ ID NO: 38800 - protein, 557 aa, Ustilago maydis 521
MAPQILKSLEPDPPRVQRGNLFDFLHSNPNKVDENKPVFYRLDGKKITRKQLYDDSRRLAYALRNKLGLRPGARIGIISPNSTAYPWVVHAGLCAGVVLVPLNPAYGAEELVHPVQQAEIEYIFCHQSVLNTVRDGLELAKVSLKSTNGQNRLWILDDGDSLKKDDKGEQDARTLLGDDRLETHKVVDDRTEDAFIVFSSGTSGKPKGVQLVHGNMTAVTTAIVHTFGDAISPNDRYIGVLPFYHIFGLAKFMCKGVYIGAECVVVPKFDLGVFCAAVEKFKCNISYVVPPILVLLAKDPRAKKYDLKSLKWVMSGAAPLGTELSMEVEAAHPGLRVTQGWGLSETSPTATFAKPEDYHAHMGTCGRLIAGVEGRLVDDDGNDVGFEQGENGKPGEFWVRGPTIMKGYLNNKEATDDCITPDGWFKTGDIAIMKNNYFWIVDRKKELIKYKGFQVPPAELEATLLSHPKIADVAVIGVYNKAQATELPRAYVVLKEEVAKNEDPEAVAKEIIEWTAKKVANHKRLRGGVKVLEEIPKSPSGKILRRLLRDEAAKESQ

SEQ ID NO: 38801 - protein, 198 aa, Glycine max
MAMLGGVRDVPSNENSVEVESLARFAVDEHNKKENALLEFARVVKAKEQVVAGTMHHLTLEIIEAGKKKLYEAKVWVKPWLNFKELQEFKPSTTITPSDLGCKKGEGASGWREVPGDDPEVQHVADHAVKSIQQRSNSLFPYELQEVVHANAEVTGEAAKYNMVLKLKRGEKEEKFKVEVHKNHEGVLHLNHMEQHHD

SEQ ID NO: 38802 - protein, 402 aa, Bordetella pertussis Tohama I
MDSILSFISGGLTQATWWQIVLFTLVVTHITIVSVTVFLHRSQAHRGLDLHPAVMHFFRFWLWMTTGMVTKEWVAIHRKHHAKCEKEGDPHSPMLFGIWKVLFRGAELYREESANKETMAKFGHGTPDDWLERNIYSKHSLAGVLTMLAIDLALFGAVGLTVWAVQMAWIPFWAAGVVNGIGHYWGYRNYNSPDTSTNVFPWGIIIGGEELHNNHHAHGTSAKFSAKWYELDIGWGYISILKFFGLAKVKKVAPKLKLESGSKGIDLSTLQGVITHRYEVMARYGDLVKRAAREELSKLKSSRQQDAANCRWTTLRRVRRWLHRNEEVLQPEQRAEVDQAIAQNQSLSTLVQMRRELGRLWESSSASSEQLLHDLQAWCQRAQQSGIAGLEQFALHLRRYAA

SEQ ID NO: 38803 - protein, 489 aa, Oryza sativa (japonica cultivar-group)
MAVSLKSSGSFCSTPPQWLHSTRDRILYGYSHSNAKECTCKKTKRPAPLCVKATSTKVELDFNDPSWKQKFQEDWDKRFNLPRITDIYDLKPRPTTFSLKKNRSPAGDENGTPMDKWNGYVNSDDRALLKVIKYSSPNSAGAECIDPDCSWVEQWVHRAGPRKEIYYEPEEVKAAIVTCGGLCPGLNDVIRQIVFTLETYGVKNIVGIPFGYRGFFEKGLKEMPLSRHLVENINLAGGSFLGVSRGGAKTSEIVDSIQARRIDMLFVLGGNGTHAGANAIHEECRKRKLKVSVVAVPKTIDNDILLMDKTFGFDTAVEEAQRAINSAYIEVPFTLDGEYGVLRHLEHLLKTKGFCVVCVAEAAGQIQLEARATDASGNVILSDIGVHMQQKIKMHFKDIGVPADVKYIDPTYMVRACRANASDAILCTVLGQNAVHGAFAGFSGITSCICNTHYVYLPITEVITVPKRVNPNSRMWHRCLTSTGQPDFH

SEQ ID NO: 38804 - protein, 668 aa, Synechococcus sp. WH 7805
MAAPQANRVELLIFSSGDAPSPDRIIDLDVHTHRSGDYWHAEVEGLKAGCLYGYRVFGPLAPGGHGFRPAKVLLDPCARGIDGWSVYQREMATGASPNTDCCLKGVVCERDAFDFDAHPRPRHDWQQTVIYEMHVGGFTRRSDSGVAPERRGTLLGVIDKIPYLKDLGVTTIELLPVQAFDPDDAPPGRDNAWGYSPLSWFTPHQGYICGGDPLEARKQMRELVAACHDAGLEVLLDVVYNHTTEGNRNGPTLSWRGLGDQIYYHQTSKGDYLDVSGCGNSIAAHQPLTRALILESLRCWAIELGVDGFRFDLGIELSRGEGLKPLEQPPLLEAMEADPLLSDLKMVSEPWDCGGLYRLNDFPAQRIGTWNGRFRDALRGFWKGDEDSTWAMGQRLRGSPDLYEGKPVNLGRSVNLLTAHDGFTLMDLVSFNGKHNLANGEDNRDGENHNISWNHGVEGPTTDHAVTALRRRQQRNMLSTLLLARGVPMLLMGDEVGRSQGGNNNTWCQDTPLSWMIWSDDHCDMELLTYVKRLLVVRRQLADLFNPLVGHSEKPQRFSSDTDGYWRQWHGVELGKPDWASWSHCLALSVHKGNQGAVLWAGLNAYFKAMHFDLPEATTPWHRLIDTALPPGQDLPAHPEPWTPPGVPLEARSLVVMVAGEYANSLRL

SEQ ID NO: 38805 - protein, 316 aa, Bacillus cereus ATCC 14579
MKEVLEVLPKTMKYLIEECKQYDALEEIRVRIGRPLECIAHGKVFFYDYITTAEDAIYLLNKLSQFSIYTMEEELKRGYVTLRGGHRIGLAGKVITEKSAVKMIRDVSSFNIRIARQKIGIAEPLLPYLYEKRWLNTMVIGPPQTGKTTLLRDVARCMSQGVSASEIPSCKVGIVDERSEIAGCVKGIPQYDFGTRVDVLDACPKAEGMMMMIRSMSPDILIVDEIGRKEDSEAIMEAVHAGVQLFISAHGFSYEDVVRRPSLKAVLELGIFDRFVELSKARGPGTVMQVKDKYGKPVLSNRKGEGRMVKIFGCRC

SEQ ID NO: 38806 - protein, 365 aa, Ustilago maydis 521
MALIIVSGLASSGRSTCSALIKEELERRIKDSGAGSSSPAQVQAPNRVVIVSDHDVHITRSAYASQRTEKPARASYLSAVTRALGKDTLVIADGGAGLNIKGFRYQLWCAAREVGVRCLSIHVHAPPQVCRYWNGKRRIEQSEEASYDDETLDSLLMRFEEPNAMTRWDSPLIIVPTILNTPTDQDQDASSSLINDNCISVEPIPFDDIWDAATKGSINKAPEVVAPTRSTTANYLSILESSTQTVVSCILQHQSSLGLQPGADIPITHPSLTGGPSLAFSLPADKPVTMASLQRIRRQFVRMHSSGSAQINELGSAARSEGVHFSLTSQVALNGSKSAAFNAAQPASTEYAIAKRFLAFLEGAL

SEQ ID NO: 38807 - protein, 420 aa, Escherichia coli K12
MPHSLFSTDTDLTAENLLRLPAEFGCPVWVYDAQIIRRQIAALKQFDVVRFAQKACSNIHILRLMREQGVKVDSVSLGEIERALAAGYNPQTHPDDIVFTADVIDQATLERVSELQIPVNAGSVDMLDQLGQVSPGHRVWLRVNPGFGHGHSQKTNTGGENSKHGIWYTDLPAALDVIQRHHLQLVGIHMHIGSGVDYAHLEQVCGAMVRQVIEFGQDLQAISAGGGLSVPYQQGEEAVDTEHYYGLWNAAREQIARHLGHPVKLEIEPGRFLVAQSGVLITQVRSVKQMGSRHFVLVDAGFNDLMRPAMYGSYHHISALAADGRSLEHAPTVETVVAGPLCESGDVFTQQEGGNVETRALPEVKAGDYLVLHDTGAYGASMSSNYNSRPLLPEVLFDNGQARLIRRRQTIEELLALELL

SEQ ID NO: 38808 - protein, 491 aa, Saccharomyces cerevisiae
MSNPIENTENSQNTSSSRFLRNVQRLALNNVTNTTFQKSNANNPALTNFKSTLNSVKKEGSRIPQFTRESVSRSTAAQEEKRTLKENGIQLPKNNLLDDKENQDPSSQQFGALTSIKEGRAELPANISLQESSSAKEIIQHDPLKGVGSSTEVVHNSVENEKLHPARSQLQVRNTESETDSGKKRPISTIVEQELPKKFKVCDENGKEEYEWEDLDAEDVNDPFMVSEYVNDIFEYLHQLEVITLPKKEDLYQHRNIHQNRDILVNWLVKIHNKFGLLPETLYLAINIMDRFLGKELVQLDKLQLVGTSCLFIASKYEEVYSPSIKHFASETDGACTEDEIKEGEKFILKTLKFNLNYPNPMNFLRRISKADDYDIQSRTLAKFLLEISLVDFRFIGILPSLCAAAAMFMSRKMLGKGKWDGNLIHYSGGYTKEELAPVCHMIMDYLVSPIVHDEFHRKYQSRRFMKASIISVQWALKVRKNGYDIMTLHE

SEQ ID NO: 38809 - protein, 435 aa, Saccharomyces cerevisiae
MGENHDHEQSIKRNSMIYNENERQLCNSNLKILQNKRALSKNDSSSKQQVQDSKPRRALTDVPVNNNPLSQNKRIVAGSKAAKVRREENIRPIVSAVQKRQIYNDRTAAEQEEEEEEEGEDDDAASIVNKKRRIDAEGVSEIVGWQDLDYVEKDDTAMVAEYSAEIFAFLYRRELETLPSHNYLLDKTSKYYLRPSMRTILVDWLVEVHEKFQCYPETLFLSINLMDRFLAKNKVTMNKLQLLAVTSLFIAAKFEEVNLPKLAEYAYITDGAASKNDIKNAEMFMLTSLEFNIGWPNPLNFLRRISKADDYDPVNRNIGKFILEYAYCCHQFIHLPPSTVSAMAMYIARRMTNRNKNELWNGTLQHYSGGIDPIHDEAFQSLCIDLVKDIASSKTHLDSLILKYKKPRYGSVYFQTFKWCTSEMHSNFQNLFNLK

SEQ ID NO: 38810 - protein, 188 aa, Coccidioides immitis RS
MPAYHSIFLQEPNEQTIGNFPILPLRTRTRGPAYTLPTLPAGSSDADIDPDSESYDCIDEILSLYRANTFFRNFEIKGPADRMLIYGILFISECLGRVKPGMPAREAEKVLINASLDHFAIPGDASFPLNQAFEPPRDRQEAETLRQYISQVRQELAIRLHSRLYPGGVGPSKWWLSFAKRKFMGKSL

SEQ ID NO: 38811 - protein, 623 aa, Ostreococcus tauri
MMSRARRAIVGRGGGSAEVARNASAQSASGRDAQTTSAETNASGGGGEGASIDGEISAPRLPGLRLTPAGRVLAAAAAAAASGRDRGPDAEMNDEFGGMRGDPEVEETPLPLPPPLGDIPRAHGGVVGKIKGQILPSSGYVPLEVQTHAEKVRLIQQQERTRRSHSITDAAVTTTAKTAGAAVGAISKMAAKLKESRHFKSASAPLTAVEIADDAPAARESHAEEAGEANARSAHTEPTSNPFVQDESRRPGRNSSELSDSGVPSSPHHRRASSAGNWSDMSYTTSDDGMLRMCHTSLAPTKPRRWTKGDNLGEGSFGSVWLALNGDTGELFALKEVRFGSSDKHREESIEQLEQEVDVLSRLVHPNIVRYIGVTREEAALYIFLEYVPGGSIASLVHRFGKFEENVIRVYTRQLLIGLSYLHSQRVLHRDIKGANILVEKSGRIKLADFGMAKVLENVSHGKSFKGSACWMAPEVIRQKNVGFEADIWSVGCTVYEMATGAPPWSDCSTQVQIIFKIASSEEIPVIPEHLSPDGQDFLRLCLQRDATRRPEAVALLDEPFVVDAHRSSNATNIPGLQYDTWASSSVLSFRDDEASVRSGDGTVGGMRSNQSSMRHVAWGDLE

SEQ ID NO: 38812 - protein, 174 aa, Lactuca sativa
MASISSSAIATVNRTTSTQASLAAPFTGLKSNVAFPVTKKANNDFSSLPSNGGRVQCMKVWPPIGLKKYETLSCLPPLSDEALSKEIDYLIRNKWIPCLEFELEHGFVYREHHHSPGYYDGRYWTMWKLPMFGCTDSAQVMKEVGECKKEYAGTEFAKGSLKVKLLKWPRSPLQ

SEQ ID NO: 38813 - protein, 309 aa, Magnaporthe grisea 70-15
MEAFKNATIAAGATALNSSHGYFDVFEEVSKYHVQLSVLERLWAAWYLWWQNDTLATGIMSFAMHEIVYFGRSLPWIIIDAIPYFRQWKIQNQKIPTAKEQWDCTMLVLLGHFTVELPQIWVFHPLATYFGLDHGVPFPPAWKIAMQIAIFFVIEDLWHYLFHRALHYGPLYKNIHKLHHTYSAPFGLAAEYASPIEVMLLGFGVVGTPIVWTSITGDLHLFTMYLWIVLRLFQAIDAHSGYDFPWSLRKFLPFWGGADFHDLHHERFIGNYASSFRWWDWVFDTEAGDEPARKRREKKLAALKAKKAQ

SEQ ID NO: 38814 - protein, 558 aa, Sulfitobacter sp. EE-36
MTFKSDIQIAREASKRPIQEIGQKLGISSDDLLPYGHDKAKVSQKFINSVQDRPDGKLILVTAINPTPAGEGKTTTTVGLGDGLNRIGKNAAVCIREASLGPNFGMKGGAAGGGYAQIVPMEEMNLHFTGDFHAITSAHNLLSAMIDNHIYWGNALEIDLRRVVWRRVVDMNDRALRQITASLGGVSNGFPREAGFDITVASEVMAILCLAKDLNDLQKRLGDMIVAYTRERKPIYARDIKADGAMTVLLKDAMQPNLVQTLENNPAFVHGGPFANIAHGCNSVIATTTALKLADYVVTEAGFGADLGAEKFLNIKCRKAGLAPSCVVVVATVRAMKMNGGVAKADLGAENVDAVQAGCPNLGRHIENLKSFGVPVVVAINHFVTDTDAEVQAVKDYVASQGAEAVLSRHWELGSAGSAELAEKVVETIEKGQADFATLYPDAMPLADKINTIATKIYRADGAVMDQKILNQLKDWEEQGYGDLPVCMAKTQYSFTTDPEARGAPTGFTIPVREVRLSAGAGFVVAICGEIMTMPGLPRVPSAENIRLNDIGDVEGLF

SEQ ID NO: 38815 - protein, 429 aa, Oryza sativa (japonica cultivar-group)
MAAALARRGGGGLARALARGRGMCSATAAERAAGAALTSEELMRMERERSAHNYHPIPVVFSKGEGSHILDPEGNKYIDFLSAYSAVNQGHCHPKVLRALKEQAERLTLSSRAFYNDKFPIFAEYLTSMFGYEMMLPMNTGAEGVETAIKLVRKWGYEKKKIPKNEALIVSCCGCFHGRTLGVISMSCDNDATRGFGPLVPGHLKVDFGDTDGLEKIFKDHGERICGFLFEPIQGEAGVIIPPDGYLKAVRDLCSRHNILMIADEIQTGIARTGKMLACDWENIRPDVVILGKALGAGVVPVSAVLADKDIMLCIKPGEHGSTFGGNPLASAVAVASLKVVTDEGLVERAAKLGQEFRDQLQKVQQRFPQIIREVRGRGLLNAVDLSNEALSPASAYDICIKLKERGVLAKPTHDTIIRLAPPLSISQS

SEQ ID NO: 38816 - protein, 264 aa, Glycine max
MAQPPFDPFYLYQHDEQSNINTLFVSGLPDDVKAREIHNLFRRRPGFDSCQLKYTGRANQVVAFATFFNHQSAMAALHALNGVKFDPQTGSVLHIELARSNSRRKRKPGSGAYVVIDKRSKGEPDLQGSSSEDGDSDPDEPSDSGDNQGDLAIMTSDETAVGSDNAVSVEQHGKGSTGGLCSTLFIANLGPNCTEDELKQAFSAYTGFNMVKMRSRGGMPVAFVDFEETHQAAKVMEELQGSLLPSSDRGGMHIEYARSKMRKR

SEQ ID NO: 38817 - protein, 273 aa, Oryza sativa (japonica cultivar-group)
MEKYEKLEKVGEGTYGKVYKAQDRATGQLVALKKTRLEMDEEGIPPTALREISILRLLSQSLYVVRLLSVEQATKNGKPVLYLVFEFLDTDLKKFVDAYRKGPNPRPLPTNVIKSFLYQLCKGVAHCHGHGVLHRDLKPQNLLVDKEKGILKIADLGLGRAFTVPMKSYTHEIVTLWYRAPEVLLGSTHYSTGVDIWLLGTPTEEQWPGVTDLRDWHEFPQWKPQILERQVPSLEPEGVDLLSKMLQYNPANRISAKAAMEHPYFDSLDKSQF

SEQ ID NO: 38818 - protein, 438 aa, Triticum aestivum
MARVEALSMSGATAIPAEYVRPQEERQGLGDAYDEAAASWSAAGSPRIPVVDVAAFDAADPGSPSSLAVVDAVRAAAEGWGVMHVAGHGIPEDLIDALRGAGTGFFRMPIEDKEAYANDPAAGRLEGYGSRLAGSAGEDGKREWEDYLFHMLHPDARADHALWPAHPPEYVPVTKTFGEHVSALSSRLLAILSLGLGVPADTLERRLRLTSGGETQEVEDDLLLKLKINYYPRCPQPELAVGVEAHTDVSALSFILTNGVPGLQVLLPGDGQTWVTARDEPGTLVVHVGDALEILSNGRYTSVLHRGLVNRQAVRVSWVVFAEPPPNSVLLRPLPELLVDETPRFEPRTFRQHLERKVLKKTNDQQEEEVVKMPPVVAQEEEKEVIKKPPVAGEEEEKEEATEPLVAGEEEHKVVKKEQSEQEDAKMAPVAANLVEVN

SEQ ID NO: 38819 - protein, 243 aa, Prochlorococcus marinus subsp. marinus str. CCMP1375
MNNWRKIDQIWCAWPSKPKALIEMVGGSYIAATPHLSYSKLLGRLLKENFAIHAWSYVPGFDHQAQANQAWKALRKCRIKLESRIGCNNLEPIRIGHSLGCKLHLLAPDGGRKSHSFIGLCFNNYKADKSIPMLGKIKQKLKIQSEFSPSPKETMNLITKNYMQKRNLLIKFNSDNIDQSELLLEHLKARGDDESQLIKCNGNHLTPMNTGIKSILLNQINANSHENNNLEQLIALISKYASQ

SEQ ID NO: 38820 - protein, 393 aa, Triticum aestivum
MARVEALSMSGATAIPAEYVRPQEERQGLGDAYAEAAACWSAAGSPRIPIVDVAAFDAADPASPASLAVVDAVRAAAEDWGVMHLAGHGIPEDLIDALRGAGTGFFRMPIEDKEAYANDPAAGRLEGYGSRLAGSAGEDGKREWEDYLLHMLHPDARADHALWPAHPPEYVPVTKSFGEHVSALSSRLLAILSLGLGVQAGTLERRLRLTSGEAQVEDDLLLKLKINYYPRCPQPELAVGVEAHTDVSALSFILTNGVPGLQVLRPGDGQTWVTARDEPGTLVVHVGDALEILSNGRYTSVLHRVLVNRQAVRVSWVVFAQPPPDSVLLRPMPELVQGDGAETPRFEPRTFRQQLERKVLKKTNDQQEDEVKKQPVAAGRRRGGAHGREEGAE

SEQ ID NO: 38821 - protein, 243 aa, Hordeum vulgare subsp. vulgare
MRVAATRPVSSAPVALLAALALLFLVGSASLAIGTMASHVLGGKSENPAAANSLETDGLARFAVDEHNKRENALLEFVRVVEAKEQTVAGTLHHLTLEALEAGRKKVYEAKVWVKPWLDSKELQEFRHTGDATSFTISDLGAKRGGHEPGWRDVPVHDPVVKDAASHAVKSIQERSNSLFPYELIEIVRAKAEVVEDFAKFDIVMKLKRGTKEEKMKAEVHKNLEGAFVLNQMQPEHDESSSQ

SEQ ID NO: 38822 - protein, 544 aa, Janthinobacterium lividum
MTADFNTGLGKNSANYAALTPLDYIARAAAVYGNRLAIAHGAVRQTWQETYARTRRLASSLIKLGVGTGDTVAVMLPNTPAMVEASFGVPMAGAVLNALNIRLDLASLTFMLRHGQAKVLLADTEFAELARQMAAQIPGLRVIQVNDVLGPEVEPFAELDYETLLASGDPGYDWQPPADEWDAIALNYTSGTTGDPKGVVYHHRGAALNALSNILEWDMPKHAVYLWTLPMFHCNGWCFPWTVAARAGVNVCLRKFEPKLVFDLMRELRITHYCAAPIVHAALANAPANWRDGIDWTVRGMVAGAPPPAAMVAKIEAMGFDLIHSYGLTEVYGPAAICAEQDEWAALSQEERAVLKSRQGVRYHLQSAVAVLDPETMQPVAADGEQIGEIMFRGNICMKGYLKNERATQEAFAGGWFHTGDLGVMYPDGYIKLKDRSKDIIISGGENISSVEVEDALYHHPQVLAAAVIAQPDEKWGETPCAFVELREGGTVTEAELIAFCKNNLAGFKVPKAIYFGPLPRTSTGKIQKFELRKRMQSDKAIDV

SEQ ID NO: 38823 - protein, 135 aa, Methanococcoides burtonii DSM 6242
MVLKNIVRAVKNIYKPPITRRYPEVPTELSDRFRGLQKLDKSKCIGCGICANTCPNSAIKIVRARVNKDSDKTRWFPAIDISHCMFCGLCIDQCPQDALSSTKVYTTGVIRLTHEELLYTPDMLAREIPVGENGE

SEQ ID NO: 38824 - protein, 396 aa, Cytophaga hutchinsonii ATCC 33406
MTEQLLCSFLKKSMQQSYTSKLPDIGVNIFSTMSALAQQYKAVNLAQGFPDFAPSEELIRLVHDYMLKGFNQYAPLAGVRPLVVNLAEKTEKLYGLSYDPDTEITITCGATEACYTALTSILHEDDEVIIPEPCFDVYLPAIQLSKAKAVFVPLTLPDFSYDWELIRSKVTPRTKLIIINSPHNPTGSILTAKDVEQLQLLVEAYPGLYVLSDEVYEHIVFDGNKHISISGNPVLKERAFIIGSFGKTYHVTGWRLGFCLAPAYMMKEFKKVHQYNTFSPVAPMQFAVADFMKKTDEYESLPAFFQNKRDLFLRHIKESKFDVIPASGTYFQMLSYKNISDENDLDFAARLTREFGLASIPVSVFYNDKTDHKLLRFCIAKKEETLLKAAHILCKI

SEQ ID NO: 38825 - protein, 289 aa, Rickettsiella grylli
MKTPISDDKIKFKKNRQSWFSRFNVFKQAPKNRKQLIELLHYAKQRNLLNSQALKMLEGVLQISDSQVRDIMIPHAKITAISAKAPLSEILPLVIESAHSRFPVINDERQVIGLLMAKDLLKYNPLSQNDFNIHTILRPVVFIPESKRLDSLLKEFQRKHYHMAIVVDEYGAASGLVTIEDVLEEIVGEIEDEHDTDEEIFIQEQTPHQFIVKAIMPIEAFNAFFNSHLETDQFDTIGGVIANRFGYLPKRGASTTIYPFHFKVLRADNRVIRLLQVTIEPVNKPLKTQ

SEQ ID NO: 38826 - protein, 447 aa, Colwellia psychrerythraea 34H
MSAFDIQQSASMSREELEAYWMPYTANRQFKEKPRMIVGAKGAYYTDADGRKIFDGLSGLWTCGAGHNRPEIAEAVYKQLGQLDYAPAFQYGHKGAFELANRIKELTPDGLDHVFFTGSGSESADTSLKMARAYWRKKGKGTKIKLIGRSKGYHGVNFGGFSVGGIGANRTLYGPAVDCDHLPHTMLPENKFIRGMPETGAEKAEELLELIALHDASNIAAVIVEPLAGSAGVLPPPKGYLKRLREICDQHEILLIFDEVITAFGRMGSNTGAEEFGVVPDILNVAKQLTNGAVPMGAVIVNDDIYQTFMDNGGPEYMMELPHGYTYSGHPVACAAALASLDILKNDQLITRVREMSPVFEHALHSLKGTQYISDIRNYGLAGALTIESAPGEPALRPYQIAQKCWEKGFYVRYGGDTIQLGMPFIVEHQEIDDVINAVGESINELS

SEQ ID NO: 38827 - protein, 481 aa, Rickettsiella grylli
MKLKNPSLFQQQCYINGKWITTPKNITVNNPATLEIIGTVPDLESTHLQHAVTAAEAALPRWMSKTAKERSELLHQWYTLILENSDDLALLLTIEQGKPFSEAQEEIRYGASFIQWFAEEAKRIYGDIIPAGLPQQHLFVNKQAIGVVAAITPWNFPNAMITRKCAPALAAGCTLVLKPSTLTPFSALALGVLAEKAGIPPGVLNIVTGDSELIGNHFTDNPVIRKLSFTGSTAIGRLLMQKAAHSIKKISLELGGNAPFIVFEDADSDQAIQGAVASKFRNSGQTCICTNRFYIHEKMYESFTKKLTHAIQQLNVGNGQEPQVQIGPLINSAAIKKVEKHIADALDKGAELMCGGKKHALGGNFFQPTLLKNCSKDMLIAQEETFGPVAALFRFSKEKEVIEWANDTLYGLAAYFYTKNVDRIIRVTQALDYGIVGVNTGRTSNEVAPFGGFKQSGMGREGSKYGIEDYLEIKYICLNTD

SEQ ID NO: 38828 - protein, 282 aa, Synechocystis sp. PCC 6803
MSKQPSFDGWQSIVGGLIAALLVLLSFNSFVVINPGQAGVLSVLGKAQDGALLEGIHFKPPLVSSVDIYDVTVQKFEVPAQSSTKDLQDLSASFAINFRLDPTEVVTIRRTQGTLQNIVAKIIAPQTQESFKIAAARRTVEEAITKRSELKEDFDNALNSRLEKYGIIVLDTSVVDLAFSPEFAKAVEEKQIAEQRAQRAVYVAQEAEQQAQADINRAKGKAEAQRLLAETLKAQGGELVLQKEAIEAWREGGAPMPKVLVMGGEGKGSAVPFMFNLTDLAN

SEQ ID NO: 38829 - protein, 327 aa, Colwellia psychrerythraea 34H
MGNKDSIKAIQALAQSDMAAVNDLIYDQLQSDVALINQLGIYIVNGGGKRMRPMLTVLAARAFAYQGDKHLEIAAIIEFIHTATLLHDDVVDESNMRRGRETANALFGNSASVLVGDFLYTRSFQMMTKLGDMRIMDILSEATNIVAEGEVLQLMNCNDASTTEESYMQVIYCKTAKLFEAATRLAAVIAKQDAKIEQAMADYGKYLGTAFQLVDDIMDYTADAKEMGKNVGDDLAEGKPTLPLLYAMKHGNEAQQKLIKEAIELGNGMDNLELILQAMEETGSLRYTQKQAEIEADKAIKALNVIADSEHKQALISLAHIAANRSH

SEQ ID NO: 38830 - protein, 458 aa, Oryza sativa (japonica cultivar-group)
METAKVAQKAWARTPLWKRAELLHKAAAILKEHKTPIAECLVKEIAKPAKDAISEVSGNFSLYLVVRSGDLVSYTAEEGVRILGEGKLLVSDSFPGNERNKYCLSSKVPLGVVLAIPPFNYPVNLAVSKIGPALIAGNALVLKPPTQGAVAALHMVHCFHLAGFPKGLINCVTGKGSEIGDFLTMHPGVNCISFTGGDTGIAISKKAGMVPLQMELGGKDACVVLEDADLDLVAANIVKGGFSYSGQRCTAVKVVLIMESVADIVVEKVKAKLAKLTVGPPEADSDITPVVTESSANFIEGLVMDAKEKGATFCQEYRREGNLIWPLLLDHVRPDMRIAWEEPFGPVLPVIRINSVEEGIHHCNASNFGLQGCVFTKDINKAIMISDAMETGTVQINSAPARGPDHFPFQLFVISMGFGLQGLKDSGIGSQGITNSINMMTKVKSTVINLPSPSYTMG

SEQ ID NO: 38831 - protein, 152 aa, Brassica napus
  misc_feature (100)..(100): Xaa can be any naturally occurring amino acid
  misc_feature (105)..(105): Xaa can be any naturally occurring amino acid
  misc_feature (117)..(117): Xaa can be any naturally occurring amino acid
  misc_feature (124)..(124): Xaa can be any naturally occurring amino acid
MAGKLMTLQVFHLLSISLVIFFVFSVNVVSEEDYQRAVPPEDKTTTVWFSRIKQSGNDYWAKLKESLGRGHARFFPPNIDFRGKDDASMGAGGKMKEAVXRSFEXSKDSVEEAARSXAEVACDXAEAVKEKVKRSFSGSETTQQQSYGTEEL

SEQ ID NO: 38832 - protein, 247 aa, Zea mays
MSSAVEAISCPKVDVPAGPEPGEPAKEAAPPAEHCDTAPNGKCAPRCHGEEEEEEEDEEDEEKAPKAIDLGPMVSIKEQLEKDKDDESLRRWKEQLLGGVDLNSVGETLEPDVKIMSLSILSPGRPDIVLPLPVEPNGKGVWFTLKEGSPYRLKFTFSVSNNIVSGLRYTNTVWKTGLKVDRAKEMLGTFSPQLEPYTYVTPEDTTPSGMFARGSYSARTKFLDDDRKCYLEINYTFDIRREWPSTS

SEQ ID NO: 38833 - protein, 410 aa, Triticum aestivum
MARVEALSMSGATAIPAEYVRPQEERHGLGDAYDEAAASWSAPGAPQIPVVDVAAFDAADPASPASLAVVDAVRAAAEDWGVMHVAGHGIPEDLIDALRSAGTRFFRMPIEDKEAYANDPAAGRLEGYGSRLAGSAGEDGKREWEDYLFHMLHPDARADHARWPAHPPEYVPVTKAFGEHVSALSSRLLAILSLGLGVPADTLERRLRLTSGEAQVEDDLLLKLKINYYPRCPQPELAVGVEAHTDVSALSVILTNGVPSLQVLHPGHDNWVTARDEPGTLVVHVGDSLEILSNGRYTSVLHRGLVNRQAVRVSWVVFAQPPPDSVLLGPLPELVQGYGASSRAPSGSSSSARSSRRRMINRTTRLRSRRSPPVVGEEEHKVVKKEQSEPEEEAKIGEAPVTANLVVEVN

SEQ ID NO: 38834 - protein, 529 aa, Thermoplasma acidophilum DSM 1728
MIVLGLEGTAHTISCGIIDESRILAMESSMYRPKTGGIRPLDAAVHHSEVIDTVISRALEKAKISIHDIDLIGFSMGPGLAPSLRVTATAARTISVLTGKPIIGVNHPLGHIEIGRRVTGAIDPVMLYVSGGNTQVIAHVNGRYRVLGETLDIGIGNMIDKFAREAGIPFPGGPEIEKLAMKGTKLLDLPYSVKGMDTAFSGILTAALQYLKTGQAIEDISYSIQETAFAMLVEVLERALYVSGKDEILMAGGVALNRRLRDMVTNMAREAGIRSYLTDREYCMDNGIMIAQAALLMYKSGVRMSVEETAVNPRFRIDEVDAPWITDASRKDYGKAGAESRIEEVSFHGRPAIRKVRISKSYRNSDLDKKIRYERMRNEFTILRKLKEAGVNSPVVYDFDPFSMSITMQKIPGRMMSAELNEGRTDFLNELGIMIAKMHRAGIAHGDLTVNNIIVNDSVFIIDPSMGKVNAEIEDMAVDIYALEDSIKGLGLDSGSVIGQMLKSYRNNFNLADDVLETVSAIRRRHRYV

SEQ ID NO: 38835 - protein, 438 aa, Triticum aestivum
MARVEALSMSGATAIPAEYVRPQEERQGLGDAYDEAAASWSAAGSPRIPVVDVAAFDAADPGSPSSLAVVDAVRAAAEEWGVMHVAGHGIPEELIDSLRGAGTGFFRMPIADKEAYANDPAAGRLEGYGSRLAGSAGEDGKREWEDYLFHMLHPDARADHALWPAHPPEYVPVTKTFGEHVSALSSRLLAILSLGLGVPADTLERRLRLTSGETQVEDDLLLKLKINYYPRCPQPELAVGVEAHTDVSALSFILTNGVPGLQVLLPGDGQTWVTARDEPGTLVVHVGDALEILSNGRYTSVLHRGLVNRQAVRVSWVVFAEPPPDSVLLRPLPELLADGAEKPRFEPRTFRQHLERKVLKKTNDQEEEEVVKKPPVVAQEEEKEVVKKPPVAGEEEEKGEATEPLVAGEEEHKVVKKEQSEQEEAKMAPVAANLVEVN

SEQ ID NO: 38836 - protein, 374 aa, Methanococcoides burtonii DSM 6242
MDETVGPSEMIVHLGPQHPMQPGPFRLNLKLKGETVVDGDIELGFIHKGIEKILENKTYLQGIPIVDRICYLTAMTNEEAYVGAVEKLADIEVPEKSQYIRVIVEELSRLQSHLLGMGEFGEFIGFVSMFMYTIKEREDILSLMDMVTGARITHTFLRFGGVRDDLPEGFKEKSVAVFASLREQIADYDKLFNHDEIYKLRCFGVGVLDSKTARDLGVSGPALRATGVPFDIRKDEPYLVYKDLDFKVCTATDGDIAARINVRLEEMLEAMYIIEQCLDQMPSGPIFFEDSLYGVRTPVMRVPEGDIFHRVEDPRGEMGFYVVSDGSDKPHRVKIRGPVYPTMQALPPLIKGTTIADVAAIAGSMDGCTSEADR

SEQ ID NO: 38837 - protein, 587 aa, Cucumis melo
MDRRRSLRPPRPNAVQDADATCTFRRDEQDASAADHLKRASPKASDALPLPLYLTNTIFFTLFFSVAYYLLHRWRDKIRNSTPLHVVTLSEIAAIVSLMASFIYLLGFFGIDFVQSFIARSSPDAWDLEDEIDRTLLIDNNRYAAPRSASAVALPSKVVDAEALNTIPLPEEDEEVVKMVVDGSVPSYSLESKLGDPKRAASIRREALQRTTGRSIHGLPFEGFDYESILGQCCEMPVGYVQIPVGIAGPLLLDGFEYTVPMATTEGCLVASTNRGCKAIYASGGATSMLLKDGMTRAPVVRFGSAKRASELKFFLEDPSNFDTLAVVFNRSSRFARLQSIRCSIAGKNLYVRFCCSTGDAMGMNMVSKGVQNVLEFLQHDFSDMEVIGISGNFCADKKPAAVNWIEGRGKSVVCEAVIKDEVVRKVLKTSVASLVELNMLKNLTGSAMAGALGGFNAHSSNIVSAIFLATGQDPAQNVESSHCITMMEPVNNGRDLHISVTMPSIEVGTVGGGTQLASQSACLNLLGVKGASKESPGANSRLLATIVAGSVLAGELSLMSAIAAGQLVRSHMKYNRSSRDVSKLES

SEQ ID NO: 38838 - protein, 522 aa, Zea mays
NSGGKCDFDLAATFFCSVVYLVVGGDMQFALALDTNSGPHQIRSCEGDGIDRLEKLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYTQLHDFGSEILPRAVLDHSVQACIFTGYWEDVGTIKSFFDANLALTEQPSKFDFYDPKTPFFTAPRCLPPTQLDKCKMKYAFISDGCLLRECNIEHSVIGVCSRVSSGCELKDSVMMGADIYETEEEASKLLLAGKVPIGIGRNTKIRNCIIDMNARIGKNVVITNSKGIQEADHPEEGVI

SEQ ID NO: 38839 - protein, 366 aa, Janthinobacterium lividum
MTTSTPNLVVTPSAHPLSDAERAARMVNPAFGRIFTDHMVVIPYRDGKWQQGELKAYGPLMLDPSASSLHYGQAIFEGYKAFAQPDGSIKTFRPEQNAERFNRSAARLAMPAIPVELFLEAGDALIAQDRNWVPKNTGESLYMRPLMIATDPYLGVRPSEEYLFVLFASPAGAYFPKGVKPVTVWISEDFVRAAPGGTGEAKCAGNYAASLMAQSQAQEKGCDQVVWLDAVHREFIEEMGGMNLFFVYKDGEKVTVVTPELTGTLLPGITRRSLLEMAKDLGYATEERKLSVQQWRDDIASGRMTEVFACGTAAVITPVGVAKANGFEMTINNNENGAVTLALREALLGLQHGTAPDTHGWMHTVC

SEQ ID NO: 38840 - protein, 541 aa, Cytophaga hutchinsonii ATCC 33406
MQMTIKPEKINETLLHYAPGSAERSAVQQKITELKAAEVIIPMIINGKEVFTDQHVRIAPPHEHAYTLGYFCEGKGVHVSNAISAALHAKHSWAVKSLKERAAVFLKAADLISTTYRAEINAATMLGQSKNVYQAEIDSACELIDFFRLNVAFAYEIETIQPCSHEGIINRMIYRPLEGFIFALTPFNFTAIAGNLPAAPALMGNTVVWKPAYTQIYSARIIMKVLIEAGLPNGVINLIYTDGPVTGDIIFQHRQFAGLHFTGSTAVFKQISTTIHNNIDLYQNFPRIVGETGGKDFVLAHASCDVQALSVALVRGAFEYQGQKCSAASRAYIPASIWPSVREHIVHMLDEIKMGTVEDFSNFINAVIDEKAFDKIVRYIDAAKKDPEASIIAGGKYDKSIGYFIEPTIIEASNPQYVTMREEIFGPVLTVYVYKDSEWNQVLGIVDTTTPYALTGSIFAADSAIIEEAKKALYYSAGNLYINDKPTGAVVNQQPFGGARLSGTNDKAGSVLNLLRWVSPLVVKENLSPPHDYTYDFMKLQ

SEQ ID NO: 38841 - protein, 339 aa, Brassica napus
  misc_feature (208)..(208): Xaa can be any naturally occurring amino acid
MADKKIRIGINGFGRIGRLVARVILQRNDVELVAVNDPFITTEYMTYMFKYDSVHGQWKHNELKLKDEKTLLFGEKPVTVFGIRNPEDIPWGEAGADFVVESTGVFTDKDKAAAHLKGGAKKVVISAPSKDAPMFVVGVNEHEYKSDLDIVSNASCTTNCLAPLAKVINDRFGIVEGLMTTVHSITATQKTVDGPSMKDWRGGRAASXFNIIPSSTGAAKAVGKVLPQLNGKLTGMSFRVPTVDVSVVDLTVRLEKAATYDDIKKAIKEESEGKLKGILGYTEDDVVSTDFVGDNRSSIFDAKAGIALSDNFVKLVSWYDNEWGYSTRVVDLIIHMSKA

SEQ ID NO: 38842 - protein, 319 aa, Oryza sativa (japonica cultivar-group)
MASFSTVFLLLSLVCLASPCAAQRVICEAPPCTTASQVKTTPTNRASHVRLPEGVTGAESLAFDSSNRGPFTGVSDGRVLKWGGDSAGWTTFAYNRNYRSNPTCASSSEETESTCGRPLGLAFHLKTGILYFADAYKGLMRVGPRGGQADVLATEADGVPFNYLNGVDVDQDTGDVYFTDSSTTITRRYQENIMRNRDATARLMKYDAKTKQVTVLKDRLPYANGVAVSHDGRYLVVAHTGPAQVFRYWLKGAKAGQYELFADLPGYPDNVRRDAKGGYWVGSTGRSYVQRAGGGFSGQAPGRRPAQRRRRRGGGADGC

SEQ ID NO: 38843 - protein, 131 aa, Triticum aestivum
  misc_feature (61)..(61): Xaa can be any naturally occurring amino acid
MAPAVMASSATTVAPFQGLKSTTGLPISRPSGSAGLSNVSNGGRIRCMQVWPIEGIKKFEXTLSYLPPLSKEALLKQVDYLIRSKWVPALSSAKVWASVFRGATTSPRVLTNGRITNVGNFPKVRGTGRQP

SEQ ID NO: 38844 - protein, 628 aa, Ostreococcus tauri
MRLRYAIQQHKHITICPLERTFDCYYMLTEESENALTQDDAAIAACLSHDESEQAQVDAQIASDEALARNLSDASRLDGWWDDDSWDKEIARAVHERDGEQDGSQFVPKLNAHVVDPESGSFPPPKSAVNFDHGRLLLRLDFYGLREKIVEGDGNCQFRALSDQLFRDGGENHAAVRAAVVERLAEQAEVYSPYCSPMTMDEYVQRMSQQGEWGDHLTLQACADAYGVDINVLTSYMESGFIEITPSGGESASSPRSLWLSFFAEVHYNSILPGTPSHQDRFANSRRHPAHDDGRIDALHHVPETPNHQDSIATRQTSAQTRRSCARRLAPTRTVGSPRSSSATTPTDTAHRTLPLRPPLPGASPCRARRSVTSDLSLAQSRKRRSRDVLLSTRRRASTHFALDAHAPRPARVLSHRSRRDAIEPQTFRGDANATSASSRDEARDQRGMRARARGIQGLYLGSLLSILGGAAYIVVRQVLIRRELDDQAKKMGERIRAGNASAEDYFEMGSILLRKKVFTQAVRNLQAAAANWDGDEQDLALVHNALGFGYSNTDKIDDAIAEFKKSVALQPGYVTAWNNLGEAYEKKKELKEAIKCYEESLVLSPKNPTATERLEEIQTRLRRRLEL

SEQ ID NO: 38845 - protein, 977 aa, Oryza sativa (japonica cultivar-group)
MAAPPKAWKAEYAKSGRSSCKSCRSPIGKDQLRLGKMVQATQFDGLMPMWNHASCILSKKNQIKSVDDVEGIDTLRWDDQEKIRNYVGSAPATASSAAAISDKCTIEVAKSARTSCRRCGEKIKKGTVRVSSKLEGQGWYHASCFLEMSPAATVENFSGWEILSHEDKRAVLDLVKKDAPSSGQTSSKGSKRKNNQNDIHDCKAPKIIRSISEGTAEDKGKAVVSHDSNANSSDLQEKLKEQSDTLWKLKDELKKHVSTAELRNMLEANGQDTSGPERHLLDRCADGMLFGALGTCPVCSSFLYYHGGQYHCSGYVSEWSKCTYSTTEPVRSKKKWKIPDEMDNGYLTKWFKSQKAKKPERVLPPMSPEKSLCQSTQQNRSFLSEGLDKLRVSIVGQSKDVVDGWKQKLKDAGANFNATVTKDSSCLVLCSELESENAEVKKARRLKIPILREGYLGECIRKNRVLPFDLYKVEAALESSKGGTMTVKVKGRSAVHESSGLQDTGHILEDGKSIYNTTLNMSDLTRGVNSYYILQVIEEDNGSDCYVFRKWGRVGNEKIGGTKLEEMSKIHAIQEFRRLFLEKTGNPWEAWEQKTNFQKQPGKFYPLDIDYGVRQGPKRKDIDKMKSSLPPQLLELMNMLFNIETYRAAMLEFKINMSEMPLGKLSKENIQKGFEALTEIQNLLGNTNNQELAVRESLIVAASNRFFTLIPSIHPHIIQDEDDLMVKVKMLEALQDIEIASKLVGFDSDNDESLDDKYKKLRCAITPLPHDCEDYKLVEKYLLNTHAPTHKEWSLELEEVFSLDRDGEFSKYSRYKNNLHNKMLLWHGSRLTNYVGILSQGLRIAPPEAPVTGYMFGKGLYFADLVSKSAQYCYVDRKNPVGLMLLSEVALGDMYELKKATSMDKPPRGKHSTKGLGKTVPLESEFAKWRDDVVVPCGKPVPASIKTSELMYNEYIVYNTSQVKMQYLLKVRFHHKR

SEQ ID NO: 38846 - protein, 331 aa, Bacillus halodurans C-125
MTYELSTDREFDLIAIGRACIDLNAVEYNRPMEETMTFSKYVGGSPANIVIGSSKLGLKAGFIGKIADDQHGRFIESYMRGVGVDTSNLVVDQEGHKTGLAFTEIKSPEECSILMYRQDVADLYLSPEEVNEAYIRRSKLLLVSGTALSKSPSREAVLKAIRLAKRNDVKVVFELDYRPYSWETPEETAVYYSLVAEQSDIVIGTREEFDVLENRTEKGDNDETIRYLFKHSPELIVIKHGVEGSFAYTKAGEAYRGYAYKTKVLKTFGAGDSYASAFLYALISGKGIETALKYGSASASIVVSKHSSSDAMPSVEEIEALIEKDETITIA

SEQ ID NO: 38847 - protein, 553 aa, Vanilla planifolia
MAAAVAIEEQKKDIIFRSKLPDIYIPKNLPLHSYCFENISKFSSRPCLINGATDEIFTYADVELISRRVGSGLSKLGIKQGDTIMILLPNSPEFVFAFLGASFIGSISTMANPFFTSTEVIKQAKASNAKLIITQGCYVDKVKDYACENGVKIISIDTTTTADDAANILHFSELTGADENEMPKVEISPDGVVALPYSSGTTGLPKGVMLTHKGLVTSVAQQVDGENPNLYMHSDDVLLCVLPLFHIYSLNSVLLCGLRAGSGILIMQKFEIVPFLELIQKYKVTIGPFVPPIVLAIAKSTVVDNYDLSSVRTVMSGAAPLGKELEDAVRAKFPNAKLGQGYGMTEAGPVLAMCLAFAKEPFDIKSGACGTVVRNAEMKIVDPETGSSLPRNHPGEICIRGDQIMKGYLNDPEATARTIDKEGWLHTGDIGYIDDDDELFIVDRLKELIKYKGFQVAPAELEALLLTHPCISDAAVVPMKDEAAGEVPVAFVVKSNGHNITEDEIKQFISKQVIFYKRINRVFFVEAIPKAPSGKILRKDLRARLAAAALPTN

SEQ ID NO: 38848 - protein, 225 aa, Brassica napus
VSTNARLTNPPPHLLSTPPTSVTNLRLPSARSKSNLFSAEFSSLQIRTVPVPVAFSDQLRRQSMKPSSVYVASDSMETEMGSQKLAKNPSLICAPVMGDSVDEMVTETCKAQELGADLVEIRLDSLKQFNPLEDLKIIIQKSPLPTLFTYRPKWEGGQYEGDEKERLDALRLAMELGADYIDVELEVAEEFIKSIKEKKPENFRVIVSSHNYQSTPSVEDLNDLA

SEQ ID NO: 38849 - protein, 175 aa, Triticum aestivum
MAPTVMASSATSVAPFQGLKSTAGLPVSRRSNGASLGSVSNGGRIRCMQVWPIEGIKKVETLSYLPPLSTEALLKQVDYLIRSKWVPCLEFSKVGFIFREHNASPGYYDGRYWTMWNLPMFGCTDATQVINEVEEVKKEYPDAYVRIIGFDNMRQVQCVRFIAFKPPGCEESGKA

SEQ ID NO: 38850 - protein, 415 aa, Oryza sativa (indica cultivar-group)
MAVDDAEDDQLASMSTEDIVRASRLLDNEIRDELQRTNLELESFKEKIKENQEKIKLNKQLPYLVGNIVEILEMNPEDEAEEDGANIDLDSQRKGKCVVLKTSTRQTIFLPVVGLVDPDKLKPGDLVGVNKDSYLILDTLPSEYDSRVKAMEVDEKPTEDYNDIGGLEKQIQELVEAIVLPMTHKDRFQKLGIRPPKGVLLYGPPGTGKTLMARACAAQTNATFLKLAGPQLVQMFIGDGAKLVRDAFQLAKEKAPCIIFIDEIDAIGTKRFDSEVSGDREVQRTMLELLNQLDGFSSDERIKVIAATNRADILDPALMRSGRLDRKIEFPHPSEEARARILQIHSRKMNVNPDVNFEELARSTDDFNGAQLKAVCVEAGMLALRRDATEVTHEDFNEGIIQVQAKKKSSLNYYA

SEQ ID NO: 38851 - protein, 89 aa, Oryza sativa
  misc_feature (46)..(46): Xaa can be any naturally occurring amino acid
SQHFTNQSKRLTREATIRKKMVAAAGESGKWWAPLLGWSGKADYIXRRPFVGGLTEEKARELRARMVETESFHDAMYHSAIASRLARSA

SEQ ID NO: 38852 - protein, 139 aa, Ostreococcus tauri
MSAAPHDEVLAAQEAHLKGLADSEERTIFDKIVSKEIPATVIYEDSLALAFRDINPQAKTHFLVIPKIRAGLTRLSKSTEDHKALLGHLMYTAALVAKQEKLDAGYRVVVNDGVEGCQSVYHLHLHVLGGQQLSWPPGC

SEQ ID NO: 38853 - protein, 94 aa, Arachis hypogaea
CATWDAGKPLAWRQKYGWTAFCGPVGPTGQAACGKCLKVTNTRTNAQQTVRIVDQCSNGGLDLDIGVFQKLDTDGNGNAQGHLTVNYNFVDCGD

SEQ ID NO: 38854 - protein, 946 aa, Debaryomyces hansenii CBS767
MVAQLIDGKAIALQVRTKIHAEIDQIQSQHKDFKPTLTIIQVGSRADSSTYVRMKLKAAEEASVECNIINLPETITQFELINQIQKLNESQSVDGILVQLPIPDHLDEAVVTSAVLADKDVDGFGPFNAGELSKKGGNPHYLPCTPKGIMELLAQSQVQIAGANAVVLGRSDIVGKPIANLLTRANATVTTLHSQTPQNQVEAFLSHADIVVAAIGKAGFVRGEWLKEGAVVIDVGTNFISDASKKSGSRMVGDCDFESCSAKASKLTPVPGGVGPMTVATLLDNVIIAAKKHYAKNNETPKFTNPLKLNLQTPVPSDYEISRAQQPKKIDEVAYEAGILDNELELFGSYKAKVSLDILKRLENKKNGKYVLVTGITPTPLGEGKSTTTVGLAQALGAHLNKNVFANVRQPSMGPTFGIKGGAAGGGYSQVIPMDEFNMHVTGDIHAISMANNLLAAAIDTRMFHENTQKDGPLYKRLVPAKKGSRKFPTCMLKRLEKLGINKTDPNELTEEEVAQFVRLDIDPDTITWRRVVDCNDRFLRGVTIGEAPTERGMTRQTGFDISVASECMAILALANSLQDLRERLGNMVIASSKAGVPITCEDIGCAGALTALLKDAIKPNIMQTLEGTPVFVHAGPFANISIGASSILADKMALKLAGTSPSLSPEERKEQEGYVVTEAGFDFTMGGERFINIKCRSSGLVPDCIVIVATVRALKVHGGGPEVKAGAALAPEYTQENVELLRTGCSNLAKHISNAKAYGLPVVVAINKMSSDTDSEHEVIKEESLKAGAVDAIVSNHWEEGGKGAVELGQGIIEACNSQDKHFKFLYESEKSVEDKISAIAKEMYGAGEVEFLPEAQKKIETYTKQGFGNLPICIAKTQYSLSHDAALKGVPTGFKFPIRDVRASIGAGYLYALAAEIQTIPGLPTHCGFMNVEVNDDGEIEGLF

SEQ ID NO: 38855 - protein, 304 aa, Ostreococcus tauri
MRACLIVMCGKPSSGKTKTVRELAERLEREVETEVVVADEAGVNARTRDEAYENATTEKMIRGALRSEVDRVLHTSGPCVILDSMNAIKGFRYELWCAARAVAARYCVVYVESSDERCTELNRARRDDDMKDSYSEEILRDLCYRFEHPIAGNRWDSPLFTFRPATDTGVHREDLFDAICAHVRGDATRTTPSARALVPNKATQNAPLSDTNWRYEMDRATQDIIDAILSAQELNGGCCCSSYTFGEGVPTLRSPRVLTLAELRRRKRDFLQLASKSLKTTRQSVQRLFVDELQRRVDDPASFR

SEQ ID NO: 38856 - protein, 396 aa, Methanococcoides burtonii DSM 6242
MSTTRDYYEILGVSKDASDTELKKAYRKLAMKFHPDKNKEADAEEKFKEISEAYAVLSDAEKKAQYDRFGHAGIDGRYSTEDIFRNADFGDFGDLGDIFGSIFGGGGGFGGFGGGGRRRQGPTRGSDLRYDLGVTLEQAAFGEKVHINVPRAENCETCGGTGAKEGTSPKTCATCRGSGQVTHARRTPLGNFMTTTTCDACHGKGQVIESPCPVCRGSGKQKKVRKMGVSIPKGADTGLRLKMSGEGEAGSPGAPSGDLYIVIHVKQHDEFERIGDDIVYGIPISFSQAALGAEIKVPTLHGKVKMKIKPGTQTHSILRLKGKGMPRLHGHGQGDQLVKVIVETPTDLTGKQKELLDEFDRLSTGNSKGSKGKGFFDKVKDTFESAISTISPGTVE

SEQ ID NO: 38857 - protein, 771 aa, Zea mays
SKKLPHQTPTCRDMAAAAPAAGKGKRKRHLSEDDVCLLQRYNPGTILTALQEVAQHAEGRIIDWRAVVAKSATGITSAREYQMLWRYLAYHHDLNESIEAGDLPLGDDSDLELELEPNPSETKEALSEASALAKALISRSSREQASGHRINLDVPALNTQNEKIVRVPSKQLAQSHRVTNVTCPVSNPKQLSHIVPSPTHLDPNGASKKRKKAKAWSKEEDADLAAGVQKYGEGNWEVILHKCNFDNTRTPDQLSQRWALKRPGGSTKPASTKHASVGSEERSATIKALHLAVGPMPVSSALRSGREQSIQHKSTAFAPKMPQVRSAVTPSLAPALALPVQPLRVAAEVQSPLRHGQQAPGQGAPPKLSNASNNTRKKQAALPNSTFSPSSIQAAAIAAGGRLATASTAANLLKAAQSKNAVHIRSLGATSLKSSASFDHGTQSGGSQHLESLNASAVNGVSGVSAVNQSGPPAGAETKKALGTTLAPVPCDSEENEDGSEFCAITLDDLFPEDAKQPETVDTKAKQPETTGPKAKQPENADPKAMHQETMDPKSKQPDTLKVGILDPKDKDMLEFDQYVASQGAHLNTDDLNKSKFTNSASQAQGLVGSQKNPLKLTPVDGKANPVTAAGRGKPVAAGVASTGKKATIPISHLAAGTPRGIVDTVNANAPIRRTLTRRAAALVPAGCQAPPPKHAIDAKGCQMTNSIATFVSSGVPASSQASTPAKDANKASPPSSSCQPKPDSVAVNGAIRAVKSVAKKGNLPAAAARQ

SEQ ID NO: 38858 - protein, 231 aa, Arabidopsis thaliana
MVGATVVSKWTPLCVASPPERNSASLNPHCSPARVNFRTALAAFRPQFRLFSRNSASRRRLRASSSAESGIFLPHLVASMEDVEETYIMVKPDGIQRGLVGEIISRFEKKGFKLIGLKMFQCPKELAEEHYKDLSAKSFFPNLIEYITSGPVVCMAWEGVGVVASARKLIGKTDPLQAEPGTIRGDLAVQTGRNIVHGSDSPENGKREIGLWFKEGELCKWDSALATWLRE

SEQ ID NO: 38859 - protein, 547 aa, Nicotiana tabacum
MPMETTTETKQSGDLIFRSKLPDIYIPKHLPLHSYCFENISEFSSRPCLINGANDQIYTYAEVELTCRKVAVGLNKLGIQQKDTIMILLPNSPEFVFAFMGASYLGAISTMANPLFTPAEVVKQAKASSAKIIITQSCFVGKVKDYASENDVKVICIDSAPEGCLHFSELTQSDEHEIPEVKIQPDDVVALPYSSGTTGLPKGVMLTHKGLVTSVAQQVDGENANLYMHSEDVLMCVLPLFHIYSLNSILLCGLRVGAAILIMQKFDIAPFLELIQKYKVSIGPFVPPIVLAIAKSPIVDSYDLSSVRTVMSGAAPLGKELEDAVRTKFPNAKLGQGYGMTEAGPVLAMCLAFAKEPFDIKSGACGTVVRNAEMKIVDPDTGCSLPRNQPGEICIRGDQIMKGYLNDPEATTRTIDKEGWLHTGDIGFIDEDDELFIVDRLKELIKYKGFQVAPAEIEALLLNHPNISDAAVVPMKDEQAGEVPVAFVVRSNGSAITEDEVKDFISKQVIFYKRVKRVFFVETVPKSPSGKILRKDLRARLAAGVPN

SEQ ID NO: 38860 - protein, 542 aa, Nicotiana tabacum
MEKDTKQVDIIFRSKLPDIYIPNHLPLHSYCFENISEFSSRPCLINGANKQIYTYADVELNSRKVAAGLHKQGIQPKDTIMILLPNSPEFVFAFIGASYLGAISTMANPLFTPAEVVKQAKASSAKIIVTQACHVNKVKDYAFENDVKIICIDSAPEGCLHFSVLTQANEHDIPEVEIQPDDVVALPYSSGTTGLPKGVMLTHKGLVTSVAQQVDGENPNLYIHSEDVMLCVLPLFHIYSLNSVLLCGLRVGAAILIMQKFDIVSFLELIQRYKVTIGPFVPPIVLAIAKSPMVDDYDLSSVRTVMSGAAPLGKELEDTVRAKFPNAKLGQGYGMTEAGPVLAMCLAFAKEPFEIKSGACGTVVRNAEMKIVDPKTGNSLPRNQSGEICIRGDQIMKGYLNDPEATARTIDKEGWLYTGDIGYIDDDDELFIVDRLKELIKYKGFQVAPAELEALLLNHPNISDAAVVPMKDEQAGEVPVAFVVRSNGSTITEDEVKDFISKQVIFYKRIKRVFFVDAIPKSPSGKILRKDLRAKLAAGLPN

SEQ ID NO: 38861 - protein, 184 aa, Musa balbisiana
  misc_feature (115)..(115): Xaa can be any naturally occurring amino acid
  misc_feature (167)..(167): Xaa can be any naturally occurring amino acid
GQGGFGKVYKGVLADGTKIAVKRAMPGSKQGYPEFQTEILVLSGIRHRHLVSLIGYCDEQLERILVYEYMEKGTLKNHLYGSDKPCLSWKQRLEICIGAARGLHYLHTGYSHTIXHRDIKSTNILLDENYLAKVSDFGLFKLGPSFGETHVTTGVKGTFGYFDPEYXKTQKLTDKSDVYSFGVI

SEQ ID NO: 38862 - protein, 394 aa, Bacteroides fragilis NCTC 9343
MAEKRDYYEVLEVTKESTVEEIKKAYRKKAIQYHPDKNPGDKEAEEKFKEAAEAYDVLSNPDKRARYDQFGHAGMSGAAGNGGPFGGFSGGMSMDDIFSMFGDIFGGHSGGGFGGGFGGFGGFGGGGSQQRKFRGSDLRVKVKLNLKEISTGVEKKFKLKKYVPCSHCHGTGAEGNSGSETCPTCKGSGSVIRNQQTILGTMQTRTTCPTCNGEGKIIKDKCKVCGGEGIEYGEEVVTVKIPAGVAEGMQLSMGGKGNAGKHNGIPGDLLILVEEEPHPELIRDENDLVYNLLLSFPTAAIGGAVEIPTIDGKVKVKIEAGTQPGKVLRLRGKGLPSVNGYGTGDLLVNVSVYVPETLSKEEKSTLEKLEESKNFKPSTSIKEKIFKKFRSLFD

SEQ ID NO: 38863 - protein, 467 aa, Leptospira interrogans serovar Lai str. 56601
MSAEFDVVVIGAGPGGYVCAIRCAQLGFKTAIIEKRKTLGGTCLNVGCIPSKALLDSSEEYHKTLHKLEVHGISVGKVDLDLNKLMNRKDQIVKEVTDGVDFLMNKNKIKRYEGFGKVLSAGKVEVAFNDGKKETLSAKHIVVATGSVPIDIPGLTVDGKNIITSDHAIDVRKLPKKMIIIGAGVIGLELGSVWGRLGTSVTVVEFLPGLISNVDRQMGSLLERSLTSQGMEFLFEHKVKGAATTKNGVKVQIEDSKGESKDLEADVVLVAVGRRPFLEGVGLEEAGVAFTQRKRIQVDAHFKTSVPGIYAIGDAIDGPMLAHKAEEEGVALAELLAGQSGHVNYNAVPYVIYTWPEMAWVGKGEEELKAAGIEYKVGKSLFRPNARSKAMNEAEGQVKILADKKTDKLLGAFVFGPRASDMVAELAVAMEFGASAEDIARSFHAHPTLSEVIKEAAMAVDKWAIHA

SEQ ID NO: 38864 - protein, 119 aa, Triticum aestivum
  misc_feature (97)..(97): Xaa can be any naturally occurring amino acid
  misc_feature (107)..(107): Xaa can be any naturally occurring amino acid
MVRTSVLHDALNSINNAEKAGKRQVLIRPSSKVIIKFLTVMQRHGYIGEFEEVDDHRSGKIVVQLNGRLNKTGVISPRYNVRLADLEKWVVKLLPAXRQFGYVILTXTSAGIMDHEEAR

SEQ ID NO: 38865 - protein, 337 aa, Coccidioides immitis RS
MVVKVGINGFGRIGRIVFRNAVEHPEVEIVAVNDPFIETHYAAYMLKYDSTHGRFKGDVKFSDNGLDVDGKHVRFYQERDPANIPWAETGADYVIESTGVFTTTEKASAHLKGGAKKVIISAPSADAPMFVMGVNNETYKSDIKVLSNASCTTNCLAPLAKVVNDNFGLVEGLMTTVHSYTATQKTVDGPSSKDWRGGRAAAQNIIPSSTGAAKAVGKVIPSLNGKLTGMSMRVPTSNVSVVDLTCRTDKSVTYDQIKEAMKKASANELKGIMSYSEDALVSSDLNGDTHSCIFDATAGIALNDHFIKLVAWYDNEWGYSRRVIDLIAYIAGVDAGK

SEQ ID NO: 38866 - protein, 330 aa, Campylobacter coli RM2228
MNLPVLDLKIYEKDKSAFLKNLREVTSNVGFFYLINHGIDKNLNEKLFKLSKDFFNLPRSSKELISMVHSPQFRGYTSEGFEYTAGEKDYREQIDIGTERKALKWDLNSPLWQRLEGPNLWPDEIPELKEIFLAWHEQTRNACLKILQAFAEALDLSSNAFGKLYGENSYEHCKIIHYPKISKDASQGVGPHKDGGLITFVFQEEQNGLEAFIDDQWISVPPLEGSVVVNIGEFLELATNGYLKATIHRVNLSPKERFSIAYFLGVQLDKDIPIFPLNPELVQESKGVDTDPKNPLLRNVASNYFKRMIRSHPDVARIYHSDLIEKFSFA

SEQ ID NO: 38867 - protein, 452 aa, Crocosphaera watsonii WH 8501
MDTKTLKNKTNVVIVGGGFGGLYTAQDLKNSSVDVTLIDKRNFHLFQPLLYQVATGGLSPADIASPLRLVLSQHKNTKVLLDHVIDLDPEKKEVILDDHEPIPYDTLILATGVSHHYFGNDQWETLAPGLKTIEDAIEIRRRIFMAFEAAEKETDPVKRQAWLTFVIVGGGPTGVELAGAIAEIAHGALAGDFRSIDPKEAKILLIEGLDRVLPPYPPELSAKAAEDLRHLGVTVQTQSMVTDINDHVVTVRQGEQIKQINSRTILWAAGVKASKMGKVLAERTGVELDRAGRVIVEPDLSIPGHSDIFVIGDLANFPHQGERPLPGVAPVAMQQGAYVAKLIKKRLQGESLPQFIYKDYGNMAVIGQNKAVVNLGFAKFSGFLAWFVWVWAHIYYLIEFDNKLVVMVQWGWNYFTRGRGARLVTGIGEGKRKDQLQQISPEATETATPVTR

SEQ ID NO: 38868 - protein, 409 aa, Staphylococcus aureus subsp. aureus COL
MSLRDEALEMHKRNQGKLEVKPNVKVTNKEELSLAYSPGVAEPCKDIYEDKRKVYDYTIKGNTVAVITDGTAVLGLGNIGPEASIPVMEGKAVLFKSFAGINGVPIALNTTDTEEIIKTVKLLEPNYGGINLEDISAPRCFEIEERLKKETNIPVFHDDQHGTAIVTLAGLVNALRVVNKDIAKIKVVLNGAGAAGIAIVKLLYAYGVRNMVMCDSRGAIFEGRSYGMNPTKDVVAKWTNKDKIEGSLEEVVKDADVFIGVSVANALSQDMVKSMADNPIIFAMANPNPEIIPDDAKAAGARVVGTGRSDYPNQINNVLAFPGIFRGALEVEATHINEEMKKAAVEAIADLIDSSELNEDYCIPGPFDKRVAPSVARNVAKAAMESGVARIEVDPQDVYDKTMKLTDLQ

SEQ ID NO: 38869 - protein, 255 aa, Oryza sativa
  misc_feature (55)..(55): Xaa can be any naturally occurring amino acid
  misc_feature (61)..(61): Xaa can be any naturally occurring amino acid
  misc_feature (99)..(99): Xaa can be any naturally occurring amino acid
  misc_feature (104)..(104): Xaa can be any naturally occurring amino acid
LQLCCDLGEGGEGQPSQSQAISLSHSKPKAKQAGRLLLLPPPFRQLLNRTRRRTXRAQFTXEISTPYPMGISHPLSDDFDASPVLPPPPPPSSCCPPAXHEDHXLDHQISDIKRANSLMTDSQMFAHKILLIPLPGRPMPSSVRLNGSGQKMKRAWAPNNQQNRDVTDSLDSSKYNSSKQQMSLAMSTLQSYYGLTPQNGAMTDAGTEMSLYSKGSLERINSETLVTSSRLPDTHNTDRSRNSEDTSNGFSATNG

SEQ ID NO: 38870 - protein, 569 aa, Oryza sativa
  misc_feature (11)..(11): Xaa can be any naturally occurring amino acid
  misc_feature (38)..(38): Xaa can be any naturally occurring amino acid
  misc_feature (526)..(526): Xaa can be any naturally occurring amino acid
  misc_feature (561)..(561): Xaa can be any naturally occurring amino acid
MASSHIILPPXDDDEEQRRLEEEEDEDPWARSGPPPAXAPEHAMKAALPFSATCVRISRDSYPNLRALRNASSVSLADAAYVKISEGDFGYVLDDVPHLVDHLPDAPTYPNPLQDHPAYSTVKQYFVNEDDTVPQKVVVQKNSRRGVHFRRAGPRQKVYFESDEVKACIVTCGGLCPGLNTVIRELVCGLAHMYNVSKIYGIQNGYKGFYSSNYLTLTPKSVDDIHKRGGTVLGTSRGGHDTKKIVDNIQDRGINQVYIIGGDGTQKGAYEIFKEIRKRGLKVSVAGIPKTIDNDIAIIDKSFGFDTAVEEAQRAIDSAHVEACSAENGIGLVKLMGRYSGFIAMYATLASRDVDCCLIPESPFYMDGEGGLLQYVERRLKENKHMVIVVAEGAGQDLIAKSLSTSEQQDASGNKLLLDIGLWLTHKIKDHFKSKKMEMTIKYIDPTYMIRAIPSNASDNVYCTLLAHSAIHGAMAGYSFTVGNVNGRHAYIPFYRVTSTRNKVKITDRMWARLLSSTNQPTFITXKREIDEPKENDRTTNKPPLPTGPSHHVPKSFDQSXNYSSNSQI

SEQ ID NO: 38871 - protein, 402 aa, Oryza sativa (japonica cultivar-group)
MSGEVECRVCHAKVQVPMAAAAVSKAYDIHRSSVSSRQRALNVLLVSGDCVLAGLQPILVYMCKVDGKFKFSPVSVNFLTEITKIIFAIIMLCIQARRLKVGEKPFLTVSTFMQAARNNVLLAVPALFYAINNYMKFVMQLYFNPATVKMLGNLKVLVIAVLLKVIMRRRFSTIQWEALALLLIGISVNQLKSLPEGSSTLGLPVAAGAYLYTLFFVTVPALASVYNEKALKSQFDTSIYLQNLFLYGYGAIFNFLGLVITAIIQGPSSFNILEGHSKATMFLICNNAAQGILSSFFFKYADTILKKYSSTIATIFTGVASAVLFGHTLTINFVLAISIVIISMHQYLSNQIKDEVPSSKIEMGDAHEHRSKESVVVNVSDSIATEAKHRHGTDERQPLLPV

SEQ ID NO: 38872 - protein, 534 aa, Porphyra purpurea
MMKKKVHPIVLAILDGWGHSNSHQGNAIKIAKTPTIDSLLETYPNTLLVASGEEVGLPKGQMGNSEVGHTTIGGGRVVEQELVKIGNSIENKSFFNNVQLNCACDHAISTQTSLHLIGLCSNGGVHSHLDHLLALIHVAESKKVPNLYIHLITDGRDTNSNSAKSFIKLIADHIEKKSFVIISTISGRYYAMDRDFRWSRTKAAYTVLTSDNSDITNQPLNYNDLIDHYYNKGISDEFIPPSRINTGSIKDGDAIIFFNFRPDRMRQLVQALVQKPFNCFLTKSLSHLHVLTFTNYDSSLNTALAFPPNTLNNFLGETISKYGLKQFRVAETEKYAHVTYFFNGGAEEPFSGEDRELVSSPSVTTYDLSPDMSAELVTQKSISAINKGIYSCIVINYANADMLGHTGKLKETIRSIETVDNCIALLFDAVSQSNGTLIITADHGNAECMLTNEGTSCTSHTTNLVPFILIEGEQATISGHGGQVEFRKNGSLADVAPTILDILNLKKPPEMTGKSLIINSKYETRNLDKTFIEL

SEQ ID NO: 38873 - protein, 261 aa, Zea mays
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLETHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLRDNLTLWTSDISEDPAEEIREAPKHDSSEGQ

SEQ ID NO: 38874 - protein, 214 aa, Triticum aestivum
  misc_feature (8)..(10): Xaa can be any naturally occurring amino acid
  misc_feature (14)..(14): Xaa can be any naturally occurring amino acid
  misc_feature (21)..(21): Xaa can be any naturally occurring amino acid
  misc_feature (24)..(24): Xaa can be any naturally occurring amino acid
  misc_feature (36)..(37): Xaa can be any naturally occurring amino acid
  misc_feature (39)..(39): Xaa can be any naturally occurring amino acid
  misc_feature (42)..(42): Xaa can be any naturally occurring amino acid
  misc_feature (52)..(53): Xaa can be any naturally occurring amino acid
  misc_feature (66)..(66): Xaa can be any naturally occurring amino acid
  misc_feature (68)..(68): Xaa can be any naturally occurring amino acid
  misc_feature (77)..(77): Xaa can be any naturally occurring amino acid
  misc_feature (82)..(83): Xaa can be any naturally occurring amino acid
  misc_feature (91)..(91): Xaa can be any naturally occurring amino acid
  misc_feature (122)..(122): Xaa can be any naturally occurring amino acid
  misc_feature (135)..(136): Xaa can be any naturally occurring amino acid
  misc_feature (140)..(140): Xaa can be any naturally occurring amino acid
  misc_feature (157)..(158): Xaa can be any naturally occurring amino acid
  misc_feature (163)..(163): Xaa can be any naturally occurring amino acid
  misc_feature (167)..(167): Xaa can be any naturally occurring amino acid
MAPTVMAXXXTSVXPFQGLKXTAXLPVSRRSNGASXXSXSNXGRIRCMQVWXXEGIKKFETLSYLXPXNTEALLKQXDYLIXXKWVPCLEXSKVGFIFREHNASPGYYYGRYWTMWKLPMFXCTDATQVINEVEXXKKEXPDAYVRIIGFDNMRQVXXVSLIXFKPXGCEERGLKQNSPGQHIKVFAGFFDFWGCFLSHLFLVPKKNIGKGPFG

SEQ ID NO: 38875 - protein, 183 aa, Musa acuminata
FGRVCSGRYTGSAEGRNEGAVKRGNPTSQQGLNEFHTEIELLSRLRHRHLVSLIGYCDEKNEMILVYEYMEKGTLKSHLYGSNLPPLSWKQRLEICIGSARGLHYLHTGQAKAIIHRDVKSANILLDENLLAKVADFGLSKTGPELDQTHVSTAVKGSFGYLDPEYFRRQQLTEKSDVYSFGV

SEQ ID NO: 38876 - protein, 393 aa, Cytophaga hutchinsonii ATCC 33406
MKTLHTINFSDTAIAFASKSTKELKHMKFLFRTMAWSKITNISVSFLKFALKYHFPIKNIVRNTLFKQFCGGETYWECGTTMEKLHASGIFSIPDYSVEGKEDEASFNQTVKELVKGIELAAGLPMVSFSVFKMSGIARFALLEKIQRGEQLSADESKEFDRVKERVTRLCFEAETHNVRLMVDAEETWIQTAIDVLYVGYMKRFNAQRPILFLTIQLYRKDGLERLKNMYAQAQKEGYHIGFKLVRGAYMEKERARANELKYPSPINDTKEQTDALYNQAVSFCLHEDIATCIATHNQLSIERAVREMDPKDQQISGFAQLYGMGDFLSYNLAHAGYNVSKYLPYGPLREVMPYLFRRAEENKSITGETTRELFFIEKELKRRKAAGFKLKA

SEQ ID NO: 38877 - protein, 400 aa, Rickettsiella grylli
MKINLSHRVSQIKPSPTLSLSATANQLKAQGKPVINLTVGEPDFDTPYHIKRAAHQAIDDGFTKYTAVDGIPRLKQAVIDKFKRDNQLDYSLDQVIISSGAKQSIYNLMQSLLNPGDEVIIPAPYWVSYPDIVLLAEAKPVFIPTSTESSLKITPQQLQAAITDKTRLMIINSPSNPSGMVYTPTELKQLAQILLRTPHVFILTDDIYEHIYWGDQPFKNILNVCPELANRTLVLNGCSKAYAMTGWRIGYAAGPKTIIRGMMNLQSQSTSNPNSIAQFAATAALTGQQTDVLHMNKIYHWRHDFFVAELNKIPGIHCLPAQGAFYSFPSFHAFIGEDKPFASDYELADFLLNNAHVAVVPGSAFGAPGYLRLSYALEETLLEKALLQLKTTLMNAMPLT

SEQ ID NO: 38878 - protein, 219 aa, Psychrobacter arcticus 273-4
MSDQQAQKQAAAKAALRYIEDDMILGVGTGSTVNCLIELLPTLKLAGAVASSQVTEDRLRALGIEIVDLNFAGQLDVYIDGADEVNAHLQLIKGGGGALTREKIVAAASNKFVCMVDESKSVEILGRAFPVPIEVLPQARSYVARQLARMGGEPVYREDFVTDYGNVILDTYDLDVSNPLALEQQLNNIVGVVCNGIFAANQADVLLKASSNGVEILNR

SEQ ID NO: 38879 - protein, 98 aa, Arachis hypogaea
MAAVGAPREVAGNENSLEIDSLARFAVDEHNKKQNGLLEFKRVISAKQQVVAGTLHHITLEAASGDSKNVYEAKVWEKPWMNFKEVQEFKLAGDGSNA

SEQ ID NO: 38880 - protein, 345 aa, Thermus thermophilus
MKVAVLPGDGIGPEVTEAALKVLRALDEAEGLGLAYEVFPFGGAAIDAFGEPFPEPTRKGVEEAEAVLLGSVGGPKWDQNPRELRPEKGLLSIRKQLDLFANLRPVKVFESLSDASPLKKEYIDNVDFVIVRELTGGIYFGEPRGMSEAEAWNTERYSKPEVERVARVAFEAARKRRKHVVSVDKANVLEVGEFWRKTVEEVGRGYPDVALEHQYVDAMAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVLRHLA

SEQ ID NO: 38881 - protein, 192 aa, Oryza sativa
MPRAEPEMEPDGRRRRRSPSPRRLNRDVGKGLKESECDRGTASGGGGTAGRYTDIAADLIDSDSDESRDRSRKRSRSQKGPKERSSRKKKSRRDGSTRKKEASEGARFALEDGNGGTGYVMSGSRHARITAVRLRKENQVYSAEEKRALAAFNSEQRARRESKVRDDLRCLVDRTLGKLAGSDHDDDPSSAR

SEQ ID NO: 38882 - protein, 435 aa, Staphylococcus aureus subsp. aureus Mu50
MQNDEMFERTVKPVLDVNEKPQPAQWAFLSLQHLFAMFGATVLVPFLTGLPISAALLASGIGTLLYILITKAQIPAYLGSSFAFITPIITGLSTHSLGDMLVALFMSGVMYVIIGILIKLSGTAWLMKLLPPVVVGPVIMVIGLSLAPTAVNMAMYENPGDMKGYNISFLIVAMITLLVTIVVQGFFKGFLSLIPVLVGIIVGYVVAIFMGIVKFDAIMSAKWIDFPHIYLPFKDYVPSFHLGLVLVMIPIVFVTVSEHIGHQMVLNKIVGRNFFEKPGLDKSIIGDGVSTMFASIIGGPPSTTYGENIGVLAITRIYSIYVIGGAAVIAIVLAFIGKFTALISSIPTPVMGGVSILLFGIIAASGLRMLVESKVDFANNRNLVIASVILVVGIGNLVFNLKEIGINLQIEGMALAALSGIILNLILPKEKKQNN

SEQ ID NO: 38883 - protein, 246 aa, Zea mays
  misc_feature (202)..(202): Xaa can be any naturally occurring amino acid
  misc_feature (221)..(221): Xaa can be any naturally occurring amino acid
MGRQFFVGGNFKMNGSIKSITDIVENLNKGKLDPNTEVVIAPPALYLLLTREHLRKGLEVAAQNIFDKPNGAFTGEISAEQLKDSGITWTLVGHSERRQILQENDDFIANKTKTATDNGLGVILCCGESLEQREAGETVSVVTKQLKAVADKVKDWSKIVVAYEPIWAIGTGKVATTEQAQEVHAALREWLKKEVSPEASEXARILYGGRVSEKTATSLPXEANIDGFLVGGASLKPAFVDIITLT

SEQ ID NO: 38884 - protein, 482 aa, Rubrobacter xylanophilus DSM 9941
MIESQIESRNYIGGEWVPADSGEVEEVRNPARPSEVLGTAPRSDRGEMERAVAAAQEALPGWRSALPAARGQILLRAADIIDSRSEELARLMALEAGKPLGESRAEVSRAAAIFRYYGSEGWRLYGVEAPSTRPGVRITSTREPLGVVGLITPWNFPLAIPSWKMAPALICGNTVVIKPAANAVLNAAELVRILEEAGLPGGVVNLVMGPGGSSGDALVRDERVRAISFTGSTAVGLSIQERAAGKKVQLEMGGKNPYVVMEDADLEDAAAKVAYGAFGYAGQKCTASSRAVVVEEVYEAFLEQVVEATRALKLGEPLDEEAVIGPVINESQYESILGAIEQAREDGRVVLDGGATGPREEGYYISPVIVADVDNGSKTAREEIFGPVLAVIKARDFDHAVEIANDTRYGLTAGIATRSLRYAEEFIERSQTGLVNVNLPTAGVEFQVPFGGSKQSGVGGREQGMAAIEFYTGWKTASVLAL

SEQ ID NO: 38885 - protein, 176 aa, Triticum aestivum
MASEKDAALAAVPNDNPTIFDKIIKKEIPSTVVYEDEKVLAFRDINPQAPTHIVIIPKVKDGLTGLSKAEERHVEILGCLLYAAKVIAKQEGLEDGYRIVINDGPSGCQSVYHIHVHLLGGRQMNWPPRLKKLLVVGQSSWQLCPLHPNRIIPVIDITVCARNICSIYGIGKTILL

SEQ ID NO: 38886 - protein, 107 aa, Porphyra purpurea
MDIETKKVIEQILDNNKIVLFMKGSKLMPMCGFSNTAIQILNTLNTDYFTYDILENENIRQAIKEHSSWPTIPQLYINREFVGGADIMLELFEQGELQAQVETLLAA

SEQ ID NO: 38887 - protein, 1115 aa, Mycobacterium smegmatis str. MC2 155
MPRRSDLNHVLVIGSGPIVIGQACEFDYSGTQACRVLRSEGIQVSLVNSNPATIMTDPEYADNTYVEPITAAFVEKVIAQQAARGNKIDALLATLGGQTALNTAVALHENGVLERYGVELIGADFEAIQRGEDRQKFKDIVAKVGGESARSRVCFTMDEVRETVAELGLPVVVRPSFTMGGLGSGMAYSAEDVERMAGDGLAASPSANVLIEESIYGWKEYELELMRDGRDNVVVVCSIENFDPMGVHTGDSVTVAPAMTLTDREYQKMRDLGIAILREVGVDTGGCNIQFAVNPRDGRLIVIEMNPRVSRSSALASKATGFPIAKIAAKLAIGYTLDEILNDITKETPACFEPTLDYVVVKAPRFAFEKFPGADATLTTTMKSVGEAMSLGRNFIEALGKVMRSLETTRAGFWTAPDPDTTVEQLLTNLRTAQDGRIYDMELALRLGASVEQVSEASGVDPWFVEQIAGLVDLRAELVEAPVLDADLLRRAKYSGLSDRQISALRPELAGEAGVRALRQRLGIHPVFKTVDTCAAEFDAKTPYHYSSYELDPAAETEVAPQTEKPKVLILGSGPNRIGQGIEFDYSCVHAATTLSDAGFETVMVNCNPETVSTDYDTADRLYFEPLTFEDVLEIYHAESLSGEGGPGVVGVIVQLGGQTPLGLAKRLEDAGVPIVGTSPKAIDLAEDRGHFGEVLTAAGLPAPKYGMATSFDQARRIAADIGYPVLVRPSYVLGGRGMEIVYDEETLRGYITRATQLSPEHPVLVDRFLEDAIEIDVDALCDGTEVYIGGIMEHIEEAGIHSGDSACALPPVTLGRSDIEAVRRATEAIAHGIGVVGLLNVQYALKDDVLYVLEANPRASRTVPFVSKATAVPLAKACARVMLGATITQLRDEGLLSKAGDGAHVGRSTPVAVKEAVLPFHRFRRADGAQIDSLLGPEMKSTGEVMGIDHDFGTAFAKSQTAAYGSLPTEGTVFVSVANRDKRSLVFPVKRLADLGFRVLATEGTAEMLRRNGIPCDEVRKHYEDPSAADPRPSAVEVIKAGEVNMVINTPYGNSGPRVDGYEIRSAAVSMNIPCVTTVQGASAAVQGIEAGIRGDIGVMSLQELHSELGSRRS

SEQ ID NO: 38888 - protein, 120 aa, Cryptococcus neoformans var. neoformans JEC21
MQRPNDSLAQRALFVKNLNFNITGADLYDLFGKYGPIRQIRLGTDANLKTKGTAYVVFESPDDAKEAVNQLNGFHLMERYIVVLYHHPSKQQASALAKAELRAREEALAEEKRRLGMKDE

SEQ ID NO: 38889 - protein, 352 aa, Oryza sativa (indica cultivar-group)
MVHPAQGQMVQDLAAGGELGAPPSRYVLREKDRPVAAAGAVQAAQRELAAIPTIDVSRLAAESGDDVVDDGGEAAKLRSALQSWGLFAVTGHGMPEPFLDEILAATREFFHLPPEEKERYSNVVAAADADGVGAGGERFQPEGYGIDRVDTDEQILDWCDRLYLQVQPEEERRLEFWPEHPAALRGLLEEYTRRSEQVFRRVLAATARSLGFGEEFFGDKVGEKVTTYARFTYYPPCPRPELVYGLKPHTDNSVLTVLLLDKHVGGLQLLKDGRWLDIPVLTNELLVVAGDEIELFALLGVADHEQVFMAPVHRVVTSERERMSVVMFYQPEPHKELAPSEELVGEERPAMY

SEQ ID NO: 38890 - protein, 413 aa, Oryza sativa (japonica cultivar-group)
MAFAARRSLASRLSHHLTRRLHPATAPHLLASHSDDDPSPPPELPPFPHSPSPRHPRAGQALDRHLLPFSLHHLAGLRRRGFSSAAGEVDAAAGVLADAAAAAEAVPAPFPGEVAAAAADSFFPVAALQHVIDYIHTFTGLNWWACIALATVLIRSATVPLLVNQLKATQKLNAIRPEMEAIKEEMNAMDPKSAKEGKAKMTALFQKHGVSPFTPLKGLLIQGPIFMSFFFAIRNMIDKVPSMKGGGSLWFTDLTTPDPLYILPVLTALIFLVTVELNLQEGMEGNPMARKMKNFSRGMAVLTVPFTMSFAKGIFCYWITSNLFTLTYGFVIRRPAVRKFCNLPALEAQSASAKKQMFNLFGGSKALTTAESPVAITGGPQSSLEQPDAAALGYRVKNPEKKAKSRGKSRRRR

SEQ ID NO: 38891 - protein, 273 aa, Thermoplasma acidophilum DSM 1728
MKLIENWFSERYSDNLQLSFRVSDQLLSIKTDYQRIDLFDTYDFGKLLAIDGTVQLTERDEFIYHELITMVPYHLTPRPPENALIIGGGDGGAARRLIDLGLKHIVNVEIDDQVVEVSKRFFPSLSSAFNDSHVKLLIQDGIKYVKNTSEKFDLIIIDSTDPEGPAEGLFSKDFYNDTRKIMNEGAVIVSQSGSPFYQPKAIKLAYSGMREVFSDVRVYTGFIPTYPSGFWSFTVASPWTMKPRPVNMSGKYFNADVMEGSFRLPQFVKELIT

SEQ ID NO: 38892 - protein, 349 aa, Oryza sativa (indica cultivar-group)
MEDVRSTLLVQELAGMRSKAVPRQYIVQQEDQPTIAATASVPIVDLGRLSQPDGDANEAVKLRQAMESWGLFMVTNHGIEDALMDNVMNVSREFFQQHLGEKQKYTNLIDGKHFQLEGYGNDQVKSDTQILDWLDRLYLKVDPADERNLSVWPKHPESFRDVLDEFLIKCDGVKNSLLPSMAKLLKLNEDYFVRQFSDRPTTIARFNYYPQCPRPDLVYGMKPHSDATILTILMVDNDVGGLQVLKDGVWYDVPTKPHTLLINLGDHMEIMSNGIFKSSVHRVMTNPEKERISVVLFYFMNLEKEIEPALELIDERHPARYKRVKIMDYLAGLFEHFLQGTRVIDTVKI

SEQ ID NO: 38893 - protein, 485 aa, Magnetospirillum magnetotacticum MS-1
MIKHLINGKHVESASTIANLNPATNEVICQIAAGGEAEVARAVAAAKEAFPKWAGLAPAQRAKLLRKVGDLINQHVDEIAKLESLDTGQSYWRTKKMLVPRAADNFYFFADTCQHVDGETYPTNDHLNYTIYQPVGVVGLISPWNVPFMTATWKTAPCLAFGNTAVLKMSELSPLSADRLGQLILEAGIPAGVFNIVHGYGSAVGEALVKHPDVRGVSFTGSTATGNRIIQSGGLKKYSMELGGKSPNIVFDDCDFERAVDAAIVAVYGNNGESCTNGTRILVQDGIYDRFVAALAERTKKVVVGDPLDEATNVGPMITRDHWKKVTGYIELGIKEGARVVAGGLGEPEGLPAHLKNGNFVKPTVLADVDNSWRVAQEEIFGPVACVIRFKDEAEALKIANATTYGLASYVWTENGAKAIRMAEGIEAGLVFVNSQNVRDLRQPFGGIKGSGTGREGGHYSYEAFLEVKNVCVSKGNHHIPRWGV

SEQ ID NO: 38894 - protein, 350 aa, Oryza sativa (indica cultivar-group)
MADESWRTPAIVQELAAAGVEEPPSRYVLGEKDRSDELVAAELPEPIPVVDLSRLAGADEAAKLRAALQNWGFFLLTNHGVETSLMDDVLNLAREFFNQPIERKRKFSNLIDGKNFQVEGYGTDRVVTQDQILDWSDRLFLRVEPKEERNLAFWPDHPESFRDVLNEYASRTKRIRDDIVQAMSKLLGLDEDYFFDRLNKAPALARFNYYPPCPRPDLVFGVRPHSDGSLLTILLVDEDVGGLQIQRDGKWYNVQVTPNTLLINLGDTMEVLCNGIFRSPVHRVVTNAERERISLAMFYSVNDEKDIGPAAGLLDENRPARYRKVSVGEFRAGIIGKFSRRERYIDSLKI

SEQ ID NO: 38895 - protein, 439 aa, Escherichia coli W3110
MLPFLKAPADAPLMTDKYEIDARYRYWRRHILLTIWLGYALFYFTRKSFNAAVPEILANGVLSRSDIGLLATLFYITYGVSKFVSGIVSDRSNARYFMGIGLIATGIINILFGFSTSLWAFAVLWVLNAFFQGWGSPVCARLLTAWYSRTERGGWWALWNTAHNVGGALIPIVMAAAALHYGWRAGMMIAGCMAIVVGIFLCWRLRDRPQALGLPAVGEWRHDALEIAQQQEGAGLTRKEILTKYVLLNPYIWLLSFCYVLVYVVRAAINDWGNLYMSETLGVDLVTANTAVTMFELGGFIGALVAGWGSDKLFNGNRGPMNLIFAAGILLSVGSLWLMPFASYVMQATCFFTIGFFVFGPQMLIGMAAAECSHKEAAGAATGFVGLFAYLGASLAGWPLAKVLDTWHWSGFFVVISIAAGISALLLLPFLNAQTPREA

SEQ ID NO: 38896 - protein, 130 aa, Zea mays
MYADAGFAFAFAAAYSPTLTSSQPQPPPPPFDYAFSSEPPLLSMPAMDHDAYLNLGANTPRPAANVCVTISDLKTEERKQKLSRYRKKKIKRNFGRKIKYACRKALADSQPRVRGRFAKIEECDLLKPSK

SEQ ID NO: 38897 - protein, 560 aa, Turritis glabra
MASSTALICDTEAWKDLKGHVEDIKKTHLRDLMSDANRCQSMIMEFDGLLLDYSRQRATVETMDKLLNLAKAAQLTEKISRMFNGEHINSTENRSVLHVALRAPKDAVIKADGKNVVPEVWNVLDKIKEFSEKIRSGSWVGATGKPLKDVVAIGIGGSFLGPLFVHTALQTDPEALECAKGRQLRFLANIDPVDVARNINGLNPETTLVVVVSKTFTTAETMLNARTLREWITTALGASAVAKHMVAVSTNLALVEKFGIDPNNAFAFWDWVGGRYSVCSAVGVLPLSLQYGFSVVEKFLKGASSIDQHFQSTPFEKNIPVLLGLLSVWNVSFLGYPARAILPYSQALEKFAPHIQQGSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYERRVAVQGFVWGINSFDQLGVELGKVLATQVRKQLHSSRTQGTALEGFNYSTTTLLKRFLETSSKPQM

SEQ ID NO: 38898 - protein, 745 aa, Legionella pneumophila str. Lens
MLDRASLVDEQFLKRVLQGDFPQLRSSMSPDTAELDKKTAIEFFDSQIKSRLLDIIARQLKEKGLSFYTIGSSGHEGNAVLGQVFRASDMAFLHYRSGAFFLQRAKQLPGIDGVKDILLSLVAAASDPISGGRHKVFGSVPLNIPPQTSTIASHLPKALGAALSITRARELGLPSKLTPDSVILCSFGDASTNHATSQATLNACSWITQQNYPLPIVFICEDNGIGISVPTPSSWIKSSVSSRPGIHYIECDGLNIADVFAKAQEADYLARVKKQPVFLHMRCVRLLGHAGSDIESQYNTQEEIEQREANDPLLHTAGILYREGWMSLQAMVELYQDNRALIEAKALEAIREPRMSSAEEIMASIVPRIDKKQKYSLPDDNRRAQVFAGAYNQLTLKRNLCQQINFALTDLMMQYPNMLIFGEDVGKKGGVYRVTADLQARFGQRRVFDTLLDETTIIGTAIGLAHNGFIPVPEIQFLAYLHNAEDQLRGEASTLSFFSSGQYQNPMVLRIASLAYQKGFGGHFHNDNSIAVLRDLPGVIVACPSNGPDAAKMLRTCMRLAYEEGRVVVFLEPIALYMTKDLYRPGDNGWLFEYPSPDGMISQGEVGVYGEGDTVILTYANGYYLSRQAEKVLRQAHNISVKIIDLRWLSPLPKDAILKEIAKAKRILIVDEGRQSGSISEGLMTLLMEEASPRLKIKRITGKDCFIPLGTAWQYLLPSQESIIDAVIALQSDKREKESGRLVVS

SEQ ID NO: 38899 - protein, 517 aa, Arabidopsis thaliana; identical to SEQ ID NO: 1159

SEQ ID NO: 38900 - protein, 713 aa, Bacillus cereus E33L
MLKVKRPFDAYLDEMNKITILLPHAYGTSRTFRLQEGSNVKDLPIAHTIALPDATKYECFIEEPLDVGKYYTVRDERNEETDLQIGAVIRTEIFDEKYYYEGTDLGAVYQKEATTFKVWAPTARLAKVRIYKSDKEYTDHEMHREENGVWAHTLQGDLAGEKYTFLVCINLIWNEAVDPYAKSVTVNGKYGVVIDLEKTNVTKRGQLPLLQAMTDAILYELHIRDATIHEGSGVSKKGTYKGLMEEGTTGQNGTLTGLSHIKDLGVTHVELLPLYCFGGVDEANPSSAYNWGYNPLYYNAPTGFYATNPSDPYNRIVECKQLIETFHEHGIRVIIDVVYNHVYERELSSFEKLVPGYYFRHGENGMPSNGTGVGNDIASERKMMRKFIVESILYWLTEYNVDGFRFDLMGILDVDTINIIEKEVRNIKRDALLLGEGWDLQTPLPLEEKATLNNANKMPHIAQFNDQFRDGIKGSTFHINKRGFAFGGHVDRNHLQYIVSGSLLSMKETGLFLEPVQSINYVECHDNMTMWDKLMRSNEESEEILKKRHVLATAMVILSQGIPFLHAGQEFYRTKQGNENSYNANDEINQLDWDRKEKEIETVNYIKGLIAIRKEHGAFRLQNVDLIKKHMTFLQTSPEVLAYHLEHVESFGPWKEIVVLFNSSLEAKTVQLPKEETWHVLVNEKQAKIEPISSFRGKELRLSPISTYILTIM

SEQ ID NO: 38901 - protein, 136 aa, Picea abies
  misc_feature (125)..(125): Xaa can be any naturally occurring amino acid
MARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDXQLARRIRGERA

SEQ ID NO: 38902 - protein, 1057 aa, Staphylococcus aureus subsp. aureus Mu50
MPKRNDIKTILVIGSGPIIIGQAAEFDYAGTQACLALKEEGYRVILVNSNPATIMTDKEIADKVYIEPLTHDFIARIIRKEQPDALLPTLGGQTGLNMAIQLHESGVLQDNNVQLLGTELTSIQQAEDREMFRTLMNDLNVPVPESDIVNTVEQAFKFKEQVGYPLIVRPAFTMGGTGGGICHNDEELHEIVSNGLHYSPATQCLLEKSIAGFKEIEYEVMRDKNDNAIVVCNMENIDPVGIHTGDSIVVAPSQTLSDVEYQMLRDVSLKVIRALGIEGGCNVQLALDPHSFDYYIIEVNPRVSRSSALASKATGYPIAKLAAKIAVGLTLDEMLNPITGTSYAAFEPTLDYVISKIPRFPFDKFEKGERELGTQMKATGEVMAIGRTYEESLLKAIRSLEYGVHHLGLPNGESFDLDYIKERISHQDDERLFFIGEAIRRGTTLEEIHNMTQIDYFFLHKFQNIIDIEHQLKEHQGDLEYLKYAKDYGFSDKTIAHRFNMTEEEVYQLRMENDIKPVYKMVDTCAAEFESSTPYYYGTYETENESIVTDKEKILVLGSGPIRIGQGVEFDYATVHAVWAIQKAGYEAIIVNNNPETVSTDFSISDKLYFEPLTEEDVMNIINLEKPKGVVVQFGGQTAINLADKLAKHGVKILGTSLENLNRAEDRKEFEALLRKINVPQPQGKSATSPEEALANAAEIGYPVVVRPSYVLGGRAMEIVDNDKELENYMTQAVKASPEHPVLVDRYLTGKEIEVDAICDGETVIIPGIMEHIERAGVHSGDSIAVYPPQTLTEDELATLEDYTIKLAKGLNIIGLINIQFVIAHDGVYVLEVNPRSSRTVPFLSKITDIPMAQLAMRAIIGEKLTDMGYQEGVQPYAEGVFVKAPVFSFNKLKNVDITLGPEMKSTGEVMGKDTTLEKALFKGLTGSGVEVKDHGTVLMTVSDKDKEEVVKLAQRLNEVGYKILATSGTANKLAEYDIPAEVVGKIGGENDLLTRIQNGDVQIVINTMTKGKEVERDGFQIRRTTVENGIPCLTSLDTANALTNVIESMTFTMRQM

SEQ ID NO: 38903 - protein, 169 aa, Colwellia psychrerythraea 34H
MILEDLNQLPAAEASHTFMQCCSASAWVKKMVTARPFSSELAIKKAADDAWQGLTEQDYFEAFEGHPKIGDVSSLRAKYANTKELAGNEQGLVKEANDDVLEVLSQGNSDYEKKFGFIFIVCATGKSAKQMSDLLQARLPNNKTQELVNAAEEQRKIFQLRIDKALAEG

SEQ ID NO: 38904 - protein, 266 aa, Brassica napus
MACLRGISRRVNLLQRRVYPTCGHLISDDKDQTKPSSDTMIRKVFAFNGANKLTSMFMERQCAAPLGLGLSSCRFMSSSSSSTPPEWSDKVDGIDFVAPEVVPDQIVEAVTTSSQAVVPAVNEVAIAAADSAFPVAALQHLIDGVHSFTGLNWWASIALTTVLIRGVTVPILLNQLKATYKLNLLRPQLEELRQEMGTKGTDPEAMAEGQRRMQLLFKQHGVTPFTPLKGLIIQGPIFISFFFAIRDMAEKVPSFKNGWNSSGLLI

SEQ ID NO: 38905 - protein, 560 aa, Crucihimalaya himalaica
MASSTALICDTEAWKDLKGHVEDIKKTHLRDLMSDANRCQSMMVEFDGLLLDYSRQCATVETTDKLLNLAKAAQLSEKISRMFNGEHINSTENRSVLHVAPRAPKDAVIKADGKNVVPEVWNVLDKIKEFSEKIRSGSWVGATGKPLKDVVAIGIGGSFLGPLFVHTALQTDPEALECARGRQLRFLANIDPVDVARNINGLNPETTLVVVVSKTFTTAETMLNARTLREWITTALGASAVAKHMVAVSTNLALVEKFGIDPNNAFAFWDWVGGRYSVCSAVGVLPLSLQYGFSVVEKFLKGASSIDQHFQSTPFEKNIPVLLGLLSVWNVSFLGYPARAILPYSQALEKFAPHIQQVSMESNGKGVSIDGLPLPYETGEIDFGEPGTNGQHSFYQLIHQGRVIPCDFIGVVKSQQPVYLKGEVVSNHDELMSNFFAQPDALAYGKTPEQLQKENVSENLIPHKTFSGNRPSLSLLLPELTAYNVGQLLAIYEHRVAVQGFVWVINSFDQWGVELGKVLAAQVRKQLHSSRTQGKALEGFNYSTTTLLKRYLETSSEPQM

SEQ ID NO: 38906 - protein, 560 aa, Arabidopsis halleri subsp. gemmifera
MASSTALISDTEAWKDLKGHVEDIKKTHLRDLMTDANRCQSMMMEFDGLLLDYSRQRATVETVDKLLNLAKAAQLTEKISRMFNGEHINSTENRSVLHVALRAPKDAVIKADGKNVVPEVWNVLDKIKEFSEKIRSGSWVGTTGKPLKDVIAIGIGGSFLGPLFVHTALQTDPEALESAKGRQLRFLANIDPVDVARNINGLNPETTLVVVVSKTFTTAETMLNARTLREWITAALGASAVAKHMVAVSTNLALVEKFGIDPNNAFAFWDWVGGRYSVCSAVGVLPLSLQYGFSVVEKFLKGASSIDQHFQSTPIEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATHVRKQLHSSRTQGTTLEGFNYSTTTLLKRYLETSSEPQM

SEQ ID NO: 38907 - protein, 434 aa, Arabidopsis halleri subsp. gemmifera
MARDNQLPCDGDGVKPLAEESLNCGTCATPSHVTCVSSPPPDRSGDVDPLPVSGVESAGADESMSDADETKKRKRLLSGEADEEKSDGEITSLDDRVDVFAAICEDLNCSLCNQLPDKPVTTQCGHNFCLKCFEKWIDRGNETCAKCRSPIPDIMAGNPRVNSSLVPVIRYVKVAKGAGAGNANFFSFTSNQDGPENAFRTKRAKTGRANAACGRIYVTVPFDHFGPVPAENDPVRNQGVLVGESWKDRVECRQWGAHFAHVSCIAGQSDYGAQSVAISGGYKDDVDHGEWFLFTGRLSYKEKHSAYAPEEGVRYDGVYRIEKCWRKARFQDSCKVCRYLFVRCDNEPAPWNSDENGDRPRPLPNIPELETATDLFERKESPSWDFDEAEGRWRWMKPPPANHEQRKRMRIAMTCLLLFVMIIFVGSSSILYRV

SEQ ID NO: 38908 - protein, 141 aa, Picea abies
MARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIPRGKGLRFDL

SEQ ID NO: 38909 - protein, 398 aa, Ochromonas danica
MKIKKKDLNIELKNFTINFGPQHPAAHGVLRLILELDGEVVEKADPHIGLLHRGTEKLIEFKTYLQALPYFDRLDYVSMMAQEHTYSLAIEKIGNIVIPERAKIIRTIFAEITRLLNHLLAVGCHAMDVGAMTPFLWAFEEREKLMEFYERVSGARMHAAYIRPGGVSMDIPLGLLDDLYIFVNQFNYRLDEMEEMLTKSRIWKERLVDIGVVSAAKAIEWGFSGVMLRGSGISWDLRKNQPYEIYSEIDFSIPVGNSGDCYDRYLVRVEEMRQSIYIISKCLTKIKEGPIKSNNYKISPPSRLEMKNSMEAVIHHFKYFSEGFVLPCGETYTSTEAPKGEFGVYLVSNNTEKPYRCKIKAPGFGHLQALNDMSKGHLIADVVTIIGTQDIVFGEIDR

SEQ ID NO: 38910 - protein, 1463 aa, Cryptococcus neoformans var. neoformans JEC21
MTGVIGDDYSTPPHNNGNTDQLLGSTVTISEKRPQAPSPDDSEWNLASQLRADQELLKSRGLTPCKSLPLAWEHLSVRGVGGLDNIEYGSSMSTILAPWLRRKYRKKAALLAATRSDLPEAEKGDGDVMAWRPGMPTPKKGEPGLRKGERYLLRDFSGVVKSGEMMLVVGRPGSGCSTFLKILAGHRDGYAGVEGIVKYGTLQPDKDFQPYKSEVIFNSEEDLHDPNLLVGHTMDFALQMCTPSRDSRLPEEPAGNGMSRKKYQDRTKWELLKMFGLTHTHDTKVGDQYVRGVSGGEKKRVSIAEVLATKASVQMWDNATRGLDADTALRYAKTLRTLADIQRNTTVVSLYQAGNGIYDLFDKVTVIAEGRVIYYGPRAEARGYFEDLGFVHPDGGNTADFLTAVTATNERKIREGFTGPIPTTPAEFSTLYEKSDIARRMREELEAHLADPAVDEQTKKFKESVEKQKDRWASKSRPEKADFMTQVRAALIRDYQQRWGDKWTFWMRPATLLFQALIAGSMFYNMPVSTAGLFLRGGTLFLSLFFPSMISLGETTAVFSGRSVLSKHKGFSMYRPSALLLAQTIGDMPLYFVMIVMFTLIIYFMTGLKVDAGLYFIYLLFIYFTTLCTTALFRSIGYAFSTFNNASKASGFALLMLSMYAGYIIYTPQMHPWFSWIRWLNPFYYSLEAIMASEVYGLELECVSPQLAPYGGDYAQYNQGCAITGAEPNSITLDGTLWMESALNFYKSHVWRNFGILIAFWVFFLGFCALMIEMIPAAGSTKSVLLYKPGGGGKYIRNAQKNGASPRDEEDGPNDSQLNEKSQGTSDGTAAEVQAVNSVLTWKNLCYTVNANGQPRQLLNNIFGYCKAGTLTALMGSSGAGKTTLMDVLAARKTDGDIRGEILMNGKQLPISFQRTTGYCEQVDVHLPQATVREALEFSALLRQPRTLSDKEKLAYVDVIIDLLELHDIEDALIGTPEAGLGVEQRKRLTIGVELVSKPTLLFLDEPTSGLDGQSSYLIVSFLRKLAAAGQAVLCTIHQPSAALFARFDQLLLLKGGGNTVYFGPVSELTSYFEKQGVTIPKNVNPAERMIDIVSGDLSKGRDWAQIWLESDECKERARELEELKKAGADNTASVEGDEHEFASTNITQLKLVTKRASVQLWRDTEYVMNKVALHVLAALFNGFSFWKIGDAYADIQNRIFTIFLFVFVAPGVIAQTQPKFLHNRDIFEAREKKAKLYSWHAFCFAEIVAEIPYLLVCALLYFAPWYPTAGFSFKPGIAGAIYLQMTLYEFLYTGIGQFVAAYAPHEVFAALVNPLLIGILVIFCGVLVPYDQITAFWRYWMYYLDPFQYLLGGLVSRALWDVEVKCKSDEYAVFNPPEGMTCENYMSAFLSEAPGYLNNPNATSDCEYCVISKGSDYLKALNLEKKVDGWRDIALTFLFVLTSYGMVFLLLKLRSKRSKMAQ

SEQ ID NO: 38911 - protein, 103 aa, Picea abies
MSGRGKGGKGLGKGGAKRHRKVLRDNIQGITKPAIRRLARRGGVKRIRGLIYEEIRGVLKIFLENVIRDAVTYTEHARRKTVTAMDVVYALKRQGRTLYGFGG

SEQ ID NO: 38912 - protein, 394 aa, Triticum aestivum
  misc_feature (46)..(46): Xaa can be any naturally occurring amino acid
  misc_feature (73)..(73): Xaa can be any naturally occurring amino acid
  misc_feature (123)..(123): Xaa can be any naturally occurring amino acid
MIVTLMNFLRACWRPSSNRHARTGSDATGRQDGLLWYKDTGEHVNXGDFSMAVVQANNLLEDQCQIESGPLSXFLDSGPYGTFVGVYDGHGGPETACYINDNLFNHLKRFASEQNSMSADVPXKAYEATEDGFFSIVTKQWPVKPQIAAAGSCCLVGVICGGMLYVANVGDSRAVLGKHVKATGEVLAVQLSAEHNVSIEPVRKELQSMHPEDRHVVVLKHNVWRVKGLIQVCRSIGDAYLKKQEFNREPLYAKFRLREPFNRPILSSEPSICVQPIQPHDEFIIFASDGLWEHLTNQEAVDIVQSSPRSGSARRLIKSALLEAAKKREMRYSDLKKIDRGVRRHFHDDITVIILYLDSSLVSRASTHRGPAVSLRGAGVSLRSSTLAPYGSQM

SEQ ID NO: 38913 - protein, 225 aa, Debaryomyces hansenii CBS767
MSSATFTQTRSQALNLEKQADTLLSRYSAFQNLSNTSSSDEENELSDSIFENLQKRENVINTLNRISETDTNLSTSKLQQLQRHKEILSEHKRSYAKIKGVIKEERNRNNLLFSVRSDIDAHRERSTNNSNNRDLNANDYILDESVRADNANSFAERLLQQAYNTRDELYSQRAHLSNAQLRMMGAVLLIPGINVLISRINTRRKRDTLILATVIAICILVLFFF

SEQ ID NO: 38914 - protein, 469 aa, Psychrobacter arcticus 273-4
MSNKLLDLIKSSNAKWVDFRFTDTRGKEHHMSFPAHSVDEESMEDGKMFDGSSIAGWKGIEASDMILRPDPETAFIDPFFDAVTVVVTCDIIEPSTLQGYDRDPRSIARRAEEYLKSTGIGDTAFFGPEPEFFVFDEVKWSVGMSGVSHEIVAEEAAWSTNKDYEWGNMGHRPRVKGGYVPVPPVDSSQDMRTVMCDRIEDMIGEGCIEVHHHEVAPCQLEIGVAFNTLVRKADEVQKLKYAVHNVAHQFGKTATFMPKPIVGDNGSGMHVHISISKDGVNTFSGDEYAGLSETALYFVGGIIKHARALNAITNPSTNSYKRLVPHYEAPIKLAYSASNRSASIRIPHVSSPKAVRVEARFPDPAANPYLAFAALLMAGLDGIQNKMHPGEAADKNLYDLPPEEEALIPTVAENLEVALQALKDDHEFLLKGDVFTKEMLEAYIALKQEEVQRVNITVHPVEFDLYYSC

SEQ ID NO: 38915 - protein, 390 aa, Wolbachia endosymbiont of Drosophila melanogaster
MPDLKTMMLNFGPQHPAAHGVLRLVLEMDGEVIERADPHIGLLHRGTEKLIEHKTYLQALPYFDRLDYVSPMSQEHAYSLCVEKLLQCEVPIRAKYLRVLFCELTRILNHLLNVSSQALDVGAMTPLLWLFEEREKILEFYERASGARFHAAYIRPGGIAADVPEDLIEDIAKFIEQFPKYIDDVDELLTENRIWKQRTVGISEISIKQALDWGFSGPMLRAAGLAWDLRKSQPYEIYDQLDFDIPIGQNGDCYDRYLVRMAEIRQSISLVKQCIEKMPEGQIKTEDRKISPPSRAEMKKSMEALIHHFKLYSEGYHVPEGEAYAVVEAPKGEFGVYIVSDGTNRPYRCRIRAPGFAHLQALDFMAKGHMLADVAAIIGSLDIVFGEIDR

SEQ ID NO: 38916 - protein, 404 aa, Zea mays
  misc_feature (120)..(120): Xaa can be any naturally occurring amino acid
  misc_feature (226)..(226): Xaa can be any naturally occurring amino acid
  misc_feature (318)..(318): Xaa can be any naturally occurring amino acid
EDRGRGRARRARAGLGSAGSLGRGRGGVRASGAHVVSQARLLLPGGQRSCTCSSEAARCGSGSGPSAERRPPPWPASDAGQPLRVQRWAEPILRRVLSSFVHVPSEFLHRRVRPHPRAKXGVSSSEPVIARRSGPLEGRIYRAAGNHGGPGAPGGPDTQPALPSPAGGPSPEPPPLILFFHGGSLAQSASRTAVHGHLCRPFATVTHGVAVSLAPPPTPGPRCRWXLRQPFVRSGGGGRARVFLSGDSSGGNIAHHVAVRAADAGINICGNILLNAMFGGTERTESERRLDGKYFVTLQDRDWYWKATLPEKACWEQXACNPFAPGGRRLTGRPGRKGLRLTIVSGLDLTCDRQLAYAEGLQQDGHHVKVVYREKATVGFYLLSNTDHYHEVMEEIGDFLAANL

SEQ ID NO: 38917 - protein, 154 aa, Brassica napus
  misc_feature (23)..(23): Xaa can be any naturally occurring amino acid
EILQRILKLRHSKESACTAAKTXVFLGYNEKREIPSLCKSVFGATCYLMEEKLAYSGNEQDMVLLHHEVEVEFPGSKRTEKHSATLLEFGEIKNGQMTTAMAKTVGIPAAIGALLLIEDKIKTRGVLRPLEPEVYLPALDILQAYGIKLMEKTE

SEQ ID NO: 38918 - protein, 874 aa, Candida albicans SC5314
MTMTTHFLYDRIRGCFLSSLVVGHVTFFVWFPGQPTRFSFDQLQTVTDAFKLDSSNLRKQLSDFLERENKLTLLASKDPLLSRNLTANANTEAKTKQSKIADESFAQLLQGLSGPPLTVAFASDGGNAEAVAKKVNRQALGRGLKSVVLQMDDLSVEDLPTETNVVFITSTSGQGEFPTNGKQFWDGVKNTTDLDLSGIRFSVFGLGDSQYWPRKEDKHYYNKPAKDLFAKLKLYGGVELADIGLGDDQDADGFSTGFNEWIPKIWAALGVDNVEGVEEPKPITNEDMKIGSDYLRGTIVEGLNDQSTGAISAVDQQLTKFHGIYMQDDRDIRDERKAQGLEPAYTFMVRVRLPGGIATPDQYLKMDELADERGNGTLKLTTRATFQLHGVVKHDLKPAIRGMNSALMDTLAACGDVNRNVMVSALPHNAKVHGQVSQIGALISEFLLPKTTAYHEIWLQGDDAGDKPGYREAWENRKEGPTKKKTLVAGNVLADVEPQYGVTYLPRKFKIVITVPPYNDVDVYAHDVGLIAIVEDNEVVGFNVLAGGGMGSTHNNKKTYPRTGSMLGYVSKDQVHIACEKIMLVQRDFGDRTNRKHARLKYTIDDLGVDVFKAKVEELLGYKFDEPRPFKIESNIDYFGWCKDELGYNHFTAFIENGRIENTPELPQKTGLRKIAEFLKSGNRSGEFRLTGNQHILISNVSDQDLDEVKKLLAQYKLDNTDFSALRKSSAACVAFPTCGLAMAESERYLPVLITKLEEALEEYGLRHDSIVMRMTGCPNGCARPWVAEVALVGKAYGAYNLMLGGGHHGQRLNKIYRYSIKEDEILDILKPLFKRWSLERNENEPFGDWCIRAGIIAETTEGKYFHDDIPEDA

SEQ ID NO: 38919 - protein, 556 aa, Arabidopsis thaliana
MTTQDVIVNDQNDQKQCSNDVIFRSRLPDIYIPNHLPLHDYIFENISEFAAKPCLINGPTGEVYTYADVHVTSRKLAAGLHNLGVKQHDVVMILLPNSPEVVLTFLAASFIGAITTSANPFFTPAEISKQAKASAAKLIVTQSRYVDKIKNLQNDGVLIVTTDSDAIPENCLRFSELTQSEEPRVDSIPEKISPEDVVALPFSSGTTGLPKGVMLTHKGLVTSVAQQVDGENPNLYFNRDDVILCVWPMFHIYALNSIMLCSLRIGATILIMPKFEITLLLEQIQRCKVTVAMVVPPIVLAIAKSPETEKYDLSSVRMVKSGAAPLGKELEDAISAKFPNAKLGQGYGMTEAGPVLAMSLGFAKEPFPVKSGACGTVVRNAEMKILDPDTGDSLPRNKPGEICIRGNQIMKGYLNDPLATASTIDKDGWLHTGDVGFIDDDDELFIVDRLKELIKYKGFQVAPAELESLLIGHPEINDVAVVAMKEEDAGEVPVAFVVRSKDSNISEDEIKQFVSKQVVFYKRINKVFFTDSIPKAPSGKILRKDLRARLANGLMN

SEQ ID NO: 38920 - protein, 838 aa, Xanthomonas campestris pv. campestris str. ATCC 33913
MSSPSIAPVTPDLVRLRATARDKDDAIAQAAQLLVAAGCVAPGYDASMRRREGLANTFLGHGLAIPHGVGEDRHLVRRDGIAVLQLPEGVEWNPGQTTRLVVGIAAQSDTHITLLRRLTRLIQDPAQLEALFTTDDPAVIVAALTGDRAPDTSAAPATDLAERFEWTIAYPSGLHARPATRWAETARGFSARAQVRAGDQAADAKSLVGLLQLGLRAGDSITVSAKGSDAPALLKRLRAVMDSLTAQEKADAERAAQRRAAPVIGWTPPQAQPAIVGIGASPGVAIGIVHRLRAAQTEVADQPIGLGDGGVLLHDALTRTRQQLAAIQDDTQRRLGASDAAIFKAQAELLNDTDLITRTCQLMVEGHGVAWSWHQAVEQIASGLAALGNPVLAGRAADLRDVGRRVLAQLDPAAAGAGLTDLPEQPCILLAGDLSPSDTANLDTDCVLGLATAQGGPTSHTAILSRTLGLPALVAAGGQLLDIEDGVTAIIDGSSGRLYINPSELDLDAARTHIAEQQAIREREAAQRALPAETTDGHHIDIGANVNLPEQVAMALTQGAEGVGLMRTEFLFLERGSTPTEDEQYQTYLAMARALDGRPLIVRALDIGGDKQVAHLELPHEENPFLGVRGARLLLRRPDLLEPQLRALYRAAKDGARLSIMFPMITSVPELISLREICARIRAELDAPELPIGIMIEVPAAAAQADVLARHADFFSIGTNDLTQYVLAIDRQNPELAAEADSLHPAVLRMIRSTIDGARKHDRWVGVCGGLAGDPFGASLLAGLGVQELSMTPNDIPAVKARLRGRALSALQQLAEQALQCETAEQVRALEAQREGQA

SEQ ID NO: 38921 - protein, 427 aa, Legionella pneumophila str. Lens
MKVNDRFNALKILTALIESRKNLSYLMSPQEISPMTKEICYGFCRHYFRLQSIADTLINKRPKDNEVWIVLLIGIYQLQYMNKPDYAVVKETVSLLGQVKKSWAKGLVNAVLRNFCRRQDHILEKLAAEPVFIYGQPNWLLQRLQKNWPNDWQFIAEANDRHPPMTLRVNVLKHSVDEYLDLLKKSGIEAFKHPVAPDGITLAIPCDVMTLPGFAQGSVSVQDAAPQLAAYLLSLKPGQRVLDACCAPGGKTCHILEKESGLASCVALDLDPQRLQRVRDNLNRLDLQATVVEGDVLEPRSWWDGHPFDRILLDAPCSATGVIRRHSDIKLLRTDEEISAISQVQSSMLNSLWPLLAPGGLMVYATCSIMSDENELQIARFVAEHSDCQVSDGKWSWGRWTGHGQQILPGEHGMDGFFYSVLRKDEK

SEQ ID NO: 38922 - protein, 598 aa, Prochlorococcus marinus subsp. marinus str. CCMP1375
MTTENIQSEDIKDPELFPCIANGQDRSKFEQFKADSNYLKEPLASELKNESNHFSNDAVQLLKFHGSYQQDNRENRKKGLDKDWQMMLRLRSPGGYIPAELFVALDDLSNRFGNKTLRATTRQAFQMHGIRKENLKEVISTIVKSMGSTLAACGDINRNVMAPAAPYNKGGYPAARKLANEIADLLIPLTAEGTYLELWADGDLTYKICPSKKVQDTRKQQFSKGLFSGDSQEPLYGSTYLPRKFKCAVTVPGDNSVDLLTHDIGLVAFTKNNGELKGCNVYVGGGMGRIHNTETTFARIADPLGYIDAKDVLSLVQSILTLQRDFGNRKLRKNARMKYLLHNKGLKWFKNKLISKYFFKGLQEIHPEPTTRLKDYLGWNKQSKGLYFVGIPLISGRLSGDIKEIIRCVVEKYQLEIRLTPNQDLLLCNIGNYQVSSIKKELAGINIPAPSSMNDISRHAIACPALPLCGLAITEAERFLPELINRIDIQLKKLKIQKSILLRMTGCPNGCARPYMAELALVGSGVNQYQLWLGGSPNLQRLAKPYLQKMHIDKLEATLEPLFINWKQNSLETSFGDYISSLSDQLIMDLLSDSSTAP

SEQ ID NO: 38923 - protein, 224 aa, Candida albicans SC5314
MSSSTFSQTRSQALSLEKQTEQLLSKFSQFQQQQQQNQSQSLDITPEETIIRQQIEEIFQKRNAVISKLNRISEVEPNLSTSKLQQLTRHKEKLNDDNLSFTKIINNIEDERNKNNLLFNVHRDINHHKQQRNIDGNAYILEESERVNNVNSIADRLLQGAFATRDELLNQRQYLNNAQSQVLSTMQNIPGLNVLISKINTRRKRDTLILASVIAICILFLFFV

SEQ ID NO: 38924 - protein, 157 aa, Arabidopsis thaliana
MKADPRKETGIKLVAVEISLTFGNRKWQPHKNSGAKDEEAKFNKRTKYKMRIRPRSSISKRRRLIGGKTLTCVSNSGLSAYTTDQSLRQLFAPFARLIKDQQTQRPKGFGFITFESEDDAQKALKALNGKIVNGRLIFVETAKEVEAPTTSLKSNKD

SEQ ID NO: 38925 - protein, 500 aa, Oryza sativa (japonica cultivar-group)
MAPPPVNSGDAAAAATGEKSKLSPSGLPIREIPGGYGVPFFSPLRDRLDYFYFQGAEEYFRSRVARHGGATVLRVNMPPGPFISGNPRVVALLDARSFRVLLDDSMVDKADTLDGTYMPSRALFGGHRPLAFLDAADPRHAKIKRVVMSLAAARMHHVAPAFRAAFAAMFDAVEAGLGAAVEFNKLNMRYMLDFTCAALFGGEPPSKVVGDGAVTKAMAWLAFQLHPIASKVVKPWPLEELLLHTFSLPPFLVRRGYADLKAYFADAAAAVLDDAEKSHTGIPRDELLDNLVFVAIFNAFGGFKIFLPHIVKWLARAGPELHAKLATEVRATVPTGEDDGITLAAVERMPLVKSVVWEALRMNPPVEFQYGHARRDMVVESHDAAYEVRKGEMLFGYQPLATRDEKVFDRAGEFVADRFVAGGAAGDRPLLEHVVWSNGPETRAPSEGNKQCPGKDMVVAVGRLMVAELFRRYDTFAADVVEAPVEPVVTFTSLTRASSG

SEQ ID NO: 38926 - protein, 473 aa, Debaryomyces hansenii CBS767
MKSFKHQTKSFDENARIKSKSNTSAKLISKNSNNNNANNITSSIDKREALGDLTQLNENRKIDLNLKTSLQKVHIYKQKHQKRPHEELGTKTELGTNEHYDNSQNSDDVLKFHFDRLGGSSDVSNLEDIGFEFANQNRIVEQFDDDEEEIVQVDPEVDEEEEEEEEEEEEEEEDYSKPMEPKWNKAIFNELQYVMKKFSKNTLDETDEDTFDVTMVAEYAPEIFNYMHELEYRLVPDLNYMSNQDELKWEMRSVLIDWVVQVHNRFNLLPETLFLTVNYIDRFLSKRKVSLSRFQLVGAVALFIAAKYEEINCPTVQEVAYMADNAYTVDEFLKAERFMIDVLEFDMGWPGPMSFLRRTSKADDYDYETRTLAKYFLEITIMDSRFVASQPSWLAAGAHYLSRKLLNRGHWTEAHVYYSGYTESQLRPLAEILLQNCRNAESNHKAIFEKYQERRYRRSSAFVQEYFEALEQL

SEQ ID NO: 38927 - protein, 247 aa, Glycine max
  misc_feature (115)..(115): Xaa can be any naturally occurring amino acid
MVLVERLVDRKAEIMESLLVRIGTAREEMKHVKNFDYVVVNAKGKLDNAVKLMESIIDARKLGFVRGLYNGQSTCEAGKKLYSLIALSLNMDEDFFDKIGAVDKPSAFLRLLRYXPGEMGPHQEICSAHSDTGALTLLMTDGVPGLQICRDKLKEPRVWEDVPYMEGAFIVNIGDLMERWTNCLYRSTMHRVKRTGKERYSMAFFLDPHPDCVVECLKSCCSESCPPRFTPIRSGDYMDEILSNTPV

SEQ ID NO: 38928 - protein, 360 aa, Vibrio sp. Ex25
MKDNTPASSPERWIIYGANGYTGELIAREAVKRGHHPILAGRSLEKVQSLAAELGLRSLAFSLEDKNSAVQHISGSSLVLNCAGPFSSTAKPMMKACLEAGAHYLDITGEISVFEFAQTLQSQAKEAGVVLCSGVGFDVIPTDCIAATLKAELPDATHLSLGFDSRSGFSPGTAKTSVEGLAQGGKVRLNGKITTVPLAYKVRNIDFGDGEKLAMTIPWGDVSTAYYTTGIENIDVFVPGSPNMIKNAKRANWVRPLLGITWVQSLIKSRIERTVKGPNEEQRNQLPTYVWGKASNKLGQSKTARVQTANGYSLTVTGSLAIVEHLLHTKPEAGVYTPSKLMGSSFVSQLPGSSDITIEE

SEQ ID NO: 38929 - protein, 185 aa, Ustilago maydis 521
MSTPSKKRLIRDFKRLSTDPPGGISGAPCADNLMIWNAVIFGPADTPFEDGTFKLVLTFDESYPNKPPTVKFLSKMFHPNVYANGELCLDILQNRWSPTYDVAAILTSIQSLLHDPNPNSPANAEAASLYRENMKEYVRRVKATVEASWLDDGEMPESIEEDDEAEAEAEAEATVDRSAPQTASA

SEQ ID NO: 38930 - protein, 1060 aa, Thermosynechococcus elongatus BP-1
MLSKLSFRHKLLLGTLFPIVVIYTGLFFYIRSQVIRRSTADYEAWQQDVASLYAQQFSNALQEITGLATTSANALEAFPTIREEELYSFLRRNLKISRLAYGAAITFTPYSFSPRKRLFAPYVYRDIHRNRLVPKDIGHIYDYTQVRWDWYSEAVRTGQPQWSDPYFEEGAGNVWMVTYAVPFYRQGQIRGVATVDVALPTLQQEIDIQGLQQAQFFVLDRKGRIIFHGDPQLIGQSIFYIAKEYNRSDLAALAEAMISGHSGHLWMTDWVSNERQWFFYTPIPEVGWSLAIRVREEALLDFIHQETWAGLLILVVSFGLISLVTLGVTSYMVRPIQRLAIAAHKIALGNLDIAGEVDTHSQDELGNLGRTFVDMAAQLQESFAELHHFNQRLEEKVKQRTAALEAANQQLSEKERVLHDHNVALVQLSQSPHVQQGHFRMALQEIIQVTAITLRVQRASAWELQGDRLKCVVQYDPAANNHTQPTYLTHSPYPEYLKLLRSGEPLVINDLLTDPRTHELREYARVQRVYSRIDTPIIFNGQLLGVICVESIGKQRVWLLEERRFVANVADIVTIALAAHQRHQAERELLKAKEAAEAANKAKSIFLANMSHELRTPLNAILGFSQILLSDRTLAPQHRQTLEKINRSGEHLLGLINDVLDMAKIEAGRMILQQTTFDLRRMLRDLEEMLKVRAEAKGLRLVFDLAANLPVAVTTDEMKLRQVLVNLLGNGIKFTKEGSVCLKVSYRAQEPPRLAFEVSDTGIGMTPQELKMLFQPFVQTDSSKKVSEGTGLGLAISRQFVQLMGGDIQVRSTKGKGSHFYFEVPIDLGDPRSLEEEKAQTIVGLRSPTSEVRILVVDDLPENRQLLTQLLEPVGFRCREASNGQEAVEIWRAWQPHAILMDIRMPVMDGKTATRQIKKEVGDRLQRGETICPPKILAVTASSFEQDKQELLGLGCDDYIAKPFRPQILFERLAAQLHLEYAYDSTPPAAPPPPTLDPTALTVMPPSWIAELQAAAKKLNAKRIRELIAEIPPEEAALIAGLQQLVKTFRFDKIVELTLV

SEQ ID NO: 38931 - protein, 375 aa, Methanosarcina acetivorans C2A
MTQYKVPVLPGDGIGPEIIAEGKKVIDAAGERFGFDVEWIEYPHGADHYLKTGELISEETLKELSGYPAIYLGSIGDPRIAPGVLEKGILLTARFYFDQYINLRPIKLLEGVWTPIKDKTAKDIDFVVVRENTEDFYIGVGGRAKKGESKDLLEVKRTLYSAKFGLDIETDSEEIGYQIGLISKEGTKRVIEYAFDLAENRKKHVSSVDKANVLSDIYGFWREEFNAVAAAHPDITTDFNFVDAITMWFVKNPEWFDVVVTPNMFGDIITDLGAMIQGGLGLAPGGNINPKGTSMFEPIHGSAPKYKGQNKVNPIATIWAGAMLIEQLGEKEAADTIVNAIQKNILEGKVKTYDMGGKNTTSDVGDDIARIVKGE

SEQ ID NO: 38932 - protein, 149 aa, Arabidopsis thaliana
  misc_feature (102)..(102): Xaa can be any naturally occurring amino acid
MSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFXGRQTVYAPGWRQNFNTREFAEIYNLGLPVAAVFYNCQRESGCGGRRL

SEQ ID NO: 38933 - protein, 431 aa, Prochlorococcus marinus subsp. marinus str. CCMP1375
MKRVLAIILGGGKGSRLYPLTKMRAKPAVPLAGKYRLIDIPISNCINSNITKMYVLTQFNSASLNRHLAQTYNLSSPFAQGFVEVLAAQQTPESPSWFEGTADAVRKYQWLFQEWDVDEYLILSGDQLYRMDYSLFVEHHRETGADLTVAALPVDGAQAEGFGLMRTDNDGNIREFKEKPSGEALKAMAVDTSRFGLSPDSAKERPYLASMGIYVFSRSTLFDLLNKYPSYKDFGKEVIPEALSRGDALKSYVFDAYWEDIGTIGAFYESNLALTQQPTPPFSFYDEKFPIYTRARYLPPSKLVDAQITDSIVGEGSILKSCSIHHCVLGVRSRIESDVVLEDSLVMGSDFYESAEERIALRKGGGIPLGVGQGTTVKRAILDKNTRIGENVTIINKDRIEEADRADQGFYIRNGIVVVVKNASILDGTII

SEQ ID NO: 38934 - protein, 516 aa, Cryptococcus neoformans var. neoformans JEC21
MSNACLSSSLSAISDCYAFVFDFNLRLNFDLNFTRMNHGYDSEDEFDHYAAPPPLPGGPAGILSHLMGGGFGGFHSAPPPSAYDDYFKAYSTAVMGGRERPEVMYGGKIIMPPSALARLSALDIPSPWTFQLRNPRSPTQHITHAGVLEFIAEEGIVHLPAWMMKRLNLEEGDPIRLTGAKLPKGKMVKIQAQNTDFLQVSDPKSVLESALRFYSTLSPDDIIEITYNSLTFEFLIMSVVPEGPGISVIDTDLEVDFATPKGYVEPPRPEPKPIPTMADKLNIDLSSNEPTGSGAGSVSGGSRPGTSMGTQTPVESFTGVGQSLSGKKVKGKGLAKKIEEVDPSSKINRADGPRIINSSSLSSTNTQVPSALILPEGKFFFGFKYIPYDPSKAPKPSLADQQKVELQPFGGEGNTLKGGKRIGGEEGKGKEKAAEDEKEDPWAKLGSGNTLKRTTTTAASSSSTPAPVSAPLEEFKARKATEQEIIDATMLDEDDFMFEDEEDDEDDVIEIDSDYD

SEQ ID NO: 38935 - protein, 241 aa, Glycine max
MLGKTRKVSARGEAVAANYAFGPSEDDVIIKHRLLTRTTTTRGDPPLKKLQKKFTTFVSEVDKDEDINYNDCEKLARAFLQELTTFEIPLLKSKAIVEANVREKENFNELKEEMNRQILLAQSDIEDLKKQLEESKVERRHKEECEAIRKLIAMQPPRSETMKVISELEKEIAALDAENTAGSRLLELRKKQFALLLHVVDELQNTIEEEQKSLVEEMRMATEELKNGMVDTNGGAEAMAI

SEQ ID NO: 38936 - protein, 157 aa, Zea mays
MASPLRRSFPSLGRALLTPAPARMLSAEASDALVEIKPREIGMVSGIPEEHLRRKVVIYSPARTASQQGSGKVGRWKINFLSTQKWENPLMGWTSTGDPYANVGEAGLTFNSAESAKAFAEKHGWNYVVRKRHTPLLKPKAYAENFKWKGPPKAEQA

SEQ ID NO: 38937 - protein, 461 aa, Xanthomonas campestris pv. campestris str. ATCC 33913
MQQSLKQHSLRAVLALLALACVPAVAADKAAEPNTQVPLGSTHYVADGFPDRIVATPAQDAARGFAVAWRTDASVTAPWLELVVAGDSPDVGTPRRIQATTATLSSENGASHHHRADIDGLTPDTLYAYRVQGHGTWGAWNHFRTAATPGTPLTLLYFGDTQNKNLSLVSRLIRQAWRSAPEARLALFAGDLVSGKDGQDDNEWAEWFEAGRWLLEGTAVAPAPGNHEYHEDAEDTPQATRTLGGHWPVTFALPRNGPAATARTSYWFDYQGVRIAVLDGTSALDLGTGQAQAQWLDGVLADNPHPWSIVLIHQPFFSPRADRENQKLVEQVLPVIRRHKVDLVLQGHDHTYGRRGDDGGQPTPVFVVSVAGPKQYRLSDMARKTMRPVGEDTQLYQVLRIDQQKLVYESRTATGRLYDAFELQRRADGSKQLIEHEAGRIAPRDCPRSATLKGRADRCWE

SEQ ID NO: 38938 - protein, 489 aa, Mycobacterium bovis AF2122/97
MSAASQRVDAFGEEAGYHKGLKPRQLQMIGIGGAIGTGLFLGASGRLAKAGPGLFLVYGVCGVFVFLILRALGELVLHRPSSGSFVSYAREFFGEKAAYAVGWMYFLHWAMTSIVDTTAIATYLQRWTIFTVVPQWILALIALTVVLSMNLISVEWFGELEFWAALIKVLALMAFLVVGTVFLAGRYPVDGHSTGLSLWNNHGGLFPTSWLPLLIVTSGVVFAYSAVELVGTAAGETAEPEKIMPRAINSVVARIAIFYVGSVALLALLLPYTAYKAGESPFVTFFSKIGFHGAGDLMNIVVLTAALSSLNAGLYSTGRVMHSIAMSGSAPRFTARMSKSGVPYGGIVLTAVITLFGVALNAFKPGEAFEIVLNMSALGIIAGWATIVLCQLRLHKLANAGIMQRPRFRMPFSPYSGYLTLLFLLVVLVTMASDKPIGTWTVATLIIVIPALTAGWYLVRKRVMAVARERLGHTGPFPAVANPPVRSRD

SEQ ID NO: 38939 - protein, 613 aa, Clostridium thermocellum ATCC 27405
MCGIAGWINLKSDLTNQKEILNSMIDRLTPRGPDASGSWISPNALIAHKRLIVVDPEGGIQPMVRRQGENTYVITYNGELYNTADLRNELESRGHEFLTSSDTEVLLVSYIEWGAKCVEHLNGIYAFGIWDEGKKRLFLGRDRFGVKPLFYAQRGDSLIFGSELKALLANPLVEPKLDAEGLAEIFALGPARTPGHGIFKDVYELKPAHSMIFDINGIQIRKYWSLESYPHTDSEKATISKVRDFVLDAITRQLVADVPVCTFLSGGLDSSAITAVASKTFASQGKGQLNTFSVDYVDNDIYFKPSMFQPNSDEPWIKKMSESFNTCHHYVKFDTPQLVDALIDAVKARDLPGMADIDSSLFLFCREVKKFSVVALSGECADEIFGGYPWFHNEKMLFADTFPWSVSVHERTKILSPEILNLIKPEEYIQRRYRETLSEVPHLKGENRIEARRREIFYLNINWFMATLLDRKDRMSMASGLEVRVPFCDHRLVQYVWNIPWELKMYNKREKGLLRQALKGILPDDIIERKKSPYPKTHNPSYKKAVSKWLLEILNDSSSPLHQLIDVKVVRSMAEGNSDNTDPWFGQLMAQPQMLAYLIQVDFWLRDNHISIV

SEQ ID NO: 38940 - protein, 143 aa, Zygosaccharomyces pseudorouxii
GVGFLDHMIHALAKHSGWSLIVECIGDLHIDDHHTTEDCGIALGDAFKQALGQVRGVKRFGFGFAPLDEALSRAVVDLSNRPYSVIELGLKREKIGDLSCEMIPHFLESFTEAARLTVHVDCLRGFNDHHRSESAFKALAVAL

SEQ ID NO: 38941 - protein, 335 aa, Bacillus megaterium
MAVKIGINGFGRIGRNVFRAALKNDNVEVVAINDLTDANMLAHLLKYDSVHGKLDAEVVVDGSNLVVNGKTIEISAERDPAQLSWGKQGVEIVVESTGFFTKRADAAKHLEAGAKKVIISAPASDEDITIVMGVNEDKYDAANHNVISNASCTTNCLAPFAKVLNDKFGLKRGMMTTVHSYTNDQQILDLPHKDYRRARAAAENIIPTSTGAAKAVSLVLPELKGKLNGGAMRVPTPNVSLVDLVAELDKEVTVEDVNNALKEAAEGDLKGILGYSEEPLVSGDYNGNINSSTIDALSTMVMEGNMVKVISWYDNESGYSNRVVDLAQYIAAKGL

SEQ ID NO: 38942 - protein, 391 aa, Cytophaga hutchinsonii ATCC 33406
MIIPAANRLNVVKEYYFVRKLEEIAKLNKEGKNVISFGIGSPDLAPSEATVDALVATSRLSNAHGYQPYRGIPELRDSIASFYKNTYGVELDSNTEVLPLMGSKEGILHVSMAFLNPGDEVLVPDPGYPTYTSLTTLIGGVVRKYALSEKNNWHPDLEELKKQDLSKVKLMWLNYPHMPTGAEADRAQIEKIIAFAKEYKILLCFDNPYSLVLNQNKPFSILSIPGATEVAVEFNSLSKSHNMAGWRIGMMVGSPIYLNPALTVKSNIDSGMYLGLQKAAIEAFKNTEAWHAERNKIYADRREKIFGILDKLGFEYSRKQVGLFVWCKPKDAAAIGDIPAYVDRLLNEAYVFFTPGAIFGEKGEGYLRASLCVPIEKITEAEARIDAWLKK

SEQ ID NO: 38943 - protein, 294 aa, Acinetobacter sp. ADP1
MYLLIKKLSSMHRYAKSKDTKAKLAPKQKISYEKKADPAITEYSVKSLNWLRKAEFLMSAPKLSLCVEDTGYEIAFAGRSNAGKSSAINSLTNQKQLARASKKPGRTQMINFFSLGNPDQRLVDLPGYGYAAVPEDMKRIWQKELENYLIHRQSLQGLVLLMDIRHPLQHFDTMMLEWAHSRKLFVHILLTKADKLNRGPANQVLLDVKQTLKKMKLSFSIQLFSSLNKQGLEELASVMAGRLNYTLDKTLDFDLDAIPEATEDDLNDELMDQDETSEFNTENIDDHLDQEPKI

SEQ ID NO: 38944 - protein, 591 aa, Clostridium thermocellum ATCC 27405
MAHKVLILGAGYAGIEAALTLHKKKRKKDDIEITIIDKNPYHTLLTELHEVAGNRITEDAVIVPLKDIFAYTDVKIVKDEIKNIDLENNKLISDTNEYQYDYLIFAVGSEPNYYGIPGMEEYAFPLWSFKDAVAIREHIKDCFDKASRTTDPETRKTLLTFVVGGGGFTGVETIGEIAHWVKSLCREYNIKREEVDLKLIEALPKILSNLKDKNINKAMKYLTNTLKVDVLLNSAISKLNEDSVELKDGRKIPTKTLIWTAGVRACCLNDNLSLEKGRACRIKVDKYAATQFKNVYAVGDASCFEYNGHTLPALVEAALQTGKGAALNVLNDIRGKEREEIKPKLHGVMVSVGSFFAVAEIMGVLLPRFLAILMKYLVNIHYLFGIGGFELVFKYIRHEFFQKKQDKFLLEKHYSVTSPTFWLVPLRLFLGYSWLMEGLNKLKEGWLSTPMLAGMAVDGQTSASVTETGEKVFRIISSHTPSWYAFIAEKLVIPNALFFQWLIVLAEIGLGIAFISGTFTFLAGLGALALNINFLLSTGLYETSWWFIPAAICMLAGAGRSFGVDYYLIPYLMRQWRYFVRNQKIKLFLFR

SEQ ID NO: 38945 - protein, 947 aa, Eleocharis vivipara
MERVCLHAIHGACKPDMDGNIRFGRKKRHLYKRLSSCRVRAMKLDQSGFEASRKQSSYALKAIATPMAVTTKKRVFTFGKNKTEGNKGMKELLGGKGANLAEMSSIGLSVPPGFTVSTEACQQYQESGHKMPPGLWDEIIDGLKWVQQDMGARLGDPEKPLLVSVRSGAAVSMPGMMDTVLNLGLNDEVVSGLAKKSGERFAYDSYRRFIDMFGDVVMGISHEHFGDKLEEMKATKGVKNDTDLSANDLKELVVQYKEVYAKAKGEPFPTDPMKQLSLAVLAVFDSWDSPRAKKYRSINKITGLKGTAVNVQCMVFGNMGNTSGTGVLFTRNPSTGEKKLYGEFLVNAQGEDVVAGIRTPQELETMKDYFPQAYQELVDNCKILESHYKDMMDIEFTVQENRLWMLQCRTGKRTGKAAVKIAVDLVSEGLVDTRTAIKMVDPGHLDQLLHPQFENPKAYKDKVIASGLPASPGAAVGQVVFTAEDAEMWHAQGKAVILVRTETSPEDVGGMHAAAGILTARGGMTSHAAVVARGWGKCCVSGCSDIRVNDAEKVLLVGDKKLQEGEWISLNGSTGEVIMGKQPLSPPALSGDLGTFMAWVDEVRQIGVMANADTPEDALAARNNGAQGIGLCRTEHMFFASDERIKAVRQMIMSGTVEQRQKALDRLLPYQRSDFEGIFRAMDGLPVTIRLLDPPLHEFLPEGNIEDIVREMASETGSAEEEVFSRVEKLSEVNPMLGFRGCRLGISYPELTEMQARAIFEAAITMSNQGVKVLPEIMVPLVGTPQELGHQVSLIRQVADKVFSATGTSVSYKVGTMIEIPRAALVADEIAEHAEFFSFGTNDLTQMTFGYSRDDVGKFLPIYIAHGILQNDPFEVLDQKGVGELVKLATERGRKTRPDLKVGICGEHGGEPSSVAFFAKSGLNYVSCSPFRVPIARLAGAQVVVQK

SEQ ID NO: 38946 - protein, 884 aa, Eleocharis vivipara
MAPSAPVVGAQRVFTFKNKTEGNKGMKELLGGKGANLAEMSSIGLSVPPGFTVSTEACQQYQETGHKMPSGLWDEIIEGLNWVQQDMGARLGDPEKPLLVSLRSGAAVSMPGMMDTVLNLGLNDEVVAGLAKKSGERFAYDSYRRFIDMFSDVVMGIPHEHFGEKLEEMKATKGVKNDTDLSADDLKELVVQYKEVYAKAKGEPFPTDPMKQLSLAVLAVFDSWDSPRAQKYRSINRITGLKGTAVNVQCMVFGNMGNTSGTGVLFTRNPSTGEKKLYGEFLINAQGEDVVAGIRTPEELDTMKDCFPQAYQELVENCKILESHYKDMMDIEFTVQENRLWMLQCRTGKRTGKAAVKIAVDLVSEGIIDTSTAIKMVDPGHLDQLLHPQFENPKAYKDKVIASGLPASPGAAVGQVVFTAEDAETWHAQGKAVILVRTETSPEDVGGMHAAAGILTARGGMTSHAAVVARGWGKCCVSGCSDIRVNDAEKVLLVGDKKIQEGEWISLNGSSGEVILGKQPLAPPALSGDLGTFMAWVDEVRQIGVLANADTPEDALAARNNGAQGIGLCRTEHMFFASDERIKAVRQMIMSGTVEQRQKALDLLLPYQRSDFEGIFRAMDGLPVTIRLLDPPLHEFLPEGNIEDIVREMASETGSAEEEVFSRVEKLSEVNPMLGFRGCRLGISYPELTEMQARAIFEAAITMSNQGVKVFPEIMVPLVGTPQELGHQVSLIRQVADKVFSAAGTSVAYKVGTMIEIPRAALVADEIAEYAEFFSFGTNDLTQMTFGYSRDDVGKFLPIYIAQGILQNDPFEVLDQKGVGELVKLATERGRKTRPDLKVGICGEHGGEPSSVAFFAKSGLNYVSCSPFRVPIARLAGAQVVVQK

SEQ ID NO: 38947 - protein, 377 aa, Glycine max
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNAPAMYVAIQAVLSLYASGRTTGIVLDSGDGVSHTVPIYEGYALPHAILRLDLAGRDLTDALMKILTERGYSFTTTAEREIVRDVKEKLAYIALDYEQELETSKTSSAVEKSYELPDGQVITIGAERFRCPEVLFQPSMIGMEASGIHETTYNSIMKCDVDIRKDLYGNIVLSGGSTMFPGIADRMSKEISALAPSSMKIKVVAPPERKYSVWIGGSILASLSTFQQMWIAKAEYDEAGPFIVHRKCF

SEQ ID NO: 38948 - protein, 320 aa, Candida albicans
MSGPVNSVSKQMNVDTDIITLTRFILQEQQTVAPTATGELSLLLNALQFAFKFIAHNIRRAELVNLIGVSGSANSTGDVQKKLDVIGDEIFINAMRSSNNVKVLVSEEQEDLIVFPGGGTYAVCTDPIDGSSNIDAGVSVGTIFGVYKLQEGSTGGISDVLRPGKEMVAAGYTMYGASAHLALTTGHGVNLFTLDTQLGEFILTHPNLKLPDTKNIYSLNEGYSNKFPEYVQDYLKDIKKEGYSLRYIGSMVADVHRTLLYGGIFAYPTLKLRVLYECFPMALLMEQAGGSAVTIKGERILDILPKGIHDKEFYCVGIQG

SEQ ID NO: 38949 - protein, 477 aa, Candida albicans SC5314
MSALFAVSRSAIALRSIAPRSSTATTSSFLALARLYSSGKFPPHTVINMPALSPTMTQGNIQSWAKKVGDELTPGEAIAEIETDKASMDFEFQEEGYLAKILLDAGAKDVPVGQPIAVYVEDAGEVAAFENFTAADAGEAPKPAPAAEEEAPKKEEPKASTSTSAPASTPSPSSKKAPTDRIIASPFAKTIALEKGISLKGIKGSGPNGRIVAKDLEGVEPQAAAAAAPAAAAATAGAAPSATASYEDIPITSMRKTIASRLLQSTQQSPSYIIQSQISVSKLLKLRASLNATAEERYKLSINDLLIKAIAKTCVRIPEVNAAWLGEQGVIRQYKNVDVSVAVATPTGLITPIVTNAESKGLAEISNQVKDLGKRAKVGKLLPEEFQGGTICISNLGMNHAVTAFTSIINPPQSAILAIGTTEKKAVPSEVNEQGFVFDDVITITGTFDHRVIDGALGGEWMKELKRIVENPLEMLI

SEQ ID NO: 38950 - protein, 318 aa, Clostridium thermocellum ATCC 27405
MSSSHYPEIEKELVLLEKFIQKNIRSRNRLLNEAVSSIVKSGGKRLRPAFVILASQFGKYNRKKVIPAAAAIEILHTATLIHDDVVDRTKFRRGQVTISEKFGVDMAVYVGDYLYTKAVLLLAGNVPEKRLSILAKGIKAICEGEVDQYQHKYSIDTSVYTYLKRIGRKTAVLFSAACALGAYIAKCPQEVSRSLVKLGLYYGMAFQIKDDINNYTKAQYEEDKPVGNDILEGIITLPVILGLKLKPELREPLKNFLDKKGNVTEDEAARVVQLIKESGGVEESRVFLNKYVEKALKEIQNLPDNEYKKAFERIIKAL

SEQ ID NO: 38951 - protein, 530 aa, Bifidobacterium longum NCC2705
MPISPIWPAATAVNAEGSIEFHGRTAESLLDEFGSPLYLIDTDEVVARARHFVRAAAEAFNTSTTHVSFAGKAFLSKEVVRLVTEAGMFVDTCTMGEMKIALAAGVPGRRLVLHGNNKSDEEIALAIEQGFAKIVIDEPDEPERVAAIARKLGKRARVMLRVTVGVHAGGHEYISTAHEDQKFGVPLLAAGADAAVLDVLNDLKDVTPAATNARISATHSPENGAEKTEKSERELHYDVKYPYDLSHEEVSDTDKALAAAMEAIADGPSIAVLKTILANQDVLELVGAHSHIGSNIHDADAFIHAAKRMMLLRKTLWATDAYILPEIDLGGGYSVAYTDGEDSMDIDVELTRLADAVNSTNRALGMPAPAISFEPGRYIVAPAGVTLYRVGTIKHVHLSDAKDSDGNPIAERVYVSVDGGMSDNIRPALYGADYTARLANRTGSAETMLARVCGMHCESGDIVVHEVQLPADLKRGDILAVPVTGAYGRTMASNYNQALIPAVVAVSESGAHVMLRRQTVDDLLNLDVSE

SEQ ID NO: 38952 - protein, 127 aa, Triticum aestivum
VIRKGSDITLIGWGAQLAVLEQACEDASKDGISCELIDLRTLIPWDKETVEASVSKTGKLLISHEAPITGGFGAEIAASIAERCFQRLEAPVARVCGLDTPFPLVYEPFYMPTKNKILDAIKATVNY

SEQ ID NO: 38953 - protein, 532 aa, Oryza sativa (japonica cultivar-group)
MEVGTWAVVVAVAAAYMTWFWRMSRGLSGPRVWPVVGSLPGLVQHAENMHEWIAANLRRAGGTYQTCIFAVPGVARRGGLVTVTCDPRNLEHVLKSRFDNYPKGPFWHAVFRDLLGDGIFNSDGETWVAQRKTAALEFTTRTLRTAMSRWVSRSIHHRLLPILDDAAAGKAHVDLQDLLLRLTFDNICGLAFGKDPETLAKGLPENAFASAFDRATEATLNRFIFPEYLWRCKKWLGLGMETTLASSVAHVDQYLAAVIKARKLELAGNGKCDTVAMHDDLLSRFMRKGSYSDESLQHVALNFILAGRDTSSVALSWFFWLVSTHPAVERKVVHELCAVLAASRGAHDPALWLAAPFTFEELDSLVYLKAALSETLRLYPSVPEDSKHVVADDYLPDGTFVPAGSSVTYSIYSAGRMKTVWGEDCLEFRPERWLSADGSKFEPHDSYKFVAFNAGPRICLGKDLAYLQMKNIAGSVLLRHRLAVAQGHRVEQKMSLTLFMKNGLRMEVRPRDLAPVADELRGADVRATAPCA

SEQ ID NO: 38954 - protein, 374 aa, Candida albicans SC5314
MLRLGLTRSFRATSASLKTVRVGIPSNIATRSPLIYSSIRFNSSTTTSGTEIQDKLTSFDDTTTSAILENVTNLHSDQLGYLQSIGLAQGWGPTSLIERLLEVTHVYTGLPWWGTIVVATIAVRLVLFPLYVRASSNATKMSKIKPQIDELLQQIKTGDTVDQMRAMEKRRLIMKENGVSTLATLFPAVQLPLAYGFFQALRKMANHNVEGFSDQGYAWFQNLIEVDPYLGLQAISAAAIIAVVRVGGETGQHAMAAGMKKVMTVVPIASIFITKGFASAIILYFAVNSIFSLIQSSLFKSSWFRKIAGMPPKLSLAEMQANNPKANQSIKDMVSKFVDDSKEKSIKQARETNKKLEATQRRKDSVNQGFIKRH

SEQ ID NO: 38955 - protein, 380 aa, Spiroplasma citri
MVMGKRDYYEVLGVNRNATDDEIKRAFRQLAKKYHPDVSKEKDAEAKFKEINEAYEVLSVPNKRRNYDQFGHAGTDPNGFGGFSHGFSSTGDFEDIFSGGFGGFGDIFENFFGGGKKRRGFSNQPIKGENIAARVTLTLKEQMFGKKINLDLNIDKKCEMCDGTGAKDPKKDIHTCTTCDGYGYVNLEQRSLFGVIQSQQPCPDCKGRGKVITNKCSKCKGQGNYRGKETVEIDLPKSIYENQQLRIQEKGNYGLNNGRRGDIYLEISVKPNKYFKRVNDNLHLNLPVSYLDALLGAEVKVPTFDEDVYLKLPPNTKTNSIFNIPNHGFFKSPTSTKRGDLIVNVIVTIPTKLSPEEKTILQKLRNNSSFKITDDFYEDL

SEQ ID NO: 38956 - protein, 329 aa, Coffea canephora
MCGGAILEGLIPPRNNNDGTRRLSSADLWPSAADFWPNSHLAKPSRSNPTDAPHKATHETCHDPHDEAGGKQQVLPKGAKRQRKNLYRGIRQRPWGKWAAEIRDPRKGVRVWLGTFNTAEEAARAYDKEARKIRGKKAKVNFPNEDSTSYPTCIPSQTQYQQVHIPSPPTFCGPSSSNCKFNQLRVGSSDCSASDCYHANSIDDCARFTNMMGFRNPSEEVSGSGSSDNECFLGHLKQVAKAAAEEEAASVITENDTKDNNKAAESEEYQVEKLSEELLAYESFMKFYQIPYIDGQSAAASANPAQELATSIQLWSFDDVSPANRPMPL

SEQ ID NO: 38957 - protein, 442 aa, Arabidopsis thaliana
  misc_feature (422)..(422): Xaa can be any naturally occurring amino acid
MSSSSRNLSQENPIPRPNLAKTRTSLRDVGNRRAPLGDITNQKNGSRNPSPSSTLVNCSNKIGQSKKAPKPALSRNWNLGILDSGLPPKPNAKSNIIVPYEDTELLQSDDSLLCSSPALSLDASPTQSDPSISTHDSLTNHVVDYMVESTTDDGNDDDDDEIVNIDSDLMDPQLCASFACDIYEHLRVSEVNKRPALDYMERTQSSINASMRSILIDWLVEVAEEYRLSPETLYLAVNYVDRYLTGNAINKQNLQLLGVTCMMIAAKYEEVCVPQVEDFCYITDNTYLRNELLEMESSVLNYLKFELTTPTAKCFLRRFLRAAQGRKEVPSLLSECLACYLTELSLLDYAMLRYAPSLVAASAVFLAQYTLHPSRKPWNATLEHYTSYRAKHMEACVKNLLQLCNEKLSSDVVAIRKKYSQXNTSLQQRSFVPRHYRKSFSS

SEQ ID NO: 38958 - protein, 1067 aa, Legionella pneumophila str. Lens
MPKRTDIKSILILGAGPIVIGQACEFDYSGTQAVRALKEEGYRVILVNSNPATIMTDPELADATYIEPVQWKEVARIIEIERPDALLPTMGGQTALNCALDLVREGVLAKYSVEMIGATREAIDRAEDREKFRQLMIKIGLDMPRSAIAHSLEEAIQVQARLGFPAIIRPSFTMGGSGGGIAYNREEFEEICIRGLELSPTHELLIDESVLGWKEYEMEVVRDKNDNCIIVCTIENFDPMGVHTGDSITVAPAQTLTDKEYQRMRDAAIKVLRAVGVDTGGSNVQFAINPEDGRMLVVEMNPRVSRSSALASKATGFPIAKVAAKLAVGYTLDELKNEITGGKTPASFEPSIDYVVTKVPRFNFDKFPQTPDTLTTQMKSVGEVMAIGSNFQESLQKAIRGLEIGRCGLHSLFHKEDMARLRGHLREPTPDRLWYIADAFRQNLSLEEIHLESRVDPWFLAQIQELVLLERSIIGKTIRELDKTTLHLMKHRGFADAYLAKLLGCTEAEVRARRVELEILPVYKRIDSCAGEFPSDTAYMYSCYEGSCEARPESNKKKIMILGGGPNRIGQGIEFDYCCVHAALSLRSAGYQTIMVNCNPETVSTDFDTSDRLYFEPVTLEDVLSIVAIEQPEGVIVHYGGQTPLKLARDLEANGVKIIGTSSDAIDMAEDRERFQQMVKELKLHQPDNGTVRSEAEAIELANKIGYPLVVRPSYVLGGRAMEIVYQEEDLRYYLSHAVEVSNDSPVLLDKFLNDAIEVDIDAVCDGKDVLIGAIMEHIEQAGIHSGDSACTLPPFSLGVVVQQDLIEQIRKMALKLGVVGLINAQFAIQADDIYVLEVNPRASRTVPFVSKATGLPLAKIAALCKVGISLKDQGLNQNHHTPSFYSIKLPVFPFIKFSGVDSILGPEMKSTGEVMGIAKRFGQAYAKAQLGAGCHIAKRRRAFVSVRDADKTRVGEIAKRLIELGFEIIATRGTALALQAAGVDCRRVFKVAEGRPHVLDFIKNNEIDFIVNTTEGKQAIADSFAIRRNALQHKVSYTTTLSGAEAACLAMKYEDRETVTRLQDLH

SEQ ID NO: 38959 - protein, 134 aa, Listonella anguillarum
MRSTGIADTVLVGPEPEFFLFDDVKYTNNMSGASFKIDDIEAAWNTGAEIEGGNKGHRPGVKGGYFPVAPVDSSQDIRSAMCLIMEEMGLVVEAHHHEVATAGQNEIATRFNTLTTKADEIQIYKYVVHNVAHA

SEQ ID NO: 38960 - protein, 349 aa, Clostridium thermocellum ATCC 27405
MDAKADLLSMTIEELENLMAEMGEQKFRAKQIFQWTNKGIKDIDAMTNLSKDLREKLKERAYINRLEVIKKFVSKIDGTIKYLFKLNDGNIIESVLMQYLHGYSACISSQVGCKMGCKFCASTGVGFVRNLTPGEMLDQILTIQNDTKNRIGNVVIMGIGEPLDNYENVVKFLRLVNHKDGINLGARHISVSTCGLVPEILRLAEEKIPVTLSISLHAPNDEIREKIMPINKRYSIDKIIEACKIYTETTNRRITFEYAMIDGLNDSKENALELAKRIRGMLCHVNLIPVNTVSDTGFKRSSREKITAFKEILERFGVETTVRRELGSDINAACGQLRRNLVENGQLVY

SEQ ID NO: 38961 - protein, 134 aa, Vibrio diazotrophicus
MRSTGIADTVLVGPEPEFFLFDDVKFSTDMSGSFFKIDDVEAAWNTGSDYEDGNKGHRPGVKGGYFPVAPVDSSQDLRSAMCLIMEEMGLVVEAHHHEVATAGQNEIATRFNTLTAKADEIQIYKYVVHNVAHA

SEQ ID NO: 38962 - protein, 109 aa, Brassica napus
MASSMLSSAAVVTSPAQATMVAPFTGLKSSSAFPVTRKANNDITSIVSNGGRVSCMKVWPPVGKKKFERRLISVLKEMVRLQSEFLKPMRPRPKLLKKRLQYQQQEEEE

SEQ ID NO: 38963 - protein, 401 aa, Bifidobacterium longum NCC2705
MAQWQTLSDRINTVAPSATLAVDSKAKAMKAAGLDVVGFGAGEPNFPTPANVVKAAADACLDPKNYKYTPTPGLPELREAIAAKMLRDSGYEVNADQVVVTNGGKQAVYESFQILLNDGDEVIIPAPYWTSYPEAVKLAGGVPVEVFAGADVNFEPSLEALEAARTEHTKAIIVNSPNNPTGAVWKPETVEAIGRWAVEHHIWVISDEIYEHLNYDDAHTTYIGAAVPECRGQLLVLNGVAKTYAMPGWRVGWMVAPLEVAKAAAKLQGHMTSNVANISQRAALAAVAGPLDEVHEMRKAFDARRRAIVTALNDIEGVNCPTPTGAFYVFADITALLGKPLGPKGTVSDTSADFAAALLDEAHVAAVPGEAFGAPGYLRFSYALADEDLAEGMRRFKEWAN

SEQ ID NO: 38964 - protein, 732 aa, Debaryomyces hansenii CBS767
MRSPNNIIEDSNISRIASSNSRALPSFSQMLARSKNNTNNYLNDNNDSNNSSVNQEFEFQMDNDSSSDYRELRNSIIQRRQSSTSNHRNEIQKLNYKNSLLLNLPTEILLQIFHHLDRKELYSLLTVCHEFADLIIEILWFRPNMQNDDSFKKIKTIMEIPKGGTHWDYRSFIKRLNLSFMTKLVDDDLLKLFVGCPKLERLTLVNCTKLTYSPVTSVLKNCEKLQSIDLTGVTGIHDDIILALANNCPRLQGLYAPGCGKVSEDAILKLLKSCPMLKRVKFNGSANITDRSIEAMHENCKSLVEIDLHNCSNVTDKYLKLIFLNLSQLREFRISNAAGVTDRLFELLPSEYYLEKLRIVDITGCNAITDRLIEKLVMCAPRLRNVVLSKCMQITDASLRALSQLGRSLHYIHLGHCGLITDFGVASLVRSCHRIQYIDLACCSQLTDWTLVELANLPKLRRIGLVKCSLISDSGILELVRRRGEQDCLERVHLSYCTNLTIGPIYLLLKNCPKLTHLSLTGISAFLRREITQYCRDPPPDFNEQQKNSFCVFSGNGVSQLRNHLNQIMEDRSYLIDHGDMHALFHERRRRFMNGGNDMDDEEMNLWVRQRGLGVLQGGDLGNPEVAEINREIFRELNEGNMGPEEMREHFQRLIRNHHQQRLLQRQMLEQDLQFQPDQQNQDPQNAPQIIQPAVFPNGDQLIQFVNGEGEDDDDVEMQPVDLFPRDRNPPA

SEQ ID NO: 38965 - protein, 366 aa, Leptospira interrogans serovar Lai str. 56601
MLEYVLANRIQGLDTSAIRKAFELAGTLKNPINLSIGQPHFPCPSNIIEAGSKALKEGKTAYTLTGGIPELKSALSEKYKNENEISYAKPERILVTSGISSAFLLLFNALLNEGDECLVITPHFLMYPAYIKIYGGKMNSIHESFEPEELKEFANKKLKIIIYSSPSNPTGKILSKKQLEALAELAEKTGAYLISDEIYEKFDYDKKFISVGSFYEKAITLSGFSKTYSMTGLRLASILAPESITKTLTTLQQYTLVCAPSITQWMGIEALKTDMSPYIADYKEKRDFVFESLKDHYEITKSEGAFYFFIKIKEKDEDFILKAVKEKELILVPGYIFTSSKNYIRISFASEWENLKRGISALVDLA

SEQ ID NO: 38966 - protein, 302 aa, Xanthomonas campestris pv. campestris str. ATCC 33913
MSIAAFWHGVLPAITTPFTANGDIDHDFLAKHANQLVDAGCTAIVPLGSLGEAATLSVDDKLAILKTLVTALQGRVPVVPGIASLATGEAVALAKAAKELGCGGLMVLPPYVYSTDWREMGAHVRAVIAATDLPVILYNNPVAYKTDFGPAQIAELAAEFPNLQAVKESSGDVRRFAALQELLGDRLALLVGMDDAIVEGLSMGAKGWIAGLVNAYPKESVRLFELARDGGYPAAKELYDWFLPLLRLDTVPKFVQLIKLVQEKVGLGSERVRAPRLVVDGAEREAALKVIDHAIATAPSLH

SEQ ID NO: 38967 - protein, 236 aa, Thermosynechococcus elongatus BP-1
MNPTDSLEDDFPDVEALVPPEESQSWGRSQIQRTLVITETAFLASTAALLWVVNFYLPVGPVLRLFFPIPIALVYLRWNRRAAWMAAIVSALLLSVLMGPPRSLQFLLPHGIMGVIFGGCWAKKESWGRSILSGAVIGTAGFFFQISLVSILLGENLWIYFNQQVTNFIDWVLVNLNLLLEPTVTLIQVVALLLVFFQSTVYALVVHILAWTLLERLGNPIPDPPPWLRTILEEPR

SEQ ID NO: 38968 - protein, 556 aa, Michelia chapensis
MAPIKRDPEPTASIRRRFSTAPPRDGPASPTPQATDALLLPLRVTNKFFLPLFFVAAYFLMRRWREKIRTSTPLHLLTLSEMAAIVALLASFIYLLGFFGIDFVQSLIFRPAEDDVADFIQSPQPPQNPIPAVHSPPIPADDADLVSAVVSGSMPSYSLESKLGDCKRAAAIRRTAIQVKTGRSLDGLGLDGFDYESILGQCCEMPVGYVRLPVGIAGPLLLDGREYTVPMATTEGCLVASTNRGCKAIYVSGGATSVLMKDGMTRAPVARFGTVKRAAALKFFLEDPINFDTLALVFNRSSRFARLQGIQCSLAGKNVYMRFTCSTGDAMGMNMVSKGVQNVMDFLHTDFPDMDIISISSNFCSDKKPAAVNWIEGRGKSVVCEAIIKEEVLRTVLKTNVPALVELNMLKNLAGSAMAGALGGFNAHASNIVSAIFIATGQDPAQNVESSHCITMMEAINNGKDLHVSVTMPSIEVGTVGGGTQLASQSACLNLLGVKGASMESPGANARLLATIIAGSVLAGELSLMSALATGQLVQSHMKYNRSSKDVSKAAS

SEQ ID NO: 38969 - protein, 335 aa, Fragaria x ananassa
MGVERVQDIASTISEDTIPAEYIRSENEQPGITTVPNTVLECPTIDFSDPDEEKLLKQIFEASTDWGMYQIVNHDISNEAISKLQAVGKEFFELPQEEKEVYAKDPNSKSVEGYGTFLQKELEGKKGWVDHLFHMIWPPSAINYRFWPKNPASYREANEEYAKNLHKVVEKLFKLLSLGLGLEAQELKKAVGGDDLVYLLKINYYPPCPRPDLALGVVAHTDMSALTILVPNEVQGLQACRDGQWYDVKYIPNALVIHIGDQMEIMSNGKYRAVLHRTTVSKDKTRISWPVFLEPPADQVIGPHPKLVDDKENPPKYKTKKYSEYVYNKLNKIPQ

SEQ ID NO: 38970 - protein, 62 aa, Zea mays
  misc_feature (14)..(14): Xaa can be any naturally occurring amino acid
PSSPPTYRVLVGMXDAILSHVTQPFQARILALNASYFLINGLHFVISVKANCNLCTVSVRPL

SEQ ID NO: 38971 - protein, 303 aa, Blastopirellula marina DSM 3645
MKRLTGLIAATYTPFGADGRLRLDQTPQMVEHLVNTGVNGLYVCGSTGEGMSLTSEERRLVAESYVKAADGRLPVIVQVGHNSVAEAKQLAAHAQAIGADAVSATCPSYFKVQSPQLLVDCMREIACGAPKLPFYYYHVPLLTGSLIDIQQFIQLGGEQIPNLFGLKYTDTKLNELQQCLKLQNQRFDVVWGCDDMILGAWASGATGAIGSTYNIAAPLYHQLITAVEAGDWNDARALQNQAIEMINVIGTFPFHSAMKAILGMLGYDFGTCRLPQRALSSNETAHLRELLEQVGFFEGFVTR

SEQ ID NO: 38972 - protein, 967 aa, Cryptococcus neoformans var. neoformans JEC21
MAEDNHNEPPPPNIPTPTFPQSKTINTAFARSPTTDSEIEPADEEEGDHRPFNPRTSTTDEHQTLFYQDASHFNVEHHVGRVCRSFAPLALLAIIALAFIPVASATDLDPYTSCPALPQKNTPILSTTGYVFNHVVRFIGLDDSFVGQHLANVKRNLDNTSIIEACMVPVLVLLSGMFAGLTLGYFSVDQTQLQVLAISGTPKHQEYARLIMPVRKNSHLLLTTLILGNMIVNEALPVVMDGLLSGVVSVVVSTAMVVIFAEIIPQSICSRYGLLIGARMAWPVRIMIWIAYPIAWPIAKLLEWVLGAHHGIIYRRGELRELIKMHAAGGEGGGDLDFDTVQITQGALDLARKTVKDSMTAIEQVFMLPIEAKLDYETLGHVVRSGHSRIPVYQMVEVPDIDLSAPTLGPTKTKMVKKVLGSLLVKSCVLLDPEDATPLASIPINAIPSIPFDEPLTNMLNVFQEGRSHMAIVSRRVRRVGPVDPEDAQSAMTAAAGGLRQRFFRRVAGISGNRSFSDGDSSASGEEDLEKGEGGKKKKRRRKNAEKHDRAGSCSSDNHTIVRPISSDDDGFTEADEIKRMAKEQQEAEMKQQRGKDSKKGSLVQAAKLTQLEQSVPADAQLSNDAVENFFDGLEGAPLGIITLEDVLEELIGEEIYDEYDEHGVPRSAASAFVPLEAMLAARKAALARQELAIAQSTPIPPVSDADVEQVVAAPTPGAGRRVKAKIQIPKFSLKKPVSQPGRPRTERLAANETPAATPPADPPCYTNKPDEKSTYSAQIITIPGELDEPPLACAQSDSRLVNRRLSTPLDSGATATPSPQPQYSLSVPGPASAVPTRLLPAGGTVSTPAVIPTSHQPSLLNEAIFIGRERKRMAASHPGQVRSQSSGPTVSSKQPTPPISVYDFGIQAAGVNGERVEGQEIVSPRPIAAQQKKIPKFKSVPTPVATPSFGFDPSAESKSSSREEKE

SEQ ID NO: 38973 - protein, 223 aa, Glycine max
MCRASDFPREYDGACLQMRMSYSPAAHLFLFLVQWTDCHLAGALGLLRILIYKVYVDGTTTMSTHERKASIREFYAVIYPSLLQLEKGVTDTEDKKQKVVCMERYRRRDDEEHRQPSDIDIEREDECGICMDMNSKIVLPDCNHAMCLKCYREWRTRSQSCPFCRDNLKRVNSGDLWVFTDNRDVVDMATVTRENLRRLFMYIDKLPLVIPDFLFDTYDSHLR

SEQ ID NO: 38974 - protein, 247 aa, Spinacia oleracea
MAIAFGRFDDSFSWASIKAYIAEFISTLLFVFAGVGSCIAFAKLTEDAALSPSGLVAVAVCHAFALFVAVSVGANISGGHVNPAVTFGLALGGQITILTGILYWIAQCAGSVAACLLLKASTGGLATPIHSVAAGVGSIEAVVMEIIITFALVYTVYATAVDPKKGSIGTIAPIAIGFIVGANILAAGPFSGGSMNPARSFGPAVASLDFSDHWVYWVGPLVGGGLAGLIYGNVFMQDDHAPLSNEY

SEQ ID NO: 38975 - protein, 171 aa, Glycine max
KMACLVSRSGRELQRYNNMGGRQVVGCIPYRYKEDIDGKMSNELEVLVVSSQKGRGLMFPKGGWELDESVEEAACRESLEEAGVLGIIESELGQWNFISKRYGIYYEGHMFPMFVKEQLDTWPEKNLRRRIWMTVAEAREVCQHWWMKEALDILVQRIVSSQQRKEDLSIG

SEQ ID NO: 38976 - protein, 310 aa, Burkholderia thailandensis E264
METIAVIGSNMVDLVTYVARMPADGETLEAPNFELGCGGKGANQAVAASKLGARVAMVSKVGDDLFAENTLRNLERFGIDIEHVRRVPGVSSGVAPIFVSPDSRNRILIVKGANRHLKPADIDAAAAKIAASRLVVLQLEIDIDTVYYAIDFAAARGIPVLLNPAPGAADLDFSRLAKLEFLVPNETELALVSGMPTDTPDAIEHAARSLVERGVKHVIVTLGDKGSLLVSRAGVVRVPPVAVDARDTTGAGDAYIGCFARHYVATLDIPAAMRLASAYAAHSVTGFGTQKSYADAATFERFLQTPRSGA

SEQ ID NO: 38977 - protein, 199 aa, Bifidobacterium longum NCC2705
MARTAHIVRETSESHIDLELNLDGTGKTDIDTSVPFYNHMMTALGKHSLIDLTIHAHGDTDIDVHHTVEDTAIVFGEALKQALGDKKGIRRFADATVPLDEALAKAVVDISGRPYCVCSGEPEGYEFCMIGGHFTGSLVRHVMESIAFHAGICLHMQVLAGRDPHHIAEAEFKALARALRFAVEIDPRVDGVPSTKGAL

SEQ ID NO: 38978 - protein, 450 aa, Nocardioides sp. JS614
MAETYDLVVVGAGMAGVAAANKCASSGWRVAIVDALPYGGTCALRGCDPKKILRRGAEIIDGARLMRGKGIDGQGLRIDWADLMRHKRGFTDPVPDNLERDLAGHGVETLHGNARFLGGNTVEIAGASVESRHFLVATGARPRALAFPGHEHLIDSTDFLDLERLPARILFVGGGFISFEFAHIATRAGSATTVVDRGPRPLRGFDPDLVDLLLGRSRQAGIAVRPATTVTAIAKDKAGYQVTLETPEGSETIECDLVVHGAGREADLAGLDLEAAGVEWSPRGVRVAGHLQSTTNPAVYAAGDSADTPGMPLTPVAVFEGRVAASNMVNGTTRAPDYAGVPTAVFTIPELARVGLLEREARERGLDVDVRFNDTSGWYSNYRTGETTAAAKILVDRATDRVVGAHLLGPEYAELINVLGLAIKLGLTTRQLKSTTAAYPTVGSDLGSML

SEQ ID NO: 38979 - protein, 444 aa, Burkholderia thailandensis E264
MAAEAAQAGVRCPHVRLNGAPGRRAAYAVRATATCRDTRARTSRSPAPGRNPIDARLPSDESGRFAGARRISRDSSAPGGLLRIRLARAIRPLLRTRCRCRTTEIESMFAWNFLGKRCFAVSAVHSIVEPSPATPDRITDSTAAFARDMRTSYRAMIPSAGAPDAVKQVLAISVGARHPDRDIPVRVYKPEGSRDEERLPTVLFVHGGGFVSGDLDTHDVLARAIANRAQALVLSIDYRLAPEFPFPAGLDDIYAVLQWAAGHLDTLGGDATRIAISGDSAGATLSAATAMLARDRGGPPLIAQWLMYPSVSNDMDTPSWDELGDTHFPTREVMRNVRHSYVPMETSPHAPLLAPIHGNHADLPPALIQVGQLDPLRDENISYASILNKAGVEASVTVYEGQSHGFIQFFKDKSNHPRGETALDDGVRFLRERFASGATQPPRR

SEQ ID NO: 38980 - protein, 380 aa, Actinobacillus pleuropneumoniae serovar 1 str. 4074
MAKKDYYEVLGLQKGASENDIKRAYKRLASKHHPDKNQGSKDAEEKFKEINEAYEVLGDAEKRAAYDQYGHAAFEQGGGAGGFGGGFGGGGFGGFEDIFSEMFGGGFGGGGRRNHVVRGDDLRYDIEISLEEAVKGCKKDIRISTLAECDTCHGSGAEKGSKVETCSHCHGSGRIRRQQGFFVTEAVCPSCHGSGKKIEKPCKSCHGDGRVQKAKNLSVTIPAGVDTGNQLRLSGEGAAGENGAPAGDLYVVIHVREHDIFERDGSNLYCEVPISFTMAALGGEIEVPTLDGKLKLKIPAETQTGKLFRVRGKGVASPRGGYAGDLICKVVVETPVALNDEQKDLLRKLEESLAGKSKHRPQQESFLDSVKNFFSNLGKH

SEQ ID NO: 38981 - protein, 502 aa, Zea mays
MGALLPWLAWLLVSLVGVYLLGHLVQARRRRGLPPGPHPLPIIGSLHLLGNQPHRSLARLAKTHGPLVSLRLGSVTTVVASSPAAAREILQRHDAAFSNRSVPDAPGAHARNSTVWLPNAPRWRALRKIMGTQLFAPHRLDALQHLRRDKARELVDHVRRLARRGEPVNVGRVAFTTSLNLVSRTIFSRDLASLEDDGASRKFQEVVTDIMEAVGSPNVSDFFPALAVADLQGCRRRLARLFARLHRIFDEEIDARLRGRDAGEPKKNDFLDLLLDAAEDDDNTAGLDRDTLRSLFTDLFSAGSDTSSSSVEWAMVELLRSPGSMAKACDELATVIGPRKDIEESDIGRLPYLQAVVKETFRLHPAAPLLLPRRAQADVKMMGYVIPEGSRVFVNVWAMGRDEETWPEPEKFMPERFLGKKKTQAVDLRGGDFDLIPFGGGRRICPGMPLAIRMVHLLLASLLNQFAWRLPAELERNGVDMAENFGITLTKAVPLCAIATEI

SEQ ID NO: 38982 - protein, 356 aa, Nocardioides sp. JS614
MSPAPHPLQERIARRVMRTVGALPAPVQRAFAGRPIRIDGQQLHPEVQLALRLLHLAGGPTFETLPLAEGRAQISSEAWVFGDELPVETVRDLTLDGRNGPIPARLYLPSGRSDPAALLVYFHGGGWVLGGLDASDSACRFLADHAGIAVLSVDYRLAPEHRFPAAVEDAVDAFHAAVAAATTWGVDPAAIGVGGESAGGNLAAVVAQLTHAASGPEPACQLLFFPVTDLSTKHPSYALFSEGYFLTEAQMEWYRGHYLEDPAQALDPRVSPLLAEDLSGLCPAYVAVAGFDPLRDEGAAYAHRLQEAGVRVSLQRHSGLIHGIVNATGVGRSGREVLLQAAGALRIELGARAGSG

SEQ ID NO: 38983 - protein, 487 aa, Oryza sativa (japonica cultivar-group)
MAFAARRSLASRLSHHLTRRLHPATAPHLLASHSDDDPSPPPELPPFPHSPSPRHPRAGQALDRHLLPFSLHHLAGLRRRGFSSAAGEVDAAAGVLADAAAAAEAVPAPFPGEVAAAAADSFFPVAALQHVIDYIHTFTGLNWWACIALATVLIRSATVPLLVNQLKATQKLNAIRPEMEAIKEEMNAMDPKSAKEGKAKMTALFQKHGVSPFTPLKGLLIQGPIFMSFFFAIRNMIDKVPSMKGGGSLWFTDLTTPDPLYILPVLTALIFLVTVELNLQEGMEGNPMARKMKNFSRGMAVLTVPFTMSFAKGIFCYWITSNLFTLTYGFVIRRPAVRKFCNLPALEAQSASAKKQMFNLFGGSKALTTAESPVAITGGPQSSLEQPDAAALGYRVKNPEKKAKSRGKSRRRSFLTGDPITGGKGTVLPFCQSFRTGRHVNAAMRNADTIPELNQTLHTPTPKPRTCFDQGESVESTTRFTHQPMRP

SEQ ID NO: 38984 - protein, 895 aa, Citrus jambhiri
MFNPVLVHQTRSIRTILPLSKPFLHGNGNVFRQIQSSPSFKKGPKIRLGSVPSNSVKAMADTAVSNGVTAVVTVRPPINPLTAGGQVIDDVEDLFSKSLQLELVSAKDENKPTISGNAKIKGVVVKDCEVQYEAEFQVPVDFGEIGAILVVNEHALEMYLKDIVLDGLPSGLVTITCESWVQPNTSKDPRIFFTNKSYLPSKTPNGLQKLRYAELVNLRGNGEGERQKADRIYDYDVYNDLGDPDEDEELKRPVLGGKQHPYPRRCRTGRPHCKTDEASEERVPSKSLIPISPYVPRDEESRRLKETTFVIKGIVSDSCVSLNTKLESRICRHRWVSQTSQKIDKLFREGVKIKDAEFWKSLLPGFVEEIKDIGDFFLRFTSPETFKRDRFFWFRDEEFSRQTLAGLNPYSIRLIAEWPLKSTLDPEIYGPPESAITTELIEKEIGGMISVEEAIKQKKLFILDYHDLFLPYVEKVRQLKSTTLYGSRTIFFLTPAGTLRPIAIELTRPPMNGKPQWKQVFLPSWHSTECWLWKLAKAHVLAHDAGYHQLVSHWLNTHCCTEPYVIATNRQLSVMHPIYRLLDPHFRYTMEINGLARQALVNADGIIESSFSPGKYSMEFSSVAYDKQWRFDHEALPKDLISRGLAVEDPSAPHGLKLTIEDYPFANDGLDLWDAIKQWVTDYVNHYYPDKSLVESDEELQAWWTEIRTVGHGDKKDEPWWPALKTPQDLIEIITTIVWVTSGHHAAVNFGQYIYGGYFPNRPTTARCNIATEDPSDEQWKFFLEKPENALLNTFPSQIQATKVMAILDVLSTHSPDEEYLGKEIEPAWREDPVINAAFEKFRGKLMELEGIIDARNADPKLRNRNGAGMVPYELLKPFSEPGVTGKGVPYSISI

SEQ ID NO: 38985 - protein, 428 aa, Chlamydophila pneumoniae J138 [sequence omitted]

SEQ ID NO: 38986 - protein, 203 aa, Triticum aestivum
MKLEVSPRQRTQEAEQNEGVAVEPWKHPKQLCASLGYGEEEASRLVPPLNFGMVDDGVFRSGFPDAANFRFLASLNLRSVVYLCPEPYPEQNARFLGRSGIKLHHFGIQGRKEPFVDIPEETIREALKVILDVRNHPVLIHCKRGKHRTGCVVGCLRKLHKWRLSSVFDEYLHFAAAKARKTDQRFMELFDTSSLVHLLASQC

SEQ ID NO: 38987 - protein, 444 aa, Arabidopsis thaliana
MHRASSKHTNAKKEAISTSKIRDNNVRVTRSRAKALGVSNSPSKPAFKHETKRVARPSNKRMASDNITVCNQKRRAVLKDVTNTLAESIISTEGNVKVACKRGGKETKQIEEDGLVDVDGEKSKLAEDLSKIRMVESLDASASKQKLVDCAEEDRSDVTDCVQIVDIDSGVQDPQFCSLYAASIYDSINVAELEQRPSTSYMVQVQRDIDPTMRGILIDWLVEVSEEYKLVSDTLYLTVNLIDRFMSHNYIEKQKLQLLGITCMLIASKYEEISAPRLEEFCFITDNTYTRLEVLSMEIKVLNSLHFRLSVPTTKTFLRRFIRAAQASDKVPLIEMEYLANYFAELTLTEYTFLRFLPSLIAASAVFLARWTLDQSNHPWNQTLQHYTRYETSALKNTVLAMEELQLNTSGSTLIAIHTKYNQQKFKRVATLTSPERVNTLFSR

SEQ ID NO: 38988 - protein, 753 aa, Nocardioides sp. JS614
MLHVPSRRHVVDMCRTLLERGYLKATEGNISVRVPGHDRFAVTPSNYDYAKMRPEDICILDFEGKVVAEAGGSDLPPTVESGLHAAVYRERPDVHAVVHTHQPYASALAFLRRPIPALTDEQVRFLGREVAIIDYAPAGTSFLAKNVAKRLGSSANAFIIANHGILAVGTDPDRAIFNMALLEKVCLAYLLALTTETGRVYTIPSAIREIALTKLKSDQKRIAAQVEQFVPVDRDLVEEPLPSADAVAERVRTAPGAGPEVAAPGAAPGAADLGYAISDYPDVDAVMRRIKALTGQPVRGLRHDALLDVLAWFDTKCAASKELTDRAKARIPGGVQHNLAFNYPFPLAIDRADGAHLTDRDGNVYVDFLQAGGPTILGSNYGPVNEQVAEVIRESGPVTGLFHEYELKLAESINRYLPHIEMYRSLGSGTEAVMAAVRAARVKTGKHMVIKVGGAYHGWSDSMVYGLRVPGTFRMNAKGIPFGATAGTRESFPHDVGQLRRKLIENRARGGTAAVIVEPLGPESGTRPAPRDYNARVRELCDEFGALLIFDEVVTGFRVGMGGAAGYFGVTPDLTVLGKAVAGGYPMAGGVGGSAEVMSVFGSGLDGKNGAHVLVGGTLSANPLSCAAGHFAIEEMARTNAPVVAGAAGDRLARGLQRLIDHYGLPYVAYNQGSIVHLQSSGVLLLDMRNPVKLLKESKPRKHLMEQLGAAYAAHGIITLAGSRLYTSMADTDEVIDDALERFDRVFALVEGV

SEQ ID NO: 38989 - protein, 493 aa, Blastopirellula marina DSM 3645
MATISRSNSSTSPEVRHTQCFIDGQWVPAMSGKTFATLNPATEEVIAEVAEGDAADIDVAVRAARNAFDSGPWRKMDARDRGALIYRLAELIEQEKEELAALESLDNGKPIRDALAADLPLVVDCLKYYAGWADKIQGATIPIRGDYFCYTRREPVGVVGQIIPWNFPMLMAAWKWGPALAAGCTIVMKPAEQTPLTCLRMAQLAQEAGIPDGVINVVPGFGPTAGGSLVKHPGVDKIAFTGEHITAQTIMKNAADTMKRVTFELGGKSPNVIFADADLDAAIAGAHFGLYFNQGQCCTAGSRVFVEDSIYDEFCERMVAMNQDRKLGDPLDPDTEQGPQVDQRQMDKILGYVELGKKQGARLLSGGQRHGDKGFYVQPTLFADVTDDMKIATDEIFGPVMSVLRFKGQDDIIQRANDTFYGLAAAVWTNDVKKAHRFAADVRAGTVWVNCYDVFDTAAPFGGFKMSGLGRELGAAGLDAYLENKTVTVNLAD

SEQ ID NO: 38990 - protein, 229 aa, Yarrowia lipolytica CLIB122
MDSSDRPSLRQRLSNWGRTDTKPAATDLTAPPNDPSENMELPPLPPVELLGYSHSTRTKIMTTELADEIRNLVPERIKLYRSWQLQYSLEQHGTSLTTLYHRNIPPHGDTARNGFVLAVKNSRGQVFGAYTDQHYHVGGKKFYGNGDCFLWKVKNADSFQAFPYTGENNFVVYCNPHFLSLGGGDGKYGLWLDDALKTGVTYPCATFGNEPLGDEKFDVVAVEVWRVGE

SEQ ID NO: 38991 - protein, 458 aa, Nocardioides sp. JS614
MVATATPGHDVSALHPELRPMYEKVVSRNPGEREFHQAVFEVMQSVGPIAEERSDYAQWSILQRICEPERQIIFRVPWVADDGKVEINRGFRVEFNSALGPFKGGLRFHPSVNLSIIKFLGFEQVFKNALTGMPIGGGKGGADFDPKGRSDGEVMRFCQSFMTELYRHVGEYTDVPAGDIGVGGREIGYLFGQYKRITNRYESGVITGKGLTWGGSQVRTEATGYGTVFFVEQMLQARGEHLEGKRVVVSGAGNVAIYAVEKAQALGAVVVAVSDSGGYVVDEAGIDLELLKEIKEVERGRLTEYVERRSGATHVTDGCIWDVPCDIALPCATQNELDESAAKTLAANGVTLVAEGANMPSTPAAVQLFQAAGVLFAPGKASNAGGVATSALEMQQNASRDSWHFDETEARLQEIMSEIHDTCLATSDHYGAPGNYVVGANLAGYVRVADAMVALGVI

SEQ ID NO: 38992 - protein, 93 aa, Glycine max
  misc_feature (79)..(79): Xaa can be any naturally occurring amino acid
LGKGGAKRPRKVLPLTIQGIPKPALFRLVSKGGVKKISGLIYEKTPGVLKIFLENVIRAAVSSPEPARRKTVPPMEVVXALKRQGRTFYGFGG

SEQ ID NO: 38993 - protein, 607 aa, Bacillus cereus G9241
MNKEERAKRQSKIRNFSIIAHIDHGKSTLADRILEKTNALTQREMKAQLLDSMDLERERGITIKLNAVQLNYKAKDGEEYILHLIDTPGHVDFTYEVSRSLAACEGAILVVDAAQGIEAQTLANVYLALDNNLEILPVINKIDLPSADPERVRQEVEDVIGLDASEAVLASAKAGIGIEEILEQIVEKVPAPTGDSEEPLQCMIFDSLYDPYRGVIAYIRVVNGTVKVGDKVRMMATGKEFEVTEVGVFTPKTTQRDELTVGDVGFLAASIKNVGDTRVGDTITHAKRPAAEPLAGYRKLNPMVFCGLYPIDSARYNDLRDALEKLELNDSALEFEPETSQALGFGFRCGFLGLLHMEIIQERIEREFKIDLITTAPSVIYKVYLTNGEDVIVDNPSNMPDPQSIDRVEEPFVKASIMVPNDYVGAVMEICQGKRGTFIDMQYLDETRVTLTYEIPLSEIVYDFFDQLKSNTKGYASFDYELIGYKPSKLVKMDILLNNEQVDALSFIVHRDSAYDRGKVIVEKLKDLIPRQQFEVPIQATIGNKVVARSTIKAMRKNVLAKCYGGDISRKRKLLDKQKEGKKRMKSVGSVEVPQEAFMAVLKMDDN

SEQ ID NO: 38994 - protein, 122 aa, Thermosynechococcus elongatus BP-1
MVIAYSAKVLERGDRALRCSPFLPPLFQTMQQRSVALAEIAGEGGLKSGFTRSPLPALLAEAELDWLIRVGLLRREVDGQGLTDRYRLTPLGQQLIQNYSQPTWSASWGDRWRNRLSRWWGM

SEQ ID NO: 38995 - protein, 359 aa, Zea mays
MSRVAGSRLLPRISALSFCTASPATAAASSSSSTAAVAAAAATASEASSTAGDPSSQPPQTARKPWGALKFAAFAAVSAAVGGTGYVSYAYSLEEVDQMTRELRKKSKQPIPEDASGFERFQAMAYSAAMKVPVAAIEVYLDVRSQIEDQIRGFSEPVSDKLLPDLAPQEQHVLTLVLDLNETLVYSDWKRERGWRTFKRPGVDAFLEHLGRFYEIVVYSDQLSMYVDPVVDRLDPKGNIRHRLSRVATKYENGKHYRDLSKLNRNPAQVLYISAHAKESSLQPENSVEIKPWKLENDDTQLLDLIPFLEYVAMARPSDIRAVLASYQSGDIAAEFIERSKEHQRRMQEQKKSGRIWRR

SEQ ID NO: 38996 - protein, 356 aa, Arabidopsis thaliana
MRMSCFFFSSPFSGGSTDPKTFESVFKISRKTFDYICSLVKADFTAKPANFSDSNGNPLSLNDRVAVALRRLGSGESLSVIGETFGMNQSTVSQITWRFVESMEERAIHHLSWPSKLDEIKSKFEKISGLPNCCGAIDITHIVMNLPAVEPSNKVWLDGEKNFSMTLQAVVDPDMRFLDVIAGWPGSLNDDVVLKNSGFYKLVEKGKRLNGEKLPLSERTELREYIVGDSGFPLLPWLLTPYQGKPTSLPQTEFNKRHSEATKAAQMALSKLKDRWRIINGVMWMPDRNRLPRIIFVCCLLHNIIIDMEDQTLDDQPLSQQHDMNYRQRSCKLADEASSVLRDELSDQLCGKNSSA

SEQ ID NO: 38997 - protein, 901 aa, Oryza sativa (japonica cultivar-group)
MPSASAAAAALVLLFLAFSLSNAQPGFISLDCGGDDDYTDGIGIQWTSDAKFVSAGQEANLLLQNQQLQQYTTVRSFPADNRKYCYTMNVRNRTRYLVRATFLYGNFDNSNVYPKFDLSLGPTPWTTVVIDDATTPVVQEAIILAAAPTLSVCLSNASTGQPFISTLELRQFNGSLYYTTDEKQFFLRLSARINFGAESNASVRYPDDPFDRIWESDLVRRANYLVDVAPGTERISTTKPIFVSTNEEPPQRVMQTAVVGKNGSLTYRIDLEDFPGNAWGVSYFAEIEDLAPNQTRKFKLVIPGKPEFSKPTVDVEENAQGKYCLYEPGYTNIPLPFVFSFGFKKTNDSSEGPILNAMEIYKYIEISVGSQDANIMASLVSRYPEAGWAQEGGDPCLPASWSWVQCSSEAAPRIFSISLSGKNITGSIPVELTKLSGLVELKLDGNSFTGQIPDFTGCHDLQYIHLEDNQLTGALPPSLGELPNLKEFFSGNSDLRMGHSNTGRTIVIIVCAVVGAILILVAAIVCYLFTCKRKKKSSDETVVIAAPAKKLGSFFSEVATESAHRFALSEIEDATDKFDRRIGSGGFGIVYYGKLTDGREIAVKLLTNDSYQGIREFLNEVTLLSRIHHRNLVSFLGYSQQDGKNILVYEFMHNGTLKEHLRGGPDDVKITSWVKRLEIAEDAAKGIEYLHTGCSPTIIHRDLKSSNILLDKNMRAKVADFGLSKPVVDGSHVSSIVRGTVGYLDPEYYISQQLTEKSDMYSFGVILLELISGHEPISNDNFGLHCRNIVEWARSHMESGDIHGIIDQSLDAGYDLQSVWKIAEVATMCVKPKGVLRPSISEVLKEIQDAIAIELQRELPSSIHHLMSKTSPSEAVNTTGSVQDLEQNASFDELLMRPGLR

SEQ ID NO: 38998 - protein, 322 aa, Legionella pneumophila str. Lens
MTIDRIRALVSEDFNAVNNLIIDKIQSQVGLIQDLSQHIVESGGKRLRPLVVLLASNACGYKGKDHISLAAMVEFFHTATLLHDDVIDESTLRRGRQTANSIWGSKASVLVGDYLFTQSVNLMVEVGIKEILNLLANTSHQITCGEVKQLANRHNPALTLDDYFDVIRAKTALLFAAAACIGPILTNAPIEIRNSLYNYGLHLGNAFQLIDDALDYCSDAATLGKNIGDDLADGKATLPLIHALQNGNATQQQQIRESLMKGSLSHLPDILIAIEQTEAIPFTKRIAAQEVDSALSALEILPDSVYKEALVDLAKFALERNY

SEQ ID NO: 38999 - protein, 513 aa, Thiobacillus denitrificans ATCC 25259
MKALPVLLIILDGFGCRDERANNAIAQANKPNWDRLWKHHPHTLIHASESEVGLPKGQMGNSEVGHLNIGAGRVVYQEFTRIDRAIESGYFYTNPALLNAVHLARDNGKTLHVLGLLSDGGVHSHELHFHALLDLAAREGLSKVCLHVFLDGRDTPPKSAELYLRRLTDKIAQAGVGHVASMIGRYFAMDRDRRWQRVKSAYDLLTQGAAEFSAGSAQAGLEAAYARGETDEFVKATAIVPADGRPVTMEDGDSVIFLNFRSDRARQLSRPFIEPDFSEFERERTPRLATYCTLTGYSDDFDVSVAFPPERIKNGLGEYVANLGLRQLRIAETEKYPHVTFFFNGGEEVSFPGEDRILVSSPDVATYDLKPEMSAFEVTEKLLAAIGSKQYDLIVCNYANPDMVGHTGNLEAAIKAIETVDTCLGRVVEAQLARGGEVLITADHGNAELMLDAETGQAHTAHTMNLVPVIFVGRRHASLAETGALEDVSPTLLRMMGLPQPPEMSGESLLAFE

SEQ ID NO: 39000 - protein, 575 aa, Lactobacillus casei subsp. casei ATCC 393
MAEHLKGIAASDGIATAKAYLLVQPDLSFQKKTVDDPSKEIDRLKQSLDQSNDELKVIRAKAAESLGEEEAQVFDAHMMILADPDFTGQVETKIKDEKVNAEQALKEVSEFFIKTFEGMTDNPYMQERAADVRDVTKRIMAHLLGRNLPNPALIDEEVVVVAHDLTPSDTAQLNKKYVKAFVTDIGGRTAHSAIMARSLEIPAVVGTDDITKKANNGDLISVDGLTGEVVVDPTDDEVAKFKQDAEAFAKQKAEWALLKTAKSITADGKHFDVAANIGTPKDLDGVLANGAEGIGLYRTEFLYMDSAELPTEDDQFEAYKKVVETMSPKPVVVRTMDIGGDKHLPYLPLPEEQNPFLGYRAIRISLDRQDIFRTQLRALLRASAFGNLRIMFPMIATIAEFKQARQIFTEEKDKLVKDGVKVSDDIQLGIMIEIPAAAVLADQFAKYVDFFSIGTNDLIQYSMAADRGNEHVSYLYQPYNPSILRLIKHVIDSAHKEGKWAGMCGEAAGDPIMVPLLLGMGLDEYSMSATSVLKVRSLMKKLSTADMAKMDEIALNQNITNDENADLVKKTTGQK

SEQ ID NO: 39001 - protein, 470 aa, Lactobacillus casei subsp. casei ATCC 393
MYQSKTHNHRFTGHLASAKTRLRLVALISTMGGLLFGYDTGVINGALPFISSELKLAPGSQGWVTSSLTLGAAFGAILVGRLSDRYGRRRLITMLAGLFFLATVASSLSPSAGWLIGARLILGLAVGGVSVLVPSFLAEIAPTSHRGRLVTQNELMVVTGQLLAFVLNAFLGTTFGNVPGIWRWMIVLAVIPAIILGIGTYFVPESPRWLMMKGRPAAARSSLEVLRSAAEVPAEIDHLKQNLAEDAKHKQASVRALKTKWIRRLVLIGIGLGVIQQIAGINVMMYYGTSILQMTGFGRDSALIANIANGVTAVAATIVTLQLLKHVPRRPMLIVGLIGSTVAITGVTFASRLPAGSPFRAFATIGMMMLFLAFFQGAISPMTWLLMSEIFPEQVRGIGMGAATFCLWLANFGVGVLFPIGLAQIGMFWTFVCFIGTNLISLLFVLIFVPETAGRSLETLHREEKARLNH

SEQ ID NO: 39002 - protein, 143 aa, Triticum aestivum
  misc_feature (85)..(85): Xaa can be any naturally occurring amino acid
  misc_feature (102)..(102): Xaa can be any naturally occurring amino acid
  misc_feature (104)..(104): Xaa can be any naturally occurring amino acid
  misc_feature (129)..(130): Xaa can be any naturally occurring amino acid
  misc_feature (135)..(135): Xaa can be any naturally occurring amino acid
  misc_feature (137)..(138): Xaa can be any naturally occurring amino acid
  misc_feature (140)..(140): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKXWVPCLEVQQRSGFIFRXEXNALPGTKNGRYWDNVELPKFRVQRXXQVFNXVXXVXKDT

SEQ ID NO: 39003 - protein, 142 aa, Triticum aestivum
MEGLQRSSSTFRRSGSSGLVWDERFLTEGAEAKAAGEGGTDEAQPEMRRSRSTGGVGMMLRRGGDDKKQQQQKKEQQGQKKKDEERDPQVFRTKEVAPDVDPPSPRVSGCILCAIFGGSGSGSGPAARRGRAKPKRRQRSAA

SEQ ID NO: 39004 - protein, 106 aa, Oryza sativa
RKPKKLPGEVISEEYSLEYGTDKIETHVGAVEPNGRAVVVDDLIATGGTLSAAVKLIERAGAEVVECACVIELPELKGRDKLGNKPVFVLVKADYEACWKQLRYRS

SEQ ID NO: 39005 - protein, 153 aa, Burkholderia thailandensis E264
MSLTVAQILKSKPDSGRTIHMVEKSDSVYNAIKLMAEKSIGALLVMDGANIAGIVTERDYARKVVLLDRSSKATRVEEIMTSKVRYVEPTQTSDECMALMTEHRMRHLPVLDDGKLIGLVSIGDLVKSVIADQQFTIDQLEHYIHGIPAAAHS

SEQ ID NO: 39006 - protein, 329 aa, Thermosynechococcus elongatus BP-1
MSQPTVLCAGEVLFDCLEIPPDPPQCFLGGAPANVACGLVKLGVSAAFLGAVGEDPLGERACAELAALGVNIEAVERVAGLPTRQVRVQLVEGDRQFVGFAPAGTSVFADMQFCGQQVSPLLLTGARFFVTGTLGLASEPTATTIAHLVHQLRQKGTLILIDANWRPIFWSDPRVAPERICPFLAQAHFLKLAKEEAELFFSDSDPQVVYRALWGRAPDHGVVITDGDQAIRYFWHENQGELQPPSMSVVDTTGAGDGFVAGWIAQLLQGTPETYRDPAWQVACLEFATVVGALVTTKRGAIAGQPTLAEVRQWLRDHPQRKIQTHSTG

SEQ ID NO: 39007 - protein, 196 aa, Glycine max
MSQLGAVLRTQREPRRSTILGLLTEQMDGVDSGTRRRRSFKERFGFIGMGCCGATWGFRSDALSVTQGEQQQQETDPECVGPAGLGSGMNLAAALAAERQLRGPQEEAVRAPGTPWRVSLMRLLEETEAEKEKEKEKEENVVGNDSVCCVCMGRKKGAAFIPCGHTFCRVCSRELWLNRGSCPLCNRSILEILDIF

SEQ ID NO: 39008 - protein, 168 aa, Thermosynechococcus elongatus BP-1
MSDTPEAPIVEAGPVGRLLQSQNLSVESLGRDASGVEMIKVDRDRLLAVCQTLYADGFNYLRCQAAYDSGPGQDLVSTYHLIKLSDNADRPPEVRIKVFVPRDDPRVPSVYWIWKTADWQERESYDMFGIVYEGHPNLKRILMPEDWVGWPLRKDYITPDFYELQEAY

SEQ ID NO: 39009 - protein, 394 aa, Adiantum capillus-veneris
MSIRLEDIDPVVVSMGPHHPSMHGVLRLVVALQGENVVDCELILGYLHRGMEKIAENRTTSQYLPYVTRWDYLATMFTEAVTVNAPEKLANIQIPERASYIRVIMLELSRIASHLLWLGPFLADIGAQTPFFYIFREREMIYDLFEAATGMRMMHNYFRIGGVAADLPYGWIDKCLDFCQYCLPKIYEYERLVTKNPIFLKRVQGVGFINRQEAINWGLSGPSLRASGVQWDLRKIDHYECYDKLDWQIQWQGEGDSLARYLVRIDEMKESINILRQALKLLPGGPYENLEGRRLVQKKDKIDWNGFNYQFVGKKSSPTLKLPKQEHYVRVEAPKGELGIFLIGDDSVFPWRLKIRPPGFINLQIVPQLIRGMKLADIVTILGSIDIIMGEVDR

SEQ ID NO: 39010 - protein, 412 aa, Kluyveromyces lactis NRRL Y-1140
MLSLKAQSSVVGKSSSLRLVRNFSKNVRALSQVADETKPGDDDLVQIDLPETSFEGYLLDVPELSYQTTKSNLLQMYKDMIIVRRMEMACDALYKAKKIRGFCHSSVGQEAIAVGIENAITKRDTVITSYRCHGFTYMRGAAVQAVLAELMGRRTGVSFGKGGSMHLYAPGFYGGNGIVGAQVPLGAGLAFAHQYKHEDACSFALYGDGASNQGQVFESFNMAKLWNLPAVFCCENNKYGMGTAAARSSAMTEYFKRGQYIPGLKVNGMDILAVYQASKFAKDWTVSGNGPIVLEYETYRYGGHSMSDPGTTYRTRDEIQHMRSKNDPIAGLKMHLLELGIATEDEIKAYDKAARKYVDEQVELADAAPAPEAKMSILFEDVYVPGSETPTLRGRLQEDTWDFAKKSFAFRD

SEQ ID NO: 39011 - protein, 366 aa, Thermosynechococcus elongatus BP-1
MQGTTIFRGDAFAKVSMKAQVFRGVNQLSYEEIPIPEIAADEVLVRVRVVGLCQSDIKKIRYPLYEPPRIFGHETAGEIAAVGDAVTGWQVGQRVVVMHHIPCMHCAYCLNENYSMCHVYKTVTTTAGFIPSGGGFAEYVKVPGHIVEHGGLIPIPDPISDEEASFVEPTNCCLKAVKKAGIAPGQTVLITGAGPIGLMFIMLVNLFGARAIATDLLPSRIAKAKEVGAAAAFDARDPDLSAKVQALTHGLGVDVSLLAVPSEKAFFQALECTRKGGKILFFAEFPDEVEIPLNPNILYRREIDLMGSYSSSYRLQSLACDIIFNRRIDVKTLVSDRYPLSKLAEAVEQAVHPTPETYKILIYPES

SEQ ID NO: 39012 - protein, 168 aa, Oryza sativa (japonica cultivar-group)
MGDDGGGDGGASSAGFSYFAVFHNYPLVAALLGFAVAQSIKFFVTRYKENRWDPKQLIGSGGMPSSHSATVTALAVAIGFQDGFGCALFATAAIFASVVMYDASGIRLHAGKQAEVLNQIVCELPSEHPLSETRPLRELLGHTPTQVCSNAIFTNHFIILHQSKAMSY

SEQ ID NO: 39013 - protein, 243 aa, Arachis hypogaea
MGRGRVELKRIENKINRQVTFAKRRNGLLKKAYELSVLCDAEVALIIFSNRGKLYEFCSSSSMLKTLERCQKCNYGAPETNVSTREALELSSQQEYLKPKARYEALQRSQRNLMGEDLGPLSSKELESLERQLDSSLKLIRSTRTQFMLDQLSELQRKEHLLSEANRALRQRQLEGYQINPMQLNPGGVDDMGYARHPPQPQPDPLFQQLDCEPTLQIGYQPDPVSVVTAGPSMGNYMGGWLP

SEQ ID NO: 39014 - protein, 290 aa, Pyrobaculum aerophilum str. IM2
MEIKMAEAGDVALRKYGTAMPQEALRLADAADVIFKGPIGESAYDVTSLIRMRYTLYANIRPVKNLPGVPAVREIDCVFVRENVEDVYVGAEYKVGDVAIALKVITEKGTRRVARMARKYAEMRRRRVTIVHKANVLRVVDGFFRDIALEELKGLEVDQMYVDAAAMELVRNPKRFDVVLTMNQYGDILTDLAAQVAGGIGLAPSGNIGDAKAMFEPVHGAAFDIAGKGVANPIATILSAAMMFEWMGRGDVAEKIRGAVEKSIEAGVKTPDIGGDKSTIEVGKFIASIL

SEQ ID NO: 39015 - protein, 458 aa, Solibacter usitatus Ellin6076
MPRVVIVGGGISGLSAAYYLAKGGVSSTIIESRPRLGGVIQTERIEDCTIEAGPDSFLSVKPAALDLIRDLGLADDVIGSNDHLRITYVRKGGRLVPLPDGLMMMVPTKILPLVTTGLLSPATKIRMGMELLRAPKMRTGDESVADFVREHYGQEAVDYLAEPLLSGIYGGDPRELSVTAVLPRFVELAAKYGSLTRGVLASRAQAPKTQSPAPLFRTLKGGLGQMVDAVVASIQGKVEIRSARAHSVERTPAGFRLQLDGEWMEAEHLVIACEAHSGAELLAGVDARLSELLGMVAYSSSMTVAVGFDAKDFANLPRGFGFLVPKKERRRLVACTWVGTKFSHRVPEGKIVARCFLGGMEDAGVLAEKDEAIQAAVLDELREIAGVTAPARFTRIARWPRSMAQYTVGHPAREAELEARIAEIPGLHVAGNAYQGIGIPDCIRMGKAAAGKILGVAQ

SEQ ID NO: 39016 - protein, 415 aa, Nocardia farcinica IFM 10152
MTSADPGNALHRRLGLTDSVVIGLGSMVGAGIFAALAPAAAAAGSWLLLALGVAALLAYCNAMSSARLAARYPVSGGTYVYGRERLGPFWGYLAGWGFVVGKTASCAAMALTVGHYAWPEHARWVAVATVVAITAVNYTGVQKSALATRIIVGAVLTVLVVVVVVAFSGSHSAAAPMPGRIGPGDVLQAAGLLFFAFAGYARIATLGEEVREPHRTIPRAIRLALGLALAVYALVAVAALLTLGSQGLATAVDPLARVVAAAGAGWLTPLVRAGAVLAAAGSLLALILGVSRTTLAMARDGHLPSPLATVHPRFGVPHRAELAVGAVVAVVAATADLRSAIGFSSFTVLVYYLVANLSAGTLGAGEGRPARWIPVVGAAGCVIVGFALPIGSVLAGLAVLALGAGWYAVRSARLA

SEQ ID NO: 39017 - protein, 232 aa, Zea mays
HVVINKSRFTQRNLLRIFPRSTRITSSNYNPLMGWRYGVQMVAANMQGHGRKLWLTQGMFRANGGCGYVKKPDALMRSKPLDFDPRAELPVKTRLRVTVYMGDGWRFDFRKTHFDRCSPPDFYARVGVAGVPADTRMEQTRVAMDSWVPAWDHEFGPFPLAMPELALLRVEVHESDNHQKDEFGGQTCLPVWELRPGIRSVRLSDHKGQPLPSVKLLMRFDFFPASDSNSTQ

SEQ ID NO: 39018 - protein, 452 aa, Burkholderia thailandensis E264
MTHLARQLDVQQFIDERRFSPYQWLILILCFLIVAADGFDTAAIGFVAPALGQEWHVTKAALGPVMSAALVGLALGALTAGPLADKIGRKRVLVGSVVLFGLFSIGCAFTQSVTELAVLRLLTGLGLGAAMPNATTLMAEYAPHAKRSFLVNTMFCGFTLGSSAGGLVAAALIPDHGWRSVFIVGGAAPLVLAALLIALLPESIRFMVLRGAPHERIAAVLRRIAPDATFDGVRFVLPDERGEQRRSGVAVVLSPRYRAGTAMLWLTYFMGLLVYYLMTSWLPTLIRDTGFTVRDAALVTALFPLGGGVGAIACGWLMDRFEPHRVIAVTYALTALFVWMIGLQAGHLALLAAVVFVAGICMNGAQSSLPALAAAFYPTSGRATGVAWMLGVGRFGGILGAFSGGLLLQAQFGFGTIFSMLAVPALIAAGALMVKRTAASRDAQPNAPTRAA

SEQ ID NO: 39019 - protein, 392 aa, Oryza sativa (japonica cultivar-group)
METVAAASYTRGAATRSPACCAAMSFSQSYRPKAARPPSTFYGESLRVNTARSLPSGRQSKAASRAALSTRCEIGDSLEEFLTKATPDKNLIRLLICMGEAMRTISFKVRTASCGGTACVNSFGDEQLAVDMLADKLLFEALEYSHVCKYACSEEVPELQDMGGPVDGGFSVAFDPLDGSSIVDTNFTVGTIFGVWPGDKLTGVTGGDQVAAAMGIYGPRTTYIIALKDCPGTHEFLLLDEGKWQHVQDTTTIGEGKMFSPGNLRATFDNPEYDKLINYYVKEKYTLRYTGGMVPDVNQIIVKEKGIFTNVTSPTAKAKLRLLFEVAPLGFLIEKAGGYSSDGKQSVLDKVINNLDERTQVAYGSKNEIIRFEETLYGSSRLTAGATVGAAA

SEQ ID NO: 39020 - protein, 678 aa, Oryza sativa (japonica cultivar-group)
MMLAGYGILAVVLVLLPPSATPAGIADCDLGVGNTYVGNSTFEANLNHLAAELPGNVSTAHTGGFAVATVGADPDQVFALALCRGDVNATACRACVAAAFVDGKNACPGINGVTVYEDACVVRFSGQRFMDFLSPDQWQVTEMIWVPEQASESVNAPAVGWFNAAIAKILAALVDHAVATATGNNSTTKKYFATGEEDFDPNIYGFAQCVPDLTQEQCKECLNTFLFQAKQVYFGKSLSWVGMNSVWCRLMYSVRPFYGGRAMLQLSAPPPPAAEAPVLSLEPGAGKKKSAAGIAAVVASSVVVLLILSFFAVVLFRRRSKVTETDHQLRKITRAQCLIFDLPALQEATDNFSDNNKLGEGGYGIVYKGVLSDGQEVAVKKLLGTSEHGLDQLQNEVLLLAELQHKNLVKLQGFCLHQGETLLVYEYVKNGSLDNFLFDTSRGNTPNWEQLYNIIFGIAKGILYLHEDSSLRIIHRDLKSNNILLGEDMEPKIADFGLARLLEEGHTNTRTTRIVGTFGYMAPEYAIHGNVSTKIDVLSFGVLVLEIVTGRRNLNSDDHDRGNLLSDVWNCWTKGTVTQLIDQSLEEQFRRQALRCIHIGLLCVQSDPDDRPHMSSVIFMLSRENMNLQPPAQPAFFFDGDSNSCSQPFEQPVYNRPNAIYEEDISVNRMTVTDIYPR

SEQ ID NO: 39021 - protein, 277 aa, Bacillus cereus G9241
MKQLYGVIGNPIGHSLSPVMHNDAFEHLNMDAHYHAFLVKEEVLGEAVRGLKALGISGFNVTTPHKVAIMNYLDEIDPLAKQIGAVNTVVHKDGKLIGYNTDGIGFVRALQSISSEPLQEKRILLLGAGGASRAIYFSLADVGVREIDVANRTVDKAKELIAACTATVHSVALSLEKATEEQENYDIIIQTTTIGMHPRVQYTPLQISSLKKGTIVSDIIYNPFETKILCEAKEQGAMIQNGIDMFVYQGALAFEMWTGRTPNIERMKQLVIRKLGG

SEQ ID NO: 39022 - protein, 268 aa, Acinetobacter sp. ADP1
MQVNSVQIKNATAIVTGASSGIGLAFASLLAQKGYNLLLIARNINKLNDLAKTLSTQYDTQCNVLSIDLSEENASKKVLEYIITNNLNISVLINNAGFSGNYKFLEADWSQLSKELNVMSIAVTELCYLIAPLMEKNSWGRIINVSSGAAYLPPTQSLLYTGLKSYVLNFSQSLDMELKPKGINVTALCPGFTRSEFHNTMGTNKQVSKVPNFLWQAPDQVALEGWHAVMKGHPVCIPGLINKIIISTSRHLPLNLQYNLGKLMNPFK

SEQ ID NO: 39023 - protein, 398 aa, Prochlorococcus marinus str. MIT 9313
MATSRRLGRLGRGVFDRNDRRKQAYRLANAGPQSLPLLDLSLGSTDLSPPAVALEAIEVALRAPESSSYCLHASTRPFREAVAAWSQRRFGVSVDPDREVLLLVGSQEGTAHLPLAVLDPGDSALILDPAYPSHRGGLILADARIERLLLRPEQEWRPDFKALSNSQWDQLRMMVFGFPHNPTAQVGEQSWLAEAMDRGIRHQVVVAHDNPYVDLALDGEAPALLRCPGWRECGIEFFSFSKAWCLGGFRLAFAIGAEHLITALRELKGVVDFNQSLALQRGAIAALTDAQDWPQEILGVYRERRDRTLAALHALGWHAPCPSMALYLWLPIPAWAKQQNYNDETLAADLLDQTGVALTPGSGFGSGGDGWLRLALVHPVEDLEAAVARMWPWWHAHI

SEQ ID NO: 39024 - protein, 462 aa, Thermosynechococcus elongatus BP-1
MVKLTPTPAYSLTLRLETSLDPTELGTVLQIIGGQQGQVGSIRLLEKTANRILRELVVVAASQEHGQAIVNAVKSDGQATVLEVSDRTFRLHEGGKITIKSKHPLQEYDDLAMAYTPGVGRVSQAIADDPDLVHKLTIKSHTVAIVSDGSAVLGLGNIGPEAALPVMEGKAMLFQEFAGLDAFPICLATQEVDEIVATVKRIAPVFGGINLEDISAPRCFDIEARLQAELDIPVFHDDQHGTAIVTLAALKNALQFVGKSLETVRIVINGAGAAGIAVARLLRKAGAKDLILCNRRGILSLQTDLTPAQKEFAVTQTGTLADALGDADVFIGLSAPGVLTVEMVQRMAKEAIVFAMANPVPEIQPELIYNHVAVVATGRSDYPNQINNVLAFPGVFKGTLACRAPRMTEEMFLAAAEAIAGLVSPSERHSAYIVPSVFDPRVAPAVAKAVEDCARSLGLARA

SEQ ID NO: 39025 - protein, 415 aa, Pyrobaculum aerophilum str. IM2
MQSESGFLAYVLAQLKRSVELGGFPEDFYAMISRPKRILHVYIPVKMDSGRIEVFEGYRVQHNDALGPFKGGIRFHPEVTLADDVALAILMTLKNSLAGLPYGGAKGAVRVDPKRLSQRELEELSRGYARAIAPLIGDLVDIPAPDVGTNSQIMAWMVDEYSKIAGRNAPAVFTSKPPELWGNPVREYATGFGVAVVAREMAKRLWDGIEGKTAAIHGAGNTGAWAAYWLEKMGVKIVAVSSTKGTVYNKAGIPAAEILRYYKREIPFEKIPGEFIKDPEASLNVEADLLVPAAIENVIRSDNAGQVKARLVVEGANGPTTPEAERVLYQRGVVVVPDILANAGGVIMSYLEWVENLQWLSWDEEETRKRLEAIMVNNVARVYQRWQKEKWTMRDAAIVTALERIYKAMKLRGWI

SEQ ID NO: 39026 - protein, 250 aa, Kluyveromyces lactis NRRL Y-1140
MSLSREDSVYLAKLAEQAERYEEMVENMKNVASSGQELSVEERNLLSVAYKNVIGARRASWRIVSSIEQKEEAKEKSEHQVQLIRTYRSKIESELTKICDDILSVLDTHLIPSATTGESKVFYYKMKGDYHRYLAEFSSGDVRESATQASLEAYKEASDIATTELPPTHPIRLGLALNFSVFYYEIQNSPDKACHLAKQAFDDAIAELDTLSEESYKDSTLIMQLLRDNLTLWTSDMSETGQEDQPAEGA

SEQ ID NO: 39027 - protein, 227 aa, Haemophilus ducreyi 35000HP
MKQIEQLFINNHAWATRMKDEQSDYFKQLAEHQKPTYLWIGCSDSRVPAEKLTGLGPGELFVHRNVANLVIHTDLNCLSVVQYAVDVLNIEHIIICGHTNCGGIKAAIGTVEDYGLISNWLLHIRDLWFKHSHLLGKLSPEQRANMMTRLNVAEQVYNLGRCSIVKSAWECGKKLSIHGWVYDVNDGVLNDQGVIATSRENLEITYRNAIAKLTTEADELVAKKLAE

SEQ ID NO: 39028 - protein, 466 aa, Clostridium acetobutylicum ATCC 824
MEIFRKKTAEDFQDEASSSNLKRGLTSFDLAAIGIGAVVGTGIFVSTGQGAKLAGPSVVISFLVAAVTCGLCSLTYCELSSMFSVSGSTYSYSYIAFGEIIAWIIGWDLMLEYLVAASAISSGWSSTLIGIVKNYGVNVPDALTKSPLSGGIVDLPAIFITLVITFLLYRGVTESAKINNVIVGVKICIIALFVFLGITHVKVTNYHPFVPYGVNGIMSAAAIIFFSFIGFDAIATTAEETKDPKKDVPKGLLICFGVVVVLYMSVAIILTGIVPYTKIDINNALPGALSSIGITWGSALVGVGAVLGMISTLLVIMYGQIRIFMVMSRDGLLPKVFSSVNKKHSTPGLCTVITGVLVSIIAGFLPLKMIMELCNIGTLFAFILVSFGVIVLRYTMPNVERKFKCPGVPFTPLVTAFFCFYMMIHLPLFTWLRFGAWLLIGFVIYFVYGSKHSKMTARDRGKEEVS

SEQ ID NO: 39029 - protein, 302 aa, Streptococcus sobrinus
LDSQKEICVLGGSKIGLVELPWALMNPGDLLLLPDPGYPDYLSGVALGRVDYETFPLLAENDFLPDLAAIPEEIARRAKFIYINYPNNPTGRVATSDFYQDLVAWAKKYQVGVVSDFAYVPWATRAMKILAFCLHRGPRRSVLNSIPSPRPLTWPAGRLAFAAGNADMIEALNLIQDHLFVSIFPAIQDAGVAALLDPQAKEAIVQLNQIYDQRREAFVQASAKIGWQAFPSKGSFYAWMPVPRGYTSQSFADLLLEKAHVAVAPGVGFGQAGDGYVRIGLLVEPERLAEAVERIGALNLFG

SEQ ID NO: 39030 - protein, 320 aa, Glycine max
MEDQSNQENPGRTTSGVSHHQFPIPKVAIAASSGRNGSHRTCLPKLTHHNYVEYLSESSTYNLPKTSTEFMMKSSYLPVGNISDGYGVSGTDRNFFYSDDPGKACSFKTIGSSSNDLDISKVGFWRADEGIKVETESSQNLVYAESHASWTSDSVGDKHNASHDPMFMVGAPTLLPKPGCSSSKQKARVTERQRRQRIADNLKALHELLPNPAEGSQAYVLDDIIDYVKYLQLQIKEQSGSRLLQADSTAIPLVFHEGYGHYINQKMLNEPLEEIMGKLVEDDSAAAVQLLESKGLFLLPMALVDELSEAVQMFGGSALV

SEQ ID NO: 39031 - protein, 179 aa, Triticum aestivum
  misc_feature (57)..(57): Xaa can be any naturally occurring amino acid
  misc_feature (67)..(67): Xaa can be any naturally occurring amino acid
VLTNKAIEANDGKPLPLVQKAFIGLTAGAIGACVGSPADLALIRMQADSTLPAAQRXRHYKNAFHAXSYDQSVELFRDKLGAGEYQTVIGASAISGFCAAACSLPFDYVKTQIQKMQPDATGKYPYTGSLDCAMQTLKTGGPFKFYSGFPVYCVRIAPHVMMTWLFLNQIQKYQKKIGI

SEQ ID NO: 39032 - protein, 574 aa, Thiobacillus denitrificans ATCC 25259
MSFSMHGIGVSGGIAIGYAHLASSARVEVPQYMLDHKYIKDELARFDEAILATRAELETLRSHIPANAPAELSAFLDMHLMFLGDSMIAEQPKRLIRETQCNAEWALAQQMEALVARFDEIDDPYLRSRQEDVVQVVQRVLKALMGHPSHLPLDVDFDSERILVAHELSPADMVIFKNVHFAAFVTDLGGTTSHTAILARSMGMPSVMALHNARGLIRDHDLLIVDGREGVVIVNPDESVLAEYRLRQNQWRIDTDKLKRLKTSKSATLDGTPVELMANIELLSDIDAVKAAGAHGIGLFRSEFLFLNRSDLPTEEEQYESYKAVAEALDGKPVTIRTLDLGADKQAPWGHTVADNPALGLRAIRLCLAEPGLFHTQLRAILRASAHGRVRMLIPMLANFVELRQTLQRIDEAKDSLRRDGLAFDEGIPVGGMVEVPAAALAASFFADQLDFLSIGTNDLIQYTLAIDRADDSVAHLYDPLHPAVLGLIQQTIRAGAKAGKPVAVCGEMAGDPLLTRLLLGLGLRTFSMHPASLLQVKQQILRSHLAELPALTQRLLKNTDPDRTLTLLGRLNG

SEQ ID NO: 39033 - protein, 273 aa, Panax ginseng
PYYVAPEVLLKHYGPEADVWTAGVILYILLGGVPPFWAETQQGIFDAVLKGHIDFESDPWPLISDSAKDLIRKMLCSRPSDRLTAHEVLCHPWICENGVAPDRALDPAVLSRLKQFSAMNKLKKMALRVIAESLSEEEIAGLKEMFKAMDTDNSGAITFDELKAGLRKYGSTLKDTEIRDLMDAADVDNSGTIDYGEFVAATIHLNKLEREEHLMAAFQYFDKDGSGYITVDELQQACAEHNMTDVFLEDIIREVDQDNDGRIDYGEFVAMMK

SEQ ID NO: 39034 - protein, 353 aa, Arabidopsis thaliana
  misc_feature (201)..(201): Xaa can be any naturally occurring amino acid
MGELDEAFIQAPEHRPNTHLTNSGDFIFSDEIPTIDLSSLEDTHHDKTAIAKEIAEACKRWGFFQVINHGLPSALRHRVEKTAAEFFNLTTEEKRKVKRDEVNPMGYHDEEHTKNVRDWKEIFDFFLQDSTIVPASPEPEDTELRKLTNQWPQNPSHFREVCQEYAREVEKLAFRLLELVSISLGLPGDRLTGFFNEQTSXFLRFNHYPPCPNPELALGVGRHKDGGALTVLAQDSVGGLQVSRRSDGQWIPVKPISDALIINMGNCIQVWTNDEYWSAEHRVVVNTSKERFSIPFFFFPSHEANIEPLEELISEENPPCYKKYNWGKFFVSRNRSDFKKLEVENIQIDHFKA

SEQ ID NO: 39035 - protein, 791 aa, Xanthomonas campestris pv. campestris str. ATCC 33913
MKFSENWLRSHVPIQASREELAATLTAIGLEVEAVTPLGDALGQVVVARIIAAVRHPEADRLQVCSVDAGQGELLQIVCGAPNARAGLVAPLALVGAQIGELTIKAAKLRGVASNGMLCSAKELGLDSDASGLFELPDDAPVGQALAEYLGLPDASIEIKLTPNRADCFSVRGIAFDVAAACASEVAAFDAAAVAPVSTRTLAVELNAGSEAPRYCGRVIEGIDPAATTPVWMAERLRRSGVRPVSLLVDITQYVMLELGQPMHAFDLDTLHGPVGVRRSRAGEQLALLDGREVTLDDSFLTITDADRPVALAGLMGGLDTRVTNTTRNVFLESAYFDPAAIMGRGRKLGLHTDAGHRFERGVDPALAPQAIEVATRLVLELAGGMPGPVVDAALPHHLPQPASILLRRARIARVLGIQIDDADVARILTALGMHVEAAADGWQVTAPSRRFDIAIEEDLIEELARIHGYDRVPTTLPGGASRIAMPSETQLDELSVRRQLVARELQETINYAFVDAALLERWQLTDGVVPLANPLSAELAVMRPRLLPGLVATLGRNVARQVGRVRLFELGKVFSAAGPGDAPVESQQVAAAVCGDALALQWGEPARKVDFHDLKGDLLALAAASGAVLEFQPSTQPFGHPGRSADIYRDGVCIGWIGQVHPRLAKSLDIDVDVIAFELQLAPLVKRALPRAGELSRYPSMRRDLAFLVPDAVSWAALSASVRTSVGPLLREVQLFDRYVGQGVEPGFKSLAMGLILQDNSRTLTDRDVDAVVADVVAVIEREHRARIRG

SEQ ID NO: 39036 - protein, 123 aa, Acinetobacter sp. ADP1
MSGKHPLVQAVENAQLKSDIPAFAPGDTVIVQVKVKEGDRERLQAFEGVVIAKKNRGLNSAFTVRKISSGVGVERVFQTHSPVVAKIEVKRRGDVRRAKLYYLRELSGKAARIREKLPARKRG

SEQ ID NO: 39037 - protein, 231 aa, Magnaporthe grisea 70-15
MARKFFVGGNFKIFTSSEVVISPPHVYLSHTRSLAKKEIEVAAQNVFDKADGAYTGETSVSQLKDLGINWVILGHSERRTILGESDEVVASKTKYAIDNGLKVIWCCGESLEERESDKTVEVVTRQLEALKAKVGTSGWENIVIAYEPIWAIGTGKVATPEQAQDAHAAIRGYLKSKVSDKVAEETRILYGGSVNEKNCGELSQKPDIDGFLVGGASLKPAFVDICTCKSA

SEQ ID NO: 39038 - protein, 134 aa, Triticum aestivum
  misc_feature (24)..(24): Xaa can be any naturally occurring amino acid
  misc_feature (36)..(36): Xaa can be any naturally occurring amino acid
  misc_feature (38)..(38): Xaa can be any naturally occurring amino acid
  misc_feature (46)..(46): Xaa can be any naturally occurring amino acid
  misc_feature (50)..(50): Xaa can be any naturally occurring amino acid
  misc_feature (59)..(59): Xaa can be any naturally occurring amino acid
  misc_feature (68)..(68): Xaa can be any naturally occurring amino acid
  misc_feature (85)..(85): Xaa can be any naturally occurring amino acid
  misc_feature (91)..(91): Xaa can be any naturally occurring amino acid
  misc_feature (94)..(94): Xaa can be any naturally occurring amino acid
  misc_feature (96)..(96): Xaa can be any naturally occurring amino acid
  misc_feature (101)..(102): Xaa can be any naturally occurring amino acid
  misc_feature (110)..(110): Xaa can be any naturally occurring amino acid
  misc_feature (119)..(119): Xaa can be any naturally occurring amino acid
  misc_feature (122)..(123): Xaa can be any naturally occurring amino acid
  misc_feature (125)..(125): Xaa can be any naturally occurring amino acid
  misc_feature (129)..(131): Xaa can be any naturally occurring amino acid
MGPTVMASSATSVAPFQGLKSTAXGLPVSRRSNGAXLXSVSNGGRXRCMXVWPIEGIKXFETLSYLPXFSTEALLKQVYYLIRSXWVPCLXFSXVXFIFRXXNASPVYYXGRYWTMWKXPMXXCXDLHXXXNEV

SEQ ID NO: 39039 - protein, 225 aa, Zea mays
MVSRPNPKISLFPPETQTQLRDRHPTRAYGAHGLPKSRNPHELLDPHSRSSANRSRAILIQRLAPSLVPLTRIASPSDASSSSPASILLPFSTRPSPSNSHTGSPHQQQAKISRSPLVSAAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 39040 - protein, 796 aa, Candida glabrata CBS 138
MNIIKKFMQLGEKQEISMIPSGEFNLLRSRKSPKSSLECIYNDAMLRIRKNGDWNFELVVNKIVEVGDNNNGDDSSDYTDDSVSVLSVASKRREEEWNFELKKDLNFSKEWNKNGDAAFVWGNTLGDEEVEKVQFVITPQLSLTEIENFLLTVYRCMYEAEHKKSASHVSREQLYKYRPEPPKELFVTESDSYDEENLGVSLSEVNPSQDNTSDNDDLFVDAPDNLDSKAKGKKIKTPKKDKTKASSSSSEEHKENNKGVEGEKLCLLNAKVFVYDPFEEKFMIQEENVPIALVQSGKYEFWLSMEGKDVDFGLAVSPQANPSFTLSNNSFTFNYTVSRITLSYKIEFNDFKDFTIFENCWSKCIWMALNKKDWEELPKNEQKYIEDSIIADLERDLDTILKLDDEEEESEDEEDNEYSKSVVSSEAFEDPNSGSNKSNSSKGNSSLTVAFRGNRSYVVRDDKIGVFKVDDDDDLEFVSAIKNISDKNKKILDPKDPMMYMEDRFMVLSDSKNGDKLYKMDIERGKIVDEWEFKDKNVVQYAPTKKFDQLVAEQTLLGISDKSVFKIDPRINTKNKIVQDESKDYASKYNFSSLATTKDGYVAVGSKRGDIRLYDRLGIRAKTLIPSLGQAIKYITVSGDGRWLLATCDASLLLMDLSIKSGKNAGNISFLKSTPASENNKTYILQISPEHATHILNYTKKPLCFTKAYFNTGINQKEDRILTSNGPFAISWSMKKVLAGDEKPYKLDWYDSTVIENNFEYNNKQNVIVALKNDVSLSKIKHFKNVNKSIFKNEPK

SEQ ID NO: 39041 - protein, 409 aa, Actinobacillus pleuropneumoniae serovar 1 str. 4074
MTNHQTISTPKQVFVGLQMLFVAFGALVLMPLITGLDPNTALLTAGIGTLLFQLCTKGQVPIFLASSFAFIAPIQYGVQQWGIPTTMGGLVFTGFVYFALSALVKWKGANILEKLFPPVVVGPVIIIIGLGLAPTAVDMALGKGTTIEPNTALLISMATLITTLIVAVFAKGLMKLVPIMFGIVVGYILSLIFGIIDFSSVTNAAWFSLPKLTTPEFKLEAILYLLPIALAPAVEHVGGIMAISSVTGKDFMTKPGLHRTLLGDGVATSAAAFLGGPPNTTYAEVTGAVMLTKNFNPRVMTFAAIWAIAISFCGKVGAFLQTIPGVVMGGIMMLVFGSIAAVGMSTLIRAKVDMGEARNLCIVSVVMTFGIGGMLINVGEFSLKGISLCAIAAIIMNLLLPKEAAKKAE

SEQ ID NO: 39042 - protein, 1201 aa, Actinobacillus pleuropneumoniae serovar 1 str. 4074
MPTNIYQLLPSSAVLRENISRHYRIDEAELVQQLLIEAETETLQPEIKNLARKLIEKVRTNRQKASGVDALMHEFSLSSQEGIALMCLAEALLRIPDQVTRDKLIKDKIAKGDWKSHIGNSPSLFVNASAWGLVFTGKLLSLNQQALSSSLNQLISKAGEPVIRKGIDFAMRLLGKQFVTGETIQLALKNSEARFNKGFRFTYDMLGESAFTEQDAQHYYQDYVNSIHAVGAASKGLGVYHSSGVSVKLSAIHPRYSLAQYDRVMDELYPRLRDLFLLAKRYNIGLNIDAEEANRLEISLDLIDRLLSEPELADFDGIGIVVQAYQKRCRSVIDYLIAKARENNRKLMIRLVKGAYWDSEVKLAQTESASGYPVFTRKVHTDLNYVACAKKLLAAQDVVFPQFATHNAQTLATIYHLAKGKRFEFQCLHGMGETLYDQVVGKENLNIQCRVYAPVGSYQTLLAYLVRRLLENGSNSSFVNQIVDENVSIDKLLEDPVAKAGITAGTMHPKTPLPIKLFADRKNSAGYELSDMHHLVQLGAQLNALADHNQYRAVPQIAEQFYQGSQRKVIYNPADQTQIVGEVTYANETDVEKAFAIAEQNQTAWQATPAEQRAAILEKIADLMESNMPTLFDLAVREAGKTLNNAIAEVREAVDFCRYYANQVKRNPQAYQNPRGIIVAISPWNFPLAIFTGEVVSALVAGNVVLAKPAEQTSLMAHYAVELFYQAGVPKSVLQCLPGSGAEIGNKLTADPRVDGVIFTGSTETAKTINRNLQKHSKIIPLIAETGGQNALIMDSSALGEQVVADVLNSAFDSAGQRCSALRVLYLQEDVADHILTMLKGAMAELRVGKPQLLNTDIGPVIDRTAQSRLLAHIEKMKAVAKSYYQVPIAAEVEQNGIFVPPTLLEIDHISQIEHEVFGPVLHVIRFNADRFEQIIDDINSTGFGLTSGLHSRIDATIDQWLDKVHAGNLYVNRNTVGAVVGVQPFGGMGLSGTGPKAGGPLYLQRLVKSEAWTLADLEGEAVIETDKLAQAVRQTLTGEQQSEALALLQTLRQKSPLAQVYKMQGITGENNYLRFEARPMIAVSNGSLFAQIKALIAIAVCGSKAVVKKDSPLAEYAHQFAEYLMVTDDFNNLSALSVMIVLEPLSTQERQHYAECNGSILTYVESLELALSLLPLVHEKSISINTAAAGGNATLMSEMD

SEQ ID NO: 39043 - protein, 534 aa, Aspergillus nidulans FGSC A4
MAEINGSFVSPAADATVFPQVFQPAGLIADFLNGLTLWKTLATLFALAVVYDQFRYIYLKGAIVGPAWKLPFMGPFLQSVNPKFHEYKAKWDSGELSCVSVFHKFVVIASTRDMSRKIFNSPTYVKPCVVDAAHKLLGKTNWVFLDGKEHVDFRKGLNNLFTRQALSCYLPRMEEVYNDYYARFLKKSKNNNYKPTPWMPEFRDLMCAVSCRTFVGHYISDEAIDKISVDYYNITAALELVNFPIILPFTKTWYGKKAADMVLDEFAKCAAKSRARMAAGGEISCIMDAWIKAQLDSAKYREKIAKGIEVDSSEKPPQVLRDFTDYEVSQTIFTFLFASQDATSSACTWLFQLMADRPEILDKVREENLRLRNGDVNAPLTMDLLDSMTYTRAVVKETLRYRPPVIMVPYIAKKDFPITDKITVAKGSMIIPSVYPATRDEEAYPNADSFDPDRWITGTAEQHPKNFLIFGTGPHYCLGQTYAVLNLMAMIGKASMEMDWVHTPTPQSEEIKVFATIFPQQPGDLDELCHSMAL

SEQ ID NO: 39044 - protein, 134 aa, Aspergillus nidulans FGSC A4
MSKIHIRTNNAPAPAPFLSQATVVGNIVFCSGQLGIDPKTGKMVEGTVKDRTRQIIKNLSAVLEASGSSLADVAKVNVFLADMKDFQDMNEVYMEGFPEPRPARTCVCVKTLPMNSDVEIECSAVVTRPTKAKL

SEQ ID NO: 39045 - protein, 333 aa, Candida albicans SC5314
MRLKLKSTNGVSTITLDDSKKLFKDFLIDIQQDTQLHQDTSESVSTIKLGFPPKPIDLSYGLETTLSDKNIKDGDQLLIEFTSFKRKSVSEPPLSPQPSEKKPNLRDDIPSTFIESLNKYLILRNIPDDNSCLFNSISYAISGYDSFKNISPPEELRKVVVNYIEKDPELYSDLILGRPREEYCRWIIKKDSWGGAIELGILADWFNVRIVCIDIESGNFIRFENEKDHPEKFIILIYSGIHYDVLATNDELSTENKDTDVAQWSTGDVQQEEDILAASQKLCKLLQSKDYATNTTTFRVRCLDCYSVLVGEMGASKHAEETGHLNFGEVKKS

SEQ ID NO: 39046 - protein, 183 aa, Oryza sativa
  misc_feature (6)..(6): Xaa can be any naturally occurring amino acid
  misc_feature (68)..(68): Xaa can be any naturally occurring amino acid
MHVVQXLAATDDDAAAAAEGITVAEASSDPENKCVYTIYVRTGTIWKGGTDSVIGVTLLGADGSGVRXSRDLERWGGLMGDGHDYYERGNLDIFSGRGPCMRQAPCRMNLTSDGTGPHHGWYCNYLEATVTGPHLGCAQQLFTVEQWLATDASPYRLYAVVDNCNKAKDAAAADADEPRVTVL

SEQ ID NO: 39047 - protein, 368 aa, Mycobacterium bovis AF2122/97
MTSGSLQFTVLRAVNPATDAQRESMLRAPGFGKYHTDHMVSIDYAEGRGWHNARVIPYGPIELDPSAIVLHYAQEVFEGLKAYRWADGSIVSFRADANAARLRSSARRLAIPELPDAVFIESLRQLIAVDKAWVPGAGGEEALYLRPFIFATEPGLGVRPATQYRYLLIASPAGAYFKGGIAPVSVWVSTEYVRACPGGTGAAKFGGNYAASLLAQAEAAENGCDQVVWLDAVERRYIEEMGGMNIFFVLGSGGSARLVTPELSGSLLPGITRDSLLQLAIDAGFAVEERRIDIDEWQKKAAAGEITEVFACGTAAVITPVARVRHGASEFRIADGQPGEVTMALRDTLTGIQRGTFADTHGWMARLG

SEQ ID NO: 39048 - protein, 444 aa, Oryza sativa (indica cultivar-group)
MDPCPFVRVLVGNLALRMPVAPPAAGAGAGVHPSTAPCYCKIRLGRMPWQVAAAPLVVADGGEQAPSGALAAAFHLSKADLEWFARKPSLLFSSSSSSRGPATLKVAVYAGRKGTTCGVSSGRLIGKATIPVDLKGAEAKAAVVHSGWICVGKKSGGKGGSAAAELSLTVRAEPDPRFVFEFDGEPECSPQVLQVRGSMKQPMFTCKFGCRSNSDLRRSVVQTERDAAAAAGKERKGWSVTVHDLSGSPVALASMVTPFVASPGTDRVSRSNPGAWLILRPAGDGSWEPWGRLECWRERGGAGASDSLGYRFDLLLPGVDHAVPLAESSIAASKGGKFAIDLTSMQPQSRGGTPGCSPRGSGDFSQWPLSSYSYRGFVMSSSVQGEGRCSKPTVEVGVPHVGCAEDAAAFVALAAAVDLSMDACRLFSHKLRKELSHLRSDVLR

SEQ ID NO: 39049 - protein, 121 aa, Actinobacillus pleuropneumoniae serovar 1 str. 4074
MSNTTFEETIFSKIIRKEIPAAIVYQDELVTAFRDISPQAPTHILIVPNKLIPTVNHVEAEDELALGRLFTVAAKIAKEEGIAEDGYRLIVNCNVHGGQEVFHIHMHLVGGEPLGKMLNNK

SEQ ID NO: 39050 - protein, 414 aa, Oryza sativa (japonica cultivar-group)
MPVTEHQGSSSSPSTFSFGRSLLSLRRDHVAMPSGEEADLEAFQRHFAASLGELLPGEVEGGGGGGGGGGGGGGEEILSVAWIRRLLEAFILCQEEFRVFVAQARRRGALPAAGEKLVVEFHERAVKALDVCNAARDGVDQVRRWERLADIAASVLLAPGEIHEGQLRRARKALSDLSVLLVDDTAASGSGGVASFLASHRNRSFGRARASPSRASFAGATSSSHFRSLSWSVSRAWSASRQLQAIGAGLAAPRAHEAGLAAPVYAMGCVLHLVAWALVAAVPCPDRSTALQAHHLPAAPARAAFPWAPPLLTLQERLAEEGKRKDRRNSCGLLKEIHVLEKSTQKLTDAIDAAPIPLFGDREADVREAAAELAAVCAAMRDGLEPLERQVREVFHRIVRSRVEGLDSSMRNAD

SEQ ID NO: 39051 - protein, 262 aa, Desulfitobacterium hafniense Y51
MAKEIGKPSFDLTGKVAIVTGGTKGIGYAVAATFAMYGCDLAITSRTPADCERIAKDIETLYGVKCLGISADSSNKDDIDRVVAQTVETFGKIDILINNAGISGKTAALLDQTEDDFMNVINTNLKGVFQFAQAVAAQIAKQGKGGRIVNIASVGGLIGGKSVAPYGASKAGVLSLTKTMANEWARYGITVNAVCPGYVITELNQDIFADPEIKAKMEKRTPVRRLGSVEEVAGPVLAMVSDSFSYMTGTYILLDGGQTIGG

SEQ ID NO: 39052 - protein, 2110 aa, Aspergillus nidulans FGSC A4
MATISSAGPAISRLEYKRRQSFKRLFGPNARISVPSPDAGIRGHMPTTFSKKYLIAEEKKEWGPRLQNDRSGNWARDSLLELLSLEEGILDQADRAWQLYMFAGQPSELNQALFVQYSKSGKEPDHVRAKHLFYEMPEKSRSTEDYLTLLRSHLTVGQLEELGSVCQQAQVNGHGLSCWALALAHCIESSDWALAQGLYETVCPVDGHKLWDCILPLLNTSSVLTSLPNLSAQLQSRANNVVSAEQRKPDFVKYFTGKIFATSNLVENISTNILIRLLRDFHSAGFLTSHIFWNLIRTLQSSERRAMFVRSVVIYRDFDWLMDKMPPSTQILNQFVKQLAHFDITANVDYFLEQFSRYHSKPPAIAYRHALAVFSRAADSSSVNRVYEQYVTHYGERVTSQFWKMRAHLLYAHARKGDVHETLVEFGKLWRKTSRRPPTHCWNILLTAYANAGDLTGCFSRFKMMVENKVKLDSYSFGIILGLCAHRGDIDLVLEALEVAKQQQVQLTTPMLDTVVEAHCRNKNLKQAEHFAEACLTVDATGSRVRMWNILLWNYAFEMDLESIARIRSRMDAAGIPADDMTYAAFLLSLVLLRQTDSARRILRTLSRSGQMHATQFHYALVLYGYVKDRNRDMVHVIFREIQERFGHHEPGTQLLFLRSQLQRDLHLIAQAQAEEAGMDSTEVHFVHAEKLLAEIIEDFDQARLVKTAPIPGVSRLPVAEAFPSSYYEPLMTEYAKKGNLDRVKQLFSEYAKARRQSIEDAQARAPLSLLTSLMLAYLKADQLEKVDECWKLAHRRARSLGKPISERLWKPQELPATTKRPPLLPAYRFELSRPLSLYMRSLAYRKRFKEIDEVVAQVEKDGFCLSTFNWSTYVQMFATTDDPTNTLKAFSVFEEKFMPAFPGWNHLRQSHGFKHSNVTAAIDLMEKQPFPKPRGMLGPKGKRYWSKRHPEFAQPTYVSLVYLASALLRARNNSIEAGTAELSALNNAAPKTITAIAAMPRLREKFQGVLLRDRAERPDRVFPERERFVWTGGVLGVGGRRRLPNMADFNPLNAEPDSSASTENSDPHQTLEPSWSTINYEDQFDLQAESALFSRREQLTTDEPLDDESIPSDMLDRELLDAVLAKQADEAALESESQTPSEEAHERLHEAPDVQQAQSESHPGHDCYIPEIYESPKGLKDDLYPPSISSTHTSIVEHRNFSGHHFLSLNRSTKKYKDNRLSDSFAMQLLVDANRLQIAYHCPLPVIVLKTLFCHRRNNSSAWTEHNSVMRPLKIECALPLSSLIPAMLERVSIDEIRAHNREMADGLLTSPFDWTQAFDRALKDVIKTLPNRPSSETADEVNYYCAYVGAFGEFSCNPRTLGSSHLNRMVSLEGIVTKCSLVRPKIIQSVHYNERKDRFVTRKYRDQTMTATGATFMNIYPQEDEDKNPLITEYGYSGQLPRSVDVIVDDDLVDRAKPGDRIQLVGIYRSLGNRNASSGSSTFRTVVMANNIIQLSSKSGGGIAQATITDTDIRNINKISKKKHVFELLSSSLAPSIHGHEYIKKAILLMLLGGMEKNLDNGTHLRGDINILMVGDPSTAKSQMLRFVLNTAPLAIATTGRGSSGVGLTAAVTSDKETGERRLEAGAMVLGDRGVVCIDEFDKMSDVDRVAIHEVMEQQTVTIAKAGIHTSLNARCSVLAAANPIYGQYDPHKDPHKNIALPDSLLSRFDLLFVVTDDIEDARDRMVSEHVLRMHRYRQPGTEEGAPVREQLNQTLGVGIDDADDSNQPTDVFEKFNAMLHVGIANTSRGRKKDIEILSIPFIKKYIQYAKSRIKPILTKGAADHIVATYSALRNDELSANQRRTSPITARTLETLIRLSTAHAKARLSSRVEERDAKVAESILRFAMFKEIVEDERRKRRKVTTFDDDSESSDDDSDEDGDDDQTPTNASVTPRSTRRNLRTRAPAAARSSTNEDVEMDADGDNVSVVEDDLYNASPRGQRNQSSQSQMSVASSRPASQLIGSQTDTSQTQNASASAPASSQTITPARLTLFRQALGPLMGTALFSSSDTADLEELIGAVNAAIRSSRSLGGESAVFQRPEAIQALKAMNERNELMYLEDDETVYRI

SEQ ID NO: 39053 - protein, 251 aa, Pseudomonas fluorescens PfO-1
MRRPMVAGNWKMHGTRASVAELINGLRHLALPSGVDVAVFPPCLYINQVIDGLKGKSISVGAQNSAVESMQGALTGEIAPSQLVDAGCSLVLVGHSERRQIMGERDGMLNRKFAAAQACGLIPVLCVGETLEQREAGKTLEVVGRQLGSIIEELGVGAFANAVIAYEPVWAIGTGLTATPQQAQDVHKAIREQLAAENSEVARGVRLLYGGSVKAANAVELFGMPDIDGGLIGGASLNADEFGAICRAAGN

SEQ ID NO: 39054 - protein, 222 aa, Triticum aestivum
  misc_feature (26)..(26): Xaa can be any naturally occurring amino acid
  misc_feature (148)..(148): Xaa can be any naturally occurring amino acid
  misc_feature (219)..(220): Xaa can be any naturally occurring amino acid
MQRNGVMECTACRSRLVAPSPRSVSXRAYDKHHNKITSKFRALKFLLVVGDCMLVGLQPILVFMSKVDGKFQFSPISVNFLTEVAKVIFAIVMLIIQSRKQKVGEKPLLARSTLIQAARNNVLLAVPALLYAINNYLKFIMQLYFNPXSTVKMLSNLKVLVIAVLLKFIMRRRFSVIQWEALALLLIGISINQLRTAPAGDTAFGLPITAIAYIYTLIXXTI

SEQ ID NO: 39055 - protein, 882 aa, Oryza sativa
  misc_feature (191)..(191): Xaa can be any naturally occurring amino acid
  misc_feature (222)..(222): Xaa can be any naturally occurring amino acid
  misc_feature (281)..(281): Xaa can be any naturally occurring amino acid
WSPGHLNQRRTAANNHLITRPRRRRRRRPIRPRPRRWRKLHAESAAAAPGSRSSSSPSSSPSRRGRSRSTRRTSRTPATPPTRAPPSATPATPPPPPPPPRRPATRTWCSAPPRPSTPPLSPSPTSSTSPPPPSPTPTPSTRSPPSPPTASCSRPCRAAAPRAATTSTTPPTPSATPASRPTSSSPTSPTXPLDVPGSHRAESPPRQPRPRRRRQPHRPAPXAPAPRRRRPPRASSTWSPTSSPGATPSPPSPRGSASTRRRCSTPTRSPRAPSYTPSPRXLVPLKNAPTPDMLAPPAQAPPPPAPAPPRAQPPPGGSGSGKGVAVGVGVGCGVLALAGVFGLLFFCLRRRRGVGEESVRPGKVVGDVSSSAEYGALASGKQTTTATSMSSLSAARSLMASEVREALESLTVYKYSELEKATAGFSEERRVPGTAVYRGVFNGDAAAVKRVSGDVSGEVGILKRVNHCSLIRLSGLCVHRGDTYLVFEYAENGALSDWLHGGDAATGVLGWRQRVQVAFDVADGLNYLHHYTNPPCVHKNIKSSNILLDADLHGKMSSFGLARALPAGDGAAAAAAQLTRHVVGTQGYLSPEYLEHGLITPKLDVFAFGVVLLELLSGKEAASSGDGENGEALLLWESAAEALVDGGGEDAGSNVRAFMDPRLGGDYPLDLAMAVASLAARCVARQPAARPAMDEVFVSLAAVYGSTVDWNPSDHGNSGRKEHGEHAERLLVQLLVEHAVDVAVAVVSALRLRRHDVHLLLLLLAAALPVSPPPLWPLADERQARADGEPAHSASELHTKKDAASSPPPSTSETTATQGEAGSSLSEPSAAITLAGGGGGAGASDSTTMSLSGRWIKDEEDVFIEWQKQRVGPGVFPLFKTK

SEQ ID NO: 39056 - protein, 254 aa, Oryza sativa (indica cultivar-group)
MAALLARQAAQALRARQMAQLGPSATAMQGHIRTYMGAGKPTRKVCDPLFPLMLILNFLASVFERSINTLFLTEMINYPFEKGPLSPRFRGEHALRRYPTGEERCIACKLCEAICPAQAITIEAEEREDGSRRTTSPRFRGEHALRRYPTGEERCIACKLCEAICPAQAITIEAEEREDGSRRTTRYDIDMTKCIYCGFCQEACPVDAIVEGPNFEFATETHEELLYDKEKLLENGDRWETEIAANLESESLYR

SEQ ID NO: 39057 - protein, 476 aa, Solanum lycopersicum
MGDSTNFAAKHPVSINITESKLFDDDGRIKRSGSVWTASAHIITAVIGSGVLSLAWAVAQLGWIAGPIVMLLFSFVTYYTSSLLSDCYRSGDPLFGKRNYTYMDVVQANLSGLQVKICGWIQYVNLFGVAIGYTIASSISLMAVKRSDCFHKHGHKAPCLQPNTPYMIIFGVIEIIFSQIPDFDQIWWLSIVAAVMSFTYSTIGLGLGIAHVAETGKIGGSLTGVSIGTVTEMQKVWRTFQALGAIAFAYSYSLILIEIQDTIKSPPSEAKTMKNATIISVSVTTVFYMLCGCFGYAAFGDHAPDNLLTGFGFYDPYWLLDIANIAIFVHLVGAYQVYCQPLFAFIEKTAAEWYPNSKIITKNISVPIPGFKSYNIYLFRLVWRTIFVIISTIISMLLPFFSDIVGILGAFGFWPLTVYYPVEIYIVQKKIPKWSRKWFGLQILSVTCLIVSIAAAVGSFAGVVSDLKVYKPFKFT

SEQ ID NO: 39058 - protein, 444 aa, Bacillus cereus G9241
MFKWLKPAPAIERLPADMIDRVYRLLRIRVLIGISVGYAAYYLVRSNFTLSSTYLVQEYGFSTAEIGLLGSVMAIVYGFSKFFMGNLSDKAFAQRFIAVGLFLSGLVNICFGFASSFGMIVTLLVVNGIVQGMGAPPCSIVMTKWFSKKERGTKTGIWNISHNVGGMLVPPLVGIGVGIFGENHWQGGVFIFPAIIAMVISVLVWINAKDTPESEGLPPIDEYRNDYENLEKADNANKMSPKEILMKYVVKNKFVWFLCIANAFVYLIRFGVINWVPLYLTTVKGFSKNEAHAAYAIFEGMAIPSSLIVGLLSDKLFKGKRMPLCIISMVGVVIGTFVYWQATSILVVSIAVSIIGCLIYVPQFLIGLSAMELVPKFAVGTTVGMCGLFGYVGGSLVANAAIGVIVDRSGWDGCFILLLTGAILSTIFLFIVQRGHESKAPKSA

SEQ ID NO: 39059 - protein, 125 aa, Listeria innocua Clip11262
MAKEIIQTSSAPKALGPYSQAVKVNGLIFTSGQLGINPATGELAEGATKQAEQAFKNLAAVLEEAGSGLDKIIKATVFFKDLNDFTAVNEVYATFFSSDFPARSAFQVAKLPLDADIEIEVIAEA

SEQ ID NO: 39060 - protein, 471 aa, Solanum lycopersicum
MADKPHQVFEVYGESKCFDDDGRIKRTGSVWTASAHIITAVIGSGVLSLAWATAQLGWVAGPTVLLLFSFVTYYTSALLSDCYRTGDPVTGKRNYTYMDAVRANLGGFQVKICGVIQYANLFGVAIGYTIASSISMVAVNRSNCFHKQGHHAACNVSSTPYMIMFGVMEIIFSQIPDFDQISWLSIVAAVMSFTYSTIGLGLGVAQVAETGKIEGSLTGISIGTEVTEMQKIWRSFQALGAIAFAYSYSLILIEIQDTLKSPPAEAKTMKRATLISVAVTTVFYMLCGCFGYAAFGDQSPGNLLTGFGFYNPYWLLDIANIAMVVHLVGAYQVYCQPLFAFVEKTAAEWYPDSKIITKEIDVPIPGFKPFKLNLFRLVWRAIFVIITTVISMLMPFFNDVVGILGAFGFWPLTVYFPVEMYIVQKRITKWSARWICLQILSGACLVISIAAAAGSFAGVVSDLKVYRPFQS

SEQ ID NO: 39061 - protein, 219 aa, Actinobacillus pleuropneumoniae serovar 1 str. 4074
MTQQEMKKIAAQAALQFVKPDTIVGVGSGSTVNCFIDALASMKDQIKGAVAASKASEERLRAIGIEVFNANEVSELDVYIDGADEITPQGAMIKGGGAALTREKIVSSLAKKFVCIVDGSKQVDVLGTTFPLPVEVIPMARSYVARQLVALGGSPEYREGVVTDNGNVILDVHNFHIIEPLKMEHTINNIAGVVTNGIFAQRYANVTIVGTPEGAKIIE

SEQ ID NO: 39062 - protein, 176 aa, Triticum aestivum
  misc_feature (9)..(9): Xaa can be any naturally occurring amino acid
  misc_feature (79)..(79): Xaa can be any naturally occurring amino acid
  misc_feature (87)..(87): Xaa can be any naturally occurring amino acid
  misc_feature (108)..(108): Xaa can be any naturally occurring amino acid
QPGRPLMAXSATSLAPFQGLKSPAGFPVKRRSKGGSLGRVRNGGRIRCMQVWPIEGIKKFETLFYLPPLSTEALLKQVXYLIRSKWXPCLEFSKVGFIFREHNGSPGXYDGRYWTMWKLPMFGCTDATQVINEVEEVKEEYPDGYVRIIGFDNMPQVQWVSFIAFKPPGCEESGKA

SEQ ID NO: 39063 - protein, 459 aa, Oryza sativa
MDRFKMIKEVGDGTFGSVWRAINKQNGEVVAVKKMKRKYYSFEECMSLREVKSLRRMNHPNIVKLKEVIRENDILYFIMEYMECNLYQLMKDRVKPFSEAEVRNWCFQIFQALAYMHQRGYFHRDLKPENLLVSKDVIKLADFGLAREVTSVPPYTEYVSTRWYRAPEVLLQSSIYDSAVDMWAMGAIMAELLTLHPLFPGTSEADEILKICNVIGSPDEQSWPQGLSLAETMKFQFPQVSGNQLAEVMTSVSSEAVDLISSLCSWDPCKRPKAAEVLQHTFFQGCTFVPPTVRSKAGVLPKTPPCVGVKGVSEHGMPRRYSTGTLSTTKPHSNASLKSSGLSKTGVQRKLQMDRQAPQKIKKPTESNNKLTTNRVPARNSPGHPVLRHSRSLPETGRATMHKVSTLTERLSHMSVTSRTRTTPKPAAPLLKAGLGKSDLLGKTDEIPPAKRLTRKLVS

SEQ ID NO: 39064 - protein, 159 aa, Bacteroides fragilis YCH46
MKNEEYTYLGGLMQGIGSLLTGMKTTIKVYFRKKVTEQYPENRAELKMFDRFRGTLNMPHNENNEHRCVACGLCQMACPNDTIKVTSETIETEEGKKKKILAKYEYDLGSCIFCQLCVNACPHDAITFDQVFEHAVFDRTKLVLQLNREGSKVIEKKKE

SEQ ID NO: 39065 - protein, 324 aa, Rhodospirillum rubrum ATCC 11170
MAEPFIPGLIADIGGTNARFALTTPEGGWRDERVYRCAAFPGPAEAAAHYLAEVLTAFEPRPDRGAICVACPVNGDHLALTNHGAWSFSISAVADRLGLAPFHAVNDFIANALAIPRLGPSGLIEIGGGAGLTGAPIAAIGPGTGLGVAILIPGRGGNRTSPLATEGGHVTLPAVTDREAVIISALRAIHGHASAERAISGPGLVWLSEAIRAADGLEPVAETPPSVMEKGLARSCPVCAEAVDTFYALLGTVAGNLVLSTGAQGGVYLMGGILPRHPEALRTSAFLARFHEKGRFRDYLDVVPIRLVTHPYPAFIGLAGLVSD

SEQ ID NO: 39066 - protein, 704 aa, Prochlorococcus marinus str. MIT 9313
MPNAFCLAADTAVSKMHLGTPWPLGSTITTRGVNFSVAAPTAKRVELLLFADANATQPEHILKLQPCHRSGDYWHVEVEGLQTGCCYGYRIFGPHNPGSDSFHPSKVLLDPCTRAISGWDIYQREQAKGSSPNIQACLKGVVCEREHFDFASHPRPRTPWDRSVIYELHVGGFSSGPKSEVTPQRQGTFLGLIDKLPYLRKLGITAIELLPIFAFDPSDAPTGRDNYWGYSPLNWFTPHPKYVHGDDPLQARQQVRELVAACHDEGIEVILDVVYNHTTEGSIDGPTLSWRGFSDALYYHQNDSGEYLDVSGCGNSIAANRPIVRQLILESMRCWAIELGVDGFRFDLGIALSRGEGLKPLEQPPLFEEIEADPELSDLKLFSEPWDCGGLYRLSDFPAHRIGTWNGHYRDDLRAFWKGDEDSAWRMGQRLSGSADLYKGEPAPLGRSLNFITAHDGFTLNDLVSFNRKHNLANGECNRDGENHNNSWNNGIEGPCSDHAVQALRHRQMRNLIATLLLSRGVPMLLMGDEVGRSQGGNNNSWCQDNPLGWMLWNPEQCDMDLHLFVSRLLMIRHQLSELFSPVNHPPEEMPVRLQQSPDDLWMQWHGVEIDKPDWGSWSHTICYSLNRGSSGAVMWMGFNAYSKAMHFDLPEPTSAWHRILDTARPSPDDLPARPNAWTSEDIDLQNHSMLILLAEEYASKLKL

SEQ ID NO: 39067 - protein, 293 aa, Triticum aestivum
  misc_feature (35)..(35): Xaa can be any naturally occurring amino acid
  misc_feature (67)..(67): Xaa can be any naturally occurring amino acid
  misc_feature (117)..(117): Xaa can be any naturally occurring amino acid
MATKRSVGTLGEADLKGKKVFVRADLNVPLDDAQXKITDDTRIRASVPTIKFLLEKGAKVILASHLXGRPKGVTPKYSLKPLVPRLSELLGVEVVMANDCIGEEVEKLVAALPEGGXVLLLENVRFYKEEEKNEPEFAKKLASVADLYVNDAFGTAHRAHASTEGVTKYLKPAVAGFLMQKELDYLVGAVANPKKPFAAIVGGSKVSTKIGVIESLLAKVDILILGGGMIYTFYKAQGYSVGKSLVEEDKLELATSLIEKAKAKGVSLLLPTDIVVADKFAADAESKIVPATA

SEQ ID NO: 39068 - protein, 496 aa, Acidobacteria bacterium Ellin345
MSVVSAVELNSNVSQFITKPRKMLIGGNWIDSASGKFFETLNPATGEVLARVAEGDRADIDLAVAAARKAFESGPWSKMSPSQRGRLLWKLADLLEQHLEEFAELESLDNGKPLSVARVADVPLAVDLFRYMAGWATKVEGNTIPLGPQFHAYTYREPVGVIGQIIPWNFPLLMAAWKLGPALAVGCTVVLKPAEQTPLSALRLGELIMEAGFPDGVVNVVPGFGETAGAALAAHPDVDKIAFTGSTEVGKLIVQAAAGNLKKVSLELGGKSPNIVLADADLDIAISGSANAIFFNHGQCCCAGSRLFVHKSQFDKVVEGVAEAAKNIRLGSGLDPATNMGPLVSQEQLDRVCGYLESGVQQGAKPLVGGKKQTGPGYFVEPTVLVDVKPTMKVVCEEIFGPVVTAIPFNSVDEVLNSANASSYGLAAAVWTRDINKAHSLAAKLRAGTVWVNCYNVFDAALPFGGYKQSGWGREMGHDALELYTETKAVCVRLEN

SEQ ID NO: 39069 - protein, 576 aa, Oryza sativa (indica cultivar-group)
MASSALICDTEQWKGLQIGKAHYDFVFWCGEQAHVGEIQKTHLRHLMHDVERCKAMTACLLIDSEYEGIYLDYSRQRATGETMEKLFKLAEAAKLKEKIEKMFRGDKINSTENRSVLHVALRAPRDEVINSNRVNVVPEVWGVKDKIKQFSETFRSGSWVGATGKALTNVVSVGIGGSFLGPLFVHAALQTDPEAAESAKGRQLRFLANVDPVDVARSIKDLDPETTLVVVVSKTFTTAETMLNARTLKEWIVSSLGPDAVAKHMIAVSTNLELVEKFGIDPKNAFAFWDWVGGRYSVCSAVGVLPLSLQYGFPIVQKFLEGAASIDKHFRSSSFEKNIPAILPYSQALEKFAPHIQQLSMESNGKGVSIDGVQLPFESGEIDFGEPGTNGQHSFYQLIHQGRVIPCDFIGVVKSQQPVYLKGEIVSNHDELMSNFFAQPDALAYGKQFTWYFQTPEQLHSEKVPEHLIPHKTFQGNRPSLSLLLPSLSAYEIGQLLAIYEHRIAVQGFLWGINSFDQWGVELGKSLASQVRKSLHASRVEGKPVLGFNSSTTSLLTRYLAVEPSTPYNTTTLPKV

SEQ ID NO: 39070 - protein, 359 aa, Kluyveromyces lactis NRRL Y-1140
MSEISVKEYVKRQEELEDEANKLMPYDPSHCTYSMGPIRQPIFACRTCNSIGVCYSCSIQCHSTCDLVELFDKRNFSCDCGTERQFEHGEKFTPCNIRKNTTPDIPDMSNRYGQNFKGLFCSCHREYDPNTTTTMLQCVLGLECNEDWFHDHCILGIEENPDPVTEDRKLPGFPELSSFEGFISWVCIDKYSSIFEKLLSHEACDKIIAHKVYRRDLVSDQNSEGMTLESTKKRGLEEMENSSGSYSLFLKEGYREEFKRLRDSLPEGDSLKSFFMHTAPFLTCEEKVYEPPEEQEQGSLVEMGETALAQNLSHQQTLASLVAFQQIKSKLTDFLRPFAENDKVVSESDIKQFFDTQKK

SEQ ID NO: 39071 - protein, 379 aa, Triticum aestivum
  misc_feature (347)..(347): Xaa can be any naturally occurring amino acid
AAQQGRDLNSYDNDTAPVDPQNQGGNSSFNAIEIASITSATAIVSVLLALIVLFIYTRKCAPFMSARSSGRREVIIFQEIGVPITYETVVRATGTFNASNCIGSGGFGATYKAEISPGVLVAIKRLSVGRLQGWEQFHAEIKTLGRLRHPNLVTLVGYHLGESEMFLIYNYLPGGNLERFIQERSKRPVEWKRLHKIALDIAKALAYLHDTCVPRILHRDVKPNNILLDTNHNAYLSDFGLARLLGNSETHATTGVAGTFGYVAPEYAMTCRVSDKADVYSYGVVLMELISDKKALDPSFSPYGNGFNIVAWACMLLKQGRARDFFVDGLWDVGPHDDLVEVLHLAXVMCTVESLSIRPTMKLVVQRLKQLQPPIREHR

SEQ ID NO: 39072 - protein, 345 aa, Arabidopsis thaliana
MTATNKQVILKDYVSGFPTESDFDFTTTTVELRVPEGTNSVLVKNLYLSCDPYMRIRMGKPDPSTAALAQAYTPGQPIQGYGVSRIIESGHPDYKKGDLLWGIVAWEEYSVITPMTHAHFKIQHTDVPLSYYTGLLGMPGMTAYAGFYEVCSPKEGETVYVSAASGAVGQLVGQLAKMMGCYVVGSAGSKEKVDLLKTKFGFDDAFNYKEESDLTAALKRCFPNGIDIYFENVGGKMLDAVLVNMNMHGRIAVCGMISQYNLENQEGVHNLSNIIYKRNRIQGFVVSDFYDKYSKFLEFVLPHIREGKITYVEDVADGLEKAPEALVGLFHGKNVGKQVVVVARE

SEQ ID NO: 39073 - protein, 504 aa, Kluyveromyces lactis NRRL Y-1140
MFRNSNTLRTLNLLRKMSSKIENDYLIQTKAFINGKWTETDDKFAVTNPSTGDTIREVTNCGVSDFNKAIEIAHDAFGTFRQTNVRERAQILDNIYNLMLENKQDLAKILTLENGKPYKDSLGEIVYSAMFFKWFAEEAPRIYGDIIPSAVSSDQKIFTIRQPLGVIGILTPWNFPSAMIARKLAPVIATGNTCVIKPAHETPLSALALGVIAEKAGLPAGVCNILPTNHTSEIGEYVCEHELVKKITFTGSTKIGQLLMGQSSKGKNIKKFSMELGGNAPYIVFKDADLDRALDGIIGCKFRQSGQTCICANRIFVHEDLYDEFSKRLVDKIDKTFKLGDGFQDGVTHGPLIHDKSIDKVASLVQDAKTKGADVLIGGSRASSLGPLFYQPTVLGNVTESMDIFYEEIFGPVAPLIKFKDVDEVIKRANDTDVGLAGYFYSQNISTIFDAAEKLNVGMVGVNTGEISEPAVPFGGVKNSGLGKEGSKYGIDDYTELKAIIVAP

SEQ ID NO: 39074 - protein, 177 aa, Candida glabrata CBS 138
MADVISSLQTQLKELDTKFAGNNVLNQLEQRTNLPKSYLVVGSTIFYLLLIFINVGGIGEILGNFAGFVIPAYYSILALKTTTTKDDTQLLTYWIVFSFLNVIEFWSKALLYIIPFYWFLKTIFLLYIALPQTGGATMIYNRFISPLTDKYILGPKKTDGVQQSVKEASRATGAATH

SEQ ID NO: 39075 - protein, 953 aa, Pseudomonas fluorescens PfO-1
MLELTVEQISMGQSAVDKPAALQLLASHLVADGLVADGYLSGLQAREAQGSTFLGQGIAIPHGTPETRDQVFTTGVRLMQFPDGVDWGDGQIVYLAIGIAAKSDEHLRLLQLLTRALGETDLGQALRRASSPEALLKLLQGAPQELALDAQMIGLGVSADDFEELVWRGARLLRQADCVSNGFAGVLQQVEALPLGDGLWWLHSEQTVKRPGLAFVTPDKPMRYLGQPLSGLFCLASLGEAHQALLERLCALLIEGRGHELGRATSSRKVLEVLGGELPADWPSARIALANAHGLHARPAKILAQLAKSFDGEIRVRIVDGQDSAVSVKSLSKLLSLGARRGQVLEIIAEPSIAADALPALLAAIEEGLGEEVEPLPAVSQQREVIADIAEVLSAPASGSLLQAIPAAPGIAIGPAHIQVQQAIDYPLRGESAAIERERLKQALADVRQDIQGLIERSKAKAIREIFITHQEMLDDPELTDEVDTRLKQGESAEAAWMAVIEAAAKQQESLHDALLAERAADLRDIGRRVLAQLCGVQTPAEPEQPYILVMDEVGPSDVARLDPARVAGILTARGGATAHSAIVARALGIPALVGAGAAVLLLKPGTPLLLDGQRGRLHVDADAATLQRASEERDTREQRLKAAAEQRHQPAHTTDGHAVEVFANIGESAGVISAVEQGAEGIGLLRTELIFMAHPQAPDEATQEAEYRRVLDGLAGRPLVVRTLDVGGDKPLPYWPIAKEENPFLGVRGIRLTLQRPQIMEAQLRALLRSADNRPLRIMFPMVGSVEEWRQARDMTERLRLEIPVPDLQLGIMIEVPSAALLAPVLAKEVDFFSVGTNDLTQYTLAIDRGHPTLSAQADGLHPAVLQLIDITVRAAHAHGKWVGVCGELAADPLAVPVLVGLGVDELSVSGRSIAEVKARIRELSLTQTQTLAQQALAVGSANEVRALVEAL

SEQ ID NO: 39076 - protein, 411 aa, Clostridium acetobutylicum ATCC 824
MKKKNKLLFILGIIGPGLITVNAGNDAGGIATYATVGASYGYKMLWGLLLITFSLAIIQEMNARMAVVTGKGLSDLIRENYGVKWSLFAMCILFIANFGVCVGDFAGIAASLELFGISKYITVPIMAFLVWFVITKGSYEKTEKVFLAFTFVFFTYIITCIKVHPNWNVVMKATITPSLSFTKGYVLTLIGMIGTTITPYMQFYLQSSVVDKGLSVKEYKYEKIDVYLGAIWGDLVSFFIIVCTAVTLYKAGIKIDSAEQAAMALKPLAGNYATILFAAGLFGASVLATMVIPLSTTYAICEAFGFESGLDNSFSEAKTFYGIFTFMILFSAALVLVPKLSLVGIMLITQQIAGILSPVILIFMVLLINNKDIMGKYINNKLQNVIVYLTVAFIIILSLILFVSPIIDKLM

SEQ ID NO: 39077 - protein, 517 aa, Oryza sativa
MGVTKAEAVAATGKVVDDIEALADLRKEPAWKKFLSHIGPGFMVCLAYLDPGNMETDLQAGANHKYELLWVILIGLIFALIIQSLSANLGVVTGRHLAELCKTEYPVWVKTCLWLLAELAVIASDIPEVIGTGFAFNLLFHIPVWTGVLIAGSSTLLLLGLQRYGVRKLEVVVALLVFVMAGCFFVEMSIVKPPVNEVLQGLFIPRLSGPGATGDSIALLGALVMPHNLFLHSALVLSRNTPASAKGMKDACRFFLFESGIALFVALLVNIAIISVSGTVCNATNLSPEDAVKCSDLTLDSSSFLLRNVLGKSSATVYGVALLASGQSSTITGTYAGQYVMQGFLDIKMKQWLRNLMTRSIAIVPSLIVSIIGGSSGAGRLIVIASMILSFELPFALIPLLKFSSSSNKMGENKNSIYIVGFSWVLGFVIIGINIYFLSTKLVGWILHNALPTFANVLIGIVLFPLMLLYVVAVIYLTFRKDTVKFVSRRELQAGDDTEKAQVATCVADEDSKEPPV

SEQ ID NO: 39078 - protein, 64 aa, Arachis hypogaea
MEFARHLVLKMMEDPEERDKKFREHVYTVKDRCAKTKEMWSLPMRPYGFWTFERHNSQLAWDAQ

SEQ ID NO: 39079 - protein, 387 aa, Pseudomonas fluorescens PfO-1
MSIQVEDYFARETFQKMKAFADKQETPFVVIDTAMIAQAYDDLRAGFEFAKVYYAVKANPAVEIIDLLKEKGSSFDIASIYELDKVLSRGVSADQISYGNTIKKSKDIRYFYEKGVRLFATDSEADLRNIAKAAPGAKVYVRILTEGSTTADWPLSRKFGCQTDMAMDLLILARDLGLVPYGISFHVGSQQRDISVWDAAIAKVKVIFERLKEEDGIHLKLINMGGGFPANYITRTNSLETYAEEIIRFLKEDFGDDLPEIILEPGRSLIANAGILVSEVVLVARKSRTAVERWVYTDVGKFSGLIETMDEAIKFPIWTEKKGEMEEVVIAGPTCDSADIMYENYKYGLPLNLAIGDRLYWLSTGAYTTSYSAVEFNGFPPLKSFYV

SEQ ID NO: 39080 - protein, 530 aa, Bacteroides fragilis YCH46
MEEIKYIEPAALHDEMLRLRNEKQMDFLESLTGMDWGVADEGDAPNVTRGLGVVYHLESTVTGERIAIKTSTNNRETPEIPSVSDIWKAADFNEREVFDYYGIVFIGHPDMRRLYLRNDWVGHPMRKDNNPEKDNPLRMDNEETYDTTREIELNPDGTYQTQENVIFDDREYVVNIGPQHPATHGVMRFRVSLEGETIKKLDANCGYIHRGIEKMNESLTYPQTLALTDRLDYLGAHQNRHALCMCIEKAMGIEVSERVKYIRTIMDELQRIDSHLLFYSCLAMDLGALTAFFYGFRDREMILDMFEETCGGRLIMNYNTIGGVQADLHPNFIPRVKKFIPYLRGIIHEYHDVFTGNVIARQRLKGVGVLSREDAISFGCTGGTGRASGWACDVRKRMPYGVYDKVDFKEIVYTEGDSFARYMVRMDEIMESLNIIEQLIDNIPEGPIQEKMKPIIRVPEGSYYTAVEGSRGEFGVFLESHGDKTPYRLHYRSTGLPLVSAVDTICRGAKIADLIAIGGTLDYVVPDIDR

SEQ ID NO: 39081 - protein, 180 aa, Zea mays
  misc_feature (171)..(171): Xaa can be any naturally occurring amino acid
MAWSAAAVSRFAAASPPAAPISVRLGAAASRSSLSFSSGRRRPVAASLSTSATVVKEAVQTEKAPPALGPYSQAIKANNLVFVSGVLGLNPETRKFISENVEEQTEQVMKNMGEILKASGASYSSVVKTTIMLADLQDFNKVNGIYGKYFPAPAPARSTYQVAALPLNARXIEIECIAAL

SEQ ID NO: 39082 - protein, 489 aa, Zea mays
MAANGMKVALHRQVSGGSMKQNAELRRQASLESPRTGRATSRFLFGRQSSMDPNRRRGRSQSPVRAPEDLGVPDNLDATMQLLFFACQGDALGIEGLLRSGVDVNSINLDGRTALHIAACEGHRDVVRVLISWKANIDARDRWGSTAVADAKFYGHSRVYDLLKFHGAKVPRTKRTPMMVSAPAEIPEYELNPGEVQFRRGCDVTPVQFSFFLCIHKHLFKNASEIWGNSFRHELTVLEKVRHPNVVQFVGAVTQSIPMMIVSELHEEKDLSVCIQKKGKLKPQKVLRYGLDIARGMTYLHQCKPDPIIHCDLKPKHIFLDSGGQLKIAGFGVTRMSKVGTDKVRLIYHGALVDSFSYHTAPELYRNDAFDSSVDSYSFGFILYEMVEGSVRAPEDSGHSIRFEGLRPSLKGRLKGYPPDFKALVEECWHPQAMARPTFSEIIIRLDKIYAHFDKHGSWKDSLKLWSVSRRLKRIVKRRSVRSRIHNEP

SEQ ID NO: 39083 - protein, 604 aa, Treponema pallidum subsp. pallidum str. Nichols
MPKISIHEALFFELLGERCDDDTLERRLRSAKAELECSSFSVREDKEGGSLSPGGEVCDPVQRTRGQASCVREGAFDARLLKIELNDTNRPDLWSTAGLARLLRVHAGGASRAAQYRAFLSDRCTVRDSYGRCVVVDARLQTIRPFIAGFVARGTGLSEVRLWDLIQTQERLASNFGRRRCTLSLGCYRAQDICWPLAYRAVLLAEVSFTPLGMSMPLSGEQILTQHPKGREYGHLLKDYSFVPLLVDARGEVLSLIPITNSASLGAVVTGDTELFIECSGTDMCAVLVAVNSLACDLSDMGMQIEPVQITYSFDTPWGRSVTTPFYFQEKREVAHEQIDRLLGMPLPVADITEAFARMDCAVQVKQGTYVVEPAAYRNDFLHAVDLIEEVMLGRTLDRFSPQVPCSFTVGRLSDLTLLTRKIKHLLVGFGYQEMIFHYLGSAREFCTRMRCTADDLIEIENPLTESYRFVRRSIIPCLLSAELKSAHALYPHRIFEIGKVAFCSPHGEHGTCTQQSLGFLNASQEASYNEVASLVSGLLYCLKLPYQVEEAQDPRFVLGRQASICVHGSRVGIFGEIHPQVLSNWDIRMPCFAGELDVGALLP

SEQ ID NO: 39084 - protein, 484 aa, Bacillus cereus G9241
MGIEQGDKVGTIAWNHHRHLEAYFAIPGIGAVLHTINLRLSADHISYIINHAEDKIILVDEDMVPILESIQHEIPHIKAFIIMTDDHKLPHTTLSPAYHYDQLLEEGDETFPFVKDLDEKEPAGMCYTSATTGKPKGVVYTHRSIALHSYTLGLADGGNISEVDTCMPVVPMFHVNAWGLPFASTWFGTKLVLPGPHFTPKILAELIERESVTITAGVPTIWIGLLQELEKHPYDISSIKTIWSGGSAAPLSMIRTYEERYEIAFRQIYGMTETSPAVVINCPKSYQRDLPKEEYYNLRSRQGYLFPGLEMKVIGQDGEIKWDGEEMGELCLRGPWIAGSYYKDERTEESMKDGWLHTGDIVTVDSEGFIKIADRTKDLIKSGGEWISSVDLENALMSHDKVLEASVVAVPHEKWQERPVACVVLKEEQAVEREELYALLEAEFPKWWMPDDILFVNEIPKTSVGKFLKRALRDQLKTYMVEQK

SEQ ID NO: 39085 - protein, 315 aa, Manihot esculenta
  misc_feature (303)..(303): Xaa can be any naturally occurring amino acid
MASASLLKSSPVLDKSEFVKGQSLRQPSASIIRCHPTAPSALTIRAGSYADELVKTAKTIASPGRGILAMDESNATCGKRLASIGLENTEANRQAYRTLLVTAPGLGQYISGSILFEETLYQSTTDGKKMVDVLVEQNIVPGIKVDKGLVPLPGSNNESWCQGLDGLASRTAAYYQQGARFAKWRTVVSIPNGPSALAVKEAAWGLARYAAVSQDNGLVPIVEPEILLDGEHGIDRTFEVAQKVWAEVFFYLAENNVMFEGILLKPSMVTPGAECKDRATPQQVADYTLNLLKRRIPPAVPGXMFLSGGQSEVEA

SEQ ID NO: 39086 - protein, 482 aa, Kluyveromyces lactis NRRL Y-1140
MSTTMLSTRNALARGLLRTSGGAAGASRNNLLLSLVASRYYSNGEKTLKQRFAEIFPEKAEEIKRLKKEHGKTVIGEVLLEQAYGGMRGIKGLVWEGSVLDPEEGIRFRGRTIPDIQKELPKAADGEEPLPEAIFWLLLTGEVPTETQVKALSADLASRSELPAHVESLLDNLPKDLHPMAQFSMAVTALESESKFAKAYAQGVSKKDYWNYTFEDSLDLLGKLPVIASKIYRNVFKDGKITSIDQNADYGKNLAHLLGYQNKEFVDLMRLYLTIHSDHEGGNVSAHTTHLVGSALSSPYLSLSAGLNGLAGPLHGRANQEVLEWLFKLREEVKGDYSPATIEKYLWDTLNSGRVVPGYGHAVLRKTDPRYTAQREFALKHFPDYELFKLVSTIYEVAPKVLTKHGKTKNPWPNVDSHSGVLLQYYGLTEASFYTVLFGVARAFGVLPQLIIDRAVGQPIERPKSFSTEKYIELVQSINAKK

SEQ ID NO: 39087 - protein, 200 aa, Desulfotalea psychrophila LSv54
MPMETQKRPTADEILEILQEGNARFRCCALEHPNLCQESRDKLNYSQEPMATVLCCSDSRVPPVHIFDLGLGDLFVVRVAGNIVNDQIMGSIEYAICHLHTPLVIVMSHSNCGAVTAVAKGTNLGGHMASLVPAIQTALKTVEGMEGGRVDNAAQQVALLMADLIRESEPIISDLVLEGKVKVVPAYYDLTTGKVEFLEL

SEQ ID NO: 39088 - protein, 331 aa, Oryza sativa (japonica cultivar-group)
MAEVQSVQALASSLAALPPEFVRSEHERPGATTFRGGDAPEIPVIDMAAPESAARVAEAAAEWGLFQVVNHGVPAAAVAELQRVGREFFALPQEEKARYAMDASSGKMEGYGSKLQKDLEGKKAWADFFFHNVAPPAMVNHDIWPSHPAGYREANEEYCKHMQRLARKLFEHLSTALGLDGGAMWEAFGGDELVFLHKINFYPPCPEPELTLGVAPHTDMSTFTVLVPNDVQGLQVFKDGHWYDVKYVPDALIIHIGDQIEILSNGRYKAVLHRTTVDKDRTRMSWPVFVEPPPEHVVGPHPQLVTDGSPAKYKAKKFKDYRHCKINKLPM

SEQ ID NO: 39089 - protein, 529 aa, Candida glabrata CBS 138
MTVDKKCVVISTGSHRTVAGFNNVDLPQCTIPSSYVRVLRDDDVSMDDGEEDESRYEYVFGLFDMMDEAAFDVNGKGGREVFTIVDDHGIPYNWKALERLYRYIYEKELKVDPSELPLVITLPSMTNRELETKIVENYMELAFEKLKVPVLQIVVEPLGIMLSTGKSSSLVIDVGATGCTVTPIIDGTILRNSIVKSRFAGDFLDFQTHKKLEELKKRVAKDDMETDGMEETPQSSLQVWLNANTSIHEFKTSMVSVFDKDLKEVEKYYEEQMRLYRQQQERMAEQQNSQTQQMNQYTIPMNNPNINNPLVQKQNYLLRVKDNKTGAMINRTVQVENKELYEIAEYLFQPKLASEDFSSKDGLGELIGKAIKKSGASVNSNTAGTQVSGSGNSSGGNSGPQTNGPLIPLNGYSSIGFGTSATGAGSDGSATNNITPEHVYSLLLTNVIITGGTSLIDGMEQRIIRELSIRFPQYKLSTFTNPDQLQRSLQAWNGAVSLSNLPKWGLTQWFTKEDFNNHKLKKDNNNVSQ

SEQ ID NO: 39090 - protein, 198 aa, Trillium camschatcense
QVTFSKRRNGLLKKAFELSVLCDAEVGVIVFSPRDKLYEFSSTSMQSTIDRYRMHTKCVNTNMPTEHNTQQWKYEAVSMANKIELLEASKRKLMGESLEPCTVDELQELESQIERSLSNIRGRKDYLLEQQIEELKEKERRLLEDNELLRHKSEEETELQLATPKGVQYDHGSQQMELETELHIGWPPKVATQCISHA

SEQ ID NO: 39091 - protein, 189 aa, Brassica napus
  misc_feature (39)..(39): Xaa can be any naturally occurring amino acid
  misc_feature (130)..(130): Xaa can be any naturally occurring amino acid
  misc_feature (137)..(137): Xaa can be any naturally occurring amino acid
  misc_feature (143)..(143): Xaa can be any naturally occurring amino acid
  misc_feature (158)..(158): Xaa can be any naturally occurring amino acid
STHAVRVRRSLAWHYSMLFSAAVDTSPAQANMDDPFTGXKAASAFPGTRKANNDITSIVSNGGRDNCMQVWPPIRKKNYDNLCYLPDLTEVQLGKEVGYLFRNKRNPCAEFEMEHCLSHREHGSTPRILXRPYWTMXKLTLFXCTDSAQEMKEVQECXTEYPNAFITIIGLYNNRQGQCINYNAYKPPS

SEQ ID NO: 39092 - protein, 179 aa, Glycine max
  misc_feature (122)..(122): Xaa can be any naturally occurring amino acid
  misc_feature (125)..(125): Xaa can be any naturally occurring amino acid
  misc_feature (162)..(162): Xaa can be any naturally occurring amino acid
MASSMISSPAVTTVNRAGAGMVAPFTGLKSMAGFPTRKTNNDITSIASNGGRVQCMQVWPPVGKKKFETLSYLPDLDDAQLAKEVEYLLKKGWIPCLEFELKHSFIYHKHNKSPEYYDRHYXPYXKLPIFNYTNTSHILKELQEAKTTYPNHFIHIIKFNNXVRQVQYIIFITYKPPSF

SEQ ID NO: 39093 - protein, 684 aa, Zea mays
MMASPPQTELQAVALALLVLLLAGAAPARAQQEYEANKQNACYATNASSVLGYTCNATTASTPACDSYLIFRSSPTYYNTPVSISYLLNSSVSATAAANAVPSVSPLAPSSLVLVPVPCACTPGGYYQHNSSYTIQFRGETYFIIANITYQGLTTCQALIAHNPLHDSRGLVAGNNLTVPLRCACPSPAQAAKGFKYLLSYLIMWGDDVTSIAARFRADPQAVLDANSLTADDIIFPFTTLLIPLKTAPTLDMLASTAPPPAPTPPQPAPAPSGRSGSGKLVGFGVGLGCGALALAGILGLLFLRARRRQRLPVGESVRQGSKVVIDVSSSADYGALASGKQITNTTTSSMSSAAWSLVASDVRGAVESLTVYKYSELEKATAGFAEEHQVPGTSVYRAVINGDAAAVKRLAGDVSGEVGILMRVNHSCLVRLSGLCVHRGDTYLVFEFAENGALSDWIHGGSGSCSGSSTLRWRQRVQVAFDIADGLNYLHHYTNPPCVHKNLKSSNVLLDADLRAKVSGFGLARAVTAAHGGAQLTGHVVGTQGYLAPEYLEDGLITPKLDVFAFGVVLLELLSGKEAGFADAGTGEEILLCESAEEALVADGGEDMDRAKVRAFMDPRLHGDFPMDLALSMAALALRCVAMEPRARPAMDEVFISLSAVYNSTMDCDPSDYGTSGSSMIGR

SEQ ID NO: 39094 - protein, 526 aa, Zea mays
METATVVVTPAPVSITHPPQHKFMKSSPARKPAKKKLASGRGGYVLEDVPHLTDYLPELKSYRNPLQDHPAYSVVKQYFVGPDDTVAKKIVVHRSSARGTHFRRAGPRKRVYFEPDEVRAAIVTCGGLCPGLNTVVRELVCGLHDMYGVTSIYGIEGGYKGFYARNTVELTPRSVNDIHKRGGTVLGTSRGGHDTAKIVNSIQDRGINQVYIIGGDGTQKGAASVHEEVQRRGLKCAVVGVPKTIDNDIAVIDRSFGFDSAVEEARRAIDAAHVEAESAENGIGVVKLMGRNSGFIAMHATLASRDVDCCLIPESPFYLDGKGGLLEFAEKRLRDNGHMVIVVAEGAGQDLVAESTRFADTHDASGNKALLDVGLWLSQKIKDHFKKKPSFPITLKYIDPAYMIRAVPSNASDNVYCTLLAHSALHGAMAGYTGFTVGPVNGRQAYIPFYRITEKQNKVVITDQMWALVLCSTNQPCFLTHEDDVERALMMDEEEPHMPLVEGENALFANPSMCNGNGHLCNGHKA

SEQ ID NO: 39095 - protein, 947 aa, Debaryomyces hansenii CBS767
MTVPVVNGSSCLSLYGKNRDLILQAINFYTNVVGLTKDSEESGSVYLRSNNSKVVIKLEESDEALSGSEVKQFTEGLVSLLGVNDWRSIESCITLMVKDLNQLVVALEENNYPVQISPNELYPDEVYTVDPLGNVVGFTVCFNPLTVNPPVKKLAPWNPEQDTMSASTSEFSKIGENGGSSKKRRNIAVMTSGGDAPGMNAVVFAVVRAAIFRGSKAFCVMEGYEGLIRGGSEYIKEMHWQDVRSYLSEGGTNIGTARCMAFKERQGRLTACKHLIESGIDALIVCGGDGSLTGADLFRKEWPSLIKELKDTNAINEEKYETYKHLNICGVVGSIDNDMATTDATVGAYSSLARICQAIDYIDATANSHSRAFVVEVMGRHCGWLALMAGIATSADYILIPEKPASSKDWQEQMCEIVQKHRAKGKRKTIVIIAEGAITLDLKPISSNDVKDILVNRLGLDTRVTVLGHVQRGGTAVAYDRIIGTLQGVEAVKAVLDCTPQTPSPLIAITENKVVRKSLVEAVEITKSVATAIEERDFEKAMSLRETEFVEHLNNFMSMNSANHNEPTLPIEKRKKIAIINIGAPAGGMNSAVYSMATYCMSRGHIPYAIYNGFTGLSRHESVRLMDWLDIEGWTSVGGSEIGTNRATPDETDIGMIAYYFEKYQFDGLILVGGFEAFVSLDQLEKARSMYPAFRIPMVLIPATISNNVPGTEYSLGSDTCLNALMEYCDVVKLSASATRGRVFIIEVQGGNSGYIATFASLVSGAQASYVPEEGIALGQLEMDISSLKEAFSIERGISKAGKLLLKSTNASKVLTTQVLANVINQEANGEFDAKTAIPGHVQQGGLPSPIDRTRGARFAIKAVQYIEDTFDDIRPYRYEMNFPTDNKKVQATAAVLGVESSHLKFRSIRKLYDFETELNKRMPKKISWNEVRDIADQLVGRTRIQK

SEQ ID NO: 39096 - protein, 236 aa, Oceanicola granulosus HTCC2516
MGAHPRRRGGPSRGGDGLMPALLFDLDGTLLETDPLHAAVFVDIFAEHGRDVDEAFYMKHIHGRLNAEIFEEYFPDSHTQEMADDKEARFRERLGGSAEPLPGLLALLERAEAAGWPMAVVTNAPRENAEAMLSAIGLDGRFATIVLGDDCPRGKPDPYPYAHAMRLLGVTPGQTLAFEDSRAGIASAAGAGATVLGVTTGLDADTLRAAGATATIRDYTDPALETEIRRIEGATA

SEQ ID NO: 39097 - protein, 172 aa, Triticum aestivum
  misc_feature (62)..(62): Xaa can be any naturally occurring amino acid
  misc_feature (74)..(74): Xaa can be any naturally occurring amino acid
  misc_feature (83)..(83): Xaa can be any naturally occurring amino acid
  misc_feature (85)..(85): Xaa can be any naturally occurring amino acid
  misc_feature (89)..(90): Xaa can be any naturally occurring amino acid
  misc_feature (98)..(98): Xaa can be any naturally occurring amino acid
  misc_feature (107)..(107): Xaa can be any naturally occurring amino acid
  misc_feature (109)..(111): Xaa can be any naturally occurring amino acid
  misc_feature (113)..(113): Xaa can be any naturally occurring amino acid
  misc_feature (121)..(121): Xaa can be any naturally occurring amino acid
  misc_feature (123)..(124): Xaa can be any naturally occurring amino acid
  misc_feature (127)..(127): Xaa can be any naturally occurring amino acid
  misc_feature (130)..(131): Xaa can be any naturally occurring amino acid
  misc_feature (134)..(134): Xaa can be any naturally occurring amino acid
MSMGRYAGATDPEAGRDGAGQAVLLRSPSGATARVSLHGGQVVSWDERPRRRILFTKQQGIXEPPKAMRGRIPXIFHSFGNCXTXEHIXXQEQNLALXQEHPSLSQXDXXXNXSVDLILKXSXXGFXTWXXFQXPVEPKGWSHGIPPNRESISNCYKILQSRITSRKKLPHY

SEQ ID NO: 39098 - protein, 1116 aa, Oryza sativa (japonica cultivar-group)
MRVAWWTRAGGWSAAVGLRVGFFVRVVMWNQQQQQEEEEVLVPRQELPNGTQPMEAVVVPSEPAATVENQQIEDPPISRFTWTIENLSRVSTKKLYSEIFVVGGYKWRILIFPRGNNVEYLSMYLDVADSAVLPYGWTRYAQFSLSVVNQMHNKFTIRKETQHQFSARESDWGFTSFMPLGDLYNPSRGYLVNDTCIVEAEVAVCKVVDYWSYDSKKETGYVGLKNQVDSACQAVYHMPTTENDMPSGSIPLALQSLFYKLQYNDSSVSTKELTKSFGWDMHDSFMQHDVQELNRVLSEKLEDKMKKGILLWQVIVLSHHGHYVQTCPFDLIGVHSNADLQLDVKGCQDVYASFDKYVEVERLEGDNKYHAEQYGLQDAKKGVLFIDFPPVLQLQLKRFEYDFMRDTMVKINDRYEFPIQLDLDRDDGKYLSPDADRNVRNLYTLHSVLVHSGGVHGGHYYAFIRPTLSDQWFKFDDERVTKEDAKRALEEQYGGEEELPQTNPGLNNTPFKFTKYSNAYMLVYIRESDKDKIICNVDEKDIAEHLRIRLEKDREEKERRKKEKAEAHLYTIIKVARDDDLTTQIGKDIYFDLVDHDKVPSFRIQKQMPFTQFKEEVAKEFGIPTQFQRFWLWAKRQNHTYRPNRPLTPQEETHTVGQLKEAANKAHNAELKLFLEVELGLDLKPLPLPDKTREDILLFFKLYDPEKEQLRLFVKASGKPQDILPKLRKMAGFSQDEEIELYEEIKFEPNVMCEYIDNRLLFRACQLEDGDIVCFQKSPKPDTADQYRYPDVPSFLVYIRNRQVVHFRSLEKPKEDDFCLEMSKAFTYDEVVEKVAQKLGVDDPTKIRLTSHNCYSQQPKPQPIKYRGVERLLDMLIHYNQTSDILYYEVLDIPLPELQALKTLKVTYHHGTKDEVSVHSIRLPKNSTVGDVLNDIKSKVELSHPNAELRLLEVFYHKIYKIFAPNEKIENINDQYWTLRAEEVPEEEKNLGPFDRLIHVYHFTKDTQNQTQVQNFGEPFFMVIREDETLSSIKERIQKKLKVPDEDFSKWKFAYISLGRPDYFEDSDTVASRFQRNMYGAWEQYLGLEHPDTAPRKTHNANQNRHSFERPVKIYN

SEQ ID NO: 39099 - protein, 430 aa, Mycobacterium avium 104
MIVGSGFTGFTCARRLAKTLRRAPVDITMISPVDYMLYTPLLPDVAGGVVDARFVAVPLANSLRGMHAVRGRVDAVDFTGRTLTYRDPEERSHSMSWDRLVLTPGSVTKLFDVPGLARHARGLKTTAEALYLRDHFVEQLELANIEDDPRVAAARRTVVVVGASYSGTELVAQLRALADAAARQMGFDPGAVRFLLLDLAEQVMPEVGKKLGDAALKVLRRRGIDVRLGTTLKEAHADHVVLSDGSRIDTHTIAWVTGVTGAPLIQDLGLPTEKGRLKVQPDLQVPGHPGVFAAGDAAAVPDLTQPGKITPPTAQHATRQGKVLARNVAASLGHGSAKEYKHRNLGLVVDLGPRYAVANPLNIHLSGLPAKAVTRGYHLYAIPRGVNRWAVSLAYLTDALFARSVVSIGLSSEDDAQFTASEGIPMPKTG

SEQ ID NO: 39100 - protein, 350 aa, Oryza sativa (japonica cultivar-group)
MASLPVPSVQAMVAAIGIDHVPPRYLRPTDADEPVASDGGEAEIPVVDFWRLQLGDGDELARLHIACQDWGFFQLVNHNVPEDVVEGMKASIKGFFELPAETKKQVVQEPGQLEGYGQLFVVSEDQKLDWADILYVKTQPLQDRNLRFWPDQPAGFRMALDRYCAAVKITADGLLAAMATNLGVESEVIAERWVGGVQSVRVQYYPPCGQADKVVGISPHSDADLVTILLQANEVDGLQIRRGGAWLPVRPLEGALIVNVGDIRQVFTNGRYKSVEHRVVVDGKKERLSMATFHSPSKNAIVGPLSEMVEHEDDAAYTSMDHDELLKLFFAKKLEGKNFLNPIKKLKNSG

SEQ ID NO: 39101 - protein, 98 aa, Solanum tuberosum
KKYSGDHKEEVKTEDTSVPVEKYEETEEKKGFLDKIKEKLPGGGHKKTEEVAAPPPPPPAAVEHEAEGKEKKGFLDKIKEKLPGYHSKTEEEKEKEKN

SEQ ID NO: 39102 - protein, 638 aa, Arabidopsis thaliana
  misc_feature (114)..(114): Xaa can be any naturally occurring amino acid
MIIMMNCFPCFTSQKSRNAPCTTNETNDDNVEHNEFRPPVVATTKRTEEREPAEQQPPVKTFNFRELATATKNFRQECLLGEGGFGRVYKGTLQSTGQLVAVKQLDKHGLHGNXEFLAEVLSLAKLEHPNLVKLIGYCADGDQRLLVFEYVSGGSLQDHLYEQKPGQKPMDWITRMKIAFGAAQGLDYLHDKVTPAVIYRDLKASNILLDAEFYPKLCDFGLHNLEPGTGDSLFLSSRVMDTYGYSAPEYTRGDDLTVKSDVYSFGVVLLELITGRRAIDTTKPNDEQNLVAWAQPIFKDPKRYPDMADPLLRKNFSERGLNQAVAITSMCLQEEPTARPLISDVMVALSFLSMSTEDGIPATVPMESFRDKSMSIALSRHGSCSVTPFCISRKDVGNKSSSSSDSEDEEEEKEQQAEKEEESTSKKRQEQEETATDSDDESDSNSEKDQEEEQSQLEKARESSSSSSDSGSERISIDETNATAQSLKISYSNYSSEEEDNEKLSSKSSCKSNEESTFSRYDSGRDHDDSSRNTSMRINSLAHDDKEEDEEENHETRSYSDHDDSPRNTSMRINSLSHDDDDEEEEEENHETRLEHIHSSKSEDQSVYSDDDAGEESGESSLHRIEAKEEEHISSDHD

SEQ ID NO: 39103 - protein, 491 aa, Clostridium acetobutylicum ATCC 824
MTSKKEQKNELKRTLTARHMNMIAIGGSVGTGLFFASGSAISTAGPGGALLAYIITGILVYVLMMSLGEMSTLLPISGSFETYATRFVDPALGFTLGWNYWFSWSICVASELVAGSLIVKFWFPHTNTTIWSIGFLLVIFILNILSAKAYGESEYWFSSIKVVTIIIFIIVGVLMIFGIMGNDSPGFKNWVISGNGSRAPFVGGIAAIINVFLVAGFSFSGTEIVGLAAGETENPEENVPKAIKSVFWRILLFYICAIIIIGFLVPFNDKNLLKSGVNNIAYSPFTMVFAKCGIAFAASAMNAVILTSVLSCGNSGLYVSSRMLYSLAKEGKAPKFLAKVNKQGVPMNALYATTLVASSAFLSSLIGEGKIYYVLYNASGITALFAWLGIGICHYRFRKAYVAQGRDLKDLKFKAKFYPYGPIMAIVLCVVIIFGANIWIFQAPKFSWFDFISNYICIPIFIALYIAYKYIKKTKLVPLEECDFEYNGKDK

SEQ ID NO: 39104 - protein, 472 aa, Arabidopsis thaliana
MNVMRRLKSIASGRTSISSDPGGDYALKRAKLDQENDNLCVDPMQVDQNSSCFEMKADVLSQESVAGTSNVPAVSEKPVDDQLPDVMIEMKIRDERNANREDKDMETTVVNGSGTETGQVITTTVGGRDGKPKQTISYMAQRVVGTGSFGVVFQAKCLETGEQVAIKKVLQDKRYKNRELQIMRLQDHPNVVRLRHSFFSTTDKDELYLNLVLEYVPETVYRASKHYTKMNQHMPIIFVQLYTYQICRALNYLHRVVGVCHRDIKPQNLLVNPQTHQLKICDFGSAKMLVPGEPNISYICSRYYRAPELIFGATEYTNAIDMWSGGCVMAELLLGQPLFPGESGIDQLVEIIKILGTPTREEIRCMNPNYTEFKFPQIKAHPWHKIFHKRMPPEAVDLVSRLLQYSPNLRCTALEACAHPFFDDLRDPNVSLPNGRALPPLFNFTAQELAGASTELRQRLIPAHCQGTGSSS

SEQ ID NO: 39105 - protein, 466 aa, Roseovarius nubinhibens ISM
MESFMMDGKFLDNDIEKIVDADRAHVWHHLTQHKPFETGEPRIILEGKDMRVWDQKGKEYVDAVSGGVWTVNVGYGRERIANAVRDQLVKLPYFAGSAGSIPGALFSEKLISKMPGLTRVYYTNSGSEANEKAFKMVRQIAHKRYGGKKHKILYRDRDYHGTTIATLSAGGQDERSAQYGPYVPGFVRVPHCLEYRAQWDLSGEEYGIAAANAIEEVILAEGPDTVGALCLEPITAGGGVIVPPEGYWPRVQEICEKYDILLHIDEVVCGVGRTGTWFGYQHYGVKPDFVTMAKGVASGYAAIACCVTSERVFELFKDDASDPLNYFRDISTFGGCTAGPAAALENMAIIEEENLLDNCNAMGAYMLDQLHALKDKHAVIGDVRGKGLFLGAELVADRSSKEPVDEKQAQAVVGDCGAQGVIIGVTNRSIPGFNNTLCYSPALIATKDDIDQIIEATDKALTKVFG

SEQ ID NO: 39106 - protein, 311 aa, Triticum aestivum
  misc_feature (160)..(160): Xaa can be any naturally occurring amino acid
  misc_feature (178)..(178): Xaa can be any naturally occurring amino acid
HASDLHMQFLRSAAYCSGDLASSARKAFLRMDEMMKGQRGWRELAELGEKGPKFTGMLESIIWSPKAGDADKLGDGWHSEEGPHSDFSGPTCGSTACVAIIRNDQLVVANAGDSRCVISRKGRDHELSRDHKPELQSEKERIEDAGGYIVAGRVHGSLTXLQEPLGDMKMKENKLLPXRNRLFSAEPEVNTVTLSEDDEFIVLACDGIWDCMSSQQVVDFVHEKLKTEDSLSAVCEKLLDRCLAPESGGEGCDNMTMILVVLKKPTDPAATSSSEQSAVTDEEMLLLARSPSPVPFVNSEPDAPKTPTSSK

SEQ ID NO: 39107 - protein, 994 aa, Botryotinia fuckeliana
MAETFTGNRSQGLMRRLSNKISRRQSTNTSREQSAGPVMLRRRSDSTSTAPDSRHYLLNSDSDEDVHEDTIEWVDSPLGIEGLVGDYPSSNASFACSSTMTGGNAGLAFGPVIPTVLLQGTTMIKITKKKRKVLTFVLEDEACKVSWDKTRPAKSFLIDNIKEIRLGSDALNYREEFKVDSQDEPRFFSILYVVPDNKSTGRSTKIMHLIAPDEQTFDLWTTTLEAISKHRYENMSSLVAFNEKAVRNYWRGEMTKQFSDTPHAEDEEALDFEGVEQLCKNLHINTSSRFLRERFQQADATKSKKLIFSEFQEFVKLMKRRGDVSEIYRELASDNVKGITLEEFIDFVNVVQGENVEKDRAKWESIFAKFARRSRSRDQPLQEGEAARMSEEALATFFTSVHNVPLETVPETFTLDRPMHEYFISSSHNTYLMGRQVAGESSVEAYISALIKGCRCVEIDCWDGKDGRPIVNHGHTMTRPIMFSDVMYTIAKYAFVKSHFPLWISLEVHCNDAQQAAMAQIIKEACGDLLVTEPLDPSSQVLPSPSQLMDRILIKVKKPRISDESSPKVNGRSRGNSLSSPRVYPAGLDNSTISSGSLLPPPTANPSGSHIKQNIRRTGTDETTSSSSSDSEGNEDRPKDKPKTSKIVKVLGELGIYSAGVKFRGFDDPESKAYNHIFSFMESTFDRNSKTQIDRRAMTRHNMRYLMRVYPNGWRVASTNFDPLKYWRRSVQMVALNWQTHDLGMQMNDAMFAGGTDQSGYVLKPSELREIKMLPSVPEEAGADHVKRERKNVNFSIDIISAQQLMRPKGLPSNRSVDPYIEVEVYHADDKSKETKGVIGEGGLDASAKDGSSGLGAPHKRRTHIVQENGFNPVFNKKFNFALTTKFPELVFVRWTVRCSSDGHSYNDKTLPLATYTAKLSSLKQGYRTLPLYDTNGDQFLFSTLFCRVKIDPATSIYVNAESNESVGVLKSLGRTVFNRTPLSPKPSVDSNHQ

SEQ ID NO: 39108 - protein, 131 aa, Allium cepa
ATAMEAMAATAMAKDPTGQMMLSGFQGLRSVGSVPVGRSVKALPIPSSFSSSVITAVAVPEVKRSKVEIFKEQSNFLRYPLNEELLTDAPNINEASTQLIKFHGSYQQYDRDERGKRSYSFMLRTKNPCES

SEQ ID NO: 39109 - protein, 459 aa, Listeria innocua Clip11262
MKHIVIIGGGLSGLAAAYELQKTHPNYTWELVEKDEKLGGKFETVKRDGFLIEKGPDSFLARKPAGVGLVKDLGLEDKLIANATGRSYIYHQKALHPIPEGSVMGIPTDREALLASTLVSEIGKARALQEPTIEPNNQETDQPLGEFFEARFGKELVKTIIEPLLSGIYAGDIYKMSLRATFPQFEQTVRKYGNLMDGLKESTMQTTGTKGTIGAFRTLEGGLDRLPKAIADALPAENLHTAKQATQITKKNTSYEISFADGDKKEADGVIIAATHDALIHLLAETTTAPFAEQPLTTLATVSLAYDEKDVPILPDGTGYLVARTALYKTTACTWVQKKWPHMVPKDKMLLRGFVGKAGESWLEQASDEAIVTAVLTDYAEIMDLHAAPLFYEVSRMKSAMPQYLVDHQDRLKQLKKNIQTDYPGVYFAGMSYEGVGIPDCIAGAQTAVTELADFLEEV

SEQ ID NO: 39110 - protein, 136 aa, Allium cepa
SLALLATTMEAMAATAMAKDPTGQMMLSGFQGLRSVGSVPVGRSVKALPIPSSFSSSVITAVAVPEVKRSKVEIFKEQSNFLRYPLNEELLTDAPNINEASTQLIKFHGSYQQYDRDERGKRSYSFMLRTKNPCES

SEQ ID NO: 39111 - protein, 130 aa, Pyrobaculum aerophilum str. IM2
MVMLDILSNALIQIKNAEIVGKKQAVIWPVNKLTYYTLRVLQRYGYVGEIEYIDDGKGGKYIVQLLGKINDIGPIRPRYPVKYREIVQWEQKFLPARQIGILIISTSQGVMSHIEAKERKIGGVLLAYVY

SEQ ID NO: 39112 - protein, 516 aa, Solanum lycopersicum
MKSTVHLGRVSTGGFNNGEKEIFGEKIRGSLNNNLRINQLSKSLKLEKKIKPGVAYSVITTENDTETVFVDMPRLERRRANPKDVAAVILGGGEGTKLFPLTSRTATPAVPVGGCYRLIDIPMSNCINSAINKIFVLTQYNSAALNRHIARTYFGNGVSFGDGFVEVLAATQTPGEAGKKWFQGTADAVRKFIWVFEDAKNKNIENILVLSGDHLYRMDYMELVQNHIDRNADITLSCAPAEDSRASDFGLVKIDSRGRVVQFAENQRFELKAMLVDTSLVGLSPQDAKKSPYIASMGVYVFKTDVLLKLLKWSYPTSNDFGSEIIPAAIDDYNVQAYIFKDYWEDIGTIKSFYNASLALTQEFPEFQFYDPKTPFYTSPRFLPPTKIDNCKIKDAIISHGCFLRDCTVEHSIVGERSRLDCGVELKDTFMMGADYYQTESEIASLLAEGKVPIGIGENTKIRKCIIDKNAKIGKNVSIINKDGVQEADRPEEGFYIRSGIIIISEKATIRDGTVI

SEQ ID NO: 39113 - protein, 518 aa, Solanum lycopersicum
MDALCAGTAQSVAICNQESTFWGQKISGRRLINKGFGVRWCKSFTTQQRGKNVTSAVLTRDINKEMLPFENSMFEEQPTAEPKAVASVILGGGVGTRLFPLTSRRAKPAVPIGGCYRVIDVPMSNCINSGIRKIFILTQFNSFSLNRHLARTYNFGNGVGFGDGFVEVLAATQTPGDAGKMWFQGTADAVRQFIWVFENQKNKNVEHIIILSGDHLYRMNYMDFVQKHIDANADITVSCVPMDDGRASDFGLMKIDETGRIIQFVEKPKGPALKAMQVDTSILGLSEQEASNFPYIASMGVYVFKTDVLLNLLKSAYPSCNDFGSEIIPSAVKDHNVQAYLFNDYWEDIGTVKSFFDANLALTKQPPKFDFNDPKTPFYTSARFLPPTKVDKSRIVDAIISHGCFLRECNIQHSIVGVRSRLDYGVEFKDTMMMGADYYQTESEIASLLAEGKVPIGVGPNTKIQKCIIDKNAKIGKDVVILNKQGVEEADRSAEGFYIRSGITVIMKNATIKDGTVI

SEQ ID NO: 39114 - protein, 397 aa, Zea mays
MEPARRLLLSDYDGAIESPLPSPPPSSATPFRPGVAVVVGILTSVFSITFLLLLYAKHCKRSAAESSGPYGSAGSGGGFGSSGNGAGGDRRNSGVDRAVVESLPVFRFGALRGQKEGLECAVCLGRFEPTEALRLLPKCRHGFHVECVDTWLDAHSTCPLCRSRVDPEDVLLLPEPPKPSTTGPPDPPETKAAAAAAAGKEPAPAPPPAPAPTPAQSGRRISGRHSTGSVRAPGRVGPDSRRSADGGVAVGCFDGTKVRKDRVLLVEPAAVVAEPDPVAFDRRFGHRILVSTAGGCKGETAPAAQQRWSDLRPSDLMFVRAEFLVTDAGRHSCSAAVNSGNARSAIGVRSVSELAGVRRLPPIRAGTCEGEPRSRGGGAPRWPGSSWWAPRGDPGRA

SEQ ID NO: 39115 - protein, 479 aa, Pseudomonas fluorescens PfO-1
MTKRYDNYINGEWVAGNDYSANINPSELSDTIGDYAKADLAQVNAAIDAARAAFPAWSTSGIQARHDSLDKVGTEILARREELGTLLAREEGKTLPEAIGEVTRAGNIFKFFAGECLRLSGDYVPSVRPGVNVEVTREALGVVGLITPWNFPIAIPSWKIAPALAYGNCVVLKPADLVPGCAWALAEIISRAGFPAGVFNLVMGSGRVVGEALVNSPKVDGISFTGSVGVGRQIAVNCVSRQAKVQLEMGGKNPQIILDDADLKQAVELSVQSAFYSTGQRCTASSRLIVTAGIHDKFVEAMAERMKSIKVGHALKAGTDIGPVVSQAQLEQDMKYIDIGQSEGARLVSGGGLVTCDTEGYFLAPTLFADSEASMRISREEIFGPVANIVRVADYEAALAMANDTEFGLSAGIATTSLKYANHFKRHSQAGMVMVNLPTAGVDYHVPFGGRKGSSYGSREQGRYAQEFYTVVKTSYIGS

SEQ ID NO: 39116 - protein, 846 aa, Roseovarius nubinhibens ISM
MQHNDPDITLITPDAPMAAETHGGRAKCLQRLVRLDLPVPTTVALSFKAVRAIAAGDITCAEALLRPFGAHPLLCVRPSSEDPDWGGPRAVLNIGMNDAQFEALSERIGREAAAKLYLRFVQSYAIHVARLDPDDLDDVSDAPVKGLQEALDIYEDEAEEPFPQDPAVQLIEVLRSMARAWEGTTARLLRQAKGAPADAGLGLVVQSMALGVGQGECGSGVMQLVNSVSGERKITGRYLSQSQGRDALTSGAGAMYLERDPRGPSLEELAPEAFARLKSYTQLMREKLREEMQAEFTIENGEVFLLDGVRVVRNARAAVGIVVALAEDKIISREEALMRIEPRALNELLHRQVDPEAHRDVLAKGVAASPGAASGVIVFSPEAAQAHAAQGVASILVRRETSPEDIRGMHAAAAVLTERGGMTSHAAVIGRGIGLPCVVGASSLRFQTTRKLLTAPDGRVFREGDKITIDGTNGEVLAGEPALLEAGNLDSLRVLMAWADAVRDIEVRANADTPRDAETARWFNAEGIGLCRTEHMFFEADRLIVMREMIFAKTSKDRAAALERLLPMQRADFADLFRIMEGKPVCIRLLDPPLHEFLPTGRSGHRELAEALDLPLSDVTRRVEALGEYNPMLGMRGVRLGITVPEIYEMQARAIFEALLSQGEGRDPVVPEIMIPLVSASREVDLVKSRIDAVASAVRNESGREFTYRLGVMVETPRAALRAGDIAPKVAFLSFGTNDLTQMTYGLSRDDAGRFMSDYVQQGVYPEDPFHSLDVYGVGELLSLGAARARETNPNLVLSICGEHGGNPESIAFCRAAGFDYVSCSPFRVPVARLAAAQLAIKDKIG

SEQ ID NO: 39117 - protein, 147 aa, Oryza sativa (indica cultivar-group)
MASKRIQKELKDLQKDPPTSCSAGPVGEDMFHWQATIMGPSDSPYRGGVFLVTIHFPPDYPFKPPKVAFRTKVFHPNINSNGSICLDILKDQWSPALTISKVLLSICSLLTDPNPDDPLVPEIAHMYKTDRHKYENTARTWTQRYAM

SEQ ID NO: 39118 - protein, 315 aa, Acidobacteria bacterium Ellin345
MGQQCSGSPALQEAQMNGLKFLRVLLIALVSLSVSTALAYGQHGGGHGGGGGGGFHGGGGGGFHGGGGGGGFHGGGGGFHGGGGGYHGGGGAYHGGGYGGGYHGAGAYHGGYGGGYHGGHGGWYGGGHSHGGYYGHSHGGYWGYPYYGWGFGIGFGWGYPYYGYGYPYGYGYPYGYGYSSYPYQPYGYYGSAGASDDSDPSYQDDQNSSPDGSYIPNAGVAPPRYSTPYPRSNPTTMRESAYNAPANQRMVGYSSAKVDRQMASARPGVRNVVNALQNMPPQARQQQLASGRYNNLSASEMKVVRVAAGVPPHGK

SEQ ID NO: 39119 - protein, 297 aa, Debaryomyces hansenii CBS767
MAQELTHPSIKDGWFAEISDTMWPGQAMSLKVEKVLHVEKSKYQDVLVFKSTDYGNVLVLDDCIQCTERDEFSYQEMIAHLALNSHPNPKKALVIGGGDGGVLREILKHESIEEAWLCDIDETVIEVSKKYLPEMSQSYKNPRTKVHIGDGFKFLAEYKNQFDVIITDSSDPEGPAESLFQKPYFRLLKDALTEKGVITTQAENIFLHMEIISRLKKDCKEIFPVAEYGYTMIPTYPSGSIGFMVCSKDPNANVTKPLRFDWDDEFVRKNLKYYNKKIHEACFVLPTWADEKLNKQN

SEQ ID NO: 39120 - protein, 240 aa, Allium cepa
RSYSFMLRTKNPCGKVPNELYIAMDTLADEFGIGTLRLTTRQTFQLHGILKKNLKTVMSTIIHNMGSTLGACGDLNRNVLAPAAPYTKKEYVFAQETADNIAALLTPQSGFYYDMWVDGEKIMTSEPPEVTKARNDNSHGTNFPDSPEPIHGTQFLPRKFKIAVTVPTDNSVDILTNDIGLVVISDSNGEPQGFNLYAGGGMGRAHRTDTTFPRLAEHLGYVPKEDILYAIKAIVVTQRE

SEQ ID NO: 39121 - protein, 1405 aa, Gibberella zeae PH-1
MESSDSIDSTVYEPTPLKENPNDDSEWKMKSEVIGFKERDKSSGVPDRELGVTWNNLTVDVIAADAAIHENVLSQYNLPRLIKESRQKSPLKTILDNSHGCVKPGEMLLVLGRPGSGCTTLLNMISNKRRGYASVKGDVFYGSMTAEEAKRYRGQIVMNNEEEVFYPALTVGQTMDFASRLKLPFQLPQGVNSHEELRTETRDFLLKSMGIEHTIDTKVGDAFVRGVSGGERKRVSIIETMATQGSVFCWDNSTRGLDASTALDYTKAIRAMTDVMGLASVVTLYQAGNGIYDLFDKVLVLDEGQQVYYGPLKEAKPFMESMGFICQHGANVADYLTGVTVPTERQIHQDYRNRFPRTAKALRAEYEKSPIYERARSEYDYPTTEIAKEKTKAFQEGVRQFKDKKLPDSDPMTVGFLDQTKACIIRQYQIVLGDKATFFIKQISMIVQALIAGSLFYNAPDNSSGLFVKSGAVFVALLSNSLVSMSEVTDSFTGRPVLLKHKSFAMYHPAAFCIAQIAADIPIILLQVTTFSVVEYFMVGLTRTAGHFFTFWIILVAITICITALFRAVGAAFKNFDDASKVSGLVITATIMYSGYLIQKPLMHDWFVWIFWIDPLAYAFDALLSNEFHGKIIPCVGNSLVPSGPGFNNGDHQACAGVGGAKPGQTFVTGDDYLASLSYGYDHLWRNFGIIWAWWLLFVAITIFFTSKWHASSEDGPSLVIPRENAHITAALRQSDEEGQTKGEKKMVGSQEDGVISGDDTDTSAVADNLVRNTSVFTWKNLTYTVKTPSGDRVLLDNVQGWVKPGMLGALMGASGAGKTTLLDVLAQRKTDGTIRGSIMVDGRPLPVSFQRSAGYCEQLDVHEPYATVREALEFSALLRQSRDTPREEKLKYVDTIIDLLELHDIADTLIGKVGAGLSVEQRKRVTIGVELVSKPSILIFLDEPTSGLDGQSAYNTVRFLRKLAAVGQAVLVTIHQPSAQLFSQFDTLLLLAKGGKTVYFGDIGDQAKTVSGYFGRYGAPCPKDVNPAEFIIDVVSGHLSQGKDWNQVWLSSPEHATVEKELDHMITDAASKPPGTTEDGNEFATSLWEQTKLVTQRMNVSLYRNTDYINNKYALHVFSALFNGFTFWQIGSSVAELQLKLFTIFNFIFVAPGVMAQLQPLFIQRRDIFETREKKSKMYSWVAFVTGLIVSEVPYLCVCAVIYYVCWYYTVGFSDHSSRAGATFFVMLMYEFIYTGIGQFIAAYAPSEVFASLVNPLIITILVSFCGVLVPYASMQVFWRYWLYYINPFNYLMSSMLTFGVWGAEVKCKDKEFARFSPPNGTTCGEYLSEWLTKVPSNLINPDATDECMVCSYTKGEDYLRTLNIKEYSYGWRNAGITAAFVFTSYALVYILMKLRTKASKKAE

SEQ ID NO: 39122 - protein, 127 aa, Allium cepa
LFCGLHIDNGRLKGQAKETLREIIEKHNLSVRITPNQNMILCDIDPSWKESINAALSQVGILEPQYVDPLNITSMACPALPLCPLAIAEAESGIPDILKRVRAVIDKVGMGKEESVVIRITGCPNGC

SEQ ID NO: 39123 - protein, 141 aa, Aeropyrum pernix K1
MAVQRTLLVVKPDGVERGLIGEVVSRVERKGLKIVAMKMMRLTREKAEEFYSVHRDKPFFGELVEFITSGPVVAMVVEGDEAVSVVRLMIGSTDGRKAAPGTIRGDFSLDIMKNIVHASDSPESFEREFRVLFSESEIVEW

SEQ ID NO: 39124 - protein, 154 aa, Glycine max
  misc_feature (15)..(16): Xaa can be any naturally occurring amino acid
KHLHKAHHKWIMPTXXASHAFHPLDGFTQSLPYHIFPFIFPLQKLAYVALFVFVNLWSVMIHDGEYLTNNPIVNGAACHSLHHSRFEVNYGQFFTAFDRLGGTYRMPEHWMFERDMKMSEKKWRSEVEKVDELIEEIEGDDNRTYGPPDTKKTQ

SEQ ID NO: 39125 - protein, 120 aa, Desulfotalea psychrophila LSv54
MKISGDVMSDCLFCKIIGGEIPVKKLYEDDDVFAFWDIAPQAPKHFLVVPKKHITGPADLAAEDEQLIGKMMRVGAQLAKEQGIGDGFRTVLNNGIQAGQTVFHIHMHILGGRDLQWPPG

SEQ ID NO: 39126 - protein, 440 aa, Agrobacterium tumefaciens str. C58
MSDTGGYFPRWRLKTEGRIMPDERLPAGQTAVLGLQHVVAMFGSTVLAPLIMGFDPNVSILFSGISTLIFFIAVGGRVPSYLGSSFAFIGPVLVATGAAAGAASPDIALALGGIIAAGVLYALIGVIVMIVGHNWIEKLMPPVLTGAIVAAIGLVLAPIAIASASGTGPGNPDGDQLSRWIAILTVTSVGAIAVYAPGMTRRLPILLGGAIAYLAYLVLANGFGLGKPVDFAGVAAAAWFGLPAFTTPVFSAPAIALIAPVVVILVAENLGHIKAIGAMTGRNLDPYLGRAFIGDGIATIFSGAFGGTGMTTYAENMGVMAITRIFSTLVFIVAALVAIILGFSPKFGALIQTIPGPVIGGLSVVVFGLIAATAGRIWVENKVDFSEPRNLITVGIALVLGAGNFKLNVAGFTLDGIGTATIGAIAFYHLLGLGRPAQGR

SEQ ID NO: 39127 - protein, 343 aa, Mycobacterium leprae TN
MRIGILTGGGDCPGLNAVIRAIVRTCDARYGSSVVGFQDGWRGLLENRRMQLCNDDRNDRLLAKGGTMLGTAHVHPDKLRAGLHQIKQTLDDNGIDVLIPIGGEGTLTAAHWLSQEDVPVVGVPKTIDNDIDCTDVTFGHDTALTVATEAIDRLHSTAESHQRVMLVEVMGRHAGWIALSSGLASGAHMTLIPEQPFDVEEVCCLVKRRFQRGDSHFICVVAEGAKPVPGSITLRQGGMDEFGHERFTGVAAQLGAEVEKRINKDVRVTVLGHVQRGGTPTAFDRVLATRFGVNAADASHAGEYGQMVSLRGQDIGRVPLEDAVRQLKLVPESRYDDAAAFFG

SEQ ID NO: 39128 - protein, 546 aa, Candidatus Desulfococcus oleovorans Hxd3
MRTSRLTDLDLWKQLKAHAEKMALPENHLKHLTMAPERLAEFSIQALDMVYDFSRQRVDRQAIDLLMELAWERKVTQRFQAMTTGAVVNTTENRAALHTACRDFSKAKRVVNKIDVTAEMARVRKEIREFSEAVHAGQITGATGKPFAHVVVVGIGGSYLGTEFVARALAAYADKGICLHFLANVDIHNFGEIAEAIDPETTLWVIVSKSFTTAETMANANQAAAFMKEQGLDPARHFVSVTSKGSPGDQTGQDAPFPVLRSFHMFDFIGGRYSVTSAVGGVPLSLYLGYDRFETFLKGAHQMDVHAATAPPTTNMPLTAALLGIWNNNFLEYPAQAIIPYASPLARLAPHVQQLYMESNGKSVTAEGKPLGVRSGVIIFGEPGTNAQHSFFQLAHQGAPFPIDFIGVIKPQYDAFQALSRGVTNHQELWANLISQPRALAEGKESEDGHRSFSGNRPSSTILLEDLSPASVGKLLAFYEARTVYEAFVWGINPFDQYGVELGKKLASEIRSQMAAKNRDAGHTFENVDSISRFYLEKLMGKGNDE

SEQ ID NO: 39129 - protein, 384 aa, Mycobacterium sp. JLS
MARDYYGLLGVSKGASDQEIKRAYRKLARELHPDVNPDEEAQARFKEISAAYEVLSDPEKRRIVDLGGDPLESAGASGGNGFGAGFGGLGDVFEAFFGGGGGSRGPIGRVRPGSDSLLRMRLDLAECATGVTKQVTVDTAVLCDLCHGKGTHGTSTPATCDTCGGRGEIQTVQRSLLGQVMTTRPCPVCGGVGEVIPDPCHRCGGDGRVRARREISVKIPAGVGDGMRVRLAAQGEVGPGGGPAGDLYVEVHEKPHDVYVRDGDDLHCTVSVPMVDAALGTTVSVDDILGGPLELIIAAGTQPGAVSTLRGHGMPHLRSGVRGDLHAHIDVVVPAKLDHTDIELLRQLKEHRSRDVAEVRTSSSPAASNAGGLFSRLRETFTGR

SEQ ID NO: 39130 - protein, 184 aa, Oryza sativa (japonica cultivar-group)
MATKAGVIATLLALNLHFFTFSDACGCQCGSCPSPGGGGGGGGGGGGGGGGRGGGGGSGGGSGGGGGSGGGGSGGGGSGGGGSGGGGGGGSGGGGGGGRCPIDTLKLGVCANVLNGLINVQLGTPPRQPCCSLIQGLADLEAAVCLCTALRANILGINLNLPINLSLLVNYCGRSVPSGFQCSN

SEQ ID NO: 39131 - protein, 385 aa, Cuscuta reflexa
WMESHSGSKCFAIPGMPLVAWLWKIAKAHVLAHDSGYHQLVSHWLRTHCAIEPYIIASNRQLSALPTIFRLLKPHFRYTMEINALAREALINANGVIESTFSPGKHSMLLSSMAYDLEWQFDLQALPADLISRGLAEEDPTAPHGLKLAIEDYPFANDGLVLWDIIKEWVTDYVTHYYPESSRVESDTELQEWWKEIRTVGHADKRDAQGWPDLKTPEDLIGILTTITWVCSGHHAAVNFGQYVDAGYFPNRPTTARTKMPTHDPSEEEWEHFMKKPEDTLLKCFPSQLQATKVMAVLDVLSNHSPDEEYLGASPETYWIDEPIINAAFERFSGGFKELEGIIDGRNADRNLNNRNGAGVLPYELIKPYSGPGVTGKGVPNSISI

SEQ ID NO: 39132 - protein, 355 aa, Arabidopsis thaliana
MESMVKKLKQNLRTGSWKKKEKSMKKERWFLENGSIFLKELIVDCNGKSIPIRSFTSSQIRKATKNFDLSCFVAEEGFYIWYKGVIEDRSYMIKRFSEYKVTDYRVSEVYKDIVLSARMSNHNNFLKLLGCCLEFPFPVLVFEFAEHGVLNYRGGITVNGEESLLPLSLRLKIGKEIANALAYLHMAFPKIIIYRDVKPLHVFLDNNWTAKLSDLSFSISLEEGKSQIEAEDVLGTYGYLDPLYFATRIVTEYTDVYSFGVFLMVVITGISVYFTGSDGYPVGILGYMKGLAENGKLNEIVYPMIMKEMTSAQRLQVEACVLLALRCCEERVEDRPKMIQVAKELKRIEHHVLRS

SEQ ID NO: 39133 - protein, 132 aa, Triticum aestivum
  misc_feature (96)..(96): Xaa can be any naturally occurring amino acid
  misc_feature (127)..(127): Xaa can be any naturally occurring amino acid
MVRVSVLNDALKSMYNAEKRGKRQVMIRPSSKVIIKFLIVMQKHGYIGEFEYVDDHRSGKIVVELNGRLNKCGVISPRFDVGVKEIEGWTARLLPXSRQFGYIVLTTSAGIMDHEEARRKNVGGKVXLGFFY

SEQ ID NO: 39134 - protein, 1103 aa, Candida glabrata CBS 138
MSAISSNTVSVIKNNQIGPWKLGETLGSGSTGKVLLASNETTKQQAAVKVISKAVFEAMNNSESNGDATNALPYNIEQEIIIMKLLNHPNVLRLFDVWETNSDLYLVLEYAEKGELFNMLVERGPLPENEAVRAFRQIIIGISYCHSLGVVHRDLKPENLLLDNKLNIKIADFGMAALESEDKLLETSCGSPHYAAPEIISGLPYEGFSSDVWSCGVILFALLTGRLPFDEEDGNIRNLLLKVQKGEFEMPDDDEITKEAQDLLARLLTVDPSKRITIREILKHPLLQKYPSIKDSRSIRNLPREDTYLSPLADTNSKIDDAILQNLVILWHGKDAREIAAKLREPGANTEKTLYALLYRFKCDTQREANRARRQSKIVQRNSTIRSTAPESPSKKKTYTPQKKNKRASIIASSSKRPVSVTKTATNITVNSSITGTPKSAKRMSMNNSARKRMSALYGTRDSPTKTSRSRRSSIITKDFLGNRPRDSVISMSHNKRASKSSKRISLVPNLKRQSVTTKLMATYAKLSEDDDWEYIERETKRTSSDFATLIDEIFEYEKYEQIRKEKAELERKVRETKEREERERKERQEKELQERLERERIEKQKEDIARQMDEEISNLKKELVGDQDNEDKFRSVSEPLESKSKKIEDIEEDIDGILRNRKYSLQTRPVSRLDPGIGFIDKPRQSEQHVPETVNLEPELEETEQKILETIRRSKFLGSSFDIKKELENVKRHRQTSQPIEKEMAPPALPETLPKAVEKKNVSMDPSLRKISDIKVPQFTRKSRHFSTSNRRLSVLSMYSTKESYSNLADILKNGPGEKEMIQTAPTPKSADDSDQLFDTIDEADTPASVSREERLYEVAEESENELANKKIDIADLLNSEGSNLKSVEEQEDSMKLPKLPPLFEDGSTKETKEQSKSMIPENMQSSESQKQIEKNNSDEGGSLNPFMTKHRDVSDKGVTKEKPTVTMKTTSEQVSADKKRNMSFLRKLSKGSSSSKDNVDVTLSTSVSSKQLFSGLVNLLKGWTKYGLKGIAIDSTSQTITGKLANDNILSFRSTAFSILIFSQEKGSAVTFRKVSGSGKAVRRLSDEVKKVLSKEGVLRD

SEQ ID NO: 39135 - protein, 449 aa, Listeria innocua Clip11262
MEKHYDYIAIGGGSGGIASINRAAMHGAKCALIEPKFLGGTCVNVGCVPKKVMWYGAQIKEAMDLYADAYGYQVDSSFNFQKLVENREAYIERIRGSYKNGLDNNKVEWIKGYAEFVDEKTLRVNGELVTADHILIATGGEPALPSIPGAEYGITSDGFFALKELPKKVAVVGAGYIAVELAGVLQQFGSDTHLFVRKHAPLRNFDPILTDTLTELIEQSDMTLHKHAVPQKVEKNSDGSLTIFLEDGRTETVDTLIWAIGRKPVIKGLQIEKAGVELVDSGHIAVDKFQNTNVDGIYAVGDVTGHYELTPVAIAAGRRLSERLFNNKKDAHLTYENIPTVVFSHPAIGTVGLTEPEAIEKYGKENIKVYTSSFTSMYTAITDHREPCRMKLICEGKTERVIGLHGIGYGVDEMIQGFAVAINMGATKADFDNTVAIHPTGSEEFVTMK

SEQ ID NO: 39136 - protein, 635 aa, Zea mays
MSGAIGGAEVHGFRGAAAQLPRSRVLGRPIRVAPPAAARPGGASAGSIRAVSAPAKKDASEVKRSKVEIIKEKSNFLRYPLNEELVSEAPNINESAVQLIKFHGSYQQTDRDVRGQKNYSFMLRTKNPCGKVPNQLYLAMDTLADEFGIGTLRLTTRQTFQLHGVLKKNLKTVLSTVIKNMGSTLGACGDLNRNVLAPAAPYVKKDILFAQQTAENIAALLTPQSGAYYDLWVDGEKIMSAEEPPEVTKARNDNSHGTNFPDSPEPIYGTQYLPRKFKVAVTAAGDNSVDILTNDIGVVVVSDDAGEPIGFNIYVGGGMGRTHRVETTFPRLADPLGYVPKEDILYAIKAIVVTQRENGRRDDRKYSRMKYMIDRWGIDRFRAEVEKYYGKKFESFRPLPEWQFNSYLGWQEQGDGKLFYGVHVDNGRVGGQAKKTLREIIEKYNLDVSITPNQNLILCGIDQAWREPITTALAQAGLLEPKDVDPLNLTAMACPALPLCPLAQTEAERGILPILKRIRAVFNKVGIKDSESVVVRITGCPNGCARPYMAELGFVGDGPKSYQIWLGGTPNQSTLAESFMDKVKLDDIEKVLEPLFTYWNGTRQEGESFGSFTNRTGFDKLKEVVNKWAESPSAA

SEQ ID NO: 39137 - protein, 295 aa, Arabidopsis thaliana
  misc_feature (235)..(235): Xaa can be any naturally occurring amino acid
MNPSPITIDLILEILSRLPAKSVRRFHCVSKRWASIFGSPYFKELFLTRSSTKPRLLFAIAEKGNKEKDCVWRFFSSPQLENPYEKSSSTLVATAEFPVRFSPDNLLICHYYDLKYFSIGYAFGLIYIYGNRGRARPLICNPTTGRYAILPNRYTYRKAFSFFGFDPIDKQYKALSMVYPSGPGHSRVITFGAGDLKWRRIKCSLRHDIKSEGVCINGVLYYLGDTSDWSRVNGXLAVIYWEDDVDIQELYYKKGIDVEEYVENNVNADATNELCVWILADVEKQEWSKHAYTWT

SEQ ID NO: 39138 - protein, 191 aa, Cryptococcus neoformans var. neoformans JEC21
MSRQLDNVNPTIFAPSAPSFVRRSTGKSAKSSLWAPEALSDDGEDYYSPGARSSGSVSDEEEGREDIDAQEVYDLLRSITDPEHPVSLEQLRVVNPEDIHVAGNRVLVYLTPTIPHCSMSTLIGLSLRVRLLRALPPRYRVDIRIKSGTHQSEHAVNKQLNDKERVQAALENKHLLSVVEGCLATAGKRGE

SEQ ID NO: 39139 - protein, 424 aa, Triticum aestivum
RGRLFPLTKRRAKPAVPIGGAYRLIDVPMSNFINSGINKVYVLTQFNPAALNRHLSRAYNFSNGVGFGDGFVEVLAATQRPGSEGKTWFQGTADAVRQFAWLFDDAKSKDIEDVLILSGDHLYRMDYMDFVQSHRQRDAGISICCLPIDGSRASDFGLMKIDDTGRVISFSEKPRGADLKAMQVDTTLLGLPKEEAEKKPYIASMGVYIFKKEILLNLLRWRFPTANDFGSEIIPAAAREINVKAYLFNDYWEDIGTIKSFFEANLALAEQPSKFSFYDASKPMYTSRRNLPPSMISGSKITDSIISHGCFLDKCRVEHSVVGIRSRIGSNVHLKDTVMLGADFYETDMERGDQLAEGKVPIGIGENTSIQNCIIDKNARIGKNVTIANAEGVQEADRASEGFHIRSGITVVLKNSVIADGLVI

SEQ ID NO: 39140 - protein, 383 aa, Arabidopsis thaliana
MTTMSDLDEIMVAEILCRTPMTCLKTVRSVCKKWNALSKKWFFFGKAKQFLGFMMMDSRVCSLRFDLRKDLVVEPPSIKQVSILDQIEVSKIFHSDGLLLCIIKNDTTRLLVWNPYLEQTRWIQPRHNFHILDCYAIGHDKNRKHKILRFVDDFLPVENVVFGYEIYDFSLDSWRVLDCFQRGVSLRGNTYFFAKERYIFEGKGPEEIDITETEDFLLCFDFTAERFGPRLPLPFHSYYAETVTLSCVKEDQLSVLCQRQPSEPSEILEIWVSTNIQPNAVSWSIFLKVDMRPLTGFQFNDMAGSFFIDQENKVAVVFDLDPSQICRYQTAYIIGQEYGGYFNSVNIGEVPNLWIPGSVGYADTTSCIPPVCSSYVPSLVQIG

SEQ ID NO: 39141 - protein, 466 aa, Zea mays
  misc_feature (104)..(104): Xaa can be any naturally occurring amino acid
MLAGYGGGGRSVHLSSHKDLLLGRCGRSFLFGNTWFLLSTYPARLLHTTDRRAPSAFVAAINRVPCVRSHCTGQGLLQRGSIVMAACGYVLRRTELGAAKRQPXDKDPSGGTRASRIAAMGSLGSAARPEVSFRYRGLEHCKKIGASLKCREPWGNSAFWTNATGPGWKLSFTVEPWTKDFSTACAAPYSAGATEDQLPLNEKMNSSTVGMSPVSEKLKLLSGSCYLPHPAKEATGGEDAHFISIDEHVIGVADGVGGWADLGVDAGLYAKELMRNSMSAIKDEPEGTIDPTRVLEKAYISTKARGSSTACIITLKDQGIHAVNLGDSGFVVVRDGRTVLRSPSQQHDFNFTYQLESGGGSDLPSSAQVFHFPVAPGDVIVAGTDGLFDNLYNNEISGVIVEALRVGLEPQIAAQKIAALARQRATDKNRQSPFASAAQEAGYRYYGGKLDDITVVVSYVKSAGAP

SEQ ID NO: 39142 - protein, 212 aa, Debaryomyces hansenii CBS767
MNLMTISQSLDESYTKHKIIPDVVDKFDTQGLLTIEYNEQDHVALGNTLKVENTQHHPVIQFTLNSPGQENDFEISNNDKFTLVLTDPDAPSHKDHKWSEYAHWIVTDLPLNANSNDVESAESLTTVLDYSKGKELLSYQGPAPPPKTGKHRYVFLLFRQDPSVSKFETPKDRPNWGTGTPSSGVRDWIKKNGPELKLLGVNFFYAQNDTQE

SEQ ID NO: 39143 - protein, 339 aa, Glycine max
SYVGPPPLNGLSYLHSNWMIHRDLKPSNILVMGEGEEHGVVKIADFGLARIYQAPLKPLSDNGVVVTIWYRAPELLLGAKHYTSAVDMWAVGCIFAELLTLKPLFQGAEVKATSNPFQLDQLDKIFKVLGHCHPTLEKWPSLASLPHWQQDVQHIQGHKYDNAGLYNVVHLSPKSPAYDLLSKMLEYDPRKRLTAAQALEHEYFKIEPLPGRNALVPCQLGEKIVNYPTRPVDTTTDLEGTTNLPPSQTVNAVSGSMPGPHGSNRSVPRPVNVVGMQRMPPQAMAAYNLSSQAAMGDGMNPGGISKQRGVPQAHQPQQLRRKEQMGMPGYPAQQKSRRI

SEQ ID NO: 39144 - protein, 132 aa, Brassica napus
VAKEAVLKKLGKVKGRTLVECETYRFRGHSLADPDELRDAAEKAKYAARDPITALKKYLIENKLANEAELKSIEKKIDELVEEAVEFADVSPQPGRSQLLENVFADPKGFGIGPDGRYRCEDPKFTEGTAQV

SEQ ID NO: 39145 - protein, 297 aa, Rhodospirillum rubrum ATCC 11170
MTASSLRSPQAPKNQAKPIEQLIPILDETASFLAALKGRTPVVFLDFDGTLAPIAERPEAVVFSAARREAVRKLAGKLPVAIVSGRDRADVEKQVGLPGLTYAGGHGFDIRLAPSGSASEVAPDDADPLAAELDGGLAGLVERLDAMEAALHAGLDGIAGALIERKRFSVAAHDRMVAPADRPAFAAALEAARRDLRGLREKAGKRLVEFLPDIDWDKGKAVLHLRRALGVDGEGYVAVFFGDDLTDEDAFRVLPEIDGIGVLVAGADEDGRGRTSHAFFRVADPDGVCRLLNDMVA

SEQ ID NO: 39146 - protein, 313 aa, Saccharomyces cerevisiae
MAPYPYKVQTTVPELQYENFDGAKFGYMFWPVQNGTNEVRGRVLLIHGFGEYTKIQFRLMDHLSLNGYESFTFDQRGAGVTSPGRSKGVTDEYHVFNDLEHFVEKNLSECKAKGIPLFMWGHSMGGGICLNYACQGKHKNEISGYIGSGPLIILHPHTMYNKPTQIIAPLLAKFLPRVRIDTGLDLKGITSDKAYRAFLGSDPMSVPLYGSFRQIHDFMQRGAKLYKNENNYIQKNFAKDKPVVIMHGQDDTINDPKGSEKFIQDCPSADKELKLYPGARHSIFSLETDEVFNTVFNDMKQWLDKHTTTEAKP

SEQ ID NO: 39147 - protein, 737 aa, Arabidopsis thaliana
  misc_feature (424)..(424): Xaa can be any naturally occurring amino acid
MASTSSLALSQALLTRAISHNGSENCVSIPAFSALKSTSPRTSGTISSRRRNASTISHSLRPLVRAAAVEAIVTSSDSSLVDKSVNTIRFLAIDAVEKAKSGHPGLPMGCAPMSHILYDEVMKYNPKNPYWFNRDRFVLSAGHGCMLQYALLHLAGYDSVREEDLKSFRQWGSKTPGHPENFETPGVEATTGPLGQGIANAVGLALAEKHLAARFNKPDNEIVDHYTYSILGDGCQMEGISNEVCSLAGHWGLGKLIAFYDDNHISIDGDTDIAFTESVDKRFEALGWHVIWVKNGNNGYDEIRAAIREAKAVTDKPTLIKVTTTIGYGSPNKANSYSVHGAALGEKEVEATRNNLGWPYEPFHVPEDVKSHWSRHTPEGAALEADWNAKFAAYEKKYPEEAAELKSIISGELPVGWEKALPTXPGDATRNLSQQCLNALAKAVPGFLGGSADLASSNMTMLKAFGNFQKATPEERNLRFGVREHGMGAICNGIALHSPGFIPYCATFFVFTDYMRAAMRISALSEAGVIYVMTHDSIGLGEDGPTHQPIEHLSSFRAMPNIMMFRPADGNETAGAYKIAVTKRKTPSVLALSRQKLPQLPGTSIESVEKGGYTISDNSTGNKPDVILIGTGSELEIAAQAAEKLREQGKSVRVVSFVCWELFDEQSDAYKESVLPSDVSARVSIEAGSTFGWGKIVGGKGKSIGIDTFGASAPAGKLYKEFGITIEAMVEAAKSLI

SEQ ID NO: 39148 - protein, 995 aa, Listeria monocytogenes str. 4b H7858
MGAKVSVQINGVARDVVEGTRILDYLNAEGIQHPHICYSEQIGPIQSCDTCMCEVDGELVRACSTNLTDGMEIKTNSELAKDAQLEAMDRILENHLLYCTVCDNNNGNCKVHNTTELLGVEKQERPYREKGYLNDFSHPFYRYDPDQCILCGRCVEACQQVQVNETLSIDWERSQPRVIWDDDRPANLSSCVSCGLCATVCPCNALMEKSMLGQAGFMTGLDEDMLEPMIDMVKKVEPNYQTVFAVSEMEAAMRETRTKKTKTVCTFCGVGCTFEVWTKDRKILKVEPTGEGPVNKFATCVKGKFGWDFVNSEKRITTPLIREGNEFVPASWEDAIHLVATKLREIQAKYGNDSIGFISSSKTTNEENYLMQKLARQVFETNNIDNCSRYCQAPASDGLTRTVGIGADSGTVEDIETAGLVIIVGASPADGHPVLASRIKRAQKTRGQKLIVSDLRKHEMAERSDLFMHPKQGTDFVWLTAVAKYMIDQGWHDEAFMENRISNVADYLSFLEPFTLEYAEKETGLSVETLKKVAQMVYEADGTAVCWGMGVTQNIAGSHTSSAIANLLLVTGNFGRHGAGAYPLRGHNNVQGACDMGSLPNVLPGIQPLGNDEVRARFEEAYGVSISPEPGLKNNEMLDAIEAGTLHSMYVIGEEMAWVDSNSNHVQEILASLDFFVVQDVFLSKTAQFADVVFPAAPSLEKEGTFTNTERRVQRLYEVLEPLGDSKPDWWIIQEVAKACGKTDWNYDHPSEIMDEIASLAPFFAGVRYDRMQGFNSLVWPVSADGKDMPLLYEERFNFPDGKAQFSTLPYIAPITFPEEYNLTLNNGRLLEQFHEGNLTDKSKGLDYKLPEVFVEVSHELAKERDLESGSLVRLSSPYGRIKLRAVVTERMKGNEVYVPMHSVSSETAVNLLTSSAGDVRTKTPAYKQTKVNLTVLEKTGKNPLPDHNPRNRKRFPQNGAEVARKWSREDYQPISKVNCACGGNCGCGGKRRNH

SEQ ID NO: 39149 - protein, 488 aa, Listeria innocua Clip11262
MSIKETSLPKVQTKLFINGKWIDGDNKETKDIVNPANGEVIAKIAQAGPKETKQAIKAAKDAFPDWAKMELADRVKLLHNIADLMEERADTLAKIMTLEQGKPLKESKGEVLTGAENFRFAAEEARRLYGETIPAPNNHAFIVKKQPIGVVAAITPWNFPGGMVTRKLAPALATGNTIVLKPSGDTPLSALAIFEIFEEAGLPKGVANIVMGSSKEIGETLTDSDDVRKLTFTGSTKVGQTLFKQSADTLKKISLELGGHAPFIVFADANLEAAVDDLITAKFRNNGQVCVSPNRIFVAKEIKEKFTKTLVAKVEKLKVGNGLDDVNVGPLIREDAIDKIDKQLKNATDKGAKVLTGGERLTGSDYDKGNFYKPTVLDNVTREMDIFYEETFGPVIPLIVFENEDEAIEMANDSEFGLASYFYTKDLARVEKVGAALEYGMVGANEIAISNPETPFGGVKHSGFGRENGHYGMEEYIQVKFINLKYRD

SEQ ID NO: 39150 - protein, 218 aa, Oryza sativa (japonica cultivar-group)
MEVEEAAYRTVWSEPPKRPAGRTKFRETRHPVYRGVRRRGGRPGAAGRWVCEVRVPGARGSRLWLGTFATAEAAARAHDAAALALRGRAACLNFADSAWRMPPVPASAALAGARGVRDAVAVAVEAFQRQSAAPSSPAETFANDGDEEEDNKDVLPVAAAEVFDAGAFELDDGFRFGGMDAGSYYASLAQGLLVEPPAAGAWWEDGELAGSDMPLWSY

SEQ ID NO: 39151 - protein, 516 aa, Desulfotalea psychrophila LSv54
MDIHKEKIIILDFGSQTTQLIARRVREMKVYSEIHPFSLPLEKLKELNPTGIILSGGPCSVYDDDAPHSDAGLFELGVPVFGICYGAQLMIQQLGGSVEKAEKREFGKAEIQILNDSDLFAGLDVARSHQVWMSHGDRVEVIPDQFEVSAESAHSPYAALRHRSKPFVAVQFHPEVVHSIIGTDLLRNFVFGLCKCQATWTMQGFIESNVAAIKEKVGDAHVICALSGGVDSSVVAAMIHKAIGSQLTCVYVNNGLMRIGESEGIIKFFKENTDLHLIDVDASDYFLGKLEGVTDPEVKRQHIGLGFIKIFEEEAHKIDGDVKFLAQGTLYPDVVESVSFRGAAPIKSHHNVGCLPDIMKLSLIEPLRELFKDEVRELGVELGLPDEAVHRQPFPGPGLSIRIMGEVTPERLDIVRRADVIVLDEMKKHGYYNKVWQSFAVLLPIQTVGVMGDFRTYEHVVALRVVDSRDAMTADWSRVPYDILGDISTRIINEVRGVNRVVYDISSKPPATIEWE

SEQ ID NO: 39152 - protein, 165 aa, Oryza sativa (japonica cultivar-group)
MQLEISPRQRSQQQKEEEGEHQQRAGEEAVGAVFSIEPWVDAAAVLVPPLNFAEVNDGIFRSGFPAADNFAFLLSLKLRSIVYLCPEPYPEENTRFLEQNGIKLHQFGIDGSKELLVNIPEEKIREALKVILDVRNQPVLIHCKRGKRYSSRSLADSDKIWKLDT

SEQ ID NO: 39153 - protein, 856 aa, Phaseolus vulgaris
MLGGIFGNKGQKIKGNLVLMRKNVLDINSITNPANVVDTAFDIFGSAIDTVTAFAASISVQLISSTKTDALGKGKVGSATKLRGQISLPTLGASEEAYDVSFDWDADFGIPGAFYIKNFMQNEFYLKSFTLEDIPNYGTIHSICNSWVYNSKKYKSDRIFFANNTYLPSETPAPLLKYREAELKNVRGDGTGKREEWERIYDYDVYNDLGNPDKAAALARPVLGGSTLPYPRRGRTGRAKTKKDPNSEKPDDFVYLPRDEAFGHLKSSDFLAYALKSVSQDVLPVLTDAFDGSLLSLEFDNFAEVHKLYDGGVTLPTGFLSKYAPIPIVKEIFRSDGEQFLKYPPPKVMQVDKSAWMTDEEFARETIAGVNPNVIKILKEFPPRSTLDTQAYGDHTSIITKEHLEPKLGGLTVEQAIENKKLFILDHHDYLIPYLRRINSSTTKTYATRTIFFLKDDGTLAPLAIELSKPHPQGDEHGPVSEVYVPAYEGVEAYIWLLAKAYVVVNDSCYHQLVSHWLNTHAVVEPFVIATNRQLSVVHPVYKLLFPHYRDTMNINSLARKSLVNADGIIEKTFLWGRYALELSAVIYKDWSLHDQALPNDLVKRGVAVADPSAPHGVKLVIEDYPYASDGLEIWDAFKSWVVEYVAFYYKSDEVLQQDSELQAWWKELVQVGHGDLKDKPWWPKMQSRENLVEVSTTLIWIASALHAAVNFGQYPYGGLILNRPTISRRFMPEKGSAEYAALAKNPEKEFLKTITGKKETLIDLTVIEILSRYASDEIYLGERDGGDHWTSDAGPLEAFKRFGKKLAEIEKKLVQKNNDETLRNRTGPAKMPYTLLYPSSEEGLTFRGIPNSISI

SEQ ID NO: 39154 - protein, 460 aa, Triticum aestivum
  misc_feature (179)..(179): Xaa can be any naturally occurring amino acid
  misc_feature (207)..(207): Xaa can be any naturally occurring amino acid
MAGLLHLHSTLLPSASLLRQRGGAQAVPRRRRACRVEAKIREIFMPALSSTMTEGKIVAWNAAEGDRLAKGDPVVVVESDKADMDVETFHNGFLAAVLVPAGESAPVGSAIALLAESEEEIPLARSQAANFSSSAAASPPAPQETVAQEASPAPPPPPPPAPVAVSAPAPPSPATQGGXRVVASPYAKKLAKELSVDLFAVTGSGQXGGRVVAKDVEAAAAAPKKAAPVPAARPDVPLGSTVPFTTMQGAVSKNMVESLAVPAFRVGYTITTDALDVLYKKIKAKGVTMTALLAKATAMALVQHPVVNSSCRDGQSFTYNSSINIAVAVAIDGGLITPVLQDADKLDIYSLSRKWKELVDKARAKQLQPQEYNSGTFTLSNLGMFGVDRFDAILPPGTGAIMAVGSSQPTVVGTKDGRIGIKSQMQVNVTADHRVIYGSDLAAFLQTLSKIIEDSKDLTF

SEQ ID NO: 39155 - protein, 321 aa, Oryza sativa (japonica cultivar-group)
MASVASFPVINMENLETEERGAAMEVIRDACENWGFFEMLNHGIAHELMDEVERVSKAHYANCREEKFKEFARRMLEAGEKGADVKGIDWESTFFVRHRPVSNLADLPDVDDHYRQVMKQFASEIEKLSERVLDLLCENLGLEKGYLKKAFAGSNGPTFGTKVSSYPPCPRPDLVDGLRAHTDAGGIILLFQDDQVSGLQLLKDGEWVDVPPMRHAIVANIGDQLEVITNGRYKSVMHRVLTRPDGNRMSIASFYNPGADAVIFPAPALAAADAAAAAYPRFVFEDYMNLYVRHKFEAKEPRFEAMKSAAEVVHAAPIATA

SEQ ID NO: 39156 - protein, 324 aa, Pseudomonas fluorescens PfO-1
MSQTSDLIQSAQRTIRLEVEAVQGLLPHIDADFVRACEMILASKGRVVVVGMGKSGHIGNKIAATLASTGTPAFFVHPAEASHGDMGMITRDDVILALSNSGSTNEIVTLLPLIKRLGIQLISVTGNPQSPLAKAAEVNLNVHVEHEACPLNLAPTSSTTAALVMGDALAVALLEARGFTAEDFAFSHPGGALGRRLLLKVENVMHAGQELPQVQRGTLLKDALMEMTRKGLGMTVILEADGKLAGIFTDGDLRRTLDRSIDIHSATIDQVMTVHGKTARAEMLAAEALKIMEDHRINALVVVDEEDRPIGAFNLSDLLRAGVM

SEQ ID NO: 39157 - protein, 560 aa, Mycobacterium sp. JLS
MTETPTRPAKPVKRPRGEGQWALGYREPLNANEQSKKDDNPLNVRERIENIYAPGGFDTIDKGDLRGRFRWWGLYTQRKPGFDGTWTGDENTDMLEDEYFMLRVRSDGGALTAKALRTLGEISTEFARDTADISDRQNVQYHWIDVRNMPEIWRRLDEVGLQTTEACGDCPRVVLGSPLAGESLDEVIDGTPAVDEIVKRYIGKPEYSNLPRKFKTAISGLQDVVHEVNDVAFIGVVHPEHGPGFDLWVGGGLSTNPMLGQRVGAWVPLDEVPDVWEGVVSVFRDYGYRRLRSKARLKFLIKDWGVEKFRQVLETEYLKRPLIDGPAPDPVTRPIDHVGVQKLKNGLNAVGVAPIAGRVSGTILSKVADLAEAAGSDRIRFTPYQKLIVLDVPDEKLDELRAGLDALGLPSTPSHWRRNLMACTGIEFCKLSFAETRSRSQVLVPELEKRLEDINAQLDVPVTININGCPNSCARIQVADIGFKGQMVDDGDGPEEGFQVHLGGSLGLDSGFGRKLRQHKVLATELGDYIERVVRNFVKQREDGERFATWALRADEADLR

SEQ ID NO: 39158 - protein, 245 aa, Triticum aestivum
MMTMAAEDQAAVPRVVSILSALLARVAERNDVVAAVERRIRDVEEQQQEEEDQGEDGKETTTTAKKKKAVSAFQGLTKPAISVGGYLERIFRFAGCSPSCYVVAYIYLDRFLRRRPALAVDSFNVHRLLITSVLTAVKFVDDICYNNAYFARVGGISLMEMNYLEVDFLFGIAFDLNVTPAVFASYCAVLQTEMAYLEHPPPSIDAVSPTSLLQHCLPDQEVDTAAAAAAAAKSGCHRHQQQLTV

SEQ ID NO: 39159 - protein, 340 aa, Treponema pallidum subsp. pallidum str. Nichols
MEWCCALSGLLPEEIQKVCAFAERFRGVQVFRWIAAGCTDFHAMSDLSSETRARLARACVISDTRVYTTLRDVDGTLKLGIELKDKRRVEAVLLVDQVSRKTACLSCQVGCPMACAFCQTGQLGFARNLSASEIVEQFLHLERCVGTLDNVVFMGMGEPMLNLDAVCRAIEILSHPQGRDLSEKRITISTSGHCRGIYSLADRALQVRLAVSLTTANAPLRARLMPRAAHDSLAKLKSAIRYFNEKSGKRVTLELALMRGVNTSERHAQEVIDFAHGLNVHVNLIPWNPVASIHFETPREVEVAHFEALLMRARIPVTRRYQRGNGIGGACGQLGKTAGV

SEQ ID NO: 39160 - protein, 204 aa, Hevea brasiliensis
MNIFMVVLLCLTGVAIAEQCGWQAGGKLCPNNLCCSQYGWCGSSDDYCSPSKNCQSNCKDSGEGVGGEIAYDVRATYHLYNPQDHGWDLNAVSAYCSTWDANKPYSWRSKYGWTAFCGPVGAHGQPSCGKCLSVTNTGTGAKTTVRVVDQCSNGGLDLDVNVFRQLDTDGKGYERGHLTVNYQFVDCGDSFNPLFSIMKSSVIN

SEQ ID NO: 39161 - protein, 206 aa, Hevea brasiliensis
MNICMVVLLCLTGVAIAEQCGRQAGGKLCPNNLCCSQYGWCGSSDDYCSPSKNCQSNCKGGGGGGGGSGGSASNVLATYHLYNPQQHGWDLNAVSAYCSTWDANKPYSWRSKYGWTAFCGPVGAHGQPSCGKCLSVTNTGTGAKTTVRIVDQCSNGGLDLDVNVFRQLDTDGKGYERGHLTVNYQFVDCGDSFNPLFSIVKSSVIN

SEQ ID NO: 39162 - protein, 355 aa, Oryza sativa (japonica cultivar-group)
MEQPKPPSVAASAAEAQNPNAFTCELPHSIYALAFSPSAPVLAAGSFLEDLHNRVSLLSFDPVHPTAASFRALPALSFDHPYPPTKLQFHPRAASAPHLLASSSDALRLWLAPLDDLAATATAAAPELRSVLDNRKTSASEFCAPLTSFDWNEAEPRRIGTASIDTTCTIWDIERGVVETQLIAHDKAVHDIAWGENGIFASVSADGSVRVFDLRDKEHSTIFYESPRPDTPLLRLAWNRYDFHYMATLLMDSSAVVVLDMRAPGVPVAELHRHRACANAVAWAPQATRHLCSAGDDGQALIWELPATPGAVPAEGIDPVMVYDAGAEINQLQWAAAYPEWISIAFENKVQLLRV

SEQ ID NO: 39163 - protein, 457 aa, Schizosaccharomyces pombe 972h-
MKLLISLLWSIFFSIVYSEKTLLNFKHYELCNGIYSKSESGGSLNPAIYVNWTEPWGQEDEVEVLIFNWKEIRKLGAFRSDDQFTYICDYDAVYTDHLCEADQLGLYLWNSTSAKSIRSYIIPTNADPQNIIYEISQSGYYCIWSHSKKMLPYQALVNWQNAYGGLPASQFPRMPISGGITIAYSVILALWMFFRFQYKHSIVTVQKAIMFLLIFSCAQQAVTSIVLDTENLRNRGNFTWLGETLVSILFACQLVLDLALLLILSWGYTRYSTNMRDRLFTEAKIPLIICFFALFVVRFFAITIQSIHLGLWFCFFFLTACISALYILFGAFVALPSTLRALVEQRYYTLHSIYKIFRIMVLCGVVTIFSFSLVALIFCSNTNNNSTNKLWKIRWYFLDGWIDGVHLTYLITLSSLWRPSQENPDLDPTGLSYPVLDPRLEEELDLLEEDIRADKSK

SEQ ID NO: 39164 - protein, 547 aa, Glycine max
  misc_feature (325)..(325): Xaa can be any naturally occurring amino acid
  misc_feature (341)..(341): Xaa can be any naturally occurring amino acid
MAASAGGQITLSSTVQLHGVACSRNWKLVKFCNGEVMGRKLVLKSAYGGSTKDVRHHQQQQHICMSLTADVSTESKLRDLDMERRNPRTVLAVILGGGAGTRLFPLTKRRAKPAVPIGGAYRLIDVPMSNCINSGINKVYILTQFNSASLNRHIARAYNSGNGVTFGDGYVEVLAATQTPGEAGKKWFQGTADAVRQFHWLFEDPRSKDIEDVLILSGDHLYRMDYMDFVQNHRESGADITLSCLPMDDSRASDFGLMRIDNKGRILSFSEKPKGEELKAMQVDTTVLGLSKDEAQKKPYIASMGVYVFKKEILLNLLRNMHREXLILFQSLFFKCYKLIXFRWRFPTANDFGSEVIPASAREFYMKAYLFNDYWEDIGTIRSFFEANLALTEHPPRFSFYDAAKPMYTSRRNLPPSKIDNSKIVDSIISHGSFLNNSFIEHSVVGIRSRINSNVHLKDTVMLGADYYETDAEVVALLAEGRVPIGIGENTKIKDCIIDKNARIGKNVVIANSEGIQEADRSSEGFYIRSGVTIVLKNSVIEDGFII

SEQ ID NO: 39165 - protein, 655 aa, Burkholderia cepacia
MCGIDGFLNSVACDEETARGTLARMTASLAHRGPDGQGIWVDPEAGIALGHRRLAIVDLSVHGRQPMASACGRYVMVFNGEIYNHRELRAELERAGRAPAWRGHSDSEVLIAAIVAWGVDATLRRATGMFAFALWNRASRVLTLARDRIGEKPLYYGRIGDALVFASELKALRGYPGFDGAIDRDALCLYLRQSSVPAPHTIYRGIHKLPPGTYIQFEHARDTPRLRAYWTLEQVIEDGRAQPFEGSADDAVGQLDAVLRQAVARQMEADVPLGAFLSGGIDSSTIVALMQAQSSTPVDTFTIGFHEAGYDEAGYAKAVARHLGTRHTELYVTADHALGVVPKLPSIYDEPFSDASQIPTFLVSELTRRHVKVSLSGDGGDELFGGYTRYFLTPRLWRKLHRVPGAVRARIAAALHALRPDHADQLAAVAQGAWGGVEARESAARIGDRLHKLGHVMTAESRIGLYRLLMSSVHHPERLALSGQEPATPLDTVSAWPAHLSFAEQAMAIDTLTYLPTDILAKVDRAAMAVSLETRMPFLDHHVVEFAWRVPAHVRLPEGQSKALLRRLLDRYVPSALIDRPKQGFCAPVDHWLRGALRDWAEALLRPSRLREEGYFDADAVERLWRQHVTGRMNWQHQLWTVLMFQAWLEAQRAA

SEQ ID NO: 39166 - protein, 762 aa, Methanocaldococcus jannaschii DSM 2661
MVNFDEEVFRAYYEHKIKSFIKEELSNNLIKGNIFEFDIEKFLMHFPDACEVNDLIIERPKEIEEIILDIFKEAYVELFGEDKELEKIQIAFKNPKGCEKLIEEISAEDINKLVKFEGNILQAGKVNALLKKAVYYCNKRIKDENGGFLCKYTYTPCDGRVEIEIDDYFSEGEFIKDMLSPREVKKILENKKVWDKLVEKGKIPRCVDLKENDEVFKENLKEIKFILDEYDSIYVNIQEMEIQQPIDLMKNPEEPARSIRVFLENTPGIYAGRVNVIGRVMKREYRHNIPIYKIYIKSNYIKISESYNKIEVKDILRNEELIETLNELGRKKNIIDILSNYLISQIKGYELVKKAIFLQQIKGAFKFLPDGTPLRRDSHILLITDPGIGKSTMLRRIARLFPQNAYASVTTATGGGLTAIVTREATEIGDGWVVKPGVFVRANEGTACIDELTVDKNVMKYILEAMESQTIHVNKGGINVKLPARCAVLAACNPKRGRFDRNLTVIEQIDIPAPLLSRFDLIFPLMDKPNRKSDEEIAEHILNTHIETATKDYKILGAIDIDGITVDEKLLKYYIIYARSCAYIEENQDLYLGEFDETKLIMPYLTDKAKKMIKKYYLEMRKLGEGDNPIPITARQLEAIIRIAEMHAKARLSDKVEDVDAEVAISIIDDCLKQVAYDPETGTLDLDKIAGTPKSRRDKMDAVLNIIREIVSLRDDGLAPEEEIYEKAMAIGLSEKDVNDALEYLKKAGDIYNPRYGFWGLL

SEQ ID NO: 39167 - protein, 205 aa, Methanocaldococcus jannaschii DSM 2661
MKRLAVILITLALVSSMCITNSNEKRENMKNAKVLMVIAPKDFRDEELFEPMAVFESNGLKVDVVSTTKGECVGMLGNKITVEKTIYDVNPDDYVAIVIVGGIGSKEYLWNNTKLIELVKEFYNKNKVVSAICLSPVVLARAGILKGKKATVYPAPEAIEELKKAGAIYEDRGVVVDGNVITAKSPDYARLFGLEVLKAIEKNNE

SEQ ID NO: 39168 - protein, 343 aa, Coprinopsis cinerea okayama7#130
MSAHPMKTLRDDEKQAAESMLGGNKTTLFDADNEAANRDTPLPTPVSSQAPRPQKPKLSAAMIIPVWIALSSSVIIYNNYLYNTLNFKYPVFLVTFHLAFAAVGTRVLQRTTHLVDGAKDIHMSKDMFMKSILPIGLLFSGSLILSNTAYLYLSAFTPVAILLISWAFRLQEPNKKLAIIVVLISTGVALASHGELKFNLFGFLTQAAAVGFESSRLVMIQILLHNLKMDPLVSLHYYAPVCAVITGFFIPFTEGLAPFYELKELGAAILISNASVAFLLNIAAVFLVGAASGLVLTLAGVFKDILLITGSVIIFGSTVTPLQVFGYSIALGGLVLFKTSGGK

SEQ ID NO: 39169 - protein, 322 aa, Streptococcus agalactiae A909
MVTLSKEQHLDMFLKMQRIRDVDMKFNKLVRRGFVQGMTHFSVGEEAASVGAIQDLTDSDIIFSNHRGHGQTIAKGIDIGGMFAELAGKATGTSKGRGGSMHLANLEKGNYGTNGIVGGGYALAVGAALTQQYEGTDNIVITFSGDSATNEGSFHESVNLAAVWNLPVIFFIINNRYGISTDITYSTKIPHLYMRADAYGIPGHYVEDGNDLMAVYEKMHEVINYVRSGNGPAIVEVESYRWFGHSTADAGVYRTKEEVDSWKAKDPVKRYRAYLIENEIATEEELAAIEAQVIKEVEEGVKFAEESPFPDMSVAFEDVFVD

SEQ ID NO: 39170 - protein, 204 aa, Hevea brasiliensis
MNTFIVVLLCLTGVAIAEQCGRQAGGKLCPNNLCCSQWGWCGSTDEYCSPDHNCQSNCKDSGEGVGGGSASNVLATYHLYNSQDHGWDLNAASAYCSTWDANKPYSWRSKYGWTAFCGPVGAHGQPSCGKCLSVTNTGTGAKTTVRIVDQCSNGGLDLDVNVFRQLDTDGKGYERGHLTVNYQFVDCGDSFNPLFSVMKSSVIN

SEQ ID NO: 39171 - protein, 204 aa, Hevea brasiliensis
MNIFIVVLLCLTGVAIAEQCGRQAGGKLCPNNLCCSQWGWCGSTDEYCSPDHNCQSNCKDSGEGVGGGSASNVLATYHLYNSQDHGWDLNAASAYCSTWDANKPYSWRSKYGWTAFCGPVGAHGQPSCGKCLSVTNTGTGAKTTVRIVDQCSNGGLDLDVNVFRQLDTDGKGYERGHLTVNYQFVDCGDSFNPLFSVMKSSVIN

SEQ ID NO: 39172 - protein, 435 aa, Arabidopsis thaliana
MAEEKSFKYVIVGGGVAAGYAAREFFNQGVKPGELAIISREQVPPYERPALSKGYIHLENKATLPNFYVAAGIGGERQFPQWYKEKGIELILGTEIVKADLAAKTLVSGTGQVFKYQTLLAATGSSVIRLSDFGVPGADAKNIFYLRELEDADYLAYAMETKEKGKAVVVGGGYIGLELGAALKANNLDVTMVYPEPWCMPRLFTAGIASFYEGYYANKGINIVKGTVASGFTTNSNGEVTEVKLKDGRTLEADIVIVGVGGRPIISLFKDQVEEEKGGLKTDGFFKTSLPDVYAIGDVATFPMKLYNEMRRVEHVDHARKSAEQAVKAIKAAEEGNSIPEYDYLPYFYSRAFDLSWQFYGDNVGESVLFGDNDPESPKPKFGSYWIKEGKVVGAFLEGGSPEENNAIAKLARAQPSVESLEVLSKEGLSFATNI

SEQ ID NO: 39173 - protein, 249 aa, Glycine max
MLGVIRHKSIRPAFSAIRHLSSAAKEITVREALNSALDEEMSADPKVFLMGEEVGEYQGAYKISKGLLDKYGPERVLDTPITEAGFTGIGVGAAYYGLRPVVEFMTFNFSMQAIDHIINSAAKSNYMSAGQISVPIVFRGPNGAAAGVGAQHSQCYASWYGSCPGLKVLSPYSSEDARGLLKAAIRDPDPVVFLENELLYGESFPVSAEVLDSSFCLPIGKAKIEREGKDVTITAYSKMVGYALKVCLL

SEQ ID NO: 39174 - protein, 405 aa, Oryza sativa (japonica cultivar-group)
MELHLTSRGALPLSPPLAGQRRPHLSLSTPSLPIKNHTYSVPPPFSKAHCAIGCQASLATNYMETSAVADLDWENLGFGLVQTDFMYIAKCGPDGNFSKGEMVPFGPIELSPSAGVLNYGQGLFEGLKAYRKTDGYILLFRPEENAIRMRNGAERMCMPAPTLEQFVDAVKQTVLANKRWVPPTGKGSLYIRPLLMGSGAVLGLAPAPEYTFMIFVSPVGNYFKEGLAPINLIIEENFHRAAPGGTGGVKTIGNYASVLKAQRIAKQKGYSDVLYLDAVHKKYLEEVSSCNIFIVKGNVISTPAIKGTILPGITRKSILEVAQRKGFMVEERLVSVDELLEADEVFCTGTAVVVSPVGSITYLGQRVEYGNQGVGVVCQQLYTSLTSLQMGHVDDCMGWTVELNQ

SEQ ID NO: 39175 - protein, 533 aa, Parachlorella kessleri
MAGGGVVVVSGRGLSTGDYRGGLTVYVVMVAFMAACGGLLLGYDNGVTGGVVSLEAFEKFFPDVWAKKQEVHEDSPYCTYDNAKLQLFVSSLFLAGLVSCLFASWITRNWGRKVTMGIGGAFFVAGGLVNAFAQDMAMLIVGRVLLGFGVGLGSQVVPQYLSEVAPFSHRGMLNIGYQLFVTIGILIAGLVNYAVRDWENGWRLSLGLAAAPGAILFLGSLVLPESPNFLVEKGKTEKGREVLQKLRGTSEVDAEFADIVAAVEIARPITMRQSWASLFTRRYMPQLLTSFVIQFFQQFTGINAIIFYVPVLFSSLGSANSAALLNTVVVGAVNVGSTLIAVMFSDKFGRRFLLIEGGIQCCLAMLTTGVVLAIEFAKYGTDPLPKAVASGILAVICIFISGFAWSWGPMGWLIPSEIFTLETRPAGTAVAVVGNFLFSFVIGQAFVSMLCAMEYGVFLFFAGWLVIMVLCAIFLLPETKGVPIERVQALYARHWFWNRVMGPAAAEVIAEDEKRVAAASAIIKEEELSKAMK

SEQ ID NO: 39176 - protein, 572 aa, Saccharomyces cerevisiae
MCGIFAAFRHEDVHRYKPKALQLSKRIRHRGPDWSGNAIKNSTIFVHERLAIVGVESGAQPITSSDGEYMLCVNGEIYNHIQLREECADYEFGTLSDCEPIIPMYLKHDIDAPKYLDGMFAWTLYDAKQDRIVAARDPIGITTLYMGRSSASPKTVYFASELKCLTDDCDTITAFPPGHVYDSKTDKITRYFTPDWLDEKRIPSTPIDYMAIRHSLEKAVRKRLMAEVPYGVLLSGGLDSSLIASIAARETAKATNDVEPSTYDSKARHLAGIDDDGKLHTAGWTSLHSFAIGLPNAPDLQAARKVAKFIGSIHHEHTFTLQEGLDALDDVIYHLETYDVTTIRASTPMFLLSRKIKAQGVKMVLSGEGSDEIFGGYLYFAQAPSAAEFHTESVQRVKNLHLADCLRANKSTMAWGLEARVPFLDREFLQLCMNIDPNEKMIKPKEGRIEKYILRKAFDTTGEPDAKPYLPEEILWRQKEQFSDGVGYSWIDGLKDTAEAVISDEMFASPKAEWGSDIPTTKEAFWYRLKFDALFPQKTVADTVMRWIPKADWGCAEDPSGRYAQIHEKHIE

SEQ ID NO: 39177 - protein, 505 aa, Acidobacteria bacterium Ellin345
MATTTAETAKATVYKNLIDGEWVESKSGQTFENLNPADTREVVGIFQRSGKEDVEHAIDAASEAYKKWRLVPAPRRAELLFKAAAILEQRKEKYSQEMTREMGKVIKETRGDVQEAIDAGYYNAGEGRRMFGPTTPSELPNKFAMAVRQPLGVCAMITPWNFPMAIPSWKLFPALVCGNTAVIKPAQDTPLSTFNFVQALNDAGVPKGVINIVTGYGGEVGTPMTEHPEVKAVSLTGSTAVGRIVGQAAAKSFKHCSLELGGKNPMIVLDDANLDLALEGALWGSFGTTGQRCTATSRIILQKGIYKKFADELVARARKLKVGNGLDETVDMGPAVNENQMNTDLKYIEIGKGEGAKLAHGGHRLDKGDYAHGWFLEPTIFTDVNHKMRIAQEEIFGPVVALIPCDDLDEAIEIANGIEYGLSSAIYTRDVNKSFRAMRDLHAGITYVNAPTIGAEVHMPFGGVKATGNGHREGGIGALDFYTEWKAIYVDYSDTLQRAQIDNRE

SEQ ID NO: 39178 - protein, 147 aa, Triticum aestivum
  misc_feature (85)..(85): Xaa can be any naturally occurring amino acid
  misc_feature (90)..(90): Xaa can be any naturally occurring amino acid
  misc_feature (100)..(100): Xaa can be any naturally occurring amino acid
  misc_feature (120)..(120): Xaa can be any naturally occurring amino acid
  misc_feature (123)..(123): Xaa can be any naturally occurring amino acid
  misc_feature (132)..(132): Xaa can be any naturally occurring amino acid
  misc_feature (138)..(138): Xaa can be any naturally occurring amino acid
MAPAVMASSATTVAPFQGLKSTAGLPVSRRSSGSLGRVSNGGRIRCMQVWPIEGIKKFETLSYLPPLSTEALLKQVDYLIRSKWXVPCLXFNKVGFSFRXEHNSSPRVLRRPYWTMWELXMFXCTDAPSVKXVEEVKXGYLILSFQP

SEQ ID NO: 39179 - protein, 467 aa, Arabidopsis thaliana
MDYIFNSFDALYSTLLILPPHCRFENITLWRTITGKGHRSNGLVQAVIFEASDRNNIGGSAYGGQRSICCTPDLAKLQGCKQGEIIRIPSPHDPQWPILLPVRFKGKRSSAKMADTEILITKTGIYNLLFISCDPQLKGLKMTGKTVWKNPDGYLPGRMAPLVNFYVYMSLAYLLLSAVWFFQYLRFRMDILPLQHCITAVILLGLLEMLFWYLDYANFNHTGMRPLALTTWVVTIGALRKTVSRILILCVSMGFGVVKSTLGGLTSKVLLVGVTYFIASEILDIAEHVGIIDDMSGRSKLFLVLPDAFLDAFLILWIFTSLSKTLEQLQMKRTSVKLEIYRKFSNALAVMVVASVAWIVYEVYFKATDPFNERWQTAWTITAFWDVIAFLLLCIICYLWTPSQNSQRDANMKLMMDRYAYSGDVDEENEEAQSLTGGKQDGDISLVKQEKNAESDREEDVEEDKRE

SEQ ID NO: 39180 - protein, 337 aa, Oryza sativa (japonica cultivar-group)
MAAPPPSSPSPPPAAAAAATQQTQPHPQTPFYELVKGNSGIEKVLLRGTRGFSAEVYLYGAQVTSWKNDHAEELLFVSSKAIFKPPKAIRGGIPICFPQFGTHGNLEQHGFARNRLWTIDDNPPPLPVNPAIKSFVDLILRPSDEDLKIWPHSFEFRLRVALGPNGDLSLTSRIRNTNTDGRSFSYTFAYHTYFSVSDISEVRVEGLETMDYLDNLKGKERFTEQGDAIVFESEIDKVYLAAPSKIAIIDHEKKRTFVLTKEGLPDAVVWNPWDKKAKAMQDFGDGEYKHMLCVEPAAVEKPITLKPGEEWKGRLALSAVPSSYCSGQLDPLKVLQG

SEQ ID NO: 39181 - protein, 504 aa, Arabidopsis thaliana
MVVINSLRRLARTTQVHLHSRYATCMSGNSTSRRIFTTEAAPEKKNTVGSKGHDMLAPFTAGWQSADLDPLVIAKSEGSYVYDDTGKKYLDSLAGLWCTALGGNEPRLVSAAVEQLNTLPFYHSFWNRTTKPSLDLAKVLLEMFTANKMAKAFFTSGGSDANDTQVKLVWYYNNALGRPEKKKFIARKKSYHGSTLISASLSGLPPLHQNFDLPAPFVLHTDCPHYWRFHLPGETEEEFSTRLAKNLEDLIIKEGPETIGAFIAEPVMGAGGVIPPPATYFEKVQAVVKKYDILFIADEVICAFGRLGTMFGCDKYNIKPDLVTLAKALSSAYMPIGAILMSQEVADVINSHSSKLGVFSHGFTYSGHPVSCAVAIEALKIYKERNIPEYVAKVAPRFQDGVKAFASGSPIIGETRGTGLILGTEFVDNKSPNEPFPPEWGVGAFFGAECQKHGMLVRVAGDGILMSPPLIISPEEIDELISIYGKALKATEEKVKELKAQHKK

SEQ ID NO: 39182 - protein, 114 aa, Triticum aestivum
  misc_feature (27)..(27): Xaa can be any naturally occurring amino acid
SFEQKCDELMDSYATLLFAKITEIKPXAFCKQYGLCRGTALFSGVTSDSTCVFCHHLLDEVMSKLKDPDAEFEIIQILIKECNKIEGHVQQCKRLVLQYIPLILVNGENSPRGG

SEQ ID NO: 39183 - protein, 405 aa, Flavobacteria bacterium BBFL7
MLYKMPHMFQKIFKNIGPGTLVAAAFIGPGTITVCILAGANYGYSLLWAMLLSVFATIVLQEMAARLGLITGKGLPEILRSTINNKAIRVAIIILVLAAIAVGNAAYEAGNISGGVLGLNIIFGTQWYFPLILGMIAFSLLIYGNYKVLERVLITLVVIMGISFIVTAIAIGPDFTSILKGLFTPSINEGDLLTIVSLIGTTVVPYNLFLHASLVSEKWNDATDLSAVRKDTIVSVFLGGLVSMSIIVAATALQSTTVSSGADVAKALEPIFGMASTYVFSIGILAAGITSAITAPLAAAYVVKGCLGWRGNMKSWSFRAVWIIILGLGVVFSSIGLKPLDIITFAQIANGLLLPVIAILLLWLVNQKNLGNYQNRNWQNVMAIMVIAIAILLGIKTLLKVFEII

SEQ ID NO: 39184 - protein, 355 aa, Glycine max
MAPSFDCVSSLLCAEDNSIFDENDYGGSVEVLEDAWQDPRYRRNLSQSENLDVPNGFFPLQSDECLRLMVEKEWDHLPNGDYVNRLRSGDLDFGARKEAIDWIEKVQQHFGFGPLCAYLSINYLDRFLSAYELPKHRAWTMQLLAVGCLSLAAKMEETDVPFSLDLQVGESKYIFEAKTIQRMELLVLSTLRWRMQAITPFSFIDHFLYKINDDQSPIGASILQSIQLILSTVRGIDFLEFRPSEIAAAVAISVVGEGQTVHTEKAISVLIQLVEKERVLKCVKMIQELASNSGGSAKGASASVSVPSVPESPLGVLVTACFSYKSDDTNAASYANSSHNISPDAKRRKLNKTFG

SEQ ID NO: 39185 - protein, 203 aa, Prochlorococcus marinus str. MIT 9312
MSSKLRVGVAGPVGSGKTALLETLCLSLKNNYEIAVVTNDIYTKEDANFLINKKVLEEGRIIGVETGGCPHTAIREDCSLNKNAVLDLENRYKPLDFVFVESGGDNLASSFSPELVDLSIYVIDVSAGDKIPRKGGPGITRSDLLLINKIDLADMVGANLNIMKSDTEFMRKGKPWFFTNLSTGIGVEEITRFLESQIPNNQN

SEQ ID NO: 39186 - protein, 322 aa, Candidatus Desulfococcus oleovorans Hxd3
MAKMKEIKAKNMNVEKFIADKVKDIQQAVGDGMAINALSGGVDSSVVTVLGHRALGKNLKTYFIDNGIMREGEPARVVATFKKMGIPVEVIDASRAFFAALKGVTDPEEKREAITQTFYKKIFGKLVVKSKATYLLQGTILTDVDETVAGIKRQHNVFAQLGIDPQKAFGYKILEPLIELRKDGVRKVGRGLGLPEAVFERMPFPGPALAARVIGEAKPDRIALARKATAIMEKTFKDVDAFQYMAILHEDRVTGMRDNKRVFGNQIEIRCWDSVDARKARPTRLSFDLLESVAKKITKTIPEVVSVTYNITSKPTSTMEAV

SEQ ID NO: 39187 - protein, 102 aa, Glycine max
MASPKSPTRPTQQNPEPSFHDFLPAMAGKLGGEGLIGELCNGFELLMDREKGVITFESLRRNAAAVLGLGDLTDEDVRSMIKEGDFDCDGALNQMEFCVLMF

SEQ ID NO: 39188 - protein, 149 aa, Triticum aestivum
MSVELVLWLFSFASVMALVGLTAYQLICLSDLEFDYINPYDSSSRINAVVIIEYVLQGVLCASFLLTLNWFPFLVMAPVTYYHVKLYMNRKHLIDVTEIFRQLHGEKKYRMIKLAFYFALFIISIYRLVMTAVLLFIDEDVNLVETRTI

SEQ ID NO: 39189 - protein, 343 aa, Mycobacterium sp. JLS
MSSDRERRSPHRRRRPTMAHVLPVLDLTDADTDPAGFRARLREAAHDAGFFYLVGHGVPVEGFERVLRLARDFFTQPPERKNEISQLLSPQFRGYSRLGGELTNGTVDWREQIDIGPERDVIEGAEGYWRLQGPNLWPAQPPGFRAAFEEWGAALSEVGVRLLRHWAVSLGAAEDTFDAAFADRPATLMKVVRYPGTTQTAQGVGAHKDSGVLTLLLVEPGSVGLQVESGPDEWIDVPPLPGAFIVNIGELLEVATGGYLRATRHRVLAPPPGTDRISIPFFLNPALDALIPILPLPPELAVRSRGVETDPDNPIFNTYGENAWKSRTRAHPDVAELHHGITR

SEQ ID NO: 39190 - protein, 886 aa, Yarrowia lipolytica CLIB122
MTILSATVEKAKKAKEIWLQDDPRDQDDDDSQVQAEVVEVDDSLIEWIAMKLGIPPSDFDGSYPREVHFMAEKLAEMTLEKALNIVKVNFEYHDHDNNFRHEYRVEINGLKEAFGSGEDPEKEDPENILLVRYWATIFHWWSPYPEVRSVTDPYDETETTVETWRVWVLGTIWVAIAAFVNQFFSVRLPAISLGSGVCQLLLYPCGRFLQYTLPDWGFTFRGKRYTLNPGVWSQKEQLLATIMIGCAAGTPYVTSNIITQALPSFYNQDWARGFGYQFVLTLVTQMMGFGLAGLLKRVAVYPVKAMWPSLLPTLAVNKALLAPNRKESINGWKISRYTFFMIIFAFSFLYFWVPNYLMNFLQTFNWMTWIAPGNKDLAVVTGSVAGLGFNPIPTFDWNQAVAGIAPITLPLYTSVTGFVGTFFGGLVILAVYYTNNSWTAHIPINSNRLFDNKGKSFNVTRILTDYKFDKEKFLNYSTPYYSAGNLVLYSAFFSIYTFSFVYTILMDWRAMRDAIVETAKALRYIHRSNYHGRVDPFSRYMRRHKEVPDWWFYLTLLIMFVLAIVLVEVWPVDTPVWSIVFVMGLVAVFIIPFTVFVSYTATSLSLNVLSELIIGYALPGRFMALNLIKALSVQIAEQAENYTSDQKLTHYAHLPPRSIFWLQIWATLVNIFVCLGVIQFQLGLDKICDADNRLKFTCPSETTFFTASIAWGVIGPKKMFDKYPVMKWMFLFGACAGLFFWFVQVMVPYYMAKKWPKYSEKIHYYRRKCLYFNPLIFVVGMLAWAPQNLTYKVGGLYLAILFNGYIKSRYLSWWRKYAYVLEAAMDTGIALSGIIIFFSVQYHPKDLEWWGNDVIYDGMDGGGIPLPPHVPIPEDPGYFGPPPSQW

SEQ ID NO: 39191 - protein, 393 aa, Oceanicola granulosus HTCC2516
MRALTYQGKHDVRVETVPDPQIVNPRDAIIEITATAICGSDLHLYDGVIPAVMPGDILGHEFMGRVVETGPGSTLEKGQRVVVPFTISCGQCFHCAQQQFSACDNSNPAEKQDLTEPLYGHPVSGLFGYSHLTGGYPGGQAEYVRVPFSDVGPIVIPDGMDDEEVLFLSDILPTGWMAAENADITEGDTVAVWGCGPVGLFAVQSARVMGAHKVIAIDHYPNRLALARQMGAEVIDYTQTHVLEALMEMTGGIGPDAVIDAVGMESHGFAPDNMLDTIKQTVGMGADAPHALRMAIMACRKGGRISMPGVYGGMADKFPLGALMEKGLQLRTGQTHVQRYTSDLLRRIQEGELDTTFMISHRLPLEEAARGYANFANNQNDWTKVVLKPGMAA

SEQ ID NO: 39192 - protein, 232 aa, Bacillus cereus ATCC 14579
MIYSCYPIIIFRENREMTNNNQIGENKEQTIFDHKGNTIMTEDREIHIISKFEEPLIVVLANVLSDEECDELIEMSKNKMERSKIGSSRDVNDIRTSSGAFLEDNKLTSKIEKRISSIMNVPASHGEGLHILNYEVDQQYKAHYDYFAEHSRSAANNRISTLVMYLNDVEEGGETYFPKLNLSVHPRKGMAVYFEYFYQDQSLNELTLHGGAPVTKGEKWIATQWVRRGTYK

SEQ ID NO: 39193 - protein, 1575 aa, Arabidopsis thaliana
MAVLYHYPCHDGVFAALAAHLYFSAKSIPSLFFPNTVYSPITINQLPLQDISHLYLFDFTGPPGFVHQVSPKVDNVVILDHHKTAIDSLGDVSLTCKNVTSVLDIERSGATIAFDYFTQKLVEESRGSCKEMNDFKRMRRVFEYIEDADIWKWELPESKAFNSGILDLKIEYDFNKNQSLFDQLLSLDHESVINRGKQSLSKKHKLIHEVLEQSYEIVLGGDEEFGRCLAVNADEITELRSELGNQLAEKSKNLSLRGVGAVVYRVPELGDENKLKISLRSVAEEDTTPVSQRFGGGGHKNASSFLLNSMEFEQWKAVVSFGVEKLWELLSRESARLNGIDEQVDGLKRQLGRLQSLLKDADAKKNETERVRNFLEDVKDIVYDADDIIESFLLNELRGKEKGIKKQVRTLACFLVDRRKFASDIEGITKRISEVIVGMQSLGIQHIADGGGRSLSLQERQREIRQTFSRNSESDLVGLDQSVEELVDHLVENDSVQVVSVSGMGGIGKTTLARQVFHHDIVRRHFDGFSWVCVSQQFTRKDVWQRILQDLRPYDEGIIQMDEYTLQGELFELLESGRYLLVLDDVWKEEDWDRIKAVFPHKRGWKMLLTSRNEGLGLHADPTCFAFRPRILTPEQSWKLFERIVSSRRDKTEFKVDEAMGKEMVTYCGGLPLAVKVLGGLLAKKHTVLEWKRVHSNIVTHIVGKSGLSDDNSNSVYRVLSLSYEDLPMQLKHCFFYLAHFPEDYKIDVKILFNYWVAEGIITPFHDGSTIQDTGESYLEELVRRNMVVVEESYLTSRIEYCQMHDMMREVCLSKAKEENFIRVVKVPTTTSTTINAQSPCRSRRLVLHSGNALHMLGHKDNKKARSVLIFGVEEKFWKPRGFQCLPLLRVLDLSYVQFEGGKLPSSIGDLIHLRFLSLYEAGVSHLPSSLGNLKLLLCLNLGVADRLLVHVPNVLKEMQELRYLRLPRSMPAKTKLELGDLVNLESLTNFSTKHGSVTDLLRMTKLSVLNVIFSGECTFETLLLSLRELRNLETLSFHDFQKVSVANHGGELLVLDFIHLKDLTLSMHLPRFPDQYRFPPHLAHIWLIGCRMEEDPMPILEKLLHLKSVYLSSGAFLGRRMVCSKGGFPQLLALKMSYKKELVEWRVEEGSMPCLRTLTIDNCKKLKQLPDGLKYVTCLKELKIERMKREWTERLGLKHICLEKSRGAFLRRSIDDIIFELVPAKSIARFRCVSESIHRRPDVTEQSLTKSMSRPRLLFALEVNKDLLFFSSPQPQNPYDNSSLVATPYKRFPKYLPTRICTTLGGLVFLQKWLRKKTRVICNPVSGDYITLPKVKATGVGESYFGFDPITKQFKVLCMTWSRYGTPNTHQVLTLETGKRLWRTIQDPILPHYRSFDRICINGVLYYGADFEESQSSKIVCFDFRFEKFSFINIADEGMFRGSYKWTLFNYKGKLGAHQYSRNGELVLWVLEDAENHKWSKSICILPPIVHNSRIVGVTGTGEIANYESNYAFSLPYFKTLTNYAFSLPYFKTLTNYAFSLPLGFHACASMPKSVALIALEDANGSVRLRTVQM

SEQ ID NO: 39194 - protein, 539 aa, Coccidioides immitis RS
MAGTSDVSRVEAPVTLKAYLMCAFAAFGGIFFGYDSGYINGVLGMDFFIEEFTGLRKSDFSPDEVKDKFVVPSWQKSLITSILSAGTFFGAIIAGDLADFFGRRTTIISGCAVFIVGVALQTASTTVALLVVGRLVAGFGVGFVSAIIILYMSEIAPRRVRGAIVSGYQFCITVGLLLASCVDYGTQERTDSGSYRIPIALQMLWALILAVGLFLLPESPRYYVKKGDVERAKAALASVRGQPLDSEFIQQELAEIVANHEYELQVVPQGSYWASWLNCFRGSLFDPASNLRRTILGTSLQMMQQWTGVNFIFYFGTTFFQSLGTISNPFLIGLITTLVNVCSTPISFWAIERIGRRPLLIWGACGMFVCEFIVAIVGVTVGERQDAVRAMIAFICIYIFFFASTWGPGAWVVIGEIFPLPIRARGVGLATASNWLWNCIIAVITPYLVYSDKANLGPKVFFLWGSLCVMCFIYAYLLVPETKGLTLEQVDKMLEETTPRTSAKWKPHTTFASEMGLTEKATLEEAVAIEVSPDHKETV

SEQ ID NO: 39195 - protein, 512 aa, Aeropyrum pernix K1
MAKTLDSPGVLVVDFGGQYAHLIARRIRELGVYSEIVPATSLDALGEALPRAAGVVLSGGPGSVWGSRHDEAAAMVLQLGKPVLGICYGHQLLAKVLGGEVGRSPLPEFGPTEVEVLDYGILLNGLPSRFKVWMSHYDAVLRPPGEAKVLARTPGSPVAAMELWGRVFGVQWHPEVRHTQYGREVLDNWLSLVGAPRTWRPGDMVSELVESVKKEVGDALAVAAVSGGVDSTVAALIAKKAIGSRLYPVFIDHGLHPEGEVERVVKLLSRLGLEPVMVDAGEEFLAALEGVGDPEEKRRVVGRVYAEVLERAARDIGAEYLVQGTIYPDVIESGARPGADTIKTHHNVGGLPKDMRLKLVEPLRYFYKDEVRLLAEKLGVPRELIWKQPVPGPGLAVRVEGPITREKLRIVRRADAIVREEVEAAGLGGKLWQYFAVLTASMATGVRGDSRSYGYVVAVRAVESVDAMTAKPAELPWWLLERIARRITSEIPEVVRVVYDITSKPPSTIEWE

SEQ ID NO: 39196 - protein, 657 aa, Saccharomyces cerevisiae
MSDNGSPAVLPKTEFNKYKIGKVKSTPAIQRDAKTNLTYIKLRKRSSEKVYGCTVFQNHYREDEKLGQGTFGEVYKGIHLETQRQVAMKKIIVSVEKDLFPITAQREITILKRLNHKNIIKLIEMVYDHSPDITNAASSNLHKSFYMILPYMVADLSGVLHNPRINLEMCDIKNMMLQILEGLNYIHCAKFMHRDIKTANILIDHNGVLKLADFGLARLYYGCPPNLKYPGGAGSGAKYTSVVVTRWYRAPELVLGDKQYTTAVDIWGVGCVFAEFFEKKPILQGKTDIDQGHVIFKLLGTPTEEDWAVARYLPGAELTTTNYKPTLRERFGKYLSETGLDFLGQLLALDPYKRLTAMSAKHHPWFKEDPLPSEKITLPTEESHEADIKRYKEEMHQSLSQRVPTAPRGHIVEKGESPVVKNLGAIPRGPKKDDASFLPPSKNVLAKPPPSKIRELHQNPRPYHVNSGYAKTAIPPPAAPAGVNRYGPNNSSRNNRFSGNSTAPNNSRNPVNRFHPETNVSSKYNKVPLPLGPQSRYQGNSNESRYKNSPNDSRYHNPRYVNKPETNFNRQPQKYSRQESNAPINKNYNPSNGSRNMAGDHHQGSRPSHPQFPISPSQGQHQLTSKPIEKKNGSFKDERAKPDESKEFQNSDIADLY

SEQ ID NO: 39197 - protein, 432 aa, Aeropyrum pernix K1 [sequence omitted]

SEQ ID NO: 39198 - protein, 157 aa, Sinorhizobium meliloti 1021
MGVSGSGKSSVGEAIAEACGYPFIEGDALHPPENIRKMSEGIPLTDDDRWPWLAAIGERLASREPVVVSCSALKRSYRDKLRESAPGGLAFVFLHGSESVLAERMHHRTGHFMPSSLLQTQLETLEDPRGEVRTVAVDVAQPLAEIVREALAGLARL

SEQ ID NO: 39199 - protein, 442 aa, Desulfotalea psychrophila LSv54
MTREEIMKIVEEENIQYFRLQFVDILGHMKNVAVPKSQIGKALDGQMMFDGSSIDGFVRINESDMYLKPDYNTFCVLPWRNKNGRGVARIICDVHKADETPFEGCPRVNLKRVLAEAKELGYTMNVGTEAEFFLFEQDEKGRATTITNDVANYFSLDPEDSGNDCRREIIETLEKMGFEIEASHHEVAEGQHEISFKYADALATADNTVTFKWVVKSIARQYGLHATFMPKPIFGVNGSGMHTNQSLFNIDGTNAFFDESDPLQLSPVAYSYIAGSLKHALVCTAVNNPLVNSYKRLVPGYEAPVYAAWSASNRSALVRIPASRGLSTRTEMRSPDPSCNPYLALAMQLNAGLDGVRNNATPPAAVDQDIFSMSNAEMDEVGIKVLPGSLKEAVDELKGSPLAKETLGAHIFEKFIEAKEKEWESYRIAVTNWEIEEYLNVY

SEQ ID NO: 39200 - protein, 470 aa, Escherichia coli
MPLNKKDTQGKGVKNASTVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGHGGEKASIDNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLGMILLLMCTMDDMRLSAILLPVWIVFLFMAFKTLRRK

SEQ ID NO: 39201 - protein, 683 aa, Candida albicans SC5314
MVNIQPQNATESAVNQSCEPITTPASSEYEGFDHNEVRQLAKILTNDNDDSAKSSLVRQLSNMSNVPGVNPCDANNLPPQLNPNCDQFDSKLWIKNLKKLYESDPEYWQHSKLGVAYTNLRVYGIANDVDYQPTVTNLLWKLGGEAFRKYFRKNDKTQYFDILKPMDAIMRPGEPTVVLGRPGAGCSTLLKTIAVNTYGFHVGKESKICYDGLTAHDIEKHFRGEVIYSAETEVHIPHMTVGDTLEFAARLRTPQNRGDNIDRETYAKRMADAYMATYGISHTRNTKVGNDIVRGVSGGERKRVSIAEVSLSGAKIQCWDNSTRGLDSATALEFIRALRTSAKILDCTPVVAIYQCSQDAYDLFDNVSVLYEGYQIFFGKASKAKEYFEKMGWKCQPRQTTADFLTSLTNPAERQTLPGFEDRVPRTPQEFESYWKRSPEYSELMGQIDGYFVDCETLNTKEVFHQAHVAKQSNHIRPSSPYRVSFFMQIKYLVGRNFKRLKGDPSLAIFRVCGQIIMGLILSSVFYNLQSTTESFYYRGAALFYAVLFNAFSSLLEVMTMYEARPVVEKHRKFALYCPSADALASIISELPVKLASSISFNLVFYFMVNLRRDPGRFFFYWLMNIWATLVMSHFFRTIGAVTTSLAGAMTPSTILLLAMVIYTGFVIPKPKYVGMGQVDYLY

SEQ ID NO: 39202 - protein, 176 aa, Zea mays
KFPGGQFSWVRGKGKREKPLVAPVGKFRVFWNFQQVKAGTPGGSRDQRGPKRCFCYKVVLKGESFVASRFIPGKFGGGGFPEAPLVVVPPRKVSSFRIANGRGFRSFFPPLGGNILGSCGFLFSLFLFPFLGGLVSFFGPELMGVPPGKNGFLFGGHVWSFVGGWGLGKRGGIFFG

SEQ ID NO: 39203 - protein, 343 aa, Oryza sativa (japonica cultivar-group)
MDHAAEAQRTDLMTITRHVLNEQGRHPESRGDFTILLSHIVLGCKFVASAVNKAGLAKLIGLAGDTNVAVQGEEQKKLDVLSNEVFVKALVSSGRTCVLVSEENEEAIIVDAPLRGKYCVCFDPLDGSSNIDCGVSIGTIFGIYMIKDKDNVTLDDVLQPGTDMLAAGYCMYGSSCTLVLSTGNGVNGFTLDPSLGEFILTHPNIKIPNRGKIYSVNEGNAKNWDAPTAKFVEKCKFPQDGSPSKSLRYIGSMVADVHRTLLYGGIFLYPADQKSPNGKLRVLYEVFPMSFLMEQAGGQAFTGKQRALELVPRKIHDRSPIFLGSYDDVEDIKALYASESIIG

SEQ ID NO: 39204 - protein, 819 aa, Candida albicans SC5314
MVNEFYDRQFECSQYIPSGPGYENVDSKNKVCTAVGSVPGEPFVNGTNYLKYAYEYYNSHKWRNLGIAIAFAVVFLGVYIWLTEYNKGAMQKGEIVLFLKSGLKKHKRKNQKATGTALEDIETGKFSNDKLIYPSDIEEEEGGATDKRLNLSGTDNRPEIFFWKDLTYQIRIKKEDRIILDHVDGWVVPGQITALMGATGAGKTTLLNCLSGRLTVGVVTEGARLVNGHSLDSSFPRSIGYVQQQDLHLPTSTVREAFRFSAYLRQPNYVSKQEKDEYVEYIIDLLDMKTYADAIVGVAGEGLNVEQRKRLTIGVELVAKPKLLLFLDEPTSGLDSQTAWSICKLMRKLANHGQAILCTIHQPSALIMAEFDRLLFLQKGGQTVYFGELGQNCQTMINYFERNGADPCPKEANPAEWMLEVVGAAPGSHAKQDYFDVWRNSNEYQVVKDEISRMEIELSKLSPLPSSSNGRDEKESRLTYACPLWKQYLLVTWRTIVEDWRTPGYIYSKLFLVVSSSLFNGFSFFKADKTIQGLQNQMFAIFMSFIPFNTLLQQMLPFYVKQRDLFEVRESPARTFSWFAFIAAQITSEIPFQIVLGTIAYFCWYYPVGLYVNAEPTNQVVSRGVLTWLLQVSFYVYVSTMGHLCNSFLELPDAAANLANLLFSLCLMFCGVLAGPSQLPRFWIFMYRCNPFTYLIQAILSTGLANTRVVCSEHEYVVIEPPAGQTCQEYMSVFITMHGGYLLQSNNGAAESGTCSYCTMDETNTFLKSVNALFSQRWRNYGIFNAFIVINVALAIFFYWLARVPKGNRESRIKHRKEE

SEQ ID NO: 39205 - protein, 354 aa, Gibberella zeae PH-1
MSLPSTMKAVVFDGLYKISVQDRPVPQIRDGRDIIIKVHAAGLCGSELHIYRGHQPSGTGFIMGHEFTGTVVQVGSDVKTIHIGDKVVAPFTASCGNCFFCNNGCSARCVESQLFGCEILNGGQAEYVRIPMADGTAVKAPETISDEALLLMADIFPTGFYGVKSAMELVPSQNIQEATMVVVGCGPVGLCAILAATHFKPRHLFAIDSVESRLEQARKLGAEPLNFETDRAGLEARIREVTEGRGADMVVEVVGQAPALRTAFDIVRPFGAISSIGVHNKEIPWTGDDAYTRNIRVQMGRCPVRSVFNEALHLLEQKQDKIGFLFDHKMPLAQAPEGYTLFEQRKTQKVVFTL

SEQ ID NO: 39206 - protein, 221 aa, Desulfotalea psychrophila LSv54
MNLTGIERGEYKVLKTLKHLFERNLEWANKIKERDPDFFPQLSKEHSPDYLWIGCSDSRVPANQITNLPPGDVFVHRNIANVVVHTDLNCLSVLQYAVDVLKVKHIIVCGHYGCGGIKASMEDAEHGLIDNWLRHVKDVIRLNADKLKDLEPDKKFNLLCELNVIEQVTNVCNTTIVQNAWKKGAELSIHGWIYSLRNGILKDLTTCIDSREEFDRRKKKM

SEQ ID NO: 39207 - protein, 215 aa, Glycine max
  misc_feature (28)..(28): Xaa can be any naturally occurring amino acid
MSKENRFLPEVLARKSVERFDETRSEFXSKRLPTSYETSLNGFDESPKIVEIDTYKTRSRSRRFTSTMSECGEDMSCHAISSPLPCPVPGRISVPDCRYIQDFDWYYNVDECRFSTAHSTPRFTNYVRPNVPATPAKSVCGDTFFRPYSNFPNYMANTQSFNAKLRSHSAPKQRPEPKKRLSLNEMMAARNSISGVRMQRPSSNFFQTQEDSWNF

SEQ ID NO: 39208 - protein, 407 aa, Arabidopsis thaliana
MALSSLLRSAATSAAAPRVELYPSSSYNHSQVTSSLGFSHSLTSSRFSGAAVSTGKYNAKRVQPIKATATEAPPAVHSFGRIGRLVLRIATFRDDIEVVAVNDPFIDAKYMAYMFKYDSTHGNYKGTINVIDDSTLEINGKQVKVVSKRDPAEIPWADLGAEYVVESSGVFTTVGQASSHLKGGAKKVIISAPSADAPMFVVGVNEKTYLPNMDIVSNASCTTNCLAPLAKVVHEEFGILEGLMTTVHATTATQKTVDGPSMKDWRGGRGASQNIIPSSTGAAKAVGKVLPELNGKLTGMAFRVPTPNVSVVDLTCRLEKDASYEDVKAAIKFASEGPLRGILGYTEEDVVSNDFLGDSRSSIFDANAGIGLSKSFMKLVSWYDNEWGYSNRVLDLIEHMALVAASR

SEQ ID NO: 39209 - protein, 314 aa, Prochlorococcus marinus str. MIT 9312
MKHLDINFPVDKFEKLIIDIGWESLDDWFNFWNNQKNILSIDQYWKNKVNDDWIWGLALPLLSQAYKIQNNFSDRKIIGISALPGTGKTTLGKWLEAISLKLNFKIVVISIDDFYLPSDEMKLAIKNNPWNVSRGFPGSHSVKLMHEKLLNWKLNGEINVPVFDKSLRNGLGDRSHWRLDKPDILIIEGWFLGIEPFPGDVNYQNINSSDLSPHELSYRYNIQNNLKKYLDSWSLIDKIWHLKPSKFEYMNKWKANQEKEMFLKKGNALQDEKLSNFLRMLNVSIPHKSFDVINSYALLLINQERNLVEAGLNL

SEQ ID NO: 39210 - protein, 402 aa, Ostreococcus tauri
MFARAARRGGFTARAVARRLGTILRLTFRLGKFSTLLWVFKLLGLIAYSLILAPAFLRVAWRCVTSRNIELGVVYGDAPRNALDLYFPDDGDEARRQRREAIGRGSVSDARSSPKSSPHEAEAPAARPVVIFITGGMWIIGYKAWGALLAQRLSRRGCIVASLDYRNFPQGTIGDMIADVGCGIGWVLDRIEALGGDGRKVVVIGQSAGAHIAATCLLRQAGWAQSKAHFPNGWSPGAISRFIGISGLYAPDDEALVEHVHRQGLYKNVFWSIMEAGFSGARASEALPRASPVTILREHEVRENVRIIPPVMLCHGESDKSAPPGQSRIFASALRSVGVAVDERYYVGKTHTDPFVTDPILGEDVLLDDITNCIFGRRLPPFDERPLVPRFLVEFARLVVPF

SEQ ID NO: 39211 - protein, 498 aa, Arabidopsis thaliana
MAFAKAPRLSRDDILGNRVSTRSFKIFSDNQKTDPASTIGTSQKKTRIPLRRKIRESQERAKAVLKTGEMERCKNGKSEKENVSKRTTELGNNNLYKTASKASNQAVPQLSSAGTYTWKTRTSVGSIQSDGNKQSKNNVRFIQTTVKTSLQNRSSLKKPPVGRSKSRSISSIPSSAVASTLSLPEKVETKCLEEDTQGESSSSGNKDPTTKVLDVTAKPKSKRRKSFTSLLVNGSKFDEKNGETTEPEKLPSIDDESNQLEVAEYVDDIYQFYWTAEALNPALGHYLSAHAEVSPVTRGILINWLIEVHFKFDLMHETLYLTMDLLDRYLSQVPIHKNEMQLIGLTALLLASKYEDYWHPRERSMLKQLKFRLNAPTPYVFMLRFLKAAQSNKKLEQLAFYLIELCLVEYEALKYKPSLLCASAIYVARCTLHMTPVWTSLLNNHTHYNVSQMKDCSDMILRFHKAAKTGNLRVTYEKYINPDRSNVAVLKPLDKLPL

SEQ ID NO: 39212 - protein, 479 aa, Zea mays
ISAMSCRSRYEFAVYHKTSSHKPSPYLISNLRKHEALQKRCGPGTAAHKKAVRRLDSGEGVVDDDDGCRYLVYISYRGLGNRMLGITSAFLYAVLTERVLLVDGGKDTGALFCEPFPGTTWLLPQAGWFSFSPLSRLQGYEGGSKENLGDMLQSGGITVSADGNVSWSAPRPPLYLYLHLSGSYGFHDKLFFCDAHQRLLGEVPWLFMWTDNYIVPGLFLTPAFSDELEAMFPEKESVFYHLGRYLFHPTNRVWHAIKSYYHANLADVDQRVGVQIRVFQKKQPPRFVLEQILSCLRDVKLLSGTKTDAAGGGNGTSSSFSRAVLVTSLSSWYYDRIRDEYGGRISGGVHQPSHEGRQRWRDAAHDMRALSEIYLLSMCDVLVTSGYSTFGYVAQGLAGLRPWVMPRAPMWAADWREELDPRDMPCRRADSVEPCFHAPSAYRCAAGRDVDLGKVSPYIRRCVDVKYGINLVNESSGQW

SEQ ID NO: 39213 - protein, 524 aa, Triticum aestivum
MPIPQIHWQLLPQVQLPQQWRQLLLGLGLLLPVLVLIVRRRKGFKLPPGPARLPVLGNLHQLGSLPHRSLRELARRHGPVMLLRLGATHMLVVSSASAAREVLKEHDADCCSRPACPGPKRLSYGFKNMAFAPYGEHWREMRKIFIVELLSMRRVKAAWGARQEQVDKLMAALAPDEPVALGEHIFAFTDGIIGTVALGNVYGADMLARKKHFQHVLDEAMDMLATFSAEDFFPNAAGRLVDRLTGLVARRDRLFSSLDDFFETVIEQHLDPARPKPENGGDLVDVLIDLWKQEHRGFTKDHVKAIIMDTFVGGIDTSSVTILWAMSELIRNPRVMKKAQEEIRAAVGEQRARVQPDDLPKLNYLKMVLKETLRLYPPATLLLPRETMRHVRIGGYDVPAGTRVAVNAWALGRAGASWGEDADEFNPDRFEAGARHGAVDLHGAHFELVPFGAGRRVCPGMAMALMNVEFALGNLLCGFDWALPEGAKAEDLCMEEAGGLTFHRKTPLVLVPTPYVPPSAASLN

SEQ ID NO: 39214 - protein, 161 aa, Ostreococcus tauri
MNDLERRIESLRALERRKDLAMRRCASVRKKKSATTAVRWNPAEQAPKAPGVETRQRDKGEVLQIQRAMLEEQDDALDDLSRAAGRAKEISIAVNDELDLHAKLLDSLDDEMADTSGRLTRASRAVQNMMRRGSSCRSATIAVLVFVLCFLVLALIIKLQR

SEQ ID NO: 39215 - protein, 427 aa, Candidatus Desulfococcus oleovorans Hxd3
MNQTRSKALFKEAAVLIPGGVNSPVRAGKAVGTTPLFIDRAQGAEIVDADGNVYIDYIGSWGPMILGHRHSAVMAAIETVLKRGLSFGASTDLEARLARMVADAVPSIEMVRMVNSGTEATMSAIRLARGITGRDGLVKFDGCYHGHADMLLVDAGSGVATQAIPGSPGVPADVVRHTISLPYNNTAALKDCLDRKGEQIACVIVEPVAGNMGMVEPDPGFLSALRKETEKHGCLLIFDEVMSGFRVAYGGAQARYRITPDITCLGKVIGGGMPVGAYGGSRQIMKHIAPEGNIYQAGTLSGNPVAMAAGIATLSELKKPGVYEALEARTRRLADGLARAAADAGVPVQAHAVGAMLGLFFADRPVTDFASAKTSDLSRFAAYYRAMLEKGIFLAPSQFEAIFVSTAHTDDHIDRTVNAAKAVFADL

SEQ ID NO: 39216 - protein, 282 aa, Phaeodactylum tricornutum
MKFLSASIALLACATSVEAFNANKAFRFGAKAMPEVSSESATTALSAGGAEKKSYDLDITEIFDGNKKFIETKKAQDAAYFDTLGTVHSPKYLYIGCVDARAPPNMIMGTEAGTMLTVRNIANMVVNNDLAVMSAIQFGINVLKIPHVIVCGHYECGGVRASVANVDHAPPLSIWLRNIRDVYRLHARELDAIKDPEDRHRRLVDLNVIEQCVNLYKTGVIQAKRIESYQEGAPAAIPRVHPIVFDPKTGAIRKLQVDFDKYMSELDAIYDLYELENAKIPA

SEQ ID NO: 39217 - protein, 191 aa, Methanococcoides burtonii DSM 6242
MRNAKITRKTKETDIQMELELDGTGSSNIDTGIGFFDHMLTSFAKHGNLDLIIEATGDLIVDEHHLIEDTAIVLGQALSEALGDKDGIARFGDARIPMDEALADVVLDLGGRTYLVMKAEFEAPRVGEMNTQLVRHFFESLTDNSKMNLHIAVTGYNDHHKIEALFKAFAYALRRAVKIEGEGIKSTKGVL

SEQ ID NO: 39218 - protein, 417 aa, Rickettsiella grylli
MSFSPVLKTHRTPKKCLLWLSLLGPGFVVMLADTDAGSLITAAQSGAVWGYRLLALQFLLMPILYIAQELTVRLGITTGMGHGELIKHYFGKVWAWLSVTTLVVSCIGAILSEFSGLAGVGALFNIPAWETLSLVVTFLTIVAWTGSYRSVERVAILLGLFELIFLWVAWDARPVGREILSGLIHIPWQNKSYLYLLAGNIGAVIMPWMIFYQQSAVLDKGLNASHLRIARWDTAIGAIITQLIMASLLIATAATIGKINPEASLNTVQQISQAITPSLGCTVGRVLFALGMTGAALVASIVVSLTAAWGLGEVMGFRRSLEHRPKDAPWFYGIYTLILVLGGLLVASGRVNLVHLSVGVEVMNALLLPFVLGFLYLLALRALPKEVSLKPLYAILVGIILLVTSSFGLFGGLSGIL

SEQ ID NO: 39219 - protein, 132 aa, Glycine max
LQGHSRATMFLICNNAAQGILSSFFFKYADTILKKYSSTVATIFTGLASAAFLGHTLTINFLLGISVVFISMHQFFSPIAKVKDDKPGELLELQDTQNHRSSDSSFVNMTAGAAEDASHQLGTDERQPLLPI

SEQ ID NO: 39220 - protein, 561 aa, Picrorhiza kurrooa
MDFRRRPPRPSQIKHQLQSPASGASADHHNQSSSPKASDALPLPLYLTNGIFFTLFFSVAYFLLHRWRDKIRNSIPLHVLTVSELAAIICLIASFIYLLGFFGIDFVQSFTSKSENEDGFILHQDRSIHCPPIAPKPIVKMDLPQDDEEVVMSVVSGEVPSYSLESRLGDCFRAAKIRREALQRVTGRSVEGLPLEGFDYESILGQCCEMPVGYAQIPVGIAGPLLLNGCEYSVPMATTEGCLVASTNRGCKAIYASGGATCVLLRDAMTRAPVVRFSSVKRATDLKFFLEDPLNFDTLSVVFNKSSRFARLQSIQCGIAGKNLYIRFSCSTGDAMGMNMVSKGVQNVLDFLQNDFPDMDVIGISGNFCSDKKPAAVNWIEGRGKSVVCEAVISGDIVTKVLKTNVASLVELNMLKNLAGSAIAGALGGFNAHAANIVSAIFIATGQDPAQNIESSHCITMMEAVNDGKDLHVSVTMPSIEVGTVGGGTQLASQSACLNLLGVKGASKESPGSNSQLLATIVAGSVLAGELSLMSAISAGQLVKSHMKYNRSSRDITNFSS

SEQ ID NO: 39221 - protein, 217 aa, Schizosaccharomyces pombe 972h-
MSSAKYVVGSKPTEKRPKDIKSIKSVPICEKHRASVVKDISRKISRIQSATLPEYQIRDLNDAINRLMREKHEWEVQIRDLGGINYLYNKAKLFEDEGEQISDIDDYRYYGRARELPGVKELFEADMSFIPERQRKQEMQKRRLDAWYFGYIPPAQESLLEDFEAKIEEQQHKHLENLGDEVEQDWKPLVIEQIPTRDDVEAILLERRKNALLSRIS

SEQ ID NO: 39222 - protein, 244 aa, Ostreococcus tauri
MDRATTSSRASTARTFHDEEADEGLIFRSQAVTSAVFDALKFDPDRVSVSFDATSTEVEPESLLQRRYTLTHNDVTRNLTLTVGTTFNDEQTSVWYTRLLRDEVLAEWREDGLHVFCQVSANEAWWIRWAAPFRAVVFRQKLPLVLDTLRYAERELLATYPELFDSPVYVNFGEASGPGDKEYWGDLRTAGSEETKSKRVVCADGAGLDPRIADNVRQTIKGPRGSGVIDIGGVVLEKSPTPPR

SEQ ID NO: 39223 - protein, 342 aa, Schizosaccharomyces pombe 972h-
MSEVIKSVPPGSQNTSQWIISKDQLVFTPSALDGIPLDQEEIQRSKGCNFIINVGLRLKLPQTALATANIYFHRFYLRFSLKNYHYYEVAATCIFLATKVEDSVRKLRDIVINCAKVAQKNSNVLVDEQTKEYWRWRDVILYTEEVLLEALCFDFTVEHPYPYVLSFIKKFVADDKNVTKVAWTYINDSTRSIACLLYSPKTIAAAAFQFALEKNEINLSTTTDGLPVWMEESQVSYEDVKGVLTLIDSLYKKINPSKQALPIDQKNGSHASSVAPGTPSSLASVSTQATPQHQNSSGRTDSFHSLNTETPSKSTVDDQILSTAAQPKKSSDTDKEMETEAS

SEQ ID NO: 39224 - protein, 209 aa, Saccharomyces cerevisiae
MSQQVGNSIRRKLVIVGDGACGKTCLLIVFSKGQFPEVYVPTVFENYVADVEVDGRRVELALWDTAGQEDYDRLRPLSYPDSNVVLICFSIDLPDSLENVQEKWIAEVLHFCQGVPIILVGCKVDLRNDPQTIEQLRQEGQQPVTSQEGQSVADQIGATGYYECSAKTGYGVREVFEAATRASLMGKSKTNGKAKKNTTEKKKKKCVLL

SEQ ID NO: 39225 - protein, 554 aa, Schizosaccharomyces pombe 972h-
MIETIPTKPYEGQRPGTSGLRKKVTVFEQPNYVENFVQATMDVVEPSAKGAHLVVGGDGRYFNFHAIQVIAAIAAGNGVEKIIVGTNGYLSTPAASHIIRKYKLTGGIILTASHNAGGPKNDFGIKYNLGNGGPAPESVTEKIYSITKTISEYKMVKIPPLDLTTTGVRRYGPLTVEVIDPVKDYVQLMKEIFDFDLIRSFLSKNPDFTFVFDALHGITGPYGEALFCKELGMPSSVCQNCKPLPDFGGGHPDPNLTYAKSLVARVDRDNIVMGAASDGDGDRNMIYGANAFVTPSDSVAIIAHHAELIPYFRDGGVHGFARSMPTSGAIDRVGKYKGKNVYEVPTGWKFFCNLFDAKRLSICGEESFGTGSDHIREKDGVWGILCWLNILAGLNAQNPKIKTLIDVKKDFYNIYGRTFYSRYDYEELENEAAGKVMDRMRAIADDKSKVGEAVLPGFVVSEAGDFEYHDPIDGSESKHQGLYIKFENGSRIVTRLSGTGSSGATLRLYMEKHESDSSKFDLDAQVALKPVVHAALEILALEELTGRKEPTVIT

SEQ ID NO: 39226 - protein, 478 aa, Nicotiana tabacum
MAAVNGVGISWPSKLTQGQRPKLVFSPSPRRCTPSSSTIKMTASVDEKKKTFTLQKSEEAFSKAKELMPGGVNSPVRAFKSVGGQPIIIDSVKGSRMRDIDGNEYIDYVGSWGPAIIGHADDEVLAALAETMKKGTSFGAPCLLENTLAEMVISAVPSIEMVRFVNSGTEACMGVLRLARAFTGRPKIIKFEGCYHGHADPFLVKAGSGVATLGLPDSPGGPKAATSDTLTAPYNDISAVESLFEEHKGEVAAIILEPVVGNAGFIQPNLDFLAAIRKITKENDALLIFDEVMTGFRLAYGGAQEYFGITPDLTTLGKIIGGGLPVGAYGGRRDIMEMVAPAGPMYQAGTLSGNPLAMTAGIHTLKRLQGPGTYEYLDKITGELTQGILDAGKKTGHAMCGGYIRGMFGFLFAEGPVNNFSDAKKSDTEKFGRFYRGMLEEGVYFAPSQFEAGFTSLAHTSEDIQKTVAAAEKVLKQI

SEQ ID NO: 39227 - protein, 391 aa, Synechocystis sp. PCC 6803
MGKNLLEQLRQFTVVVADTGDIQAIETFTPRDSTTNPSLITAAAQMPQYQEIVDSTLLKAKDEAGENASIKDIVRLAFDRLAVAFGLKILQIIPGRVSTEVDARLSYDTEATIAKARYLIGEYAKAGIDKKRILIKIASTWEGIKAAEVLEQEGIHCNLTLLFGLHQAIACAEAKVTLISPFVGRILDWYKKSTGKEYDSHEDPGVQSVTTIYNYYKRFGYKTEVMGASFRNIGEIIELAGCDLLTISPQLLDQLRNTEGDLPRKLDPATVPQDIEKIVMDKATFDKMHAEDPMASEKLAEGIAGFTKALEVLEHLLEERLKVLDGQEHIKHGAEEIFHAYDLDGDGFITREEWAGTDVVFDALDRDHDGKITAAEMSAGLGAAFRLASVG

SEQ ID NO: 39228 - protein, 336 aa, Schizosaccharomyces pombe 972h-
MAIPKVGINGFGRIGRIVLRNALVAKTIQVVAINDPFIDLEYMAYMFKYDSTHGRFDGSVEIKDGKLVIDGNAIDVHNERDPADIKWSTSGADYVIESTGVFTTQETASAHLKGGAKRVIISAPSKDAPMYVVGVNEEKFNPSEKVISNASCTTNCLAPLAKVINDTFGIEEGLMTTVHATTATQKTVDGPSKKDWRGGRGASANIIPSSTGAAKAVGKVIPALNGKLTGMAFRVPTPDVSVVDLTVKLAKPTNYEDIKAAIKAASEGPMKGVLGYTEDAVVSTDFCGDNHSSIFDASAGIQLSPQFVKLVSWYDNEWGYSRRVVDLVAYTAAKDN

SEQ ID NO: 39229 - protein, 345 aa, Triticum aestivum
MKCPSDSSAGRDPCAPPPASAGGGSSEPAKKRQRTSSSSQAEASSSSQPPPQQPGDAREVPGLGDDVICEVLRRVEARTLAAAACVSRGWRTLAQDERLWEAPCVREWAGLGFSEQLLRDVVLSFGGFRRLHAVSIRARRRFGVGCGNWHGVRTPGQGRRRGAPWTDDEHRLFLLGLKTYGKGDWRNISRNFADEDADAGGPATRSEVLYQAQLRGGKGGRSIPRHHQQHLTGRPASLAVPVIDDQPGPAHRLSAATGPVLACQPTTKQARRGERALRFGRTGLSGCRTTPGFCKIKACRVVLYMISWPRTGVPSTLYYMISWQGLQDTENVRGKGCLELDAVVS

SEQ ID NO: 39230 - protein, 133 aa, Synechococcus sp. WH 5701
MGMGTPAEAITTAAAPAPVGPYNQAVKAGGLLFCSGQIALDPATGALVGAGDVEAETRQVLANLQAVLAAAGCTAQHVVRTTVFLTDLADFARVNALYAEVFSAGVSPARACVQVAALPKGALVEIDCIALLG

SEQ ID NO: 39231 - protein, 666 aa, Bacillus halodurans C-125
MSKHVEQLAVNTIRTLSIDSVEKANSGHPGMPMGAAPMAFCLWTKFMNHNPANPDWVNRDRFVLSAGHGSMLLYSLLHLTGYDLSLEELQNFRQWGSKTPGHPEYGHTPGVEATTGPLGQGVAMAVGMAMAERHLAATYNRDGYNIVDHYTYTICGDGDLMEGVSAEAASLAGHLKLGRMILLYDSNDISLDGDLHHSFSESVEDRFKAYGWHVVRVEDGNNLDEIAKAIEEAKADERPSLIEVKTTIGFGSPNKGGKSVSHGAPLGADEVKLTKEAYEWTYENEFHIPEEVAAYYEQVKQQGAEKEESWNELFAQYKKAYPELASQFELAVHGDLPEGWDAVAPSYEVGKSVATRSSSGEALNAFAKTVPQLFGGSADLASSNKTLIKGEANFSRDDYSGRNVWFGVREFAMGAAMNGMALHGGLKVFGATFFVFSDYLRPAIRLAALMQLPVIYVFTHDSIAVGEDGPTHEPVEQLASLRAMPGLSVIRPADGNESVAAWKLALESKDQPTALVLSRQNLPTLEGAVDRAYDGVSKGAYVLAPANGSADLLLLASGSEVSLAVNAKEALEKEGIHAAVVSMPSWDRFEAQSAEYKEEVLPSDVTARLAIEMGSSLGWAKYVGNQGDVVAIDRFGASAPGERIMEEFGFTVQHVVARAKALLENK

SEQ ID NO: 39232 - protein, 374 aa, Kineococcus radiotolerans SRS30216
MSSQFLVVGAGLAGASAAWRLTERGCSVTLVERDVPASAQGSSHGSARIFRYAYPERTYVDLVAASEPGWAELEARHGAALVIRCGALDFGARRDPHGLAAVLAAAGVEHELVPREQARERWPHVAVDTDVLHHAAGGVLDAETTVRTMVAAARAGGAEVLTGWPLQRLERTGAGFTAHAADGRTLSAGRVVVSAGGWLPDLLGDLPLPAGFLAAFPRLEVREENAFHFPYRDAGADWPALIHEDEDLSVYALPGGRDAGFRGQKVAEFNGGRVLPSAAARTGVVDPANRARVVDHVRRFLPGLEPEPYAETTCLFTSTPTEDFVVDGAEGVTVLSPCSGHGAKFAPLLGEVAADVALGTGSVPERFRVGVARG

SEQ ID NO: 39233 - protein, 218 aa, Arabidopsis thaliana
MSMNQFRTMEEEKQDGGELFHTIEVAKVDRNNVSQPPPAATAALLEVPGDELNLIPPLNFSMVDNGIFRSGFPDSANFSFIKTLGLRSIISLCPEPYPENNMQFLKSNGISLFQFGIEGSKSKEPFVDILDQKIREALKVLLDEKNHPLLIHCKRGKHRTGCLVGCMRKLQKWCITSILDEYKRFAAAKARVSDQRFLESFDVSGLKHTPMSFSCSNR

SEQ ID NO: 39234 - protein, 168 aa, Brassica napus
  misc_feature (137)..(137): Xaa can be any naturally occurring amino acid
  misc_feature (155)..(155): Xaa can be any naturally occurring amino acid
MESVLLCSKVVPRGTPLERNRKFSFRHLNKHLKCNSLPAASRNTPSLRSFEAIKGPSSLRFAPSPVRKGLSFLPKCSISTSTVSDSDNPFVTKFRQLVNKVSQLKVKPLDAVKLTLLLSVLTLAAKKIATLVFNPFXFWMYFSWTWLFWPWFIAXGLGGPTGVYCFRK

SEQ ID NO: 39235 - protein, 892 aa, Magnaporthe grisea 70-15
MTSRTSSYSSQVPRQPSRRPTLNATLSTSLSSADQVEDADVQGAAVESQIEQEIAEIKRYEVRLIQPATPVPQCPEFGQLTFLPQDFTTIDWVQDAAQERLRRKARRKRRQSSVYDNSYVGWRSWAAESYEAAQGWIVVTIIGIAIGLNAAFLNIVSEWLSDIKLGHCKTAFYLNENFCCWGEDNGCNDWQPWTNFGPINYIIYIIFATIFACTAATLVKSYAPYAAGSGISEIKCIIAGFVMKGFLGSWTLLIKSVGLPLTIGSGLSVGKEGPSVHYAVCTGNVISRLFAKYRSNASKTREILSACAAAGVAVAFGSPIGGVLFSLEEMSSYFPLKTLWRSYFCALVATSVLAAMNPFRTGQLVMFQVHYDRTWHFFEIAFFAILGIFGGLYGAFVIKWNLKVAAFRKKYLKEYPIVEASLLAFITAILCFPNVFLRIEMTESMEILFLECEGGEDYHGLCEAKNRAWNIMSLLIALILRTGLVIISYGCKVPAGIFVPSMAIGALFGRTIGIVVQALQESFPSSSFFSSCAPDVPCITPGTYAFLGAAAALSGIMHITVSVVVIMFELTGALDYILPTMIVVGITKMVSDRLGHGGIADRMIWFNGFPYLDNKEEHNLGLPVSAAMTSDLDTIPIAGMTMESVERLLAKDNYQGFPIVEENNNAAESSNNARRGRNLVGFIGRTELRYAVDRARRERQISPSAKCNFMPTDVNAVTPITPAGNSRRASFLGDAYTVDFSRFVDSTPVTVHPRLPLETVMELFRKIGPRVILIEHRGRLLGLVTVKDCLKYQFKAEAAENGSSSRADDDDEVQEKIWAFLQRAAWWLGDKVSLASGGRISLNGSFDETSRVSRTGHRAGNSGNSRGSTGQILEGTEDEMGDEAGGVEMEYR

SEQ ID NO: 39236 - protein, 404 aa, Arabidopsis thaliana
  misc_feature (267)..(267): Xaa can be any naturally occurring amino acid
MAAFLQTNIRLEIIPGRYSSLTDHKFRAPYRIRCAAASPVKKRYNITLLPGDGIGPEVISVAKNVLQKAGFLQGLEFDFQEMPFGGAALDLVGVPLPEETSTAAKQSDAILLGAIGGYKWDKNEKHLRPEMGLLNIRRDLNVFANLRPATVLPQLVDASTLKKEVAQGVDMMIVRELTGGIYFGEPRGITINENGEEVGFNTEIYAAHEIDRIARVAFETARKRRGKLCSVDKANVLDASILWRKRVTALASEYPDVELSHMYVDNXAMQLVRDPKQFDTIVTNNIFGDILSDEASMITGSIGMLPSASLGESGPGLFEPIHGSAPDIAGQDKANPLATILSAAMLLKYGLGEEKAAKMIEDAVVDALNKGFRTGDIYSPGNKLVGCKEMGEEVLKSVDSKVPV

SEQ ID NO: 39237 - protein, 152 aa, Zea mays
MAAAAAMMVSGGRAALVVAGVLCAVAAMAAAQQASNVRATYHLYNPAQNGWDLNRVSAYCATWDADKPLSWRQKHGWTAFCGPAGQKGQAACGKCIRVKNRATGASIVARIVDQCSNGGLDLDYETVFKKIDTNGQGYQMGHLNVDYQFVAC

SEQ ID NO: 39238 - protein, 319 aa, Arabidopsis thaliana
MFFDGYHYHGTTFEQSYRCYPASFIDKPQLESGDKIIMPPSALDRLASLHIDYPMLFELRNAGIERVTHCGVLEFIAEEGMIYMPYWMMQNLLLQEGDIVRVRNVTLPKGTYVKLQPHTTDFLDISNPKAILETALRNYSCLTSGDSIMVPYNNKKYFIDIVETKPANAISIIETDCEVDFAPPLDYKEPERPTAPAAAKGPAKAEEVVDEPEPKFNPFTGSGRRLDGRPLAYEPAPASSSKDKQPVVANGNGQSSVASSSEKATRAQGKLVFGANANRAPKEAAPKVGAAKETKKEEQEKNDEPKFQAFSGKKYSLRG

SEQ ID NO: 39239 - protein, 377 aa, Arabidopsis thaliana
MADADDIQPIVCDNGTGMVKAGFAGDDAPRAVFPSVVGRPRHHGVMVGMNQKDAYVGDEAQSKRGILTLKYPIEHGVVSNWDDMEKIWHHTFYNELRIAPEEHPVLLTEAPLNPKANREKMTQIMFETFNSPAMYVAIQAVLSLYASGRTTGIVLDSGDGVSHTVPIYEGFSLPHAILRLDLAGRDLTDYLMKILTERGYMFTTTAEREIVRDIKEKLSFVSVDYEQEMETSKTSSSIEKNYELPDGQVITIGAERFRCPEVLFQPSFVGMEAAGIHETTYNSIMKCDVDIRKDLYGNIVLSGGTTMFSGIADRMSKEITALAPSSMKIKVVAPPERKYSVWIGGSILASLSTFQQMWISKAEYDEAGPGIVHRKCF

SEQ ID NO: 39240 - protein, 341 aa, Salmonella enterica subsp. enterica serovar Typhi str. CT18
MKALSKLKAEEGIWMTDVPEPEVGHNDLLIKIRKTAICGTDVHIYNWDEWSQKTIPVPMVVGHEYVGEVVGIGQEVKGFKIGDRVSGEGHITCGHCRNCRGGRTHLCRNTTGVGVNRPGCFAEYLVIPAFNAFKIPDNISDDLASIFDPFGNAVHTALSFDLVGEDVLVSGAGPIGVMAAAVAKHVGARHVVITDVNEYRLELARKMGVTRAVNVAKESLNDVMAELGMTEGFDVGLEMSGAPPAFRTMLDTMNHGGRIAMLGIPPSDMSIDWTKVIFKGLFIKGIYGREMFETWYKMAALIQSGLDLSPIITHRFSVDDFQKGFDAMCSGQSGKVILSWD

SEQ ID NO: 39241 - protein, 673 aa, Silicibacter pomeroyi DSS-3
MDLTALRTANPDHWTKATAIRALTLDAIAAANSGHSGMPMGMADVATVLFEKHLKFDAANPTWPDRDRFILSAGHGSMLLYSLLYLTGNPEITLDEVKNFRQMGAKTAGHPENFLAKGIETTTGPLGQGISNAVGFAIAEEIQRAQYGKKVVDHYTYVIAGDGCLMEGVSQEAIGLAGRLELSKLVVLWDNNNITIDGTVDIADRTDQVRRFAASGWHVIEIDGHDPAAIDAALTQAKGSKKPTMIACKTHIALGHAAQDTSKGHGALTDQGQLLAAKEGYGWAHGPFEVPSDVKSAWEAIGSRGAAERAAWEARFAELSERKQAEFTRAYAFEAPKKLAGAIRALKKQVSEDQPKWATRKSSEEVLKVVNPIMTETVGGSADLTGSNNTKTADLGIFLPENRKGRYIHWGIREHGMAAAMNGMALHGGIRPYGGTFMCFTDYARPAMRLAALMKIPSVFVMTHDSIGLGEDGPTHQPVEHLAISRATPNTYVFRPADTVETAEAWELALTFQNSPSVLSLTRQNLPTLRTEHKVKNLTAQGGYVLAEATGKRQVILIATGSEVEIAMQARATLEAEGIGTRVVSMPCMELFAEQDEAYRKRVLPAGPVRVGIEAAMRAGGWDRWLLGERGREAKAGFVGMTGFGASAPAEELYEKFGITAAATVAKVKDLLG

SEQ ID NO: 39242 - protein, 154 aa, Methanococcoides burtonii DSM 6242
MNVKDIMSSNVIVCSPQDTISSTAQLLKKKNISGVPVVDEGKVVGIVSEVDLLKLLNIPEHGGLWLPSPFEIIEIPIRELIGWEDTKKMLSDVGSKPVSDIMEKDVFTIGLESSVEDASRSMSRHKINRLPVVDNGEIVGLITRGDIIRGLAGI

SEQ ID NO: 39243 - protein, 507 aa, Salmonella enterica subsp. enterica serovar Typhi str. CT18
MVLVILDGYGYREEQQDNAILNAKTPVMDALWAKRPHTLIDASGLEVGLPDRQMGNSEVGHVNLGAGRIVYQDLTRLDVEIKERTFFANPVLTNAVDQAKNAGKAVHIMGLLSAGGVHSHEDHIMAMVELAAERGAEKIYLHAFLDGRDTPPRSAEASLKKFEDKFAALGKGRVASIVGRYYAMDRDNRWDRVEKAYDLMTLAQGEFQADTAVAGLQAAYARDENDEFVKATVIRAEGQADAAMEDGDTLIFMNFRADRAREITRAFVNADFDGFARKKVVNLNFVMLTEYAADIKTAVAYPPASLANTFGEWMAKNDKTQLRISETEKYAHVTFFFNGGVEEPFAGEERILINSPKVATYDLQPEMSSAELTEKLVAAIESGKYDTIICNYPNGDMVGHTGVMEAAIKAVEALDNCIEQVTKAVESVGGQLLITADHGNAEQMRDPATGQEHTAHTNLPVPLIYVGEKNVKAVEGGKLSDIAPTMLSLMGMEIPQEMTGKPLFIVE

SEQ ID NO: 39244 - protein, 129 aa, Brassica napus
VPDFLPKWETAVTYNFPNRFYARSFSSSTNRMAVGGFLGDYNTRMDIFSLDSDSMSLKPFQSFSLRHPNLPTKLMLSPPSFRRRGGGDLLASSGNFFRFWGVNENSSSGGPVWVLNTSKTGEFWAPLTS

SEQ ID NO: 39245 - protein, 120 aa, Silicibacter pomeroyi DSS-3
MTDAKTRIDETVKANDVVLYMKGTKEMPQCGFSSRVAGVLNYMGVAYADVNVLADDEIRQGIKDYSDWPTIPQLYVKGEFVGGCDIITEMTLSGELDTLFEENGVAYDKDAADKIRAANA

SEQ ID NO: 39246 - protein, 542 aa, Aspergillus fumigatus
MIEAKMTPFEFNQHVNADRLARKLSARQVQMIAIGGTIGTGLFLGTGKALATGGPASMLISYAICGGIVFVTMLSLGEMAAFIPIAGSFCTFAGRFVDDALGFALTWNYWFNDAVSTAADVIALQLLLQYWTDNFPGWAISLIFLIFVILLNVMSVRIYGEIEYWLSLLKVITIIIFIILGIVVNCGGNKDHKYIGDKYFYVGDAPFVGGIGGFASVFVTASFAYGGTESIAITAGETKDPAKNLPRVVRNVFWRIVLFYIISIILIGLNVPYNYPNLSKKTTATSPFTIVFMEAGSAVAGSFINAVLMTSVISAANHALFAGSRLLYTLAVDGHAPHFFGHLNRFQIPWVAVLATSLVSGLCFGASYIGAGQLWTWLQNETSIVGVSNQISWVCIGIASLRFRAAIRRQNLEHLLPFKNWTYPVGPIIAVGLNIVLILVQGWSCFSPSFQAVDFVSFYIEIPIMIVMFLAWKLVKQTRFVHLDEMDLVTDRYDLNAEHAESDGNADGDSPSRVGRILHIKQLQSEKGVLGKLKRVGMWLFL

SEQ ID NO: 39247 - protein, 1692 aa, Schizosaccharomyces pombe 972h-
MDQSKRLLKSAVPNPPEHFKTGISWLDDLDEKDDDSATSVNYDIPEITEANLCNDSHEALSPCTQPVGNSGRPVEAFKTYPSTPAVPSKSVLFHFYEPDENFSLSDTGRTKSDTALAARESSEKSEVPRDTRSAGIKPYKENNSSNCAISKEAGLRRLIDKDRESFDKNLNQSFTNLTFPEPISDDSDSVEFQRDSLNNNWPASLEGSIHELPRNSDDDGIPASAAHILDLDYHRDSYDSPWKKFLPYPSILSDDSWKAPESWGTSLPTEAIPKQVFTTRFFARPSLGNRKKEFFLRVYRDDRTSVSFICPIGIQTHEVIKLLARLFFLPSSANFYLLLIQFNTERILLPHEQPCIIFERLLSLFGCKVTSDEEINEEDNYSVARLVFTTMDIGADVLRKFSEKKITANLDISRSNLEVIPVKIYPYAHELISLNVSHNLSLDLPLDFMERCVKLKRLDISNNLRSPRGKPITALRQLEVLNMSRNDIYELDPLIFSGLSRNSLKELNIANNKLFFLPHSTRYLVNLTYLDLSYNNFVTFPLIITELSQLETLNFSHNLLSQISSKIGSLVKLKHLYLQFNDLSNRLPQEIGLLKNLETIDLSYNAITNIASLSECPKLNSINVACNLLSFYEYSNPSATFIDFSFCPLTTIDPAFSYSNLVYFDISHAKLIGLKDSVIETLVNVETVKVNYNHFTSISDAISAMQNLKYLSCTNCEMSYVSPNLGKLKHLVHLDLHANNIKIFPEEVWQVSSLKVVNLSSNILEKIKLPVATSKKLTRTISQLKIMRTLSGNPVSSLSSQEFVMPTVEELYLVDNRLGNDCFTALEYFKCLKVLNLSYNYLTEIPSKFFQNFSDLKHLFVSGNELANLSISSTAQVLLETLYANGNRLSSFPKNEALSKSLRFLDISTNNLQNLAVEKAEKKSLTKLPQLEYLNLSGNTWFRFSEHEDTNFTKSYLKNLKFLSIMDLNTKFSNAPSDVLNHFIQRNSPQPNILRYGVCGYLSRSIPVISACELVVNNFLHPQSSLYCVLDSDISAGKNNRVLKFVYDNLASCLAHEINAADSSSEQICNALRRGFLRLNKKLGNVIHYDLRKSSEGDVDSNYVTTMNISEKGYSMDSSCLDIGVSIILVYVRDTRAFVANVGTSMAIMSTRNDSEPTTLSVMHDVYNRDEIRRIVDSCGFISGEIKSTTTRAIGRLSQFPGVQAVPYVNVQYLSELNEFIILANQEFWSVLSKRTVIDVVRANRHSPLLASTKLRDYAIAYGAEKNVLVVIVELNGLFEENSLNFNQLRGDEKTLAISEKNDNMSFVQDLPDDSSLARMNREVSPPKGCIAMVFTDIKNSTLLWERHPIAMRSAIKTHNTIMRRQLRATGGYEVKTEGDAFMVCFQTVPAALLWCFSVQLQLLSADWPNEIVESVQGRLVLGSKNEVLYRGLSVRIGVNYGVTVSELDPITRRMDYYGPVVNRTSRVVSVADGGQIAVSAEVVSVLNQLDSETMSSEKTNVNEMEVRALKQIGYIIHNLGEFKLKGLDTTEMISLVYPVQLQGRLERLIKSRSLGTPTALPETQTYTPVRSRSNSLRPMLARLSDSKSVHGEEGGSGKRSVSSLRNVSPSESTGGYEGCIFDDQQYQLLYELCERLEDHAAILHGFPEPPPCDTGLAAPVNQAEEYSLFYRLTLRIENTIYCVSQMLGHTG

SEQ ID NO: 39248 - protein, 321 aa, Pseudomonas syringae pv. syringae B728a
MDQLPVIDIAPLYGTETQAWQDVARQIDSACRAWGFFYIKGHPISAQRIEQVQSAAKDFFARPAAEKLLIDITQSTHHRGYGAIATEQLDPSLPSDLKETFDMGLHLDARHPDVLAGKPLRGPNRHPDIPGWETLMEQHYLDMQALAQTLLRAMTLALGIERDFFDQRFKDPVSVLRMIHYPPRGTATSAEQQGAGAHTDYGCITLLYQDTAGGLQVRDVRGEWIDAPPLDGTFVVNLGDMMARWSNDRYLSTPHRVISPLGVDRYSMPFFAEPHPDTRIECLPGCQSDDHPARYPVTTCAEFLLSRFADTYAYRREQEAS

SEQ ID NO: 39249 - protein, 449 aa, Bacillus halodurans C-125
MAKFTREDILRIAQEDNVRFIRLQFTDLLGTIKNVEIPVDQLPKALDNKMMFDGSSIEGFVRIEESDMYLYPDLDTWVIFPWTPEKGKVARLICDVYQPGKPGEEPKPFLGDPRGILKRVLKEAEALGFTAFNIGPEPEFFLFKNDESGEPTLELNDKGGYFDLAPTDLGENCRRDIVLELEDMGFEIEASHHEVAPGQHEIDFKYADAVTTCDNIQTFKLVVKTIARKHGLHATFMPKPLFGVNGSGMHCNMSLFRGKENAFFDESTESQLSGTAMQFLAGILKHADSFTAITNPIVNSYKRLVPGYEAPVYVAWSMRNRSPLVRIPSSRGLSTRIEVRSPDPAANPYLAMAAMLAAGLDGIKRKLTPPAATDRNIYVMSKEERDEEGIRDLPSTLKEAVDNFLKNDVLVEAIGEHAVEHFVEAKEIEWDMFRTQVHPWERDQYMQTY

SEQ ID NO: 39250 - protein, 484 aa, Zea mays
  misc_feature (32)..(32): Xaa can be any naturally occurring amino acid
  misc_feature (394)..(394): Xaa can be any naturally occurring amino acid
MATSVRGFSSALRDVPGSYGLPLVGAVRDRLXDFYYFQGQDKYFESRVERYGSTVVRMNVPPGPFMARDPRVVAVLDAKSFPVLFDMDKVEKRDLFTGTYMPSTSLTGGHRVCAYLDPSEPTHAKVKQLLFSLLLSRKDDVIPVFRSNFSSLLATVESDLAEGGKAEFNKLNDVTSFDFIGEAYFGVRPSATELGKGGPSKAAKWLIWQLHPLVTLGLPMVLEEPLLHTFHLPPFLVKGDYRALYKYFSTVAKQALDTAEGLGLSREEACHNLLFATTFNSYGGLKVLFPGLLANVASGGEKLHERLVAEIRGAVADAGGKVTLAAVERMELAKSVVWESLRLDPPVKFQYGHAKKDLLVESHDAVFQVRKGEMLFGYQPCATKDPRVFGDTAXGDFVPDRFLGEEGSKLLQYVYWSNGRETENPSVDNKQCPGKNFVVLVGRLLLVELFLRYDTFTAEVGKELLGTSVIFTGVTKATSGPGSE

SEQ ID NO: 39251 - protein, 1058 aa, Streptococcus pyogenes SSI-1
MPKRKDIQKIMVIGSGPIIIGQAAEFDYAGTQACLALKEEGYKVILVNSNPATIMTDKEIADKVYIEPLTLEFVNRIIRKERPDAILPTLGGQTGLNMAMALSKAGILDDLEIELLGTKLSAIDQAEDRDLFKQLMQELDQPIPESTIVKTVDEAVTFARDIGYPVIVRPAFTLGGTGGGICSSEEELCEITENGLKLSPVTQCLIERSIAGFKEIEYEVMRDSADNALVVCNMENFDPVGIHTGDSIVFAPTQTLSDIENQMLRDASLKIIRALKIEGGCNVQLALDPYSFKYYVIEVNPRVSRSSALASKATGYPIAKLAAKIAVGLTLDEMINPITGTTYAMFEPALDYVVAKIPRFPFDKFEHGERQLGTQMKATGEVMAIGRNLEESLLKACRSLEIGVCHNEMTSLSNISDEELVTKVIKAQDDRLFYLSEAIRRGYSIEELESLTKIDLFFLDKLLHIVEIEQELQMHVDHLESLKKAKRYGFSDQKIAEIWQKDESDIRAMRHSHSLYPVYKMVDTCAAEFDAKTPYFYSTYELENESVQSNKESILVLGSGPIRIGQGVEFDYATVHSVKAIQKAGYEAIIMNSNPETVSTDFSVSDKLYFEPLTFEDVMNVIDLEQPKGVIVQFGGQTAINLAQALSEAGVTILGTQVEDLDRAEDRDLFEKALKELGIPQPQGQTATNEEEALEAAKKIGFPVLVRPSYVLGGRAMEIVENKEDLIEYIRTAVKASPEHPILVDSYIFGKECEVDAISEGKSVLIPGIMEHIERAGVHSGDSMAVYPPQQLSKQIQETIAEYTKRLAIGLNCIGMMNVQFVIKNEQVYVIEVNPRASRTVPFLSKVTGIPMAQIATKLILGQTLKDLGYEDGLYPQSQLVHIKAPVFSFTKLAQVDSLLGPEMKSTGEVMGSDTSLEKALYKAFEANNSHLSEFGQIVFTIADDSKAEALSLARRFKAIGYQIMATQGTAAYFAEQGLSACLVGKIGDAANDIPTLVRHGHVQAIVNTVGIKRTADKDGQMIRSSAIEQGVPLFTALDTAKAMLTVLESRCFNIEAI

SEQ ID NO: 39252 - protein, 812 aa, Schizosaccharomyces pombe 972h-
MSSQKRADSSSSFDQAERRSLDENERKKKYFFNREGSGIDNFETDGMVFQASKAFDYYLLTTFKDRVNEIINEQNEENVIDQSRWSKLWRIWNVGYSWFILSIIGTTVGFAAYMLDIVTSWLSDIRRGYCTSHWYYNEKFCCWYSETMGMFKHDLYNDLTFQGSSCTAWKPWTYKFSLNYLIYTAFALLFVLCAAIMVRDVAPLAAGSGISEIKCIISGFLRDSFLSFRVMLVKCVGLPLAIASGLSVGKEGPSVHLATTIGHNISKIFKYAREGSIRYRDICVASAASGVAVAFGSPIGGVLFGIEVGKFIEILTNSFKEMSGGYDPKMIVYSFFCCLSAVGVLHMLNPFRTGQVVLFEVRYSGSWHFFELLFFCFLGIFGGLYGEFVMRLFFLIQKLRKKYLSRWGVLDAAFVTVITSLVSFLNPWLRLDMTLGMELLFQECKSSSSPELINLCDPSLRTKNTILLLIATFARTIFVTFSYGAKVPAGIFVPSMAVGASFGYMIGLIAEMIYQRFPNSVLFLACHGSESCITPGTYALLGAAASLSGIMHLTVTIVVIMFELTGALNFILPTVLVVALANSIGNMLGKTGIADRSIEINGLPLLEPEKSINSSNTINIPITEVMASNLITIPSIGFTWRKLLGMMEGYDFSGYPVVLDSRSNYLIGYLKKSSLKSSFEAAKLEPSFTFDQQLCFGKVDSVGDSKSSKFGESDRIDLSAYMDVNPISVLHTQSIANVAVLFEVLSPSVIFIEKDGNLVGLISKKDLLLASKYYQEDNDLVNPANRHRAVSTERINDSYENIELKPLKLNIE

SEQ ID NO: 39253 - protein, 127 aa, Sinorhizobium meliloti 1021
MTIKRYGTGETGAGKQHLPFARAVEANGWLYVSGQVAMEAGEIVGGGIVAESRKAIENMIAILHEAGYGLEDVVRVGVWLDDPRDFWTFNGVYAQYFGANPPARACVQSRMMVDCKVEVDCVAYKAK

SEQ ID NO: 39254 - protein, 406 aa, Arabidopsis thaliana
MFGPTGGLGMNPSMDDMNLIQQAQRHQLVVSNLGEEIDLEIGPGEDDAAFANNSLIGGPPREPSTGEHDETKHMVLVSDLPSEDQDISKGTPAKRKKKVVKRWREEWADTYKWAYVDMKDGTARIFCSICREYGRKHRRNPYGNEGSRNMQMSALEEHNNSLLHKEALRLQTASKDKIVVDKPIYVKTVMSKSAGSIVEGALKRDPNEIEFVQSVQESVHALERVIAKNSHYVNIMERLLEPERMIVFRVPWIDDRGETHVNRGFRVQFNQALGPCRGGIRFHPSMNLSIAKFLGFQQTLKNALSPYKLGGASGGSDFDPKGKSDNEIMRFCQSFMNEMYRYMGPDKDLPSEEVGVGTREMGYLFGQYRRLAGQFQDRGYIGLLLASELKLVAMAWCTLHDLYLQI

SEQ ID NO: 39255 - protein, 241 aa, Brassica napus
  misc_feature (193)..(194): Xaa can be any naturally occurring amino acid
  misc_feature (227)..(227): Xaa can be any naturally occurring amino acid
  misc_feature (230)..(230): Xaa can be any naturally occurring amino acid
MGLEEAGDLVLHIILSKIGPENTARVACVSKRLKVSASEDSLWSIFCSLDLNISTPLDPHGDPSPSFKMAYQSWRESFIMYPWHLVKRVSHCWDNLKLWLSLNFPEAEATLRKGATEEDLEEFESALKVKLPLPTRLLYRFVDGQEPPPPSSSPSSGLDGSLGLIGGYSVYSHDVNVYLLPLKEVIRETNETXXDLGVSNGSNFIAVAASATASLKMFFLDCSDGQXYTXTSTRQMLPCVP

SEQ ID NO: 39256 - protein, 389 aa, Ostreococcus tauri
MKRPTPRVGGRMSTVTRAGRDYYDVLGVSRSADSKELKRAYRQLARKFHPDVNKDPGAEDKFKEISNAYEVLSDDQKKAIYDRFGEDGLKGGMGGMGGMGGMGGMGGMSDPFDLFESLFGGGGMGGMGGMGGMGGMGGRSQARNRPTQGDDERYDLEIDFLEAVFGVEKELDTMRLENCDKCSGSGVKAGTKPTTCGTCGGQGQVVATVRTPLGNFQQVTGCQACGGTGQSSTPCPSCGGDGRVRRSKKIQLRVPPGVDKGSRLRVRGEGNAGRRGGPPGDLYVFINVRDDPELKRFDNVNISSTVTVPYTKAILGSTVKVRTVDGPVDLKIPAGVQPQATLLMAKRGVPRLGNDSARGDHYVTVKVTIPSKLSDEERAMIEKLDEKQK

SEQ ID NO: 39257 - protein, 523 aa, Yarrowia lipolytica CLIB122
MIILTTLNNMGIPVEGWHILAGLAILAVITEIYVIGSQLLARRNKTLAPMAFYWIPWVGSSIPYGIDPYEFFEDCRNRYGDVFSFYMLGRVMTVSLGTKGHEFVFNSKLADVSAEEAYTHLTTPVFGTGVIYDCPNSRLMEQKKFCKGALTRDAFRSYVPKIVEEVTNFFAVNFEGKTGKADVMTTQPQMTIFTASRCLLGDEIRSKLNGDFAKLYSDLDNGFTPINFVFPNLPLPSYRKRDLAQQKIRDTYMSVIQRRRMEKDVQDRDLIDALLKNHTYKDGKRMTPQEIAHLLIGVLMGGQHTSASTSAWMLLRLGLDPAIQDELYQEQVDILGEADGSFRQPTYEDILTMTKLQNTIKETLRLHMPIHSIFRQVMRDLPVPGTSFVVPKGHFVMASPGYSQQAERYFPNAKKFDPRRWMTPTEKMAESETDAEAGETVDYGFGAISKGVSSPYLPFGGGRHRCIGEQFANCQLTTLMSCYIQNFKWTVPEGSKLPAVDTTSMITLPVHPSYIVWSKRERN

SEQ ID NO: 39258 - protein, 784 aa, Bacillus cereus ATCC 14579
MKGVILAGGKGRRLRPLTCNTPKPMLPLLEKPVLEYNIELLRQHGIREIAITVQYMSTTIKQYFGDGSKWGVNLYYFEDSPPLGTAGSIKQAEQFLDETFVVISGDALTDFQLSEGIRFHEQKKRMVTMFVKEVENPLSFGLVVMNKDQEVTRYIEKPGWNEVVSNVVNTGIYIMEPEIFSYIPPRQFFDFSHDVFPLLANKNVLFAYLSEGYWLDIGTFNQYRQAQFDLLTKKLQVPIPYTEVLPMVWMGEGVTIGKGTKIHGPSFIGEGAKIGTGAVIEPYSIIGKNSIVSNYSHLQKSIVFANTHIGKYCELLETTIGERTIVEDDVTLFQKSVVADHCHIGRSTVIKQKGKLWPYKAIDSHSIVGAAGIQESEMSAGWLQKSRIVGRGNVEITPQFIVKIAMAYGSLFKKGESILIGSQENIETTSYKNLFLHAIHGIGIHTMECKEMNESLFQYSVHHLQCAGGVFIQVENENEIVIKLYGQAGMPLTYKQQKEIEQVYMSELFYYVHEKEMGRNKLVHVSMNEYIEVILEHIDIEKIQMQKFHLLINKRNDTLQHLLMLFLQRLGCTVTWIYASEQKDHVKALMKSSKANMALMFSEQGNHFELYDKHSNIYQGTDLEEVDIPDFLLESTGNIYPMSLKLGECYLLFYTQDERKSFQVRWKRDILYRIGKLFELIALQGKTFLSIVEQSPPLYLLYDEVVCSWNEKGEIMRKLLDDIERKGEGIFEGVQFKYTEKEWSYIVSDTKQPKFLVYSHARNPVIARENMKNLIEKIRQYQKV

SEQ ID NO: 39259 - protein, 103 aa, Elaeis guineensis
MSGRGKGGKGLGKGGAKRPRKVLRDNIQGITKPAIRRLARRGGVKRISGLIYEETRGVLKIFLENVIRDAVTYTEHARRKTVTAMDVVYALKRQGRTLYGFGG

SEQ ID NO: 39260 - protein, 891 aa, Schizosaccharomyces pombe 972h-
MSSKDISSKSPSGNDALNDKKGTKTSETNDRNSTNNTKERDELEDLSEEDLQLKNDLELLVQAVQDATPELVGSSLTQLKEIIRTSTSSMTAVPKPLKFLRPHYFTLVKIYDSWPQSPQKTQLADILSVLGMSYSNTSKHESLKYRLQGVTTDPSLWGHEYVRHLASEIEEEFASRQEEEAPTDDLMELALTIVPFFLTHNAEADAIDLLQELGAIEKVVPFVELDNASRVCLYITSCVNLLPFPEDVAMLRTAHAIYRKFDQLTQALNVAIRLDDMSLIKEDCEAATDPLLKKQMSYMLARQQIPMDMGDEELNDALNNTHLSDHFHYLGKELNLMDPKVPEDIFKTHLEVARTGLGASGVYSAKQNLANTFVNALVNAGYSNDRLILVDDEKTSWIYKNKESGLISATASIGLLQLWNVDMGLSLLDKYLYSSEENTKAGALLGIGVTNVAVRNEADPAMAILSEYLETGSVKLRASAILGLGLAYSGANREDLLDMLSPIVTDTDCPMQLSCLAALSLGLIFVGTCNGDVASTILQTLMEREESAQNDQWGRFMALGLALLFNGKQDLADATVETLKAIEGKIARQAEILVDICSYAGTGNVLHIQKLLHICSEPPSDDAKESETTIQTFAALGVATIAMGEDIGAEMVLRHFDHMMHYGEPSIRKAIPLALGLLSASNPQMRIFDTLSRYSHDNDLDVAYNAIFAMGLVGAGTSNARLAQLLRQLASYYHKESNALFMVRIAQGLLYLGKGTMTLNPYHTERQILGQTAFAGLMTVVLAMLDANTFVLDTSHWLLYAITLAIRPRMLITLGEDGQYLPVSVRVGQAVDVVGQAGRPKVITGWVTHTTPVLLHHNERAELATEAYTPLTSLEGIVILKKNTEDIEMTA

SEQ ID NO: 39261 - protein, 425 aa, Hordeum vulgare subsp. vulgare
MGNCWGTRIKDGSTHPGASGMFSRGSGKDGSRLSACSSRASSASMPPSAKTECEILQSANVKVFSYNDLRLATRNFRPDSVLGEGGFGSVYKGWIDEHTLSACKPGTGIPVAVKRLNLEGLQGHREWLAEVNYLGQFCHQNLVKLIGYCLEDEYRLLVYECMPRGSLENHLFRRGSHFQPLSWNLRMKVALGAAKGLAYLHSAEAKVIYRDFKTSNILLDTDYTAKLSDFGLAKDGPVGEKSHVSTRVMGTYGYAAPEYLSTGHLTAKSDIYSFGVVLLEMLSGRRAIDKNRPQGEHNLVEWARPYLTHKRKIFRVLDTRLEGQYSLNGAQTIAALAVECLSFEAKMRPSMEAVVSILEGIQDSSDPTRRPADPARRPAAERPQDPKSGSKTAPGASNSGKGRRKSSGDLLKEPGRDPKPSAYSS

SEQ ID NO: 39262 - protein, 323 aa, Gibberella zeae PH-1
MDGKRHPSSFQQLEKLGEGTYATVFKGRNRQTGELVALKEIHLDSEEGTPSTAIREISLMKELKHENIVGLHDVIHTENKLMLVFEYMDGDLKRYMDTNGERGALKPTTIKSFMYQLLKGIDFCHQNRVLHRDLKPQNLLINNKGILKLGDFGLARAFGIPVNTFSNEVVTLWYRAPDVLLGSRTYNTSIDIWSAGCIMAEMFTGRPLFPGTTNEDQIVRIFRIMGTPTERTWPGITQFPEYKPTFHMYATQDLRNILQTIDPTGIDLLQRMLQLRPELRISAHDALQHAWFNDLLVHPQQQNLQSQARAYPQAVPSQAFDTY

SEQ ID NO: 39263 - protein, 251 aa, Magnetospirillum magnetotacticum MS-1
MTNRRKLIAGNWKMNGLKADGLALAKGLADKLASASPNCDMLVCPPFTLIAPVADALAGSKLAVGGQDCHAKTSGAHTGDTSPAMLADLGCKYAIVGHSERRTDHAETDNVVKAKAAAALSAGLVAIVCIGETLAQRDAGQTIEVNRSQLNGSLPEGANAANTVIAYEPVWAIGTGRVATPAQAQEVHAAIRAELVKLVGAAEAGKMRILYGGSMKPDNAKELLALPDVDGGLIGGAALKVADFWAIAESC

SEQ ID NO: 39264 - protein, 257 aa, Zea mays
  misc_feature (229)..(229): Xaa can be any naturally occurring amino acid
  misc_feature (243)..(243): Xaa can be any naturally occurring amino acid
MATQLLSTVAHRDTLPEGYTRPENDRPQLADVVTDSNIPLIDLASPDKHRVIAEIDQACRTYGFFQIINHGISEELLEKVMAVGLEFFRLPPEEKAKLYSDEPSKKIRLSTSFNVRKETVHNWRDYLRLHCHPLEEFVPDWPSNPETFKEIISTYCCEVRLLGLRLLGAISLGLGLEEDYIENGLGEQEQHMAVNYYPRCPEPDLTYGLPKHTDPNALTILLMDPHVSXLQVLKDGAQWIAVXPRANALVVNLGDQL

SEQ ID NO: 39265 - protein, 409 aa, Schizosaccharomyces pombe 972h-
MFSVIGRGIKFSSKSHYSVSCFLIATQGAKIRQIHTHNTFFKNFSFAKLGRNQRTSSLIKIHNSSTSFPKSRSEKVVYTPSLPLSSSVLASFSFLPHNILQNGLNTLHIWSGLPWWASIAACAVAMRIAVFPIMLKMMKTSAKLAIINPKVAEHMSVLSKAKAEGNSELMMQATTQIQNLYKVNNVNPLNLLSAPVFQGILFISFFYALKTMAGVPVEGFTDGGFWWVNDLSQPDPLHIFPVANGLLMLLNIELGSETGSNKVAMSPSMKKFFRFLCLASPLFTMNFPMAIFMYWFPSNVFSVFQGAFLRSSTIRHKLGLPEVPSAMPVPNAQNESFVKSFTDIVHGVQEKGKYPQASEILDATRFLKTDTNNEQKPTNNSTITKATTLSDNSQNDKSSSVTKPTEKKD

SEQ ID NO: 39266 - protein, 348 aa, Oryza sativa (japonica cultivar-group)
MAGEGGGGAGALALPPQRRPTTGGGTDLCHTPTPLALYPQIATWPPMPPMAPTTNSGTTHARSRSKAKPVINLDDGDDVRTAKRLTWASDEDLRLVSAWLYHSNDPINGNGKKNESYWGDVVELYNSTTPINRKREVKHLKDRWQRIKRWVGFFCASWKKAALVYTSGYSDDQLRDFANQFYVDDYPNEGPFTVLHCWKVLRDEPKWHAVLEELEKPHKRSLDDGSDTLSQKDIGEKERPIGRNEAKKQRNGKGKGKGKDDDDSLREDMKKYMDVQAAASKRHEEFLGTQHRISDAKVEVARLRREAVLTESYQKMMSMDTSQMTDEMKAEHVMGLKMLREKLLGDII

SEQ ID NO: 39267 - protein, 327 aa, Prochlorococcus marinus str. MIT 9312
MAGTLLFNALKEAIDEEMANDVNVCVMGEDVGQYGGSYKVTKDLYEKYGELRVLDTPIAENSFTGMAVGAAMTGLRPIVEGMNMGFLLLAFNQISNNMGMLRYTSGGNYKIPAVVRGPGGVGRQLGAEHSQRLEAYFHAVPGIKIVACSTPTNAKGLMKAAIRDDNPVLFFEHVLLYNLSEELPEGDYTCALDQADVVKEGKDITLLTYSRMRHHCLKAVEELEKKGIDVELIDLISLKPFDIETISKSIRKTNKVIIVEECMKTGGIGAELIALITEECFDDLDARPIRLSSQDIPTPYNGNLENLTIIQPHQIVEKVEQLISGSI

SEQ ID NO: 39268 - protein, 350 aa, Lingulodinium polyedrum
HEEATKVISKLVKQAPLSQAELLGLQGEINVQGEDQKKLDVITNDVLKKALQYSGKLGTLASEEEDSPVLGSFETRGDDGQVISRGETLVADTGKYVCVFDPLDGSSNVDAGIAVGTIFGIFEEPDLEACNLPEDIKDMDATQMACLASTLQPGKALVAAGYVLYSCSTEMVFTTGNGCIGFTLDESIGEYVLTRPSIQIPPRGKIYSMNEANVEEWDEPMKRYVEDIQTGKGETGTQYSLRYIGSMVGDVHRTLLYGGIFAYPADSKNKDGKLRLLYEAAPMSFILEQAGGKAITGFSRVMDIPPAAVHQRVPVILGSKDDVEECQKYFEASKDEALRKRCESRLQVPA

SEQ ID NO: 39269 - protein, 620 aa, Magnaporthe grisea 70-15
MEETRELPAEAMPVSAPQRRTMGDYARRVKRSLTTRDGLVGNYDYKYLFTPKLPFMKTPRSAAPFFGLNDRMPVFLAMLLGFQHALAMLAGLITVPLLLSGTGGANLPPATQQYLVSSVMIVAGILSTVQITRFHLFKTPYYLGTGLISVVGCSFAVIPVATGGIKQMYASGFCPSGPDGTPLPCPDAYGALLGTAAVCALFEILLSFLPPKVVLRIFPPIVTGPTVMLIGISLVRSGFTNWAGGTGPCSNADPTPFFASCPNINAPHALPWGSAEYLGLGFSVYMTIFLCERFGAPLMQSAAIVIGLAVGCIIAAATGYFDNSGINSAPAVSFIWVQTFKLQVYPPLVLPMMAVVLICMCETIGDITATCDVSRLEVEGRMYESRIQGGVLADGVNSIFAALMTITPMTTYAQNNGVIALTRCANRKAGYFCCLFLIIMGVFAKFAAALVAIPAPVLGGMTTFLFSSVAVSGIAIITKGVPFNRRNRFILTAGLALGYGATLVPTYFHSVFGPTDNGSLQGFLNAIELIMETGFAVAAFICVVFNLLLPDEVVDEADDAAQQQLRGGAASSSSAADLSERGDAHPPSGKAAERGGVSQVVASGGEAGSDTGIEHKVKDS

SEQ ID NO: 39270 - protein, 251 aa, Treponema denticola ATCC 35405
MDKEKNDYDKLFSEITKARHLVAFTGAGISTLAGIKDFRGKDGLYKQPNTEKMFDIDVFYRDPSVYYGMAKEFIYGLEEKQPAIVHTVLADLEKRGILKAVITQNIDLLHQKAGSKNVIEVHGSPSVHYCINCSYTETFEETAKTAKTGEVPRCPKCGSPIKPAITFFGEALPQKALMKAETEASKSDFMLVLGTSLLVYPAAALPAYTLRNGGKIAIVNNQPTQFDSYTDLLFEDLEETFEEIDKRLKKV

SEQ ID NO: 39271 - protein, 684 aa, Oryza sativa
YECAYDLFHSTKKKKKKATASSRPCWLVKRSRASDIDPVVADTLSESESKRMKSANDEEAIDKDSIIQKADDLAVRVEEELFKLFGGVNKKYKEKGRSLLFNLKDKSNPELRERVLSGDITPDRLCSMTAEELASKELSECRLANAEELAQMVVLPSTEVDVRRLVRKTHKGEFQVEVEETDGISVEVELGGNLLTQVPSKAPEDQTKSDDKESTDDKTGIQDNDKAPDGTSQDEDNGAGKNDPQDDLEYVDNEKSDLMQELMVDDLKDTENLPPIPSLDEFMQGLDSEPPFENLSAGTPEEDSDDRDEADTTAESAELPEEEVKVSAAEKIVSEADLPSSQDKSESKLESPKDEVGSNLGPVEQREGKLIKSSPDSVEVKQTTTENVLNRDSTVHNMATTLPMIRESIWEGAIQLTMSSLTNVVAIFKSGEKPPVKEWRSFVEIKGRVKLSAFQEFVEQLPKSRSRAIMVTELCWKEGSHESGRQHLLQTIDSYISDERVGLAEPADGIELYLCPSQGKTVEILSRHLPKEHLESLAVSASSIIGVIVWRRPNVPRMPAHPRHDGSRRPSILKKPQVTGSTPGPRPSLPMSSHGAPPGFPVQRHRHEEDVTDDVPPDFGPGVARDEDDLPEFNFVNSSNPAANVTTTQAYKGRQHVPLTSARPVEQMRELVQKYGKRSSDQGV

SEQ ID NO: 39272 - protein, 396 aa, Ostreococcus tauri
MASHASPSIARASRGADRGRANERASARAGKRGKRATTRSRRPSAPPGRDGRPPTTNSTSEGDDDADPEAPLGRRSRRPVLRVGARAQTLPPPEGRHVSEKRMKKVALEGAARRAADAPAADGVAEVALIGRSNVGKSSLLNLVTFGAGAAVVSAKPGTTCSMNHYSVDGRWRLVDLPGYGYAEAEPGEIEAWDAFTKEYFATRENLAGVLLLIDASVPPTANDEKYANWLIENETPFTIVFTKCDRDKPKGPSVEDNKAAFRAKLEERWHRLPSMISTSSVTTQGRDEVLKFISSLIVYRRMRNEERKKAKRQEKVKAMKEERYEAKGEAMRKARGGKPAKKPVSKVEEEWDDEEELDEDWDDESSFTVNAKGKGAKTIQDMIRAELEEINREGR

SEQ ID NO: 39273 - protein, 465 aa, Pseudomonas syringae pv. syringae B728a
MQPETLDNDDLIYGLNDRPKPWTAILAAFQHVLASFVGIITPPLIIGSTLGLTPYMPYLISMALMVSGTGTFIQARRPFGIGAGMICLQGTSFAFLGAVLSAGFLVKQRGGSPEDIMAMIFGVCFFGALVQIALSRCISQLRRVITPLVTGIVITLIGVSLIKVGVTDLGGGFNAPDFGAPVNLALGAFVLAVIIVLNRSNTPWVRLSAIIIGLAVGSLAAWFSGKLVPQALHDLPLISVPVPFRFGFNFDWSAFLPVALIYLISSIETVGDLTANCMLARQPISGPSYLARLKGGVLGDGVSCMIAATFSAFPNTTFAQNNGVIQLTGVASRYVGLYIGAVLFVLGLFPHIGAIVQQIPKPVLGGATLVMFGSVAAAGVRILAQSPLDRRSMLIIATSLGVGLGIAAQPALLHQLPKLVQNLFDSAITSGGITAIVMCLLIPEGKVTAATTDAVTEPEPVEQPR

SEQ ID NO: 39274 - protein, 347 aa, Silicibacter pomeroyi DSS-3
MRAAQLTAWRQPLTLATLPDPTPGPGEVVLRVLACGVCRSDWHAWTGADPDVELPLVPGHEFCGEVVALGTGVSRWRLGDRVIAPFILACGRCGDCAAGHQTICANQQVPGFTRNGAFAELIAVPFADTNLTALPDSLPPHVAAGLGCRVTTAWQALVGRAELRPGEWLAVFGGGGVGLSALLLGRALGARVVVVDVVEDKLTHAKSLGADAVVNAADTDAAEAVRELTGGGAHVAVEALGIAATMTGAMRSLRKLGRLVMIGMPAGEHTAMTLPMDVLYSGQLTLQGTRGMPAWRYPSLLSLIDGGHVDLSPLVTRTIALSQASDELAAFDRPAPPGVAVITDFAT

SEQ ID NO: 39275 - protein, 448 aa, Pseudomonas syringae pv. syringae B728a
MNMFEVSDVPVTRQLKLDAHWMPYTANRNFQRDPRMVVAAHGSYLTDDKGRKIYDALSGLWTCGAGHTRKEIQEAVSRQLGVLDYSPGFQFGHPLSFQLAEQITDLTPGNLNHVFYTNSGSECADTAVKMVRAYWRLKGQATKTKMIGRARGYHGVNVAGTSLGGVNGNRKMFGQLMDVDHLPHTLLASNAYSKGMPEAGGIALADEMLKLIELHDASNIAAVIVEPMSGSAGVIVPPQGYLKRLREICDQHNILLIFDEVITGFGRTGSMFGADSFGVTPDLMCIAKQITNGAIPMGAVIASSEIYHTFMNQPTPEYAVEFPHGYTYSAHPVACAAGLAALELLQRENLVQQAAAVAPHFERALHGIKGAKNVVDIRNYGLAGAIQLAPRDGDAIVRPFEAGMKLWKAGFYVRFGGDTLQFGPTFNSQAQDLDRLFDAVGETLNLID

SEQ ID NO: 39276 - protein, 877 aa, Saccharomyces cerevisiae
MSETVKDKVIIDEKVSTKGTVDYAEGAEYSERLSNHSSDFSQWYTDEQILHFMKKLGYENRTLYDIPEDVAYILKKMPELTLEDSFKILKDSIIYFKDDENIPHDQYEEWKRLVDLEDLDSKEGIDEYDSFDIRAFASAIKFHSPYQEVRAVVDPEDDPTIPVETFRAYFLAIIWSVIGSGFNEFFSHRVVSISLNTPIIQMFLYICGKAWAKTIPCWTITIRGRKYGINIDKPWTQKEQMFSTLLYAICQGAFYTHYNILTQKLFYHSAFSFGYQFLLSLSVQFIGFGFAGILRKFVVYPARALWPTVMPTIAINKALLGKEKHESGMSRYKFFFLTFFIMFIYNWFPTYIINILNTFNWMTWIKPSNINLANITGGVTGLGINPISSFDWNVISFNSPLVYPFWSYLTQYLGCILAALIVIAVYYSNYMSCQYLPIFTNSLYTNTGHSFKVTEVLDSDNKLDVKKYQSYSPPYYSAGNLVSYGAFICAYPLMITWSFIVHSKLLFNAFKDWALNLWAMRKLKSWVTMFKSDYRALDDYDDPHSNAMKNYKEVPDWWYFAILIGSLVVGIAVVEHYPTNTPVWGLFVCLGFNFVFLIPTTILQATTGYSFGLNLLIEMVMGYALPGNPIAIMILKAFGYNIDGQADNYVSNLKIAHYCKIPPMALFRGQCVIVFIQIFVNLGVLNWQISNIKDFCTPHQNAKFTCPDAVTYYNASVVWGAIGPKRIFNYIYPIFKWCWLIGACIGIFFGVWKRWGKFYPRYFDPMLFVGGMLNMSPPYNLMYYTSGMIVSYISQYYMKRHHLNLWEKYNYVLSAGFSTGLVLSAIIIFFAVQYKDTAFNWWGNTVPYAGADGVGYPLKNITDTANGYFGYAPGHYP

SEQ ID NO: 39277 - protein, 246 aa, Staphylococcus aureus subsp. aureus Mu50
MKMTKSALVTGASRGIGRSIALQLAEEGYNVAVNYAGSKEKAEAVVEEIKAKGVDSFAIQANVADADEVKAMIKEVVSQFGSLDVLVNNAGITRDNLLMRMKEQEWDDVIDTNLKGVFNCIQKATPQMLRQRSGAIINLSSVVGAVGNPGQANYVATKAGVIGLTKSAARELASRGITVNAVAPGFIVSDMTDALSDELKEQMLTQIPLARFGQDTDIANTVAFLASDKAKYITGQTIHVNGGMYM

SEQ ID NO: 39278 - protein, 387 aa, Escherichia coli K12
MSVIKMTDLDLAGKRVFIRADLNVPVKDGKVTSDARIRASLPTIELALKQGAKVMVTSHLGRPTEGEYNEEFSLLPVVNYLKDKLSNPVRLVKDYLDGVDVAEGELVVLENVRFNKGEKKDDETLSKKYAALCDVFVMDAFGTAHRAQASTHGIGKFADVACAGPLLAAELDALGKALKEPARPMVAIVGGSKVSTKLTVLDSLSKIADQLIVGGGIANTFIAAQGHDVGKSLYEADLVDEAKRLLTTCNIPVPSDVRVATEFSETAPATLKSVNDVKADEQILDIGDASAQELAEILKNAKTILWNGPVGVFEFPNFRKGTEIVANAIADSEAFSIAGGGDTLAAIDLFGIADKISYISTGGGAFLEFVEGKVLPAVAMLEERAKK

SEQ ID NO: 39279 - protein, 576 aa, Coccidioides immitis RS
MGFRGPSWVHNASIDSIPDSIPISEFILNEKYCRAGLTASKKPFIWGATGDGYTAVEVSQRVDYLARALANEFGWRPNLRTEWDKTICVFSLNTIDFFPLTWAVHRLSGIASLASAAYSVNELAYQLQASNVHALFTCLPLLDTALKAAAKCGIPRNRVYLLDMPQSFTGSGSKPLKFKTVNQLIEKGSNLDELEDLRWKKGQAARQCAYLCFSSGTSGLPKGVMISHMNVISQISLFKLFEGHTRTENQKDTVLGLLPYSHIFGLSVFHSAVYRGECVVVVPKFELATLLGAIERCKINVLYVVPPVIISMVKNESLMKKYELNSVRHIITGAAPLGNETAEDLHRLYPTWSILQAYEGLTETTAVATHTSPHDIFFGSSGCLLPLLQARLVTPDGTEVEEYDTPGELLLHGPTIVLGYLNNEAANRETFQDGWLRTGDEAVFRKSFNGEDHVFIVDRIKELIKVKGFQVAPAELEAHLLTHPAVADTAVIGVHDDSAGEVPKAFVVKASEITVDHQTLIHDIQKHVQDHKAHYKWLHGGIEFIDAIPKSASGKILRRYLRDKEREARRRGGSKI

SEQ ID NO: 39280 - protein, 361 aa, Synechocystis sp. PCC 6803
MGEIKRIGILTSGGDCAGLNAVIRSVVHHAIGTYGWEVIGIQEATQGLMENPSKAIALHRDNIDHLLMMGGTFLGTTNKGNPFAFPMADGTVRDRTEDIIAGYRQLGLDALIGIGGDGSLAILRRIAQQGGINLVGIPKTIDNDVGATEISIGFDTATNIATEALDRLHFTAASHNRVMVLEVMGRDAGHIALAAGIGGGADIILIPEIPYRIQSVCNKIRQRQAEGKNFCLVMVSEAVRTELGDQVKQIQQFGEDRYGGIGKYIAEQIAQRTGAETRVTVLGHIQRGGIPSPFDRLLGSVFGVAAVDLIAEGKFDHMVAWRNRQTISVPIEEAIQTYQTVQLDGTLVKTARGLGICLGND

SEQ ID NO: 39281 - protein, 100 aa, Magnaporthe grisea 70-15
MPTQPARGGPRSSMGGSAPTANMGPRIGTSGKVSGKKLLHGAGGKRHRRLARRGGVKRLSGMIYDETRGAMKQYLERILRDCVAYCDYRRAKTVTVHDVR

SEQ ID NO: 39282 - protein, 466 aa, Staphylococcus aureus subsp. aureus COL
MTKSVAIIGAGITGLSSAYFLKQQDPNIDVTIFEASNRPGGKIQSYRKDGYMIELGPESYLGRKTIMTELAKDIGLEQDIVTNTTGQSYIFAKNKLYPIPGGSIMGIPTDIKPFVTTKLISPLGKLRAGFDLLKKPTQMQDGDISVGAFFRARLGNEVLENLIEPLMGGIYGTDIDKLSLMSTFPNFKEKEEAFGSLIKGMKDEKNKRLKQRQLYPGAPKGQFKQFKHGLSSFIEALEQDVKNKGVTIRYNTSVDDIITSQKQYKIVYNDQLEEVYDGVLVTTPHQVFLNWFGQDPAFDYFKTMDSTTVATVVLAFDEKDIENTHDGTGFVIARTSDTDITACTWTSKKWPFTTPEGKVLIRAYVGKPGDTVVDDHTDNELVSIVRRDLSQMMTFKGDPEFTIVNRLPKSMPQYHVGHIQQIRQIQAHIKQTYPRLRVTGASFEAVGLPDCITQGKVAAEEVIAEL

SEQ ID NO: 39283 - protein, 409 aa, Candida albicans SC5314
MSAKIELVTENVTNGHSGASETIQYTKSQMVGHGSFGVVFQIQLQPSNEIGAVKRVLQDKRFKNRELQIMKLVHHRNIADLKYYFYTNNEKNELYLNLILEFVPETLYKASHYYVSKRLNMPPLEVKLYTYQMFRALNYIHSQGICHRDIKPQNLLINPDTGELKLCDFGSAKILNPSEPNVSYICSRYYRAPELIFGATNYTTKIDVWSAGCVMAELILGQPLFPGESGIDQLVEIIKILGTPSREQIKNMNPNYMEHRFPQIKPIPLQKIFKKMSPDCIQFLIKVLQYSPIDRISCIEGLIDPYFDELRNENTKLPNYRKIFSQQFHSNNSSGFGNAANYQLYNSQPDLRDLPELFDFDDRELSVAPRLNKQLVPNWAYSHLRLNQHINSLDDFSPMSADELKVTLE

SEQ ID NO: 39284 - protein, 326 aa, Magnaporthe grisea 70-15
MAQTPLITVLGSLNIDLVSYVPHHPLPGETLTANSFAVSPGGKGANQAIACAKLSRPQSDKTAATANVRMVGAVGADSYGSLLRSNLEGHGVDVSGVAVRADPAKTGLAIIVVDEPTGQNRIILSPESNHDLDKAVAIEAGLKDKPDLLIMQLEVPIPVVLEAMQAARTASIPCVLNPAPAVELPASAFEGLEHLIVNETEASVLGRVAESVLDTEEGLRSVADGFVKAGVRNVVITLGGRGVYFLQGWTGKAALVPALKATVVDTTAAGDTFVGMYALAAVAASKAGVDFDAEAAVRTANKAAAKTVERKGAQDSIPWRDELEGQ

SEQ ID NO: 39285 - protein, 473 aa, Prochlorococcus marinus str. MIT 9312
MSKSPQDVLSQIKDEGIELIDLKFTDIHGKWQHLTLTSDMIEEDSFTEGLAFDGSSIRGWKAINASDMSMVPDSSTAWIDPFYKHKTLSMICSIQEPRSGEPYDRCPRALAQKALKYLDSTGIADTAFFGPEPEFFLFDDVRYDSKEGGCFYSVDTIEAPWNTGRIEEGGNLGYKIQYKEGYFPVAPNDTAQDIRSEMLLLMGELGIPTEKHHHEVAGAGQHELGMKFDSLIKAADNVMTYKYVVRNVAKKYGKTATFMPKPVFNDNGTGMHVHQSLWKSGQPLFFGESAYANLSQTARWYIGGILKHAPSFLAFTNPTTNSYKRLVPGFEAPVNLVYSEGNRSAAVRIPLTGPSPKAKRLEFRSGDALANPYLAFSVMMLAGIDGIKNQIDPGDGVDVDLFELPAEELAKIDTVPSSLNDSLNALKADKDYLLAGGVFTEDFIDNFIDIKYEEVQQLRQRPHPHEFFMYYDA

SEQ ID NO: 39286 - protein, 449 aa, Streptococcus agalactiae A909
MSKQYDYIVIGGGSAGSGTANRAAMYGAKVLLIEGGQVGGTCVNLGCVPKKIMWYGAQVSETLHKYSSGYGFEANNLSFNFTTLKANRDAYVQRSRQSYAANFERNGVEKIDGFARFIDNHTIEVNGQQYKAPHITIATGGHPLYPDIIGSELGETSDDFFGWETLPNSILIVGAGYIAAELAGVVNELGVETHLAFRKDHILRGFDDMVTSEVMAEMEKSGISLHANHVPKSLKRDEGGKLIFEAENGKTLVVDRVIWAIGRGPNVDMGLENTDIVLNDKGYIKTDEFENTSVDGVYAIGDVNGKIALTPVAIAAGRRLSERLFNHKDNEKLDYHNVPSVIFTHPVIGTVGLSEAAAIEQFGEDNIKVYTSTFTSMYTAVTTNRQAVKMKLVTLGKEEKVIGLHGVGYGIDEMIQGFSVAIKMGATKADFDDTVAIHPTGSEEFVTMR

SEQ ID NO: 39287 - protein, 807 aa, Flavobacteria bacterium BBFL7
MKVSYNWIRQFITVPESIEDHAALLTSLGLEVEGVEKFESVKGGLQGIVVGHVLECVKHPNADKLKLTKVNIGSETVQIVCGAPNVAAGQKVPVATIGTTLYTESGEAWKIKKGKIRGEESHGMICAEDELNIGTSHDGIMVLDENLDPGTLFSDVINIENDYTIEIGLTPNRSDAMSHLGVARDLRAGLAIDGDLLEFITPSVSSFHVDNRSHRVDIEIEKSELAPRYCGVTLTGLTIKDSPEWIQNRLKAIGIVPKNNVVDITNYVMHELGQPLHAFDLATIEGNKIVVKTLPAGTTFTTLDEVEHELHEEDLMICDSVKPLCIAGVYGGLNSGVKKGTNSIFLESAYFNPVSVRKTAKRHGFNTDASFRFERGIDPNITEYALKRAALLILESAGGEISSDITDVYPQKIEDQQVFLPFSKVNSLIGQEIPKEEIKSILRTLDINVNNVTETGLGLTIPAYRNDVTRPADVIEEILRVYGYDRIGTSDKLNASIAKTSRLDNHKLQDLVAQQLAGQGFYEMMANSLTSDKHHTLTDQISPKNEVRMLNPLSSDLSVMRQSLIYGALEAVSHNINRRQENLRLFEFGNTYHQYQERQFTEQKHLSLITTGAIHEQSWNHPSRKADFFYIKGAVLSALKRLGITSINEKPTKMDFLSEGISLNSGVKIADLGVVKKKICKSFDIDATVHYANIYWDEVLKLVKEERKTVTTIPKFPAVKRDLALLVNDETSFKELHDIALQTEKKLLKEVQLFDVYEGKNLAKGKKSYALSFLLQDEVKTLTDKQIDKAMQKIQQQLEKQAGVELR

SEQ ID NO: 39288 - protein, 355 aa, Prochlorococcus marinus subsp. marinus str. CCMP1375
MALSYYKEELKKTASSLATSGKGILAVDESTKTIGKRLASINVENTEENRKAYRGLLFTTEGLGEYISGAILFEETLFQAHPDGEPMVKKLEKLGVIPGIKVDKGLRPLAGGNDVETFCSGLDGLVERSSDYYAQGARFAKWRAVLQITNNGSPSKLSIKENAWGLARYARSVQESGLVPIIEPEILMDGSHSINKTAEVQEEVIKEVYMACQLNGVFLEGTLLKPSMTVQGADCKDKADPQKISELTIRTMERCVPASVPGIVFLSGGLSEEAASIYLNLMNKQPRKANWNVGFSYGRALQHSCLKEWGGKNLEAGQKALLARAQANSEASKGIYVAGSQPSSDEALFVAGYKY

SEQ ID NO: 39289 - protein, 524 aa, Oryza sativa (indica cultivar-group)
MATRVKDVARRSSKKYVDEALYRRLFRRGSTPQAVREEVDGFLDSRKRAFKWEVGVCVRRLRKQALYRPALKLSEVMARRGMNPTVSDQAIRLDLVAKSRGIAAAEKYFLDLPETSKTHLTYGALLNCYCKDLMTEKAEALMGKMKELNFAFTAMCYNSLMTLYTKVNQHEKVPSVIQDMKADDVLPDIYTYNVWMRALAARVDIKGVERVIEEMKRDGRVTPDWTTYSNLASIYVDAGLFEKAEAALKELEKWNTSNDLEAYQFLITLYARTQNLVEVHRVWRSLKRNQPRRANMSYLNMIQALANLKDLPGAEACFKEWEAQYINPPKTNTKAPGTAETSSNESDVKATKDKGTDGELKHPKYDIRVANAMIKEYITEGMFDQAVAVKKRAKMRGGRLNAKTWEIFMEHYLKEGDLKMVHWCADRAIKKGHSAGRIWVPPHEVTETLMDYFEKNKDVDGAEKFVEVLKKVQKDLGTVVFEPLVRTYAAAGKKLPGMRHRLKIENVEVSEETAKLLDSVCIDQ

SEQ ID NO: 39290 - protein, 164 aa, Zygosaccharomyces pseudorouxii
NGVATQATSAQTIDIHTGIGFLDHMIHALAKHSGWSLIVECIGDLHIDDHHTTEDCGIALGDAFKQALGQVRGVKRFGFGFAPLDEALSRAVVDLSNRPCSVIELGLKREKIGDLSCEMIPHFLESFTEAARLTVHVDCLRGFNDHHRSESAFKALAVALREAT

SEQ ID NO: 39291 - protein, 190 aa, Brassica napus
MFAAENGLKGDPRLEAISAAIRVVPDFPKKGIMFQDITTLLLDHKAFKHTIDIFVDRYKDMHISLVAGVEARGFMFGPSTALAIGAKFVPLRKPGKLPGKVISESYELEYGHDRLEMHVGAVEPRERVIIIDDLVATGGTLSAAISLMESQGAEVVECACLIGLPEVKGQHKLEGKPLYVLVAPSGLMNL

SEQ ID NO: 39292 - protein, 429 aa, Bordetella pertussis Tohama I
MSQAPAHSLPSYLDAEHLGPWGIYLQQVDRVTPYLGPLARWVETLKRPKRALIVDVPIEMDNGSIAHFEGYRVQHNTSRGPGKGGVRFHQDVTLSEVMALAAWMSIKNAAVNLPYGGAKGGVRVDPRTLSHSELERMTRRYTSEIGVIIGPSKDIPAPDVNTNAQTMAWMMDTYSMNEGATATGVVTGKPIALGGSLGRVEATGRGVFVVGCEAARDLNLDVSKARIVVQGFGNVGGTAARLFHEAGAKVIAVQDHTGTIHNDGGLDVHKLLAHVGNQGGVAGFTGAQQLADDDFWGLETDFLIPAALEGQINENNAARVRAKVVVEGANGPTTPEADDILRENGVYVVPDVLANAGGVTVSYFEWVQDFSSFFWSEEEINQRLERLMREAYSAVSQVAKEHKVTLRTAAFIVACTRILQARQVRGLYP

SEQ ID NO: 39293 - protein, 363 aa, Burkholderia pseudomallei K96243
MTNRNDETQQMTAIVCHAPEDYRVERVAKPRANARELVIRIGACGICASDCKCHAGAKMFWGGPSPWVKAPVIPGHEFFGYVEALGEGAAEHFGVALGDRVIAEQIVPCGTCRYCKSGQYWMCEVHHIFGFQREVADGGMAEYMRIPSGAIVHPVPLGISLEDAAIIEPLACAIHTVNRGDIQLDDVVVIAGAGPLGLMMTQVAKLKTPRRLVVVDPVEARRALARAYGADVTIDPAREDAPAIVRALTGGYGCDVYIETTGVPAGVTQGMALIRKLGRFVEFSVFGKDTALDWSIIGDRKELDVRGAHLGPYCYPVAIDLLARGLVTSKGIVTHGFSLDEWDEAIRVANSLDSIKVLMKPRG

SEQ ID NO: 39294 - protein, 450 aa, Silicibacter pomeroyi DSS-3
MIPPKPPARPDKVSLWRYLRLFRQDLLSAQPARLYRAWMAEFRTPFFRSYLVNQPDLVDTVLKGRPDDFPKSNRISEGLRPLLGNSVFLTNGETWKRQRRIIDPAFEGGRLRDTFPAMWAASEAAVNRLAAQAGQETEIEEVTSHAAADVIFRTLFSIPIEHEVAAQVFTRFRAYQRAQPLLNLAAFVPVPQWVPRFHSRETRRNAAVIRGLIRQLTDTRMGEIRAGTAPDDLATKIMTTTDPQTGDRFDTDEMVDQVAIFFLAGHETSASALAWTLYLMALYPDWQEKLAEEARTLDSGTDFSVMSKLRLSRDVFREALRLYPPVPMMVRETTCPERFRDRDVPKGAQIVLSPWHLHRHERLWERPDDFDPARWQTENGKTCQRNAYMPFSAGSRVCTGAGFAMVEGPLILSMLLLRFRFERIAGREPVPVAHLTVRAADGIWLRVVER

SEQ ID NO: 39295 - protein, 396 aa, Glycine max
MAVEYTCCSTAFFVHILVIVLLVLFAGLMSGLTLGLMSLSLVDLEVLAKSGTPQDRKHAEKILPVVKNQHLLLCTLLICNAAAMETLPIFLDGLVTAWGAILISVTLILLFGEIIPQSVCSRYGLAIGASVAPFVRVLVCICFPVAYPISKAGKGGELTHDETTIIAGALELSEKTASDAMTPISETFTVDINSKLDRELMNEILEKGHSRVPVYYEQPTNIIGLVLVKNLLTVHPEDEAPVKSVTIRRIPRVPESMPLYDILNEFQKGHSHMAVVVRRCDKTNQQSSQNNANDSVRDVKVDIDGEKPPKEKALKPKMPLHKWKSFPNTNKSSNRGSRSRKWSKNMYSDILEIDGSPLPKLPEEEEAVGIITMEDVIEELLQEEIFDETDHHFEDS

SEQ ID NO: 39296 - protein, 191 aa, Methanosarcina acetivorans C2A
MRTGRISRKTKETDIQLELNLDGKGVADISTGLGFFDHMLASFSRHSEFDLKVRAEGDLYVDEHHLVEDVGIVLGRALAEVLGDMSGIARFGEARIPMDEALAEVALDVGGRNYLVLKAEFASPQVGQFSTQLVRHFFETLASNAKITMHASVYGDNDHHKIEALFKAFAYAMKRAVKIEGKEVKSTKGTL

SEQ ID NO: 39297 - protein, 116 aa, Staphylococcus aureus subsp. aureus Mu50
MTNHKLIEAVTKSQLRTDLPSFRPGDTLRVHVRIIEGTRERIQVFEGIVIKRRGGGVSETFTVRKISSGVGVERTFPLHTPKIEKIEVKRRGKVRRAKLYYLRSLRGKAARIQEIR

SEQ ID NO: 39298 - protein, 463 aa, Ostreococcus tauri
MARGGASAAEESDSASDAQSPPMVYPTEAAAYELIEEIGRGVSATVRTGRGTRETSRTETRAEGWKTTRGDAMVWRAKCLKNDETVAVKVLDLEEHEPEHLDEIRREAQTMSMLSHPNLVKYHCSFVNETSLWVVMPYLAGGSALNLMKWSHPSGFDEPIIACIVKAACKALDYFHRNGNIHRDVKAGNILVDEDGTVKLADFGVSASCWGSGGRPRSHQTFVGTPCWMAPEVMEQEHGYDFHADIWSLGITCLELCHGHAPFSKYPPMKVLLMTLQNPAPTLEESAEDGRSFSRHLREFVGLCLQKDPSKRPTASKLLEHKFLKDAKKADWLAKTLLDNIPSLGERTQRLAERDARRRAESKVGEEQREAASAEAYKHGVSNWNFDMADLKAQAAALDDPVVAESEAVAAANALENMQLGDKPNVERKGRFEIITEDVAPERSEASQTSKHVSYSSELSRGW

SEQ ID NO: 39299 - protein, 700 aa, Kluyveromyces lactis NRRL Y-1140
MFATGISKGLIGVALPIRSIHGSMRGPIQTVNKLPLRAVCLASFKPSVRNFHVSSCLRSEIEQEKSTPPVGLVKTSGFTSKLGKLVKWSIFTAGIVASGVGAIIIGFFIYDSTTYKSCGTAVEIKVPKLALNPELGGPENLPILRETLDAYDSEMKELTSYKPKLVVLGSGWASVGLLKNLNPGDYDVTVVSPQNYFLFTPLLPSAATGTLEVKSLMASIRKIVNDVNGHYLEAYAEKVEFDEKLIKVSQINTKTGAKDSFYLPYDKLVIAVGSTSNTHGVEGLQYCSRLKTAEDAITLRKKIKTLLERACLPTTSDEERRRLLSFVVCGGGPTGVEFAAEVFDLLNEDLPSMYPRILRQQLSVHVIQSRSNILNTYDEKISEYATQRFRKETIDVLTNSRVERILPDRVIFKQKDDKTGEVELKEIPFGICLWSTGVSQNPLTKQVVHSLAHSQRNKRAIETDSYLRVIGAPTEDVYAIGDCSTVRTDLADHTADYIRRFIVNRHLSLTRSNEIITDEDIKHLSLSYNEIIDIAKQVARRHPQTREHLIHLEDDLPKYDVNKSGQLNFDQISTLLREVETKVTSLPATAQRAHQQGKYLGKKLTKVARSANKDSIQGIHEKGIDEKVYRPFRYVHLGSLAYIGNSAVFDLPGYSFVGGLIAMYLWRSIYFAQTVSWRTRVLLFMDWLKRGMFGRDILSE

SEQ ID NO: 39300 - protein, 439 aa, Thermotoga maritima
MTIETIKRIIEEENVRFIRLQFTDINGTLKNLEITPDVFLESWEDGIMFDGSSIEGFVRIEESDMYLKPVLDTFAVLPWTVDGAKSARVICDVYTPDGKPFEGDPRYRLRRMMEKAEQLGYTPYAGPEMEFFILPINEKGEPVPEFLDHGGYFDLLPLSKVEEIRRDIAIALEKMGITVEATHHEVAPSQHEVDFRYDTFLRTGDNAQTVKLVIKTMAIFHGYHATFMPKPFYGVNGSGMHVHMSLFRGDKNAFYDPDDPLGLSKELRYFVGGILKHAKRLAAVTNPTINSYKRLVPGYEAPVYISWSVGNRSALIRIPKARGKATRLEYRSPDPTCNIYLAFAAILAAGLDGIINKIEPPAPVEENIYHMTSERREELNIESLPGSLKEAVEELKKDDVIIDALGEHIFEKFVEAAEKDWKEFSTYVTNWELQRYLYL

SEQ ID NO: 39301 - protein, 530 aa, Gibberella zeae PH-1
MRFLTGLLVLGMSLWTTQAYEIGLSNKEGYQEYCTGMYSKSSWGGPVDPFILVKFLNSSDSGVKDPTASLVIFEWKDRNLVGIPDPDVPGNRLGVCGDDFVKQGYCNKTDIGKFILNPDVDKKSSSVVLTKAVHLNTAAPINYAIKKTGYYCVLTDVVNTKKYDLVVEYRNAYGELEATQIPKLPFYGGMSILYALLAAYWGFLYYQHRHDISILIFLVVEMLITWGFYEYQNRHGSNIGSKVFLTIVGILNAGRNSFSFFLLLIVCMGYGVVKHTLGKSMIRVRWLAAAHFLFGLVYSLTFLSITPETAGPFVLLIVLPLAGTLTAFYVWTLNSLNWTLKDLRERKQHAKEAMYRKLWWAILISVMVIFGFFFFNSFTFASASDPDFVPFHWKTRWFILDGWLNVVYFADVAWIAYLWRPTSNNRRFAMSDEIAQDDDGNFDLGDIGVPGEDSDDEEAEVAKPQNNSQNANGLSFSSASRSAPQQPRNTRTGPRESLENETIFAVGEDGDKFSDDDDSDEEDAKLVKAK

SEQ ID NO: 39302 - protein, 633 aa, Magnaporthe grisea 70-15
MSGTGSRQPLDASAGRDVVYCHACENEWFQDQNGLVCPQCHSEATEIVTPENDPRPVNTHDSRTEPQGHRDRYDDSDPEEEDIEEHSHRAPGGIYFTSRVFRMPVNHGAGTESPHVHPSDGNAVMERFYEMMNRDMGSSAAPGASNSDGTRSATGQGASENSGTRHYTTRTTMFPGGSTSFTITTAPLQRDGNNPPIGEFDAYADPHPRTRRRIVIVMLDSRGADSNASILSTIMGNITNPVGNTPHRGGETSSNDEASGLPPHGFPIAFQQLLGALMTGYGGTRNWGDVVTSQEEFDRIISQMMEANPMSNAAPPASEAAIEKLERKKLDEKMLGTDETVECTICMDDLSLGDEATVLPCKHFFHGECVTIWLKEHNTCPICRTPMEQRSSAERTQAPQNQSSSGPRAARPEPPRGIFPWAFQPSGSGTGSFVNSSSQRPSQSSQQSPIDIQQNDSGHTSHRRELLRSPSTNEERLRAIRDLANSDRHGGSDRPTTPPFAGRRRNSLSPPSPSMQAPWNLSYDPVHDFTSASRDRTRERDGDRSNSQSSSRFTSTNRDQEGHRDRERYRQQTYESSQPPSREQRDQERNDDNGSRRGDPNQTSSGSTFDPFSWIRDRLPGGGNSSGDSHRRG

SEQ ID NO: 39303 - protein, 401 aa, Zea mays
MEYGAVLAAAPLVARPNWLLLSPPPLAPSIQIQNRLYSISSFPLKAGPVRACRALASNYTQTSETVDLDWENLGFGIVQTDYMYIAKCGTDGNFSEGEMVPFGPIALSPSSGVLNYGQGLFEGLKAYKKTDGSILLFRPEENAERMRTGAERMCMPAPSVEQFIDAVKQTVLANKRWIPPTGKGSLYIRPLLMGSGAVLGLAPAPEYTFIIFVSPVGNYFKEGLAPINLIVEDKFHRATPGGTGGVKTIGNYASVLMAQKIAKEKGYSDVLYLDAVHKKYLEEVSSCNVFVVKDNVISTPAIKGTILPGITRKSIIDVALSKGFQVEERLVSVDELLDADEVFCTGTAVVVSPVGSITYQGKRVEYGHQGVGVVSQQLYTSLTSLQMGQTEDWMGWTVQLN

SEQ ID NO: 39304 - protein, 456 aa, Gibberella zeae PH-1
MSSKSRWADTEEDARLDAKLKEEKRRKKAEKARKLEEEKKLQDTAKQSNLEADDDRPSKRRRITPEPGAKQDEKLPPAKLLRFPTGSWGKSRSVENYEKLNDIEEGTYGWVARATNKATGKVVALKRLKLEPQDRNGLPVTGLREIQILKDCQHRNIVTMEEVVVGDDVSRPDNSLFLVLEFVEHDLKSILEDMPEPFLSSEVKRLLLQLTSGIAYLHDNWILHRDLKTSNLLLNNRGQLKIADFGMARYVGDPPPKLTQLVVTLWYRAPELLLGAKTYDAAVDMWSVGCIFGELLTREPLLQGKNEVDQVSRIFELCGVPTEETWPGFRRLPNARSLRLPKTQVATGSVVRARFPSLTSAGAGLLGDLLSLNPERRPSAQEMLQNEYFRQDPKPKPESMFPTFPSKANQERRRRVEPHAPVRGGQAASLGDADLSGIFQGRDKEEKGAGFQLRMI

SEQ ID NO: 39305 - protein, 631 aa, Olimarabidopsis pumila
MTAVLFLCFILFCFSFTPSLQNVRESEPLLRFKTSVNITKGDLNSWRTGTNPCNGKWFGIYCQKGQTVSGIHVTRLGLSGTINVEDLKDLPNLRTIRLDNNLLSGPLPPFFKLPGLKSLLLSNNSFSGEIADDFFKETPQLKRVFLDNNRLSGKIPSSLMQLSGLEELHMQGNQFSGEIPPLTDGNKVIKSLDLSNNNLEGEIPKSIAERKNLEMKFEGNQKLCGPPLNTICEETPTSFGEKKEVTGKAIFMVIFFLLLFLIIVAIITRWKKKRQPEFRMLGKDHLSDHESVEVRVPDSIKKPIESSKKRSNADGSSKKGSAHGKGGGGGPGGGGMGDIIMVNSEKGSFGLPDLMKAAAEVLGNGSLGSAYKAVMANGLSVVVKRIRDMNKLARDAFDIEMQRFGKLRHPNVLTPLAYHYRREEKLVVSEYMPKSSLLYVLHGDRGVYHSELTWATRLKIIQGVARGMDFLHEEFASYDLPHGNLKSSNVLLSETYEPLISDYAFLPLLQPNNASQALFAFKSPEFVQNQQVSPKSDVYCLGIIILEVMTGKFPSQYLNTGKGGTDIVEWVQSSIAQHKEEELIDPEIASNTDSIQQMIELVRIGAACIASNPNERQNMKEIVRRIERVTL

SEQ ID NO: 39306 - protein, 197 aa, Triticum aestivum
  misc_feature (99)..(99): Xaa can be any naturally occurring amino acid
  misc_feature (140)..(140): Xaa can be any naturally occurring amino acid
  misc_feature (168)..(168): Xaa can be any naturally occurring amino acid
MAKFGEGDARWIVQERADGANVHNWHWAERDCLDWSRALLSKLLAGLPVLSGEGGLALRTTTLDKLDGEAYVNIRKGKVIPGYELSLTLAWEADATTQXGVVKVTGTAEVPYLADENADEDPELRITVRGDDGPLARRAXDAFIAHGQPLVITKIRDYVAGMANGGPXQDEIDSTKISTSCPAAVAQCGSAPSFGKG

SEQ ID NO: 39307 - protein, 115 aa, Olimarabidopsis pumila
MASLDSDVPMIPAGEASSSTVPSKKVKRFEIKKWSAVALWAWDIVVDNCAICRNHIMDLCIECQANQASATSEECTVAWGVCNHAFHFHCISRWLKTRQVCPLDNSEWEFQKYGH

SEQ ID NO: 39308 - protein, 362 aa, Prochlorococcus marinus subsp. marinus str. CCMP1375
MASHKITLLTGDGIGPEISIVAKKILAALSEKHSITFTIEEKPFGGQAIELTGKPLPEDTLNSCKASDAVLLAAIGDPKYDDLPRDLRPETGLLNLRAGLNLFANIRPIKIRQALISSSSLKSEIIKDVDLVVVRELTGGIYFGQPKGRISTEEAGERAFNTMTYSDYEIDRIAKIAFDLSETRRKKICSIDKANVLEVSQLWRERVIKAQEQYPNIELTHQYVDNAAMQLVREPAQFDVILTSNLFGDIISDEAAMLTGSIGMLPSASLGEDGPGVFEPVHGSAPDIAHKNLANPIAMILSTAMMLRTGLMEYKAATDLENAIDKVLGKGFRTIDLNRDQSNTKLGCREMGDQIIKAINGI

SEQ ID NO: 39309 - protein, 291 aa, Ostreococcus tauri
MSEAWKTVKPYVNGGLSGMGATCVIQPLDIVKVRLQLGSTSGPIGTAAGIIKNEGFGALYTGLSAGLLRQATYTTARLGLHQNFVDMLNKQNDGANLSLEHKAGAGLAAGGLGALVGSPADLSLIRMQADGTLPADQRRNYRGVGHALMDIVKKDGVGGLFVGAGTTSIRAMALNMGMLASNDQAKEMMAANNITGFPATVGAASIAGFFASFFSLPFDYVKTQLQKQKPGPDGKMPFSGFLDCCGKTMAEGGPLKFYTGFPTYYVRIAPHAMITLMVLDAIKQFQADNGL

SEQ ID NO: 39310 - protein, 484 aa, Magnaporthe grisea 70-15
MNSSGVPNILRPGGSQRNVSNTPLGLADIRPRADSSLSDGIPGSAAYDVANTQSGTSNYMAPWALYAFDWCKYPPQGNGAGKLAIGSYLEDGHNFIQILDTQVVPTPPEAYSQGGSRTCLEFTKVAEATHSYPVTRLLWEPHSPNSQKQSTDLLATSGDHLRLWSLPSDASSSMSNNINRSSRDPAPPTKLTPLALLSNSKTPDHTAPLTSLDWNQVSQNLIITSSIDTTCTIWDIPSLTAKTQLIAHDKEVYDVRFCANSVDVFVSCGQDGSVRMFDLRSLEHSTIIYEPTGKDEKDPSGGRISPTLAQQTMSNPPPLLRLATSPHDTHLLATFAQDSNVIRILDVRQPGQALLELRGHGGSLNCIEWSPLRRGTLASGADDCQVLIWDLLQNQSAAPPLNGAPQPDNVRSPVASWQCDYEIGNLGWTPQLANSENGEWLGVSAGRGIWGLKTIDRSFGGAEPSSLHRMLGDWMAYIGPANRV

SEQ ID NO: 39311 - protein, 590 aa, Cryptococcus neoformans var. neoformans JEC21
MSKITVAPSREEVPSLSALGIKAHPDALTLAYDDNALAGSYGGNGLKDLFASRMVLLAASAACIGGLLFGFDQGILSICLTMPQFQDQFPETNAEVNPQASLNKGIMTALLELGAFLGAFMSGYVSDRYSRKGSLAFGMVWFIIGSVLQSASYSFAQLVVGRFIGGIGIGVLSSTAPTYISEIAPPNIRGALLVLEQFSIVLGIVVMYYITYGSRYLSGGGSFRLPFALQMFPCIILGGFLYQLPYSPRWLALRGRDQECLASLCRLRQLPDTDPRVQAEWITIRAEAIRNREVLVKAHPTMTDKSTKSEFKLELASWVDMFRVGSIRQTMIGILLMFFQQFVGINALVYYAPTLFEQLGLDYELQLTLAGALNIAQLVAVVAAFFLLDKFGRKVFLIVGAIGLTVSHSVVAAMIGTYGDNWPAHKGPAWVGVGFIFGVMIFYGIGWGPVPWAMPAEIHASSRRAKGVAITTCSNWLNNFIIGLITPPLISGTKGYGAFIFFAIWSLLACLWSVFFVPETKGRTLEQMDAVFKSRTAIEDAQARDDILQIVCKEALNSINNPRQVPKMEIEMLENVDEKKSGTPSTISQV

SEQ ID NO: 39312 - protein, 397 aa, Synechococcus sp. WH 7805
MLTSERLARLGSGVFDRNDRRKAHYCLGSRHPQQPLIDLSLGSTDLAPPAEVIAAMAGALQDPISSSYCLHAGTEAFRHAAAAWCERRFGVAVDAETEVLLLVGSQEGTAHLPMAVLDPGESALILDPSYPSHRGGLELADASIHTLPLRAETGWAPDFSSLTTEQWRQLRLMVLGFPHNPTACTGEQAWLDEAMEHCHRHDLVLAHDNPYVDLALEGEAPALLRCPQWKERGIEFFSLSKGWCLGGFRLAFAVGAAPLISALRQLKGVVDFNQCRALQQGAVLALDRFAHWPASLRPVYRDRRDRMLRSLERIGWSVPQPSMALYLWMPLPSWARSRGWSDEQLAAEVLEHCGVALTPGSGFGTAGAGWLRLALVRPSIELESAVDRLAPWWALQS

SEQ ID NO: 39313 - protein, 192 aa, Triticum aestivum
  misc_feature (167)..(167): Xaa can be any naturally occurring amino acid
RPPTRPSNDTLGVQVLKSRGIFVDPNWYWIGVGALLGYIMLFNVLFIVFLDLLDPLGKGQNVVSEEELMEKHVNRTGENVELLLLGNDSQNSPSNGGGEITGADTRERGMALPFTPLSITFDNIRYSVDMPQEMKDKGITEDRLVLLKGVSGAFRPGVLTALMGVSXAGKTTLMDVLAGRKTGGYIEGDISI

SEQ ID NO: 39314 - protein, 446 aa, Lactobacillus rhamnosus
MARKAITADEIRQTVKDENVLFLRLMFTDINGIIKNVEVPISQLEKVLNNKIAFDGSSIDGFVRIEESDMLLYPDLNTWLLFPWENDHGKIARLICSVHRPDGTPFGGDPRNNLIRVVNEMKDAGFTAFNIGPEPEFFLFKLDEDGNPTTHLNDRGSYFDFAPLDMGENCRRDIVLELEKMGFEVEASHHEVAPGQHEIDFKYADALEAADNIQTFKLVVKTIARKHGLYATFMPKPLHGINGSGMHINMSLFHDKGNAFFDPDTGDQLSETAMHFLAGVLRHAYALTAINNPTVNSYKRLVPGFEAPVYVAWSGKNRSPLIRVPQSRGLSTRLELRSVDPTANPYLAIAAILQAGLDGVKNQLKPEEAVDRNIYRMQDDERKANHIQDLPSTLHNALKALAADDVVKAALGKHLYQSFMDSKNLEWSAYRQQVSEWERQQYLELY

SEQ ID NO: 39315 - protein, 379 aa, Triticum aestivum
PSQISHLFSPNRIPNPDLIGDPPSVAMSRTGSRLASSVVRLPGRSRVSASPSPRRRSLSPSPSPRRQRRRDRSPIPSRDRRGERSPVPSRDRRRDRSPSPYRDRRRDRSPSPFRDRRRQWSPYHNERGRDMDRVRDVEPPARRGGGGGGEWSASDDDDEDLKGLTYFEYRRVKRQQLRKSLKKCIWKVTPSPPRRDDEADEYQYSEEEEEKKESPKKDSSEKSDVEENKDSSESESDESGSLSDSSESDYSRKKKKGRKGRRSSSKRSRRAHRRHRKSDVESESDSKVDEDSEGSDDSEDSRDKRRSKRSRRHKKSKRRARSSRRKKRLRLDVPSDVSSEEVEVLVSSPISTDSKKMGKSSRKKSSSQSDSEDSIPSDA

SEQ ID NO: 39316 - protein, 100 aa, Triticum aestivum
MTLQMEPPRPPPLKSVSTSCDLHPEETFTGFCTACLRERLAGLEASDAVAAAPGRKSTSAIRSLFSRPFAAAAGGAAPSSSGAAPPDLRRCKSFSCGGRG

SEQ ID NO: 39317 - protein, 395 aa, Hyphomonas neptunium ATCC 15444
MEDPRQHILPVYRPPEEVFVQGEGVYLFTEDGRRYLDFIAGIAVTALGHAHPAMVEALRDQAGKLWHTSNMFRVKGQEELADKICRDSFADRVFFTNSGTEAIECAIKAARKYHWAAGNADRLDIITFTGAFHGRSIGAINAGGNPKYLEGFGPKLPGFVHLEWGDHDALKAAVAASTAAAVLVEPVQGEGGVRAMPEQCLKGLRDLCNEHGVLLIYDEVQCGMGRTGQLWGYQWAAGADPDILCAAKGIGGGFPFGACLMTEAVGEPMQPGSHGSTYGGNPLAMAVGNVVWDIISSEEFLANVRRVSGTLQQGLKSLADSHPDKVEGVTGKGLLTGLRLKADPKNLQGICRDGGLLTGVAGNNVLRLAPPLIIDDAQVRDAIGMIDAALTEWTP

SEQ ID NO: 39318 - protein, 322 aa, Pseudomonas syringae pv. syringae B728a
MQPQAFYRAVADDFSAVDLIIKKQLTSRVPLVSKIGDYITSAGGKRLRPLLVLLCGKALGREGDDVRLLAATIEFLHTATLLHDDVVDMSGMRRGRSTANALWGNAPSVLVGDFLYSRSFEMMVELGSMEVMKILSKATRIIAEGEVLQLSKIRDASTTEETYMEVIRGKTAMLFEASTHSAAALCNAPQEQSEALRTFGDHLGVAFQLVDDLLDYRGDAETLGKNVGDDLAEGKPTLPLIYTMREGSPEQAALVRQAIQKGGLEDLESIRNAVESAGALDYTAQLARDYAARAIACLDALPPSEYRDALVELSEFAVARTH

SEQ ID NO: 39319 - protein, 600 aa, Oryza sativa
MKVTPTPHANGSKVAARLTRLLRCSPRDSNVIARSLQSAAAAVAVPVPTSSPARMLPPSAAATAGDGGGVPHFVGTMREERRKEKNEEMVAGQPLEMEEVEVAPPRAHEVRIKILCTSICHTDITFWRMEGNHPSIFGHEAVGVVESVGEHVQEVAVGDMVVPVFAAQCSECPDCLSDRSNLCSKLPNVAGLMPRDRTTRFSSVSTGEPIRHFLSVSSFAEYTVVDITHIVKLDVGFPPAMACLLSCGISTGVGAAWKVAAVEPGSSVAVFGLGAVGLAVAQGARMRGAKRIIGVDLNPDKFDVGKRLGMTDFINPNDTGGKTVSEVIKEMTGGGGADYCFECIGSTSVMAEAFQSTRNGWGKTILLGVSGNKAPISIPSHEILRGRSVIGSLFGGIKPKNDIPMLAQKYLDKELELEEFITHEMGFEEINRAFELLTQGKSIRCIIWMDGAKVIDNGEVFDSALASVAVVLESIRSEGQLWSLAGERGALSNVDYDHLLAPVKASPRPLSREGEEEEGDIAMVAAQSFVSTQDSASDTVVDYSGNEDKFHESNTTLVGWHWRHHWVYWLGPFIGAGLAGLLYEYLVIPSADATPHGGAH

SEQ ID NO: 39320 - protein, 409 aa, Zea mays
MEAARQQQEECPCGGPEAADHFERLHDAVLLDVLNRIGDVKALGRCALVSRRFHALVPLVDSVFVRVDCVIPDDPPPSSSSSSSSSCAAPGTPPRQAPAPTARGRGALARIARALLGGVARPIHALGQILSSAAATVSRRSEPLPASPPPAPVADVSHHSPSEVLRSFRELRRLHIELPTGELGIDDGVLLKWKADFGSTLGSCVILGASSVSSKPPAGSAQAETAAADSTPAAPDTGRETEEPGSLPDSLYTNGGLKLRVVWTISSLIAASARHYLLQPIICNHELLESLDLTDADGQGVLTMDKRQLQELRVRPVSPSGSSHRTLMPALSMRLHYAPLIELPGGTLLKGATLVAIKPSEDALREGQGAGAAGPVGTCWISEAFEEPYRTAAKVLLKRRAYCLEMNSF

SEQ ID NO: 39321 - protein, 140 aa, Hordeum vulgare subsp. vulgare
MWKYRVLGSVAALLLLLAVVVPFTQTWTQSARDKAAMAEDAGPLMGGIEDSPMGQENDLDVIALARFAVSEHNKKANALLEFENVVKLKKQTVAGTMYYITIRVTEGGTKKLYEAKVWEKLWENFKQLEEFKPVQDAAIA

SEQ ID NO: 39322 - protein, 403 aa, Cytophaga hutchinsonii ATCC 33406
MTTITNPQTLSTVVNSLSESETLAMTKKARELASQGNKVISLSVGEPDFKTPQHVMDAAKKAIDEGYHSYSPVAGFADLRAAIAEKLVKENNINVTAENIVVSTGAKQSLANVIQAIVDKGQEVIILAPYWVSYSEMVKLAEGKSVILTGTIENDFKVTAAEIAKAITPKTRAIMYSSPCNPSGSVYSEKELREIGELLKQNPQIVAIADEIYEYINFEGKNFSLGSIDEIKDQVVTVNGFSKGFAMTGWRLGYIAAPKYIAAATEKLQGQVTSGTCSITQRAGLAALQGDLSAPLKMKEAYLRRRDLIIDLLKEIPGLKINKPAGAFYIFPDVSAYLGKSVNGQVIKTSSDLSMFILNDAFVSTVGGDSFGSPNNIRISFAASDENIIEAIKRIKECLAKLK

SEQ ID NO: 39323 - protein, 840 aa, Synechocystis sp. PCC 6803
MSSPQVPTVFAIDDSPLNLKILQRFLEKQGWKVFIAEDGLTAITEINQVQPDIIVLDIMMPGIDGFEVCRRLKAAPATAEIPIIFLSALTDQKSIVKGLELGAVDYIHKPFQQEEIITRLQLQLKLHQTNQALLQKNQQLEEQIEKTARTQAALMQSEINFAVAFNQSPDPIFIYGRNSGCIMDVNQPFCQFFGLTKQELVGVSRQQFYFWVDEQQRQSFLRDLLLWQKDGLVKFENREIEVYDQEKQVRTMLLSGEPMEFNRVDCLLFVMRDITERRKAEKQLKILSQACEQSPASIVITDVQGNITYVNPKFEEISGYKSAEVLGRNPRILKSGNKTQEDYELMWKTLASGRNWHGEFHNRRKNGELYWERASISPISNQQGIVTHYVAVKEDITKEKQQAEALFHQAHYDHLTGLPNRILAKDRLQQAIESALRQKHIFGLMFLDLDNFKKVNDTLGHDAGDQLLVEVSERLQRALRQTDTVARLGGDEFLIILDQVSHSRKLMAIAQRLLRVMRQPVNLQGLEFFVHGSIGITVFPDDGFHADVLLRNADTAMYAAKLAGRNMFRFFTPHMNQAAQQRMAIESELRQGLSRQEFQILYQPIVSLESGQIVGAEALMRWHNRLLGTVPPDQFIPIAEEVGLIVELGEWLLDNVCCQAAHWHSALGEQTFWVSVNVSPRQLKDSYFVAILQGFLQRYQVRPEWLELEITENLILEENGDLLKNLSDLEEENIALSLDDFGTGYSSLNYLRKFNFNSLKIDRSFVELLPHDNNTVGLVRAIIAMAHHLELKVIAEGIETPEQWNFLRLQGCDYGQGYLFSPAIAVEEWESLGQKPPFFP

SEQ ID NO: 39324 - protein, 464 aa, Escherichia coli K12
MPDAKKQGRSNKAMTFFVCFLAALAGLLFGLDIGVIAGALPFIADEFQITSHTQEWVVSSMMFGAAVGAVGSGWLSFKLGRKKSLMIGAILFVAGSLFSAAAPNVEVLILSRVLLGLAVGVASYTAPLYLSEIAPEKIRGSMISMYQLMITIGILGAYLSDTAFSYTGAWRWMLGVIIIPAILLLIGVFFLPDSPRWFAAKRRFVDAERVLLRLRDTSAEAKRELDEIRESLQVKQSGWALFKENSNFRRAVFLGVLLQVMQQFTGMNVIMYYAPKIFELAGYTNTTEQMWGTVIVGLTNVLATFIAIGLVDRWGRKPTLTLGFLVMAAGMGVLGTMMHIGIHSPSAQYFAIAMLLMFIVGFAMSAGPLIWVLCSEIQPLKGRDFGITCSTATNWIANMIVGATFLTMLNTLGNANTFWVYAALNVLFILLTLWLVPETKHVSLEHIERNLMKGRKLREIGAHD

SEQ ID NO: 39325 - protein, 665 aa, Pseudomonas aeruginosa PAO1
MPSRRERANAIRALSMDAVQKANSGHPGAPMGMADIAEVLWRDYMQHNPSNPQWANRDRFVLSNGHGSMLIYSLLHLTGYDLGIEDLKNFRQLNSRTPGHPEYGYTAGVETTTGPLGQGIANAVGMALAEKVLAAQFNRDGHAVVDHYTYAFLGDGCMMEGISHEVASLAGTLRLNKLIAFYDDNGISIDGEVHGWFTDDTPKRFEAYGWQVIRNVDGHDADEIKTAIDTARKSDQPTLICCKTVIGFGSPNKQGKEECHGAPLGADEIAATRAALGWEHAPFEIPAQIYAEWDAKETGAAQEAEWNKRFAAYQAAHPELAAELLRRLKGELPADFAEKAAAYVADVANKGETIASRKASQNALNAFGPLLPELLGGSADLAGSNLTLWKGCKGVSADDAAGNYVFYGVREFGMSAIMNGVALHGGFIPYGATFLIFMEYARNAVRMSALMKQRVLYVFTHDSIGLGEDGPTHQPIEQLASLRLTPNLDTWRPADAVESAVAWKHAIERADGPSALIFSRQNLPHQARDVAQVADIARGGYVLKDCEGEPELILIATGSEVGLAVQAYDKLSEQGRKVRVVSMPCTSVYEQQDESYKQSVLPVEVGARIAIEAAHADYWYKYVGLDGRIIGMTSFGESAPAPALFEHFGFTLDNVLAVAEELLED

SEQ ID NO: 39326 - protein, 292 aa, Bacillus halodurans C-125
MDFGHVLTAMVTPFDAKGNVDLEKVERLVEFLLANGTEGLVVAGTTGESPTLREEEKLALFEKVVTVVNKRVPVIAGTGSNNTYVSAQLTKKATALGVDGIMAVTPYYNKPSQEGMYAHFAAIAEATHLPVMLYNIPSRSVVNLSAETIVKLSYIPNITSLKEANGDLDHMVSVIEQTPDTFHLYSGDDSLTLPALSIGAKGVVSVASHIIGPEMQQMMMAFRGGDVEHAANLHRKLLPIMKGLFTAPNPTCVKAALQIKGFDTGGVRLPLVPPTSEQRQHLQFLIEQLKVS

SEQ ID NO: 39327 - protein, 511 aa, Campylobacter coli RM2228
MKKADILVLDFGSQYTQLIARRLREQGVYAEILPFNVSLADIKAKEPKGIILSGGPASVYATDAYFCDKEVFNLGLPILGICYGMQLMAHHYKANVAPAGHKEYGKASIEIQKDSDLFKNLPKKQIVWMSHSDKVENLPQGFEVLATSENSPYCVFANEEKKFFALQFHPEVQHSEFGKSILKNFAKYACNCESIWNMGSFAKTQAEKIREEVGKDKVLCAVSGGVDSSVVAALLANAIKDQVIVVFVDNGLLRSDEKEQVEFMFKNTLGINLISIDASKIFLDRLAGVTDPEQKRKIIGNTFIEIFEEEAKKHKDVKFLAQGTLYTDIIESSVIGASKTIKSHHNVGGLPEKMNLKLVEPLKEIFKDEVRALGIELGLSKEIVYRHPFPGPGLAIRIMGEVNRPSLELLRKADVILLEELRSTGWYNKTWQAFCVLLNVKSVGVMGDNRTYDNTICVRVVDASDGMTATFSHIPYEILENISRRIINEVEGINRVVYDISSKPPATIEWE

SEQ ID NO: 39328 - protein, 387 aa, Pseudomonas aeruginosa PAO1
MTVLKMTDLDLKGKRVLIREDLNVPVKDGQVQSDARIKAALPTLKLALEKGAAVMVCSHLGRPTEGEFSAENSLKPVAEYLSKALGREVPLLADYLDGVEVKAGDLVLFENVRFNKGEKKNADELAQKYAALCDVFVMDAFGTAHRAEGSTHGVARFAKVAAAGPLLAAELDALGKALGNPARPMAAIVAGSKVSTKLDVLNSLAGICDQLIVGGGIANTFLAAAGHKVGKSLYEADLVETAKAIAAKVKVPLPVDVVVAKEFAESAVATVKAIAEVADDDMILDIGPQTAAQFAELLKTSKTILWNGPVGVFEFDQFGEGTRTLANAIADSAAFSIAGGGDTLAAIDKYGIAERISYISTGGGAFLEFVEGKVLPAVEILEQRAKG

SEQ ID NO: 39329 - protein, 394 aa, Brassica napus
MTTRKRQIKNFTLNFGPQHPAAHGVLRLVLEMNGEVVERAEPHIGLLHRGTEKLIEYKTYLQALPYFDRLDYVSMMAQEHAYSLAVEKLLNCEVPLRAQYIRVLFCEITRILNHLLALTTHAMDVGALTPFLWAFEEREKLLEFYERVSGARMHASFIRPGGVAQDLPLGLCRDIDSFTQQFASRIDELEEMLTGNRIWKQRLVDIGTVTAQQAKDWGFSGVMLRGSGVCWDLRRAAPYDVYDQLDFDVPVGTRGDCYDRYCIRIEEMRQSLRIIVQCLNQMPSGMIKADDRKLCPPSRCRMKLSMESLIHHFELYTEGFSVPASSTYTAVEAPKGEFGVFLVSNGSNRPYRCKIRAPGFAHLQGLDFMSKHHMLADVVTIIGTQDIVFGEVDR

SEQ ID NO: 39330 - protein, 996 aa, Thermoplasma acidophilum DSM 1728
MIIRNDYIVIISLDHCMSEKAFSISIDGRSYDANDGETVLQVMMRNRLDISHICYHPSLGPIQTCDTCLVEADGKIVRSCATQVHENMNVVYSEDRVKDLRKEAVQRILANHNLYCTVCDNNNGDCELHNAVLDLKIDKQKYPFSRKPYDVDDSNPFYVYDPSQCILCGRCVEACQDVQVNETLHIDWSLERPRVVWDDGSKINESSCVSCGHCVTVCPVNALMEKTMIGNAGYLTDLDTETKNTMIDLVKAFEPIITMRPVMAISNIESKMRETRIRKTKTVCTYCGVGCSFEMWTVGRKILKVQPKPESPANGISTCVKGKFGWDFVNSPDRLTEPLIRDGDRFRMASWDEALDLIASRLREIKEKYGPDAIEFIASSKGTNEEAYLVQKLARQVFGTNNVDNSSRFCQAPATTGLWRTVGYGGDAGSISDLYVSDLILAVGTNTAESHPVIATRIKRAHKLNGQKIIVADLRMHEMARRADVFIHPRPGTDLVWINAVAKYIVDQGWQAREFIEKRVNFYDEYVKSLEPFTLEFAEKVSGVSADDIRKIATMIHEAKSMAVIWAMGVTQHQAGSDTSTALSNLLLLTGNYGRPGTGGYPLRGHNNVQGASDFGAMSAYLPGYQSVSDEKARKKIEEYWKCQIPDKPGYDNNTCLEAINSDRIRAMYVVGEELVETGSDSEYIRKQLEKLDFLVVEDMFLSETAKYADVVLPAAASVEKEGTFVNTERRIQRIYRVMEPLGNSRPDWQIIQDVANRLGAGWNYRHPSEIMQEVSKIAPIFAGVSYERLEGFGSLQWPVSDGGKDTPLLYTDRFNFPDGKARFYPLKYSPPLTVDQEFDLHLNNGRILEHFHEGNETYRSPGLKEKVPGTFVEVSPELAAERGLKDGDLVRITSKWGSIKVRVLVTDRVSGKELYMPMNSGGDSAVNNLTSRLMDPTAHTPAYKELPVKMEKIEGGHGESPMPRTNPRYGKPHPQRGVMVEEKWKRSDYIKLTGD

SEQ ID NO: 39331 - protein, 565 aa, Sorghum bicolor
MALLLASAINHTAHPAGLRSHPNNESFSRHHLCSSPQNISKRRSNLSFRPRAQTISSESAGIHRLSPWEIPRRDWFPPSFLFGAATSAYQIEGAWNEDGKGPSTWDHFCHNFPEWIVDRSNGDVAADSYHMYAEDVRLLKEMGMDAYRFSISWPRILPKGTLAGGINEKRVEYYNKLIDLLLENGIEPYITIFHWDTPQALVDAYGGFLDERIIKDYTDFAKVCFEKFGKTVKNWLTFNEPETFCSVSYGTGVLAPGRCSPGVSCAVPTGNSLSEPYIVAHNLLRAHAETVDIYNKYHKGADGRIGLALNVFGRVPYTNTFLDQQAQERSMDKCLGWFLEPVVRGDYPFSMRVSARDRVPYFKEKEQEKLVGSYDMIGINYYTSTFSKHIDLSPNNSPVLNTDDAYASQETKGPDGNAIGPPTGNAWINMYPKGLHDILMTMKNKYGNPPMYITENGMGDIDKGDLPKPVALEDHTRLDYIQRHLSVLKQSIDLGADVRGYFAWSLLDNFEWSSGYTERFGIVYVDRENGCERTMKRSARWLQEFNGAAKKVENNKILTPAGQLN

SEQ ID NO: 39332 - protein, 336 aa, Triticum aestivum
  misc_feature (135)..(135): Xaa can be any naturally occurring amino acid
  misc_feature (190)..(190): Xaa can be any naturally occurring amino acid
MAPLGDAVAPASAAAPGLVVSFGEMLIDFVPDVAGVSLAESGGFVKAPGGAPANVACAISKLGGSSAFIGKFGDDEFGHMLVEILKQNGVNAEGCLFDQHARTALAFVTLKSNGEREFMFYRNPSADMLLTEAEXNLDLIRRARIFHYGSISLITEPCRSAHVAAMRAAKSAGILCSYDPNVRLPLWPSXQAARDGIMSIWKEADFIKVSDDEVAFLTQGDATDEKNVLSLWFEGLKLLIVTDGEKGCRYFTKDFKGSVPGYSVNTVDTTGAGDAFVGSLLVSVSKDDSIFYNEAKLREVLQFSNACGAICTTKKGAIPALPTTATALELISKGSN

SEQ ID NO: 39333 - protein, 565 aa, Sorghum bicolor
MALLLASAINHTAHPAGLRSHPNNESFSRHHLCSSPQNISKRRSNLSFRPRAQTISSESAGIHRLSPWEIPRRDWFPPSFLFGAATSAYQIEGAWNEDGKGPSTWDHFCHNFPEWIVDRSNGDVAADSYHMYAEDVRLLKEMGMDAYRFSISWPRILPKGTLAGGINEKRVEYYNKLIDLLLENGIEPYITIFHWDTPQALVDAYGGFLDERIIKDYTDFAKVCFEKFGKKVKNWLTFNEPETFCSVSYGTGVLAPGRCSPGVSCAVPTGNSLSEPYIVAHNLLRAHAETVDIYNKYHKGADGRIGLALNVFGRVPYTNTFLDQQAQERSMDKCLGWFLEPVVRGDYPFSMRVSARDRVPYFKEKEQEKLVGSYDMIGINYYTSTFSKHIDLSPNNSPVLNTDDAYASQETKGPDGNAIGPPTGNAWINMYPKGLHDILMTMKNKYGNPPMYITENGMGDIDKGDLPKPVALEDHTRLDYIQRHLSVLKQSIDLGADVRGYFAWSLLDNFEWSSGYTERFGIVYVDRENGCERTMKRSARWLQEFNGAAKKVENNKILTPAGQLN

SEQ ID NO: 39334 - protein, 214 aa, Synechococcus sp. WH 7805
MPPALSHRQALRMMECSYLAAAAALIWLALYYLPVGGSLFRLALPLPLALLTVRRGSRAGLEGLAVSILLLMALMGPVRGPLMLFPYGLLSLWLGWCWQHRQSWWISWGFGLVIGAAGFLVRVVALSLLVGENLWVVITRAGAGLLDRLLELLQLPLAPDLLLVQVMALVLVVIQQLIYVLALHALAYWIFPRLQAPVPEPPRLLNGLVALDPL

SEQ ID NO: 39335 - protein, 437 aa, Petunia x hybrida
MNTNRAVLVPHRGEVGGKQKNGQADGRNNRRVLGDIGNLVTGAPVIEGKPKAQISRPATRSFCAQLLANAQAEKNKVKPLAEVVNKVPAKKKASDKPAVQEAVIVISPDEEVKKKTIEKSPLSKRKAKKTGKTLTSTLTARSKAACGLSNRPKNEIDDIDAADAANHLAVVEYVEDIYNFYKLTEDESRVNNYMEFQPELNHKMRAILVDWLIEVHRKFELMPESLYLTINILDRFLSMKTVPRKELQLVGISAMLIACKYEEIWAPEVNDFMHISDNVYTRDHILQMEKAILGKLEWYLTVPTPYVFLVRYIKAAMPSDDQEIQNMAFFFAELGLMNYTTTISYCPSMLAASAVYAARGTLNKGPLWTPTLQHHTGYSEEQLMECTKQLVSYHKGAAESKLKAIYRKFSSPDRGAVALFPPARNLLPTTTTTTTSS

SEQ ID NO: 39336 - protein, 173 aa, Vibrio vulnificus YJ016
MAGSSVIVMGVCASGKTTIGELLAEKLGRKFIDGDDLHPRANIQKMASGQPLNDHDRKPWLERIRDAAYSLESKNEHGIIVCSALKKSYRDQIRDGNNNVTFLFLDGDKSLILERMRQRQGHFMKENMVNSQFETLERPDGEPRTLLVSIDTTIEDVVANAAELILEQDEAQA

SEQ ID NO: 39337 - protein, 620 aa, Ustilago maydis 521
MAPSLHRSVGGIRTLGIRSSRPQPEIAISDLLSNSAAAQGIRAALPNSLARTVQSEAAVGRSWFRSSSASQRASSLSDNSDGQAGEPRVARKQRGRRWLRRSGMLVAALGVVYIVDEYINARTAQRNLLTAWTGLQIAMDYKLNFDRNSLESINALHERCADKLMYVCEKNQGLYVKLGQAIGCQAAILPKPYHQLTKLFDNAERLPYEQVRKVLIDELGADPKEVFAEFDEVPVAAASVAQVHRARLKPPPGSAPGTLGPEVAVKVQRPNIRKYAKWDLWSFRVLLKLYERIFELPLSFSGQYISDQIEQETFFDRELANSLRAKTAIETDPVGLVRRTCYVPQFYKQFCTPRVLVMEWIGNTCRMTDRDKLDEWGLSAKQVSRSVCEAFASQIFQHGFVQADGHPSNVLVRQHPNGKKGQHQVVLIDHGLYVELSEDFRRKYAQLWKAIFTLDLKTLDEITVSWGMGQGSSELFASATLLRPWSKPKSKDEANKLGEHAPKTDLELQREIKDKLKIFLEHTELLPKELLFVSRSMRIIQANNQVLGSPVNRLNILAKHAAAALISSTDTPSLYRVFRPIRSNTALKDTSIGQRFSTWIKDRFDFLLCQSSGVGLDGEN

SEQ ID NO: 39338 - protein, 451 aa, Vibrio vulnificus YJ016
MATHFDYICIGGGSGGIASANRAAMYGAKVALIEAKDLGGTCVNVGCVPKKVMWHGAQIAEAMSLYAPDYGFDVEVKGFDWSKLVESRQAYIGRIHQSYDRVLGNNKVNVIKGFAKFVDEKTVEVNGEHYTADHILIAVGGRPTIPNIPGAEYGIDSNGFFDLAEQPKRVAVVGAGYIAVEIAGVLNALGTETHLFCRKESPLRSFDPMIIDTLVEVMAAEGPTLHTHSVPKEVVKEADGSLTLHLENGESQNVDQLIWAIGRHPATDAINLSATGVATNERGYIKVDEFQATNVAGIYCVGDIMEGGIELTPVAVKAGRQLSERLFNNKPNAKMDYDLVPTVVFSHPPIGTIGLSEPEAIAQYGKENVKVYTSGFTAMYTAVTQHRQPCKMKLVCAGEDEKVVGLHGIGFAVDEMIQGFGVAMKMGATKADFDSVVAIHPTGSEEFVTMR

SEQ ID NO: 39339 - protein, 635 aa, Synechocystis sp. PCC 6803
MVTTPTAAPRKPSKVEGIKERSNYLREPLATELLNDANYFTDDAVQILKFHGSYQQDNRDNRVKGQEKDYQFMLRTRNPGGLIPAQLYTALDDLSKTHGNQTLRVTTRQGLQIHGIVKKDLKMAIATVVNNLGSTLGACGDINRNVMAPAAPFRDKPEYGYAWDYANKVADLLSPQSGAYYEIWLDGEKVISGEEAPEVKAARQKDLNGTNLNDPKEPIYGQQFMPRKFKISVTVPGDNSIDVYTHDISLVVITDRHGELRGFNVLAGGGLGRTHNKEETFARAADPIGYVSKDDVYDLVKAIVATQRDYGDRHNRRHARMKYLLADWGVEKFRKQVETYMGKPFQSFKPLPAWRYQDYLGWHEQGDGKLFFGLSVENGRIKDEGDFQLKTALRKVVDQFQLPLRLTANHNILLYDINAQDKAAIEQIFQQHGVVTDPEAIDTLVRYSMACPALPTCGLAVTESERIMPSVNARLRDLLNSLDLPNESIVTRMTGCPNGCARPYMAEIGFVGSAPNSYQVWLGGSPNQERLAAAYTEKMPLEQLESLFEPLFVYFKQSRKGKESFGDFCHRVGFTALREFSHGYTAPAKGGKNRKNQRRVSLSDEMYAQLKARSERDNCPMNQIVQQALTAYLGK

SEQ ID NO: 39340 - protein, 1221 aa, Azoarcus sp. BH72
MRFDADVPEAPGALRAAITAATRRDEADCVHALVAELQQRRARLGLDDAAVEARAAALVVDVRRRRRGAGGVDQLMHEFSLSTQEGVALMCLAEALLRIPDHATADRLIRDKIGQGDWRTHLGHSESLFVNAATWGLLISGRLVATRSERALGSALSRLLARGGEPVVRRGVDFAMRLLGQQFVLGETIGAALRRSRDSESRGYSHSFDMLGEAALTAADAERYTRAYEEAIHAIGAAAAGHGPRAGPGISIKLSALHPRYCRAQRSRVRAELLPRLAALMRLARGYDIGVNIDAEEADRLELSLDLFEALVADPLLAGWDGLGFVVQAYQKRAPFVIDYLVDLAHRSGRRLMIRLVKGAYWDSEIKRAQVEGQAGYPVYTRKAHTDLAYLVCAARLLAEAGAVYPQFATHNARTVAEVHEMAQCVGAGGTLPAYEFQCLHGMGESLYDSVVGGARLGVPCRIYAPVGSHRTLLPYLVRRLLENGANSSFVNRIVDDSMPVAALAADPLQAVLAGDVTPHPSIPLPAGLYGPERRNSAGLDLASDAVLAALEAALVARAGEPRRAQPLLGSGKLDEAAARQRARPVCNPADHADIVGSVVEALPDEVEAALAAAAAAAAGWAAVPPAARADALRAAADRFEAQQAALVSVLVREAGKTWGNAVAEVREAVDFCRYYAQQVVTLPAPTQAAPLVCISPWNFPLAIFVGQLSAALAAGRCVLAKPALATPLTAALAVELMHAAGIPRAALQLLPGRGGSVGQTLARDPRIGGVLFTGSTDVARGLARWLAERGAGPEPCLIAETGGQNAMIVDSSALLEQVVQDVLVSAFDSAGQRCSALRVLCVQRDIAEPLLTMLKDAMGELRIGDPAALATDIGPVIDNAARDALEAHVARMQAAGRGVFRVPLPPACENGSFVAPTLIEIDGIGDVGREVFGPILHVLRFDAEGLDRLIASINATGYGLTGGLHSRIDETVERVVAGLRVGNLYVNRNMVGAVVGVQPFGGEGLSGTGPKAGGPLYLHRLLGTAQLDPAALGLVAPAEPAAALGVLAAWARQRGDSALAARCAEDGARSLAGCHCALPGPTGEANTLRFVGRGVVLCVADSAPALLAQLAAALATGNSALFEAGAAAYRVAAELPSALGGWLGVRGHGPDPVFAVALFDGDTEAEWLLRRRLAERPGPLVAVLRADGAGRYPLHRLVAERVVSINTAAAGGNAALMTLG

SEQ ID NO: 39341 - protein, 416 aa, Carboxydothermus hydrogenoformans Z-2901
MKKFKVTNKFLQKSLYVLSIIGPGLITVNAGNDAGGIATYAAVGALYGYRMLWGLLLITFSLAVIQEMNARMAVVTGKGLSDLIRENFGVKVTFLAMVILFVANLGVCIGDFAGIAASLELFGVAKFVSVPLMAFFIWYVIIKGSYSRLEKILLLFTVVFFSYIITAFVVKPNWSEVFKATVIPSIIPRKDYILTFIGMIGTTITPYMQFYLQGSIADKGLSLKDYKYEKLDVYFGAFWGDLVSFFIIVTTAATLYKAGIKIETAQDAALALKPLAGQYASLLFGIGLLGASILAAIVIPLSTAYAVTEAFGFERGLDKSFGEAPVFYGIFTFMIFISALLILLPKISLVGIMLATQQLAGILSPIILILMVLLTSKKELMGELVNNRLQSIIVWVTVIFIIILTITLVMASFFNF

SEQ ID NO: 39342 - protein, 593 aa, Oryza sativa (indica cultivar-group)
MAMDDLAGSSSSSSAMDAVVADPSHGWQKVTYPKRHRKQGAAALPSAAAPDLGFLPNGGGKVNVFEAVDRNAEKRHRALLAARDAADPDAARIAAATASAYSDDDDDSDEAQATRPEGEVKKPKVKKPKKPKVTVAEAAALIDAENLAAHLVQISESYENQQDIQLMRFADYFGRSFASVSAAQFPWAKMFKESLVSKMVDIPLCHIPEPVRNTASDWINQRSPDALGDFVMWCIDSIMSELSGQAVGAKGSKKAAQQTPRAQGPEDCMVVAIFVVLALTVRRKPEVLTNVLPKIMGNNKYLGQEKLPIIVWVIAQASQGDLVTGMFCWAHFLFPTLCAKPSGNPQTRDLVLQLLERILSAPKARGILLNGAVRKGERLIPPVTFDLFMRAAFPVSSARVKATERFEAAYPTIKELALAGPPGSKTVKQAAQQLLPLCVKAMQENNADLTGESAGVFIWCLTQNAESYKLWERLHPENVEASVVVLSTIVTKWSELSHKLSAESLKVTLKNLRTKNEAALEAATDSGKQASIKAADKYSKEILGRLSRGGACLKGSLLVITLAVAAGFVLSPNLEIPSDWDKLQAMVASHLSF

SEQ ID NO: 39343 - protein, 242 aa, Pisum sativum
MFFIYLKLQGYAAREFVKQGVHPGELAIISKEAVAPYERPALSKAYLFPESPARLPGFHTCVGSGGERLLPEWYSEKGIQLYLSTEIVSADLAAKFLKSANGEHFDYQTLVIATGSAVIRLTDFGVIGANAKNIFYLREVDDADKLYEAIKRKKNAKAVVVGGGYIGLELSAVLKLNDLDVTMVYPEPWCMPRLFTSEIAAFYEGYYANKGINIIKGTVAVGFTANSDGEVKEVKLKDGRVL

SEQ ID NO: 39344 - protein, 426 aa, Hyphomonas neptunium ATCC 15444
MSEIIDIHAREILDSRGNPTIEVDVTLDDGSTGRAAVPSGASTGAYEAHEQRDGDKARYNGKGVLKAVDAVNGEICNELAGMDATEQRLVDTLMIDLDGTENKSRLGANAILGVSLAVAKAAAESSALPLYRYLGGANARILPTPMMNIINGGAHADNPVDIQEFMIMPVSAESISEAVRMGAEVFHALKKTLHDAGHNTNVGDEGGFAPNLASADEAIGFIMKSIEKAGYRPGEDIALALDAASTEFYKNGKYELAGEGKSLSSEQFGQYLADLCGRYPILSIEDGMAEDDWDGWVALTELLGDRVQLVGDDLFVTNPDRLAIGLQKGAANSILVKVNQIGTLSETLDAVELAHLHGYTAVMSHRSGETEDSTIADLAVATNCGQIKTGSLSRSDRIAKYNQLIRIEEELGPIGMYAGLARINAG

SEQ ID NO: 39345 - protein, 391 aa, Synechocystis sp. PCC 6803
MQFADRLNAFGGNVFADMDLAKAQARAQGQTIIDLSLGSSDLPTPAPILATIAKALEDPSTHGYLLHQGTLPLRQAIAVWYEKRFGLAVDAETEVLPLIGSQEGTAHLPLAVLNPGDVALLMDPGYPSHMGGVYLAGGEIYPMALRSENQFLPVFTAIPNSVLAKAKMTVLSYPHNPTTAIASLEFFQTAVQFCRDHDLVLVHDFPYMDLVFDGIAMPPSVLQADRQKSCAIEFFTFSKSYNMGGFRIGFAIGNIQLISALKKIKAVVDFNQYAGILQGAIAALESPPETVQQTVQIFAQRRATLIDALAKIGWAVPLPTATMYVWAPLPESWLGNSLEFCQKLVAKTGVALSPGSGFGAGGEGYVRFALVQEPDILATAAKKIGQFLDQN

SEQ ID NO: 39346 - protein, 486 aa, Pseudomonas putida
MKDIRNFINGEYVTNVSGKTYEKRNPVDNSLIGMVHEAGQPEVDAAVAAARAALNGPWGKLSVVDRCAMLDGVVAEINRRFDDFLQAEIADTGKPAHLASHIDIPRGAANFKIFTDTIKNVSTESFEMRTPDGKTARSYGVRTPRGVIAIICPWNLPLLLMTWKCGPAMACGNTVVVKPSEATPSTATLLGEVMNKVGVPPGVYNVVNGFGVNSAGSFLTAHQGVNGITFTGETKTGTAIMKAGADGIRPVSLELGGKNAAVVFADCDFENALATVTRSAFENCGQVCLGTERVYVERPIFDKFVSALKERAAAIKPGRPFDADTKIGPLVSKIHQKKVLSYYAKAKAEGANIVLGGGVPNMPDDLKDGCWVEPTIWTGLPESSPIVREEIFGPCCHIQPFDTEEEVLNMVNDSPYGLATSIHTQDISRASRLATQIEVGLCWINSWFLRDLRTPFGGSKQSGIGREGGLHSLEFYTELRNVMIKY

SEQ ID NO: 39347 - protein, 565 aa, Sorghum bicolor
MALLLASAINHTAHPAGLRSHPNNESFSRHHLCSSPQNISKRRSNLSFRPRAQTISSESAGIHRLSPWEIPRRDWFPPSFLFGAATSAYQIEGAWNEDGKGPSTWDHFCHNFPEWIVDRSNGDVAADSYHMYAEDVRLLKEMGMDAYRFSISWPRILPKGTLAGGINEKGVEYYNKLIDLLLENGIEPYITIFHWDTPQALVEAYGGFLDERIIKDYTDFAKVCFEKFGKTVKNWLTFNDPETFCSVSYGTGVLAPGRCSPGVSCAVPTGNSLSEPYIVAHNLLRAHAETVDIYNKYHKGADGRIGLALNVFGRVPYTNTFLDQQAQERSMDKCLGWFLEPVVRGDYPFSMRVSARDRVPYFKEKEQEKLVGSYDMIGINYYTSTFSKHIDLSPNNSPVLNTDDAYASQETKGPDGNAIGPPTGNAWINMYPKGLHDILMTMKNKYGNPPMYITENGMGDIDKGDLPKPVALEDHTRLDYIQRHLSVLKQSIDLGADVRGYFAWSLLDNFEWSSGYTERFGIVYVDRENGCERTMKRSARWLQEFNGAAKKVENNKILTPAGQLN

SEQ ID NO: 39348 - protein, 527 aa, Prochlorococcus marinus str. MIT 9312
MNEELNSWDKFCNYLWFDKKLNIWLDISKIIFTNDDIVTLEEKFTDVLSSIKELENGAISNIDENRQVGHYWLRNPSISPSSNIGEEISADINEISEFGKQILNGNIKNKNNQKYTDVLWIGIGGSGLGPLLITESLQKCSKGLNFSYIDNVDPFLISEKLEELAEKLSTTLFVVVSKSGGTPEPRIAMEIIKSHCENNSLEWNSNAIAITMKDSKLFNKAISENWLKIFNLQDWVGGRTSITSSVGLLPLALINENIFEFIRGASLMDEATRTSDFKNNPAALLSSAWYLTGDGVGKRDMVVLPYRDRLQVFSKYLQQLVMESLGKKFNRNGEVVNQGISVFGNKGSTDQHAYVQQLRDGIDNFFCIFIELLDSPSTNIFDGKENPKEYLSGFLQGTRSALSSENRQSITITLEKLNCFSLGALIALFERSVSFYAELVNINAYDQPGVEAGKKAAANIIDYQQKVSNLLEKGGEYSINEITSLIDNSVSEPIFFILREMCFGNEDYLVKGDWSNPNSLVIQKRNS

SEQ ID NO: 39349 - protein, 322 aa, Thermoplasma acidophilum DSM 1728
MDWELELHSKVEEVNARLLETVKSEEPDLDRMARYTIEAGGKRFRPLLTILAYESSTDEPYFKILDLATGYELIHTASLIHDDIIDNSPMRRGRPTLSYKEGVNNAIVVADYLFAKAYELGSRYGPIVSKVMADASSRLAEGQILEAVNLGNLNISEDTYYRIIENKTAHFFEACARGATIAANADLNTRNMLSGFAFNLGMAFQVTDDILDITGDDKYTGKPTFVDIKHDALTLPIIYALHNSDENDRDKIVGMINGSIEIDKDLLKRIFLRSGAIDYSFGIAKRFITSAMDYLKNVTRSPDIDLLMELALMVIDRIEIYG

SEQ ID NO: 39350 - protein, 406 aa, Oryza sativa
MAAAATTSSHLLLLSRQQAAASLQCGLSFRRQPGRLAGGSSAPSVRCMAAVDTASAPAATEASKKSSYEITTLTTWLLKQEQAGTIDGEMTIVLASISTACKQIASLVQRAPISNLTGVQGAVNVQGEDQKKLDVVSNEVFSNCLKSSGRTGVIASEEEDVPVAVEESYSGNYIVVFDPLDGSSNIDAAVSTGSIFGIYSPNDECLADIADDQNLDQVEQRCIVSVCQPGSNLLAAGYCMYSSSVIFVLTIGTGVYVFTLDPMYGEFVLTQEKVQIHKAGKIYAFNEGNYALWDDKLKSYMDSLKEPGPSGKPYSARYIGSLVGDFHRTLLYGGIYGYPRDQKSKNGKLRLLYECAPMSFIVEQAGGKGSDGHQRILDIMSTEIHQRVPLYIGNVEEVEKVEKFLA

SEQ ID NO: 39351 - protein, 732 aa, Oryza sativa (japonica cultivar-group)
MAFLGWAVDIARDSGASSSVVLTCDGYGSALYFSPWDSVPLPATASPDDGFLLPRFPDVCVQRSQFTNHLAPANGTGGGGSRTGVKEEASEVLSWPPTSKQSVRRLEVAEHWYRLYKTDNQRLSPDSQQVSVLAESHCDLASGNWKEISIHHKKMPSSTTTKTTTPSRDAWIVSARSDPFHLLLEAQAPLGIKADALSQIAAVHQSHRNTSHIRELSLAMDNAYIIAILSVAILFLLHYYLLGRGNGGAARLPPGPPAVPILGHLHLVKKPMHATMSRLAERYGPVFSLRLGSRRAVVVSSPGCARECFTEHDVTFANRPRFESQLLVSFNGAALATASYGAHWRNLRRIVAVQLLSAHRVGLMSGLIAGEVRAMVRRMYRAAAASPAGAARIQLKRRLFEVSLSVLMETIAHTKATRPETDPDTDMSVEAQEFKQVVDEIIPHIGAANLWDYLPALRWFDVFGVRRKILAAVSRRDAFLRRLIDAERRRLDDGDEGEKKSMIAVLLTLQKTEPEVYTDNMITALTANLFGAGTETTSTTSEWAMSLLLNHPDTLKKAQAEIDASVGNSRLITADDVTRLGYLQCIVRETLRLYPAAPMLLPHESSADCKVGGYNIPRGSMLLINAYAIHRDPAVWEEPEKFMPERFEDGGCDGNLLMPFGMGRRRCPGETLALRTVGLVLGTLIQCFDWERVDGVEVDMTEGGGLTIPKVVPLEAMCRPRDAMGGVLRELV

SEQ ID NO: 39352 - protein, 371 aa, Bacillus cereus ATCC 14579
MSKRDYYEVLGLSKGASTDEIKKAYRRLAKKYHPDVSKEENAIEKFKEVQEAYEVLSDDQKRAQYDQFGHAGANQGFGGFGGGGDFGGGFGFEDIFSSFFGGGGGRRRDPNAPRQGADLQYQVTLDFEEAIFGKELNVEIPVEDPCDTCKGSGAKPGTSKETCKHCSGSGQVSVEQNTPFGRIVNRQACGHCSGTGQIIKEKCTTCHGSSKVRKRKKINVKIPAGIDNGQQIRVSGKGEAGVNGGPARDLYVVVHVRNHEFFEREGDHIICEMPLTFAQMALGDEVEVPTVHGKVKLKIPAGTQTGTEFRLKGKGAPNVRGYGQGDQYVVVRVVVPTKLTSQQKDLLREFAGQEEQDDSLFGKLKRAFKGE

SEQ ID NO: 39353 - protein, 207 aa, Clostridium thermocellum ATCC 27405
MKLKLNLNLNNARFEITAVRPEQYPKNDLPEITFVGRSNVGKSSLINTMLNRKNLAKVAATPGRTRVINFYNIDDKLYFVDLPGYGFAKVPKTMKTGWKDIIETYLIERKQLKKVIMLVDIRHSPTSDDVLMHEWLKAMRKSYVVVATKLDKIPRTKIKERISDIRSILKLEDDVKIIPFSSETRQGRDELWDEILDESYFVESYFS

SEQ ID NO: 39354 - protein, 267 aa, Oryza sativa (japonica cultivar-group)
MDPKLVEVTQLFSRFKAAFARNDFDTCVDLLSQLKVRLTKFPSLPPSFQQTPNAVEELKIARDIYEHAVVLSVKIEDQDAFERDFCQLKPYYMDTCGIIPPSPQEYPILGLNLLRLLVQNRIAEFHTELELLPVTALENPCIKHAVELEQSFMEGAYNRVLSARQAVPHETYVYFMDLLAKTVRDELAGCSEKGYDYMSIAEARQVLMFSSDKELHQYIAEEHPEWEVKDGSVFFQKAKETQPCKEIPSLQVINQTLSYARELERIV

SEQ ID NO: 39355 - protein, 311 aa, Colwellia psychrerythraea 34H
MAKSPQQPVIQSILDDAYHKFENDTSGKNADYIPALAKVDSAYFGLAVVTPHGKIYTKGDVSQPFSIQSISKVFTLALAMEQKGPQTIVDKIGVNATGLAFNSVTAIELNKARSVNPLVNAGAIATVSLLDGKNEKAKWSALSAWYDKFANRKLSVLEDVYKSESDTNGHNRAIAELLTSYDRFYGDVDLNLAIYTRQCSVAVTTKDLAVMASVFANNGVHPLTDKRLMSSDNVSRVLAVMTTAGLYENSGQWAYQVGLPAKSGVGGGIIAVSPGKFAVAVFSPRLDSAGNSIRAQKAIDYIAEKLHANIF

SEQ ID NO: 39356 - protein, 541 aa, Rickettsiella grylli
MNGAPSRFTHSDEWKNLKQHASDLKKIPLTELFLNDPFRAKTFSLTEKPLTVDYSKNPILEKTLTLLIQLADRLHLKQKINDLFQGACVNTTQHLPALHTALRNPHKKGLLINGEDILVKIHTNLDKMQQFVDAIHQHRWRGWSGKKITDIIHLGIGGSDLGPRMVVHALKKTWKENSINLHFISPIDDSLSYLIKKINLETSLFIITSKSFRTHETLSSATQLFKHFQEKYGAQSTKRHFLAVTHHIEKAIAFGIDPAHIFPLWNWVGGRYSLWSAVGLPIALAVGMSNFRTLLQGAYTMDQHFLNQPWRTNLPVILGLLGVWQVNFFQTSAHAILPYDTRLHYLPAYLQQLEMESNGKSISIHGKPIDYATCPIIFGAHGLNAQHTFYQLFHQGTAHFSADFICTLRDPSMNINDHRQVISSVLSQSKVFMEGYVSDNGYQCLPGNHANTILALNELNPFSLGLLIALYEHKVFVQSVIWQINPFDQWGVEYGKQLNKTIYQQLNNTDTSLMTPLDSSTRAFIERFQTLNCSLKHTRKI

SEQ ID NO: 39357 - protein, 355 aa, Methanosarcina acetivorans C2A
MSKNICFIDGLEGVLKYREVDINELVKLPYDAVSYLLIRGRLPGEQELAEYSARLHAERRINKEVIDVIRMCNFNIDAMAALRTVISFISQFDPDLNDSSPEGNMRKAIRLIAIVPTIVATYYRMANGKEPLPPDPSLSHGANFLYMIKGSKPDPLDAEVMEKDFILSAEHELNASTFSSRVTASTMSDLYSAVVSGLCTLKGPLHGGARAEVMTMLDEVASPENAEKFVLEKISQREKIMGFGHRVYKTYDPRGVIFKQLSKKLAESKGDMHWYTTAEAVENVVVRELVEKRGKPIYPNVDFYSGVIYKYMEIPPQLATSIFAIGRVSGWIAHCFDQYERKKIIRPRAFMLDEC

SEQ ID NO: 39358 - protein, 520 aa, Coccidioides posadasii
MGLLANVLTGVSKACSGQSLWTLVLLGICAFFTLSVFVNVLKQVFFKNPNEPPVVFHWFPIIGSTISYGIDPYKFFFSCQKKYGDIFTFILLGKKTTVFLGTKGNDFILNGKLKDVCAEEVYSPLTTPVFGRHVVYDCPNAKLMEQKKFVKFGLTSEALRSYVTLITREVESYLENSPAFQGDSGVFNVAKSVAEITIYTASRSLQGKEVRDKFDSSFAELYADLDMGFAAINFMFPWAPLPHNRKRDRAQQKMTQVYTDIIRERRKAGGKKDSEDMVWNLMSSVYKDGTPVPDVEVAHMMIALLMAGQHSSASTGSWIVLRLASRPDILEELYQEQLRVLGPDLPPLTYESLQRLELHSNVIKETLRLHAPIHSILRAVKSPMPVDGTKYVVPTSHNLLAAPGVPSRMADYFPEPMLWDPHRWEKGGGVNATGVQDEAAEEKVDYGYGLVSKGANSPYLPFGSGRHRCIGEQFAYVQLGTITAALVRALKLRKLDGDKEVPDTDYSVSLTLLFSSARSH

SEQ ID NO: 39359 - protein, 270 aa, Polaromonas sp. JS666
MKTIVITGASDGIGAEMARQLAQTHRTGVALVLAARNEALLAEVAAQCAAHGAQTLVVKTDVSVEAQCRQLIAAAVARFGRIDALVNNAGRSAQALFEDVKAEDLAWYEQLMRINLWGSVWCTHAALPHLKQSRGAIVAVSSLAGLIGVPGRTAYSATKFAMTGFFEALRAELKGAGVSVTTVYPGVVATQTRYRGFNAAGAPADASGLKEDQAMSVEECAGLILQGMARRDREVVMTAKGRLGRWLKLVAPARVESMALAALKDEVKPH

SEQ ID NO: 39360 - protein, 237 aa, Hyphomonas neptunium ATCC 15444
MTKLALIRHGQSAWNLENRFTGWWDADLTAQGEAEARHSGKLLAEVDADFRAGFTSVQTRAIRTMWLALTEMKRVWLPIEKDWHLNERHYGGLTGLNKAETAAKHGEDQVHVWRRSYDIPPPPLEVGSTFDLSTDPRYRGIDIPNTESLKTTLDRVLPYWQQKIAPGLIAGTDTMIAAHGNSLRALVKHLFNVPDETITGLEIPTGNPLLIELDPNLKPVSVRYLDAERAHSLPDLP

SEQ ID NO: 39361 - protein, 512 aa, Thermoplasma acidophilum DSM 1728
MKALVEDDLFSKIGLDDVNSGVYDGEWVKPSGKMLTVKSPIDGSEVAKISLATRADYDRLVSRAIEEFKKWRMIPAPKRGLIIREIGDELRKEKKNLGKIVTIEAGKTPSEGEGEIQEMIDISDLALGLSRQLYGLTIASERPYHRMYEQWVPLGPVAVITSFNFPASVWSWNAFIAAVDGDVVIWKPSSKAALTAVAVMKVIERVLKRNNAPNIFFLMVSSGSEGGDWITNDPRIPLVSFTGSVPVGKKISENVAKRLGKSILELGGNNGAIVSDKADIDLALRGVVFGALATAGQRCTTTRRVIVQEKIYDQFLEKLKNAYSTIKVGDPREKGVLVGPLIDEDAVKDYEHAIDLAIKQGGKLIFGGKRITIKGLEGGHYVMPTIIEAKPDMPIVKEETFASILYVMKYRTIEEAIEIHNSVPQGLSSSIFTTDLREEEAFLSPYGSDCGLANVNTSTAGAEIGGAFGGEKDTGGGRESGSDAWKYYMRRQTVTKNWGQTLPLAQDVVFEF

SEQ ID NO: 39362 - protein, 146 aa, Pisum sativum
MGFTDKQEALVNSSWELFKQNPGYSVLFYNIILKKAPATKGMFSFLKDSAGVVDSPKLQAHAEKVFGMVHDSAVQLRVSGEVVLGDATLGAIHIQKGVVDSHFVVVKEALLETIKEASGEKWSEELSTAWEVAYEGLASAIKKAMS

SEQ ID NO: 39363 - protein, 525 aa, Zea mays
MERVLKDDAVEEKGERARMASFVGAMAISDLVKTTLGPKGMDKILQSTGRGRNVTVTNDGATILKSLHIDNPAAKVLVDISKVQDDEVGDGTTSVVVLAGELLKEAEKLINMKIHPMTIIAGYRMALECARDSLLKKTMDNKENTDKFRSDLMNIAMTTLSSKILSQDKEYFAELAVDAVLRLKGSTNLESIQILKKPGGSLKDSFLDEGFILDKKIGIGQPKRIENAKILVANTAMDTDKVKIYGARVRVDSMSKVADIEAAEKQKMREKVQKIIAHGINCFVNRQLIYNFPEELFADAGILAIEHADFEGIERLALVTGGEIASTFDNPESVKLGHCKVIEEIMIGEDRLIHFSGVAMGQACTIVLRGASEHVLDEAERSLHDALCVLSQTVNDTRVLFGGGWPEMVMAKEVDELARKTPGKKSHAIDAFSHALQAIPTIIADNAGLDSADLISQLRAEHHKENSTAGIDVITGTVGDMQKLGIQESFKVKQAILLSATEAAEMILRVDEIITCAPRRREDRM

SEQ ID NO: 39364 - protein, 187 aa, Triticum aestivum
MRPPRGGGGFRERGGDQGGRFGGGGRGRGRFGGGGGGFRDEGPPAEVVEVSTFLHACEGDAVTKLTNEKVPYFNAPIYLQNKTQIGKVDEIFGPINESYFSVKMFEGVIATSYNEGDKFFIDPMKLLPLSRFLPQPKGSTPRGGGRGGRGGGRGGFGGRGGFRGRGAPRGRGPPRGGGRGFRGRGRF

SEQ ID NO: 39365 - protein, 146 aa, Pisum sativum
MGFTEKQEALVNSSWELFKQNPSYSVLFYTIILKKAPAAKGMFSFLKDSAEVVDSPKLQAHAEKVFGMVHDSAIQLRASGEVVVGDATLGAIHIQKGVVDPHFVVVKEALLETIKEASGEKWSEELSTAWEVAYEGLASAIKKAMN

SEQ ID NO: 39366 - protein, 214 aa, Zingiber officinale
GSVAQQVDGDNPNLYFRKEGVLLCVLPLFHIYSLNSVLLCGLRVGAAILLMRRFEISAMLELVQLHRVTVAPFVPPIVLEFVKSSLVDGYDLSSIRIVMSGAAPMGKELEDKFMGKLPNATLSQVDTSLIECMQNPSPCSDLLMNNVGLNRGTGYRKQGRCWRLCLAFAREPFPVKSGACGTVVRNAELKIVDPDTGRPLGRNKSGEICIRGRH

SEQ ID NO: 39367 - protein, 325 aa, Triticum aestivum
  misc_feature (132)..(132): Xaa can be any naturally occurring amino acid
  misc_feature (189)..(189): Xaa can be any naturally occurring amino acid
MLFARRDIEAAGAGAGAGQDGSPAAKKGKPESAAAADVARPTLTRTEALGAAAVLALFVAGIFCIFLAAPRREFGQILRLPRSLADVRLLKDNLAVYASEHQANLVLGYCSIYIFMQTFMIPGTIFMSLLAXGALFGVIKGGVSVVFTATAGASSCYFLSKLIGRPLVCWLWPERLRYFQSEIAKRKEXLLNYMLFLRITPTLPNTFINMASPIVDIPFHIVFAATLMGLIPASYITVKAGRALGDLRSVREWYDFKTLVVLFLIGSVAVVPTSVKERNFPGAWAKIHFYGPIPKGFNPPCRLLFPSPICVPIQLDILKRKRTCE

SEQ ID NO: 39368 - protein, 1108 aa, Prochlorococcus marinus subsp. marinus str. CCMP1375
MPRRNDIRRILILGSGPIVIGQACEFDYSGTQACKALKKEGFEVVLINSNPASIMTDPEMADRTYIEPLTTEVITKIIELEKPDALLPTMGGQTALNAAVDLAEKGILRKFKIELIGADLESINKAEDRQLFKNSMEKIGVNVCPSGIACNIEEAINVGSNIESFPRIIRPAFTLGGSGGGIAYNQEEFISICKSGLEASPASQILIEKSLLGWKEFELEVMRDNVDNVVIICSIENIDPMGIHTGDSITIAPAQTLTDREYQRLRDQSIKIIREIGVETGGSNVQFAVNPVDGEVVVIEMNPRVSRSSALASKATGFPIAKIAALLAIGYRLDEILNDITGKTPCCFEPTIDYIVTKIPRFAFEKFSGSPPILTTSMKSVGEVMAIGRSFEESFQKALRSLEIGLSGWSYDCENINISLKDIDRLLRVPSPDRLMAIKMAMYHGKSDQYINSLSNIDIWFLSKLRNIMEAENNKLLGKTILDLDYDSMFELKKLGFSDSQIGFLVGEDELRVRSFRKDLNIKPVYKTVDTCSSEFESNTPYHYSTYERTFKEIIKDGSLINKSSANEVIQNQYRKILILGGGPNRIGQGIEFDYCCCHSSFQLQKEGFQTIMLNSNPETVSTDYDTSDSLYFEPLTFEDVLNVIELENPEGIIVQFGGQTPLKLAMPILNWLDTKEGKMSGSKIFGTSPKSIDQAEDREQFEHILRELRVRQPSNGIARSISEAEKIANRISYPLVVRPSYVLGGRAMEIVYDSQELKTYMNKAVKVEPDHPVLIDEYLENAIEVDVDALSDSFGNVVIAGLMEHIEPAGIHSGDSACCLPSISLSDSSIKTIKEWTNSLAKSLNVIGLINLQFAVQRDDNGEEKVFIIEANPRASRTIPFVSKAIGWPLARLATSLLIGKTLHQIGILNEPVPPLQTIKEAVMPFRRFPGSDSVLGPEMRSTGEVMSSAKNFGMAYAKSELAAGEALPTKGIVFLSTHNRDKPALIPIARRLVDLGFGLIATSGTAEVISNAGIDVSSVLKVHEGRPNIEDVIRSGQIQLIINTPIGRQAIYDDKYLRRAALDYSVPTLTTLAGARAAVEGICALQNEPISVTALQDIHSLVTFHG

SEQ ID NO: 39369 - protein, 432 aa, Clostridium thermocellum ATCC 27405
MYTTQMDAAKKGIITDEMRIVAEKEGVHVEKLRELVASGKVVIPANKNHKKLEPQGIGEGLRTKINVNIGISKDCCNFEMELEKAKKAIELKAEAIMDLSSYGKTREFRRKLVEMSPVMIGTVPVYDAVGFYEKDLKDISAEEFFEVVEKHAEDGVDFMTIHAGINRETAKRFKENGRLTNIVSRGGSLIFAWMELTGNENPFYEQYDRLLQIFEKYDVTISLGDALRPGSINDSTDASQIQELIVLGELTKRAWEKNVQVMIEGPGHMAINEIAPNMVLEKKLCHGAPFYVLGPIVTDIAPGYDHITSAIGGAIAAANGADFLCYVTPAEHLRLPDIDDMKEGIIAARIAAHAADIAKGIKGAREWDYQMSEARRNLDWNRMFELAIDREKAERYRKSSMPEDEDTCTMCGRMCAVKNTNKALKGEKINIL

SEQ ID NO: 39370 - protein, 324 aa, Burkholderia pseudomallei K96243
MTAAVERAAGGASPARAGRVMVVGSLNMDLVVRSARLPRPGETLAGRSFAQAAGGKGGNQAVAAARLGAQVAMLGRVGADAHGAALRAGLVAEGIDCVALSVSATATTGVALIVVDDASQNAIVIVAGSNGEVTPESIAGHEAAIAAADVLICQLETPAAAVRAALAAGRRLGKTVVLNPAPAAGPLPADWLPLVDYLIPNEIEAAALTGLPVRDPASAETAARALAAAGARNVIVTLGGQGVLALTADGDARHYPAPRVAPVDTTAAGDTFIGGFAARLAARDAPHDAIRFAQRAAALSVTRAGAQPSIPTLAELDAFAPGPA

SEQ ID NO: 39371 - protein, 323 aa, Polaromonas sp. JS666
MQDWLFGSAIYFSRLFPDHSQGREPTDQDMKPITGSIVALATPLHDDGSVDYPTLRKLVDWHIAEGTDCIGVVGTTGESPTVNVEEHCEIIRVSVEQAKKRVPIMAGCGANSTAEAIELARFAKQVGADCQLQVVPYYNKPTQEGQYRHFKAIAEAVGDLPIVLYNVPGRTVADMAHATVLRLAQVPGIVGIKEATGNIERAQWLIKEVPQGFAVYSGDDPTAVALMLCGGQGNVSVTANIAPRLMHELCVAAVAGDARRAMELQFKLLPLHRNLFVEANPIPVKWAMARMGLCGGTLRLPMTPLDTSNEAAVEGALRACGLI

SEQ ID NO: 39372 - protein, 174 aa, Oryza sativa (indica cultivar-group)
MDSSNNNNNKRARDAEDEADEAKRLRAEDLLDMLDDDTDAGGAAGDLASVMRSFEEEIVAGDVAGDVAPTTQPELGFLLEASDDELGLPPATASSSEEEAGAGEPEDAIGFGGQIWGFEDEIGGGGYAGFALTSPEAVAAAAAAAEWDDDGFDAGLFGFGDEVSALRHETMPAV

SEQ ID NO: 39373 - protein, 517 aa, Agaricus bisporus
GLIGGILSLRSFQEYLGINTKNAVKKAILDGNIISVLQAGCFFGALGTGYLSSRFGRRPCLIASGIVYITGGLLQCTVGLGPSQAAALHVFYIGRFISGIGVGMVSTLVPLYISECVPRTIRGRCTGTLQFATNSGLMLGFWVNYSVSKNVPFGEMQWRIPLIIQMIPSLLFIIAMFFQPESPRWLVEHGKHKEAATVLARTGGKDVDHPSVVQTLEEIKQEFVASKQPSFLKQIRLVGESRAVALRCFIPPLVMFFQQWTGTNAINLYSPEVFRHLGIHGTSGALFATGVYGVVKVVSVALALTFAVERFGRKRGLIFGGIGQALMMFWLGGYSATHQDGTVSPASHVSIVALYLYGAFFSMGWGPLPWVVAGEVAPNHVRSFALSIAVGTHWLFGFVISKVTPIMLDRIKYGTFLLFGFCCMIVATWAYFCLPETSGFALEDIKYLFERDVIIRSLQDAPGGKIFLGGRRVESVASLKERRVGVAGEQGEKITGLNSELEDVSSKKSTLKETSSV

SEQ ID NO: 39374 - protein, 422 aa, Methanosarcina acetivorans C2A
MQRAENPMRDTQIDYARNGILTPEMKQIIGKENIDEDTLLSRVAEGSLIIMTRKGCPPVAIGKGASTKVNVNLGTSAAKIDVDAEIEKVRIADKYGADTITDLSMGGDIRAIRTGVLENSKLPITTVPIYQTIVECGMKEVTADDIFSYLRAQVDEGMSSVVLHCVEKATLEKLKGMGRVMGMVSKGGSLTSVYMLINGCENPFIENFDEVIDVLRKKDVVLSLGNTMRSGCIHDLNDGAQMMEINTNVQLAKRANEAGVQVIIEGMGGHIQAADIPAHVKLYKSKSSFPLFVAGPLPTDIALGYDHIAGAVGASMASGAGADYLCYITPAEHLSLPGPEQVRKGLIAFKIAAHIGDSMKYGMSNRDLLLAQKRARFDWEGQMELALDSDRPRDICPMTGPCSMCGEYCAIKIMRDYLEGDK

SEQ ID NO: 39375 - protein, 415 aa, Oryza sativa (japonica cultivar-group)
MAASEQRVVAVIMVGGPTKGTRFRPLSLNVPKPLFPLAGQPMVHHPISACRRIPNLAQIYLVGFYEEREFALYVSSISNELRVPVRYLREDKPHGSAGGLYSFRDYIMEDSPSHIVLLNCDVCSSFPLPDMLEAHKKYGGMGTLLVNKVSAESANQFGELVADPETNELLHYTEKPETFVSDLINCGVYIFTPNIFNAIEDVLKQKKDRANLRRVSSFEALHSATKALPADYVRLDQDILSPLAGKKELYTYQTLDFWEQIKTPGMSLRCSGLYLSQFRHTSPHLLASGDGKRSATIIGDVYIHPSAKVHPTAKIGPNVSISANARIGAGARLIHCIILDDVEIMENAVVIHSIVGWKSTVGKWSRVQGEGDHNAKLGITILGEAVDVEDEVVVVNSIVLPNKTLNVSVQEEIIL

SEQ ID NO: 39376 - protein, 569 aa, Clarkia gracilis
MSTPALISETEAWKDLKAHLEDIKRTHLRELMGDTERCQSMMVEFDNIFLNYSRQQASPDTINKLYKLADAAHLNQKIDRMYNGDHINSTENRSVLHVALRAPRNSAICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYGFAVVEKFLQGAHSIDQHFSSAPFEKNIPVILGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLILHKIFTGNRPSLSILLPTLDAYRIGQLLAIYEHRVAVQGFVWGINSFDQWGVELGKSLATQVRKQLHASRVKGEAVEEGFNFSTKTLLTRYLEATSDVPADPSTLLPKI

SEQ ID NO: 39377 - protein, 531 aa, Oryza sativa
MPSIRRLLLAGAAVAVVVVSCAVVCAEASVHEYAGERFAGVGNGFVLHGGSEGVYASATAESFVRFEKVAFRRTPEAASVAEEDGNRTVTVAAVIFEAGDRDAVGAVSDVVGGERALCCTPGMARRGGCTEGAVVYRAPASSNATGRWPKVLAASFLPGSLVAAFPDETVAVARTGMYSLHFVHCDASLAAGQVVAAEGKTIWKNSRGYLPGRMAPLKPFYGAMSLAFAALAALWFARYARFWREVSPLQNFATAAIALGMVEVTTWYLDLAEFDASGVRPAGTTFWAATSGAVRAAACRVLALLVAMGYGVTRPALGCGNARVAALGAAFLAAAEVLDVGDNVGIVSDHSPARRLFFILPVAALNTVFIYWIFTSLSRTISKLKARRMTAKLEMYRKFANSLTIAVALSLGWIKIQVHFKTTDEHNERWRVAWVIPAVWELISFFLLCTICILWTPSQNSMRFAYSREECEDDTEHNDEDDDVEDTRPLIRAGPLSYVGNWACYVTQDAKIILRTDSGVYAKAGEEYKRV

SEQ ID NO: 39378 - protein, 363 aa, Glycine max
MKLTVKTLKGSHFEIRVQPSDTVMAVKKNIEDVQGKDNYPCGQQLLIHNGKVLKDETTLVENKVSEDGFLVVMLSKSKTSGSAAASSVQPASNPPTTVSTSNSTPPSDPPVQTQAANNSTSSTDAPTTNVSADTYGLAASNLVAGSNLEQTIQQIMDMGGGNWDRDTVSRALRAAYNNPERAIDYLYSGIPEAAEVAVPVPQTAGISSGAVPVGPNSSPLNMFPQETISSTGAGLGSLDFLRNNPQFQALRSMVQSNPQILQPVLQELGKQNPGLLRLIQEHHGEFLQLINEPVDGSEGDMFEQPEQDMPHAINVTPAEQEAIGRLEAMGFDRASVIEAFLACDRDEQLAANYLLENAGDFED

SEQ ID NO: 39379 - protein, 203 aa, Clarkia lassenensis
KFLLGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLTKENVSEHLIPHKTFTGNRPSISILLPTLDGYRIGQLLAIYEHRVAVQG

SEQ ID NO: 39380 - protein, 501 aa, Mycobacterium smegmatis str. MC2 155
MGFMTTTLASTHPVETVHGHRVPTGLFIGGDWRTTDSTFTVLDPATTGHIADVSDAGAAEALAALDAAHAVRDEWRRVTPRARAGLFGEAYRLLRSRAEAFAAVMTAESGKPLAESRAEFNLSAEFFLWYTEQIAHLHGTYAPASHGGYRVVTTHQPVGPALLITPWNFPMLMIARKAGAALAAGCPVIVKSAKETPLTCALFVETLREAGFPAGVVNLVHTTSSSAVSAALMADPRLRKISFTGSTGVGSTLLAQAAPGILNASMELGGDGPFIVLEDADVELAAKQAVVCKFRNAGQACVAANRIIVHRAVAEEFTKRFVALTEQLRVGNGFDDGVDVGPIISARQLDGVSELVDTLRGLDSELLTGGNALPGDGFFFAPTVFRVNGRPTELCSRELFAPVATIYQVESTSEAIEFANDTRYGLAAYVFTRDLSRAVAVGERLDFGMVGINRGIMADPAAAFGGVKASGLGREGGHDAIYDYLEPKYLALTVDEEAGLA

SEQ ID NO: 39381 - protein, 256 aa, Clarkia gracilis
KFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVMKSQQPVYLKGEVVNNHDELMSNFFAQPDALAYGKTPEQLKKENVSEHLIPHKTFTGNRPSLSILLPTLDAYRIGQLLAIYEHRVAVQGFVWGINSFDQWGVELGKSLATQVRKQLHASRVKGETVEGFNFSTKTLLTRYLE

SEQ ID NO: 39382 - protein, 219 aa, Brassica napus
MLRRLGWLIGLSQRSRQTKTLDAEAYVAARAVKPVLMVDTVQEIAVYIHRFHNLDLFQQGWYQIKISMRWEDGDNNNSSGIPSRVVQYEALDATSNESSGVWKIDDKDNSFLSQPFRIKYARQDVRLCMMVSFTMPLERYEGSATSAVILRFELLYSPIIESIDAFPAAAHDFRIPPKALSGLHSYCPVHFDTLHAVLIDVSVHVSVMKSAAYKRPAVL

SEQ ID NO: 39383 - protein, 809 aa, Mycobacterium smegmatis str. MC2 155
MSFLLTVAQAGPMSLTAAHTLDVDTARLDTLQQIEQRVLWLSTAMIHHANRVRPNTSGLKVGGHQASSASMVTIMTALWFEQLRSGDRVSVKPHASPVLHSLNYLLGRLDEKYLTTLRQFGGLQSYPSRSKDPDPVDYSTGSVGIGATAPIWGAVARRFVDAHYGPTGAGRQYSLVGDAELDEGAVWEAILDPGIAELGEVVWIVDLNRQSLDRVVPNIAARRLEKMFDAAGWQVITVKFGRLLESLFARPGGDALRSRILDMPNPEYQRLLRCTAGDIRTRLPGDGPRSGEIASLIADLDDQTLTAAIRNLGGHDLAALTQAYREIDDTRPTVIIAYTVKGHGLPTEGHPQNHSALLSHDEFDALATRLGMDPNAPWQRFAQDSDAGRLCVAAAQRLSRDDITAIDPPAVPGDIGRTPKGTATTQAALGRVLLDLSREAPDAAARVVTVSPDVSSTTNLGGWVNKVGVWSATERRNWFADDAETIMHWDERPSGRHVELGIAETNLVGLLGELGATWSRWGQPLFPIGVLYDPFVERALEPWSFGIYAGGQSILVGTPSGVTLAAEGGAHQSIKTPSIGIEQPGCISYEPAFAIDVEWTLLASMGRLGRPGGTSAYLRLSTRPVDQSLAAVPTDPAARERRRRQVVAGGYPLRRAPGARVTIAAMGAVLPEALAAADRLTEQGVPADVVCVTSPGLLFDAWQARQGHDAANTGADTWILDQLFPADRALPLVTVLDGHPHTLAFLANIQRVRATNLGVSRFGQVGSLDEVHRYHGLDTDSIVRAALDVSEGTGVAGFTGVSGITGAGS

SEQ ID NO: 39384 - protein, 110 aa, Glycine max
  misc_feature (29)..(29): Xaa can be any naturally occurring amino acid
  misc_feature (46)..(46): Xaa can be any naturally occurring amino acid
  misc_feature (99)..(99): Xaa can be any naturally occurring amino acid
MAAATSSVASTPQGVAERRGIPAASFVEXVETYLRQAGLEVNSALXFLQERLQQYKMVEMKLLAQQRELQAKIPDIEKCLDIVATLKAKKALGEALIAXFELSKGIYSRA

SEQ ID NO: 39385 - protein, 146 aa, Pisum sativum
MGFTEKQEALVNSSWELFKQNPSYSVLFYTIILKKAPAAKGMFSFLKDSAEVVDSPKLQAHAEKVFGMVHDSAIQLRASGEVVLGDATLGAIHIQKGVVDPHFVVVKEALLETIKEASGEKWSEELSTAWEVAYEGLASAIKKAMN

SEQ ID NO: 39386 - protein, 146 aa, Pisum sativum
MGFTEKQEALVNSSWELFKQNPSYSVLFYTIILKKAPAAKGMFSFLKDSAEVVDSPKLQAHAEKVFGMVHDSAIQLRASGEVVLGDVTLGAIHIQKGVIDPHFVVVKEALLDTIKEASGEKWSEELSTAWEIAYEGLASAIKKAMN

SEQ ID NO: 39387 - protein, 243 aa, Prochlorococcus marinus subsp. marinus str. CCMP1375
MRKTVIAGNWKMHMTCSSAKEYIDKFIPFSKEFPSDRHVVIAPPFTAISTLASLLQGTNIQLSSQNVHWEDTGAFTAEISPSMLLEHDVRYAIVGHSEPRKYFSESDEQINLRARSAQSNGLIPIVCVGESIEQRERGEAERVIRRQVEQGLEQTDLTKLVIAYEPIWAIGTGKTCESNEANRICGLIREWAGFSDLIIQYGGSVKPANIDEIMSMSDIDGVLVGGASLDPENFARIANYQSI

SEQ ID NO: 39388 - protein, 361 aa, Arabidopsis thaliana
MAENLACGETSESWIIDNDDDDINYGGGFTNEIDYNHQLFAKDDNFGGNGSIPMMGSSSSSLSEDRIKEMLVREIEFCPGTDYVKRLLSGDLDLSVRNQALDWILKVCAHYHFGHLCICLSMNYLDRFLTSYELPKDKDWAAQLLAVSCLSLASKMEETDVPHIVDLQVEDPKFVFEAKTIKRMELLVVTTLNWRLQALTPFSFIDYFVDKISGHVSENLIYRSSRFILNTTKAIEFLDFRPSEIAAAAAVSVSISGETECIDEEKALSSLIYVKQERVKRCLNLMRSLTGEENVRGTSLSQEQARVAVRAVPASPVGVLEATCLSYRSEERTVESCTNSSQSSPDNNNNNNNSNKRRRKQ

SEQ ID NO: 39389 - protein, 417 aa, Vibrio vulnificus YJ016
MDYFNYQDDGQLWAEEVSLTSLAEQYGTPLYVYSRATLERHWHAFDRSVEGHPHLVCYAVKANSNLGVLNTLARLGSGFDIVSGGELERVLAAGGDPRKVVFSGVGKTEAEMRRALELNIKCFNVESEPELERLNRVAGELGVKAPISLRINPDVDAQTHPYISTGLRDNKFGIAFDRAPAVYQFAQSLANLNVQGIDCHIGSQLTAIEPFIDATDRLLALIDDLKEQGINIRHLDVGGGLGVVYRNELPPQPSEYAKALLGRLENHQDLELIFEPGRAIAANAGVLLTKVEFLKHTEHKNFAIIDAAMNDLMRPALYQAWQDIVPVQPRQGEAVTYDLVGPICETGDFLGKDRSLVLAENDLLAVRSAGAYGFVMSSNYNTRARAAEVMVDGKQHYLVRQREELRSLWELEHILPE

SEQ ID NO: 39390 - protein, 986 aa, Ostreococcus tauri
MGARGRSTGTRSTDAGAGRRGGRGRGNGTTRARPVRGVHVRRRAVVEPERGATGGERRAWHAADAASLGAFNEETIARYAKYPEPVREDAHVYKDADGYYVVKEEWRKPTNPFEKLKLEKDPMRELIGLAGLEAMAEASAVDFKAWDEALNDPDETDQRPKWAGLFHRRKGHYGRYMMRLKLPNGLINSTQMRYLASVIENYGEDGCADITTRQNIQLRGVELKDAPEILRKLEELGMCSLQSGLDNVRNATGNPLAGFDPQEIVDTRPYTLAIQEYVTGGGRGNPAIANLGRKWNVCVVGSSDFFEHPDINDLAFIPAMKDGKMGFNIIVGGFISSQRAAESISLDAWVPEGEVVAATHAVLTTFRDYGHRGNRQKCRMMWLIDEMGLDNFRLEVASRMPIGELARAAEKDLIDRDSPRRSYIGVHEQKQDGFSWVAAAVPGGRMQPEDLREMADLSDKYGTGEIRLTVEQNFIIPHVPTEKVDDILKERLFQEYTPFPGKLVSNMVACTGNQFCGFAQIETKRQALEMAEHLESVLDLTKDVRMIWTGCPNSCAPVQVADIGLMGAQVKNPSGEKGMVPGVNIFIGGTVGPNGHLKEKPEIEKVACTELKPILEDIMIERFGATRKAVPTPNPGRASRWKINKSAQYTKGVPKAMGKATHICTACGYIYQETKKFNELPADYVCPSCSAPKTKFEAMKQEVDPASARPTVEYPEGTLVTLKQGETVNLKLIEKEQVTSNTVRFRFELPSPEHILGLPVGQHVTVTIDGVSRPYTPITRDADKGFMDLLVKVYDKGELTQKLNSVTVGSMVAFEGPSGLVTYSARGEFSTLNPATGVVSKKACKNIAMIAGGTGITPMLQVIRQIFSDVGDTTRVSLLFANVSSADIILKKELDELAAAHKNLSVHYTIDKQEPNWTGDVGYVSKDMIEKCKLLDDNTGFFKKLFSSSDANDTAVLMCGPPVMLEKAVVPALDALNVPSECRILF

SEQ ID NO: 39391 - protein, 504 aa, Oryza sativa (japonica cultivar-group)
MVDSLLYGLLDLRMAAPLLAAAVALYVLVEQLSYHRKKGSLPGPPLVVPFIGSATHMIRDPTGFWEMQAARARKSGVGFTADFLAGKFTIFIRDSELSNRVFANVRPDAFFVIGHPFGKKLFGDHNLIYLFGDDHKDLRRRMATNFTPRALSTYAAIQQRGIVSHLRRWLDRSAANGGKAEPIRVPCRDMNLETSQTVFAGPYLTEEARERFKSDYNLFNVGLLAFPVDLPGLAFRRARQAVARLVRMLRDCARESKARMRAGGEPECLVDYWMQETVREIDEAKAAGLPPPAHISDDEEIGGFLFDFLFAAQDASTSSLCWAVSALDSHPDVLARVRAEVASLWSPDSGEPITADKIAEMKYTKAVAREVVRHRPPATLMPHIALQNFQLTESYTIPKGTLVLPSMYESSFQGFHDPDAFDPERFFSEARREDVVYKRNFLAFGAGPHQCVGQRYALNHLVIFMALFVSLVDFRRERTEGCDVPVYMPTMVPRDGCVVYLKQR

SEQ ID NO: 39392 - protein, 552 aa, Ustilago maydis
MSYGGYSGGSGRGGSYGGGRGGYGGGSSSYGNGGSSYGGGSSYGGGSSYGNGGGGYGGGYGGGYGGGDRMSNLGSNLGAVDWNSVNLVPFEKNFYVEDPRVSNRSDSEVQQYRASKQMTIQGQNVPKPVTSFDEAGFPDYILSEIKKMGFSEPSAIQSQAWPMALSGRDLVAIAETGSGKTIGFALPAMVHINAQPLLKPGDGPIALILAPTRELANQIQVECNRFGGSSRLRTCAVYGGVPKGPQIRDLQRGAEICIATPGRLIDMVDAGKTNLRRVTYLVMDEADRMLDMGFEPQIRKILQQIRPDRQTLMFSATWPKEVQRLAGDFLNNYAQVNIGSTELAANHNVKQIIEVCTEFEKKGKLIGHLETISAENGKVIIFTSTKRVADDLTKFLRQDGWPALAIHGDKQQQERDWVLAEFKSGRSPIMVATAVASRGLDVKDISYVINYDFPTNTEDYVHQIGRTGRAGRTGTAYTYFTPENSKSARELIGILREAKQEIPREIEEMGRFGGGGGGRGFRGGRGRGRGRGGYGGGGRTGANSFAVGNSRW

SEQ ID NO: 39393 - protein, 501 aa, Oryza sativa
MELLLWCTPCVILLLSSLYLLRLFVDARRNLPPGPRPQPLIGNILDLGSQPHRSLARLAGRYGPLMTLRLGTVTTVVASSPGAARDILQRHDAAFSARSVPDAARACGHDGFSMGMLPPSSALWRALRRVCAAELFAPRSLDAHQRLRRDKVRQLVSHVARLARDGAAVDVGRAAFTASLNLLSSTIFSADLADFGDARAESSVGDLRDLISEFTIVVGVPNVSDFFPAVAPLDPQRLRRRVARVFERLQAVFDGHIERRLRDRAAGEPPKNDFLDALLDYRSPEDGRGFDRPTLQFLFTDLFSAGSDTSAVTVEWAMAQLLQNPPAMAKAREELARVIGSKQEIEESDISQLKYLEAVVKETLRLHPPAPFLLPHQAETTTQVGGYTVPKGTRVLVNVWAIGRDSKVWSDPDKFMPERFLQSEVDLRGRDFELIPFGSGRRICPGLPLAVRMVYLMLASLLHRFEWRLLPEVEKNGVDMAEKFGMILELATPLRAVAIPV

SEQ ID NO: 39394 - protein, 257 aa, Rickettsiella grylli
MRGQYIIGNWKMNGCKTSVTSLLNALRDVEKKEQSNVTMVVCPPYIFLDKTQKMLEKSPLQWGGQNMAAEPEGPYTGEISGLMLYEFGCRYVLLGHSERRQHYAETNDQIAKKFNLAVNSGLTPILCVGETLAERQANQTQVVLQTQLEKIIAHASPLLPQAIIAYEPVWAIGTGVSAEPEQAQEIHQFLRDQIRMVDSDLAQILPILYGGSVKISNANALFQMPDIDGGLIGGASLDASEFLSIYEIMTSIERHNS

SEQ ID NO: 39395 - protein, 725 aa, Hyphomonas neptunium ATCC 15444
MTWYALALGAGILSVLYGWVQIQSIMKAPAGNARMLEIAAAIQEGANAYLKRQYRTIGIVGVVVAIVLVILLGWKAALGFVIGAVLSGAAGYIGMLVSVRANVRTTEASRHGLNEGLKMAFKSGAVTGMLVVGLALIGIVGYYGLLTGPLGLSLGDEDQKREIIDALVSLGFGASLISIFARLGGGIFTKGADVGGDMVGKVEAGIPEDDPRNPATIADNVGDNVGDCAGMAADLFETYAVTLVATMVLGGIYFAATPYIAEIMMLPLAIGAVCIVTSIIGSFFATLSKGSTNVMGALYKALNVTGVLSIGGLAIAIHTVLPGGLGGTLEGAGALLGLVDPATGQAADITGWHLFACGVVGLFVTLLIVVITAYYTETKYRPVRSIAKASESGHGTNVIQGLAVSLEATALPALTIIGGILLTYNLAGLYGIAIATTTMLALAGMIVALDAFGPVTDNAGGIAEMAELPSEVRTTTDALDAVGNTTKAVTKGYAIGSAGLGALVLFAAYAEDLSYFTARATEGSFFYNITVDFSIANPYVVVGLLFGGLLPFLFGGMSMMAVGRAAQAVVEEVRRQFREMPGIMKGEVKPDYGRAVDMLTQAAIKEMIIPSLLPVLSPIILFGVILVIGGPGEALASVGAMLLGVIVTGLFVAISMTSGGGAWDNAKKYIEDGHHGGKGSEAHKAAVTGDTVGDPYKDTAGPAVNPMIKITNIVALLMLAVLAGH

SEQ ID NO: 39396 - protein, 427 aa, Polaromonas sp. JS666
MSAIVDIVGREILDSRGNPTVECDVLLESGVMGRAAVPSGASTGSREAIELRDGDKSRYLGKGVLKAVEHINTEISEAVLGLDASEQAFLDRTLIDLDGTDNKSRLGANATLAVSMAVARAAAEEAGLPLYRYFGGSGAMQMPVPMMNVVNGGAHANNNLDLQELMIIPIGAPSFREAVRYGAEVFHALKKILHDKGMSVAVGDEGGFAPNVPSHEAAIQMILEAIDKAGYVAGEQIALGLDCAASEFYKDGKYVLAGEGLSLDATEWTNILATWVDKYPIISIEDGMAEGDWDGWKILTERLGKQVQLVGDDLFVTNTKILKEGIDKHIANSILIKINQIGTLTETFAAIEMAKRAGYTAVISHRSGETEDSTIADIAVGTNAGQIKTGSLSRSDRMAKYNQLLRIEEDLGDIATYPGRAAFYNLR

SEQ ID NO: 39397 - protein, 576 aa, Azoarcus sp. BH72
MPFTLHGLPVSQGIAIGHVHLVSHALLEVNHYHVAQRHLADETARLDDAVATVQGELIGLKAAATGGQAHSEVGAFVDLQLMMLADPMLIDAARALIESRGCNAEWALVQQMELVVAQFRQIEDPYLRERQADVVQVVERLVKVLLGHPGHLPPRRRDGLGTIVVAHDLSPADTIGFRDHNIAGFVTDVGGPTSHTAIVARSLAIPAVVGLHHIRDLVEDDELLIVDGTRGVIIVAPDDSIIEEYRLRRAELELERSKLKRLRDTPATTLDGETIHLLANIEGPKDVAQVKASNADGVGLYRTEFLFIGRDTLPDEDEQYEAYRTVLKAVPGKPVTIRTFDVGADKALNGAHSRFEPNPALGLRAVRYSLAEPKMFLTQLRALLRASVHGRLQIMVPMLAHAHEIDQTLTLIDKAKAELRAERIKFDEQVPIGGMIEVPAAALALGMFIRRLSFLSIGTNDLIQYTLAIDRSDEAVVHLYDPLHPAVLKLIGATIQAGARYGLPVSVCGEMAGDPAYTLLLLGMGLRNFSMHPGHILEIKQQVLRADLGELAPRVQRILKMDEQARVREAVERLAG

SEQ ID NO: 39398 - protein, 381 aa, Rickettsiella grylli
MAKKTDYYETLGVSRHATDSELKKAYRKLAMKYHPDKHHAAETQQAKEAEEKFKAISEAYDVLSDSKKRAAYDQFGHAGVESTGTSGNAQGFNFNDVFGDIGDVFGNIFGNRGGPQQSQRAQRGADLRYTLELDLESAIHGTTVQIRIPRLVTCKSCQGSGARKGTKPIVCKTCGGQGQVRIQQGFLTIQQTCPECHGEGRIITTPCPDCRGQGHVQETKTLAVKIPAGIDEGNRIRLAGEGEAGHRGAPAGDLYVQIHLKPHPLFKREGNNLYCDVPIHLTLALLGGDIQIPTLTGIVNLHIPPETQSGKVLRLRGKGVPGRPGGTGDLLCRVSVETPVHLTKAQKELVIALENALKNGNHYPKAKIWFEHVKKFFSKQY

SEQ ID NO: 39399 - protein, 439 aa, Oryza sativa (japonica cultivar-group)
MAASPAAGAAAATVSSFVSPSSFSSVNFRFEAFKTKVPRNANMAKLQAGYLFPEIARRRAAHLLKFPDAKIISLGIGDTTEPIPDVITNAMAKRAHALSTVDGYSGYGAEQGEKKLRAAIAATYYADLGIEETDIFVSDGAKCDISRLQVLFGSNVKIAVQDPSYPAYVDSSVIMGQTGLYQEDVQKYGNIEYMKCSPENGFFPDLSSVPRTDIIFFCSPNNPTGAAASRDQLTKLVKFAKDNGSIIVYDSAYAMYISDDSPKSIFEIPGAKEVAIETASFSKYAGFTGVRLGWTVVPKELLFSDGHPVAKDFNRIVCTCFNGASNISQAGGLGCLSPEGLKAMSDVVGFYKENTKIIVDTFTSLGFNVYGAKNAPYVWVHFPGRNSWDVFAEILEKAHVVTTPGSGFGPGGEGFVRVSAFGHRENIIEAARRLKQLYK

SEQ ID NO: 39400 - protein, 643 aa, Ostreococcus tauri
MGTRERARVGADGASRARTRWSRRVVSPARAWEGTGGVETLGTVTTRRGDRANGTRAATGKDADGGKTLEERIASGEFTVQAKTGPYRVVADAIRGAIPENSGTFGRGAMSKMPVATGDIREIAGQPVFVPLYKLFLAYGEMFVLAIGPKKFVVVSDNAVAKEMLLTQAKSFSKGLLSEILDFVMGQGLIPANGEVWKIRRKVIVPSLHKKYVTSMVGMFGDCGLKGMAQLARAEKMGESVEMENFYSRFALDIIGKAVFNYDFDSLTTDDPVIKAVYTVLREAEYRSVTFIPYWKVPPLRWLVPRQRQCQEALKVVNDTLDELIDRCKKIVEEEDEEFVEEYMNTDDPSILHFLIASGDDVTSKQLRDDLMTLLIAGHETTAAVLTWTTFLLAKHPDIKQKVFEEVDRVVGDRNPTVADMRELVYTTRVINESMRLYPQPPVLIRRALEPVTLGGYNIDAGTDFFISVWNLHRNPRIWPEPDAFKPERFPIEGPMPNEYTEDYAYLPFGGGQRKCVGDQFAIFESIVSLAMLMRRFDFELDESKHPDGECGMTTGATIHTTNGLHVRLKRREGRGGAEMSGAVRGKALTELDDVDVVRGSIDAPTASADEVDVLIAEDIDAGTVEKIQRATKIIEEEEARAR

SEQ ID NO: 39401 - protein, 426 aa, Oryza sativa (japonica cultivar-group)
MAKYGEGDARWIVQERADGTNVHNWHWAERDCLEWSRSRLTSLLAGLPVLSGEGGLALRTTALDKLDGEAYVNIRKGKVIPGYELSLTLAWEAEATTESGVVKVSGAAEVPYLADENADEDPELRVTVRGDDGPVARRAKDAFLTKGKPLVLEKIREYVAAMAKGGPAKDELDSKKTPTKAAAVEAGCAATAPAPAAEKKEEAPAVKEKKAKAKDKEGFKTIEMTEKFYCRAKDMYEILMDENRWKGFTQSNARISREVGGQFSLFDGSISGVNEELQEGKLIVQKWRFGSWPDGVHSTRLELTSSNSLSDHVIPDLAFGGCCDFAAFQAAACTTSALGTRQWGAVFMVGDSAPGTWHYATVFLGGSIFTCHLSMDGVGAGAAPVGGVCECRLSLRLPLLRAHSGEVSFKLSLHDLSVLPNCLSKE

SEQ ID NO: 39402 - protein, 412 aa, Zea mays
MADTGRDAFPDEAEPAFTLDEYMEDIEAVELEADLVLGGDEGKECTYAGGYLKRQAVFSCLTCVPDGVAGVCTACSLACHDGHEIVELWTKRKFRCDCGNSKFGGHLCKLCPEKDYENSANTYNHNFKGSYCTCGRPYPDPEAKEQVEMIQCSICEDWFHGDHIGLNSIEEIPRDEEGEPLYEELICHKCSSVCHFLKLYPDTIWASGKPNLAVETDASDSNVMKKPSGHADPEKHENGALVDNTVGEKTSVENDSTKAIAVPEEANLGSSSGNNCKLGVDVNTMPAITDKSEPFFMSKGWRETLCRCETCFNFYAQRGIAYLIDKEDSIEEYEKIAKQKREMKLEQQQGAETNFLNSLNHVQKIEMISGINDMKNEFQSFLESFDASKPVTSDDIHSFFENLAKKKKQRLS

SEQ ID NO: 39403 - protein, 426 aa, Zea mays
  misc_feature (154)..(154): Xaa can be any naturally occurring amino acid
  misc_feature (238)..(238): Xaa can be any naturally occurring amino acid
  misc_feature (313)..(313): Xaa can be any naturally occurring amino acid
  misc_feature (330)..(330): Xaa can be any naturally occurring amino acid
MTEAARFHGMIGGGGGKGMQDNVINGFDNIPYYQKFGEGSHMSVDSVDGFNLTNCAGGSVAMSVDSSSVGSNESRTVILKHPGLRDAPTASYSVNNSVFRPNRVAAHTLNEDALAQVLMDPNHPTEVLSSYEQWTIDLGRLDMGGPFAQGAFGXLYRGIYNGEDVAIKLLEKSENDPERAHSMEQQFVQEVMMLSRLSHPNIVRFIGACRKSVVWCIITEYAKGGSVWQFLARRQNKXPLRLAVKQALDVARGMTYIHALGFIHRDLKSDNLLISADKSIKIADFGVARIEVKTEGMTPETGTYRWMAPEMIXHKPYDHKVDVYSFGALXIVLWELGAITGMLPFTNMTAVQAAFAVVNKGARPVIPQDCLPSLRHIMTRCWDANPEVHPPFTEIVCMLESAEMELLSNVRKARFRCCISEPMTTD

SEQ ID NO: 39404 - protein, 421 aa, Rubrobacter xylanophilus DSM 9941
MRRAGEDPVGLAARSALEGGRRGLGRVWPFLGPAFVAAVAYVDPGNFAADMEGGARYGYLLLWVVACADLVAVLVQSMSARLGIATGRNLAELCREAFPWPVVALLWLQAEAVAMATDLAEFVGAALALRLLFGLALLPAALLTGAAVFGLLALQRRGVRPLEAAVSAMVGVIVLAFALQVFLSGPEWGRAVAGLLEPGFAGPGSVLLAAGILGATVMPHAIYLHSALVQRRVVGRTAEERRRIYRFELLDVAVAMGLAGLVNASMLVVAAALFHPGGAAGLEGVFYGISALEGRWAALLFGLALLASGLSSSSVGTMSGQVVMQGFVSRSIPLFARRALTMAPALAVIAAGVDPARALVLSQVVLSFGIPFALVPLILFCRDRALMGSLAAGRPLTAAAAAAAAAVISLNVLLLCQTLRP

SEQ ID NO: 39405 - protein, 268 aa, Arabidopsis thaliana
MAKAGENSRDKSRWSLEGMTALVTGGSKGLGEAVVEELAMLGARVHTCARDETQLQERLREWQAKGFEVTTSVCDVSSREQREKLMETVSSVFQGKLNILVNNAGTGIIKPSTEYTAEDYSFLMATNLESAFHLSQIAHPLLKASGSGSIVFMSSVAGLVHTGASIYGASKGAMNQLGRSLACEWASDNIRVNSVCPWVITTPLTSFIFSDEKLRKAVEDKTPMGRVGEANEVSSLVAFLCFPAASYITGQTICVDGGASVNGFSFKP

SEQ ID NO: 39406 - protein, 333 aa, Vibrio vulnificus YJ016
MTIKVGINGFGRIGRLAMRAAFDWPELEFVLINDVAGDATTLGHLLEFDSVQGRWHHEVTVQGQQLHINGHVIETTQQRDISAVDWSGCDVVIEATGVHRKSRFLNQYLEQGVKRVVVSAPVKEEGIANIVVGVNDEIFNPEQHRIVTAASCTTNCIAPVVKVIHEKLGIEQASFTTIHDLTNTQTILDAPHKDLRRARACGMSLIPTTTGSATAIVEIFPELKDRINGHAVRVPLANASLTDIIFDVKRDTTAEEVNALLKEASQGELNGILGFEERPLVSIDYRGDQRSTIVDALSTMVVGTRMVKIYAWYDNEMGYATRTAELVRKVGAA

SEQ ID NO: 39407 - protein, 207 aa, uncultured bacterium
MYRVPPDQECTMDLSRRQFFKVAGIGLAGSSLGALGMAPTSAFAEQVRHFKLAHTHETRNTCPYCSVGCGLIMYSQGDAAKNVAQNIIHIEGDADHPVNRGTLCPKGAGLLDFIHSPGRLQYPQVRKPGSTEWTRISWDEALDRVADLMKADRDANFIEKNAQGQTVNRWLTTGFLAASAASNEAGYITHKVVRSLGMLGFDNQARV

SEQ ID NO: 39408 - protein, 681 aa, uncultured bacterium
MTNTWTDIANANLVLVMGGNAAEAHPCGFKWVTEAKAHNKARLIVVDPRFTRTASVADYYAPIRTGTDIAFMGGLINYLLTEDKIQHEYVRNYTDVSFIVRAGYGFEDGIFSGYDAAKRSYTDKSGWGYELGEDGFAKVDPTLQDPRCVYQLMKQHYSRYTIDLASQICGMPVDAMQKIWEEIATCSQPGKTMTILYALGWTQHSIGSQIIRSAAMVQLLLGNVGMPGGGVNALRGHSNIQGLTDLGLLSNSLPGYLTLPADAEQDFTAYIVKRTQKPLRPGQLSYWQNYSKFHVSLMKAWYAGNATVENNWAYDYLPKLDIPNYDILKVFDLMGQGKVNGYLCQGFNPIAALPDKNRVMAALAKLKWLVVMDPLATETSQFWEKVGPYNDVNSADIQTEVIRLPTTCFAEEDGSLVNSSRWLQWHWKGADGPGEARTDVRIMSELFLRLRQRYQANGGKFPDPLLKLSWPYKIPDEPSPEELAKEINGSATMDFTDSAGAAIKANAQLAGFGQLRDDGSTASGCWIFCGSWTELGNQMARRDNSDPFGMHQHQGWAWAWPANRRILYNRASADLAGRPWDPSQLAGKWLVTLNAPQDSPAQPGHCLIDLQPQQTLGDGAECLGAWLGEPVLGWFPEPDGIAITDKDGSRILFFSRQHEGLYQGALKSGLGVTLQRAAGKD

SEQ ID NO: 39409 - protein, 561 aa, Psychrobacter arcticus 273-4
MYQYNYADQTLVEERVAQFRDQTERFLAGELPEEQFLPLRLQNGLYIQRYAPMLRIAIPYGLLASYQLRKLAEITRKYDKGYGHFTTRTNIQLNWPKLEEVPDIMAELASVQMHSIQTSGNCIRNTTTDPYAGIHQEEIADPRPYCEIIRQWSTFHPEFAFLPRKFKIAVIGTANDRAATQVHDVGLHVKTNDAGELGFEVIVGGGLGRTPVIGKVIKEFLPRQHLLSYLDAILRVYNLHGRRDNKYKARIKILVESMGGPAFAKLVDAEWEAHIKDGPLTLTDASFDTASRFFSEPDYVTFDALQVQSELQQQLSADKEFANWYQQNTVAHKVAGYRAVVISLKAGLVDGTYIPSGDVSESQMDALADLADTYSFSELRGTYQQNLVFADVQTNQLYELWQQLSELHLARANINTLTDMIVCPGWDYCSLANATTHNIAEQIEKQFDDLDYLYDLGEIRLNMSGCMNACAHHHTGDIGILGVDKKGEHWYQISLGGNSSDNAKIGKILGKAVPADDVATTLQKILDVYLEQRVSNEHDIEGFGDLVDRVGITPFKEKVYG

SEQ ID NO: 39410 - protein, 675 aa, Aspergillus oryzae
MADSLKMGSLSLNESQHAPAPNSSGRAAYIPPHLRQRQTGANMDGAPAAAPPAPGPSGPGNSWGSRGGPRGGNWANANAPDFSPRGPNPNGNTSWTPTEGSRRSFNPDAYGNPGHGGSYGGGSARGSGDGQWRDGKHIPGPANARVERELFGLPNDPTKQNTGINFANYDDIPVEASGQNVPEPVNAFTNPPLDDHLIANITLAHYQTPTPVQKYSIPIVMNGRDLMACAQTGSGKTGGFLFPILSQAFQNGPSPTPAPASGQFSYGRQRKAYPTSLILAPTRELVSQIFDEARKFAYRSWVRPCVVYGGADIGSQLRQIERGCDLLVATPGRLVDLIERGRISLVNIKYLILDEADRMLDMGFEPQIRRIVEGEDMPHVNDRQTLMFSATFPRDIQMLARDFLKDYVFLSVGRVGSTSENITQKVEYVEDHDKRSVLLDILHTHGTSGLTLIFVETKRMADSLSDFLLNQRFPATAIHGDRTQRERERALEMFRSGRCPILVATAVAARGLDIPNVTHVINYDLPTDIDDYVHRIGRTGRAGNTGIATAFFNRGNRGVVRDLIDLLKEAHQEVPSFLESIAREGSGYGGRGGRGGRGRGANATRDMRRVGGGMGGPPSFGGSSYGGPSAGYGGSYGGGAPSYGGSGGGSYGYGGSGGGGGYGNPSGPTGPSSWW

SEQ ID NO: 39411 - protein, 468 aa, Colwellia psychrerythraea 34H
MSQAVFDLIKEHDVKFIDLRFTDSKGKEQHISIPHHQVTEDFFEDGKMFDGSSIEGWKGIDESDMVMMPDASTAILDPFTDAVTLNIRCDILEPSTMQGYSRDPRSVANRAEEYLRSTGIADDVLVGPEPEFFVFDDVRFHTDMSGSFYKIDDKEASWNSGTEYEEGNMGHRPGVKGGYFPTAPVDSSQDLRSAMCLVMEDMGLIVEAHHHEVATCGQNEIACRFNTLVKKADEVQIYKYVVHNVAHAYGKTATFMPKPLVGDNGTGMHVHMSLAKDGVNLFAGDKYGGLSETALYYIGGIIKHAKALNAFTNPATNSYKRLVPHFEAPVMLAYSARNRSASIRIPLVPSPKAMRIEARFPDPACNPYLAFSALLMAGLDGIKNKTHPGDAMDKDLYDLPAEEAASIPQVATSLDDALDNLEADFEFLTAGGVMDKDMIDAYIAIKREESRRVNMTTHPLEFELYYSV

SEQ ID NO: 39412 - protein, 526 aa, Hyphomonas neptunium ATCC 15444
MTQQADSVLKAHERVLIVDFGSQVTQLIARRLRESGVYCEIHPFNKVDGAFLAAFGPQALILSGGPASVTWKDAPLADQAIFDSGLPILGICYGQQVMMHQLGGKVESGTSREFGRAFIEQVEADPILEGLFEGDNSEQVWMSHGDHVAEMAPGFGVIARSPGAPYAVIADPERKFYGTQFHPEVVHTTHGARLLRNFTHGVAGLKGDWTMAAYRAEAIQKIRNQVGKGRVICGLSGGVDSSVAAVLIHEAIGDQLTCVYVDHGLMRAGESEQVVSLFREHYNIPLVHVDASELFLGQLDGVTDPEKKRKIIGGLFIDVFDAEANKIGGADFLAQGTLYPDVIESVSAIGGPSVTIKSHHNVGGLPARMKMKLVEPLRELFKDEVRALGRELGLPEAFVGRHPFPGPGLAIRIPGAITREKADTLRKADAIYIDEIRKAGLYDEIWQAFSVLLPVNTVGVMGDERTYEAVLALRAVTSTDGMTADYYPFEHAFLGRVATRIINEVKGVNRVVYDVTSKPPGTIEWE

SEQ ID NO: 39413 - protein, 353 aa, Arabidopsis thaliana
MAIASSSPSSSSNVSVIPTGPQVFISFRGKELRKGFISFLVPALKKKNINVFIDEHEVRGKDLISLFRRIGESKIALVIFSEGYTESKWCLDELVQIKKCVDQKKIIAIPIFYKLDPAVVKGLKGKFGDKFRDLIERYHHEPERYQKWTEALTSVSRTFALCLPEHSDKSEKDFIRSIIKEVKKALSNISRERNGDREDIDDCFVVSERKLTTDMYDTPEVSTSTMRKVSSNNGVGVGTFKSQKPNFDDEDDDGDSLLKALVAKLVASTTSIVAAYAELQRAHSDAIQAAETVVVDVKTLSELIRSSNGGGGGSGSGSGSSLENQPRRSKVRKQVWAEVLGISSDSTIILECI

SEQ ID NO: 39414 - protein, 200 aa, Lactococcus lactis
MTRISHITRNTKETQIELSINLDGTGQADISTGIGFLDHMLTLLTFHSDFDLKIIGHGDHETVGMDPHHLIEDVAIALGKCISEDLGNKLGIRRYGSFTIPMDEALVTCDLDISGRPYLVFHADLSGNQKLGGYDTEMTEEFFRALAFNAGITLHLNEHYGQNTHHIIEGMFKSTARALKQAVSIDESKVGEIPSSKGVL

SEQ ID NO: 39415 - protein, 1452 aa, Aspergillus fumigatus
MNESHEAGKNSSTNVEEREEEVLRLARQFTEQSSYSTAGQTPFAAEAGSALDPNGERFNARAWCKAMLQMHIGDKEAHPLRTLGVAFSNLNVHGFGSDTDYQKSVGNVWLKTLSLARIAFGQKQRKVDILQNLEGLVEAGEMLVVLGPPGSGCSTFLKTIAGETYGFHVDKNSNINFQGIAKQMAHEFRGEAIYTAEVDVHFPKLTVGDTLYFAARARTPRHIPGGVNATQYAGHMRDVIMAMFGISHTKNTIVGNDFIRGVSGGERKRVSIAEACLSNAPLQCWDNSTRGLDSANAIEFCKTLRMQADINGTTACVSLYQAPQAAYDYFDKVLVLYEGREIYFGPTSMAKHYFLQMGFVCPDRQTDADFLTSMTSHLERVVQPGYEDRVPRTPDEFAARWKASPQRAQLMQHIKSYNAKFALDGEYLDKFKQSRRAQQAKAQRVSSPYTLSYVQQVKLCLWRGYQRLKADPSVTISSLFGNTIISLVIASIFYNLKADTSTFFQRGALLFFAVLMNALGCGLEMLTLYAQRGIIEKHSRYALYHPSAEAFSSMIMDLPYKILNAITSNIVLYFMTNLRRAPGAFFFFVFTSFILTLTMSMFFRSMASLSRSLVQVLPFSAVLLLGLSMYTGFAIPTGYMLGWARWIAYINPISYGFESLMINEFHNRDFPCMDYVPSGPGYTDVGLNNRVCSTVRSVPGQAFVNGNAYIESAYSYTASHKWRNIGVIFAYMFLLGAVYLVATDFITEKKPKGEILVFPRGHKALKKGKSDEDLEGGGGRSATVEKIGSDGLAMIERQTAIFQWKDVCFDIKIGKENCRILDHVDGWVKPGILTALMGVSGAGKTTLLDVLATRTTMGIISGEMLVDGQPRDESFQRKTGYAQQQDLHLSTATVREALEFSALLRQSAHVPRQEKIDYVTEVIKLLDMTEYADAVIGVPGEGLNVEQRKRLTIGVELAARPQLLLFLDEPTSGLDSQTSWAILDLLDKLKKNGQAILCTIHQPSAMLFQRFDRLLFLQAGGRTVYFGEIGQNSQILIDYFVRNGAPPCPPDANPAEWMLDVIGAAPGSHTSINWFETWRRSPEYARVQEHLAELKHERRHQTNLFRTTSGQKREDKDSYREFAAPFWAQLYQVQVRVFQQIWRSPTYINSKTALCVLSALFVGFSLFHTPNTIQGLQNQMFGIFMLLTLFGQLIQQIMPHFVAQRALYEVRDRPAKTYSWKAFLIANIVVELPWNSLMSVLMFLCWYYPIGLYRNAEPTDAVHLRGTQMWLMIWTFLLFSSTFAHFMIAAFDAAENAGNLGNLLFLLCLLFCGVLATPDQLPRFWIFMYRVSPFTYLVSGMLSVGISNTNVTCADNEYLRFDPVNGTCGEYMGSYMSNLGGYLADEMATANCSFCPIKETNVFLGRVSSSYSDIWRNFGLMWVFIVFNIFAACSLYWWVRVPRDKKPVAKAE

SEQ ID NO: 39416 - protein, 212 aa, Lactococcus lactis
MRPDFHKQELIPVIVQDYQTNQVLMLAYTNEVAFEKMLETGETWFWSRSRQKLWHKGEESGHFQKIKGMRLDCDQDTLLVFVEQIGNACHTGAYSCFYDELIPFDDSDIFSELEKQIIDRKLHPVEKSYTNYLLGEGIDKVLKKVGEEASEVTIASKNSDKGELLGEIDDLLYHLFVLMNQQGISLEEVRQKAKERHQLEGNKKEFHTRTAD

SEQ ID NO: 39417 - protein, 103 aa, Glycine max
MSGRGKGGKGLGKGGAKRHRKVLRDNIQCITKPAIRRLARRGGVKRISGLIYEETRGVLKIFLENVIRDAVTYTEHARRKTVTAMDVVYALKRQGRTLYGFGG

SEQ ID NO: 39418 - protein, 130 aa, Brassica napus
MVRISVLNDALKSMFNAEKRGKRQVMIRPSSKVIIKFLIVMQKHGYIGEFEYVDDHRSGKIVVELNGRLNKCGVISPRFDVGVKEIEGWTARLLPSRQFGYIVLTTSAGIMDHEEARRKNVGGKVLGFFY

SEQ ID NO: 39419 - protein, 380 aa, Picea abies
NNVNPIKEVQDSPKEPNPITEQISVHADCKQTVEKPNENEIVVSANKAAVASLKQQSTLQSPRISRQPKTSLNQGNPVPLAKLHEDAGRSSSLDFVNIDSEYKDPQMCTAYVTDIYANMRVVELKRRPLPNFMETIQRDINANMRSVLIDWLVEVSEEYKLVPDTLYLTISYIDRFLSANVVNRQRLQLLGVSCMLVASKYEEICAPPVEEFCYITDNTYKKEEVLDMEINVLNRLQYDLTNTKPLRPFSGVSFEQLKHPVRFQACIWEFMGNYLAELTLVEYDFLKYLPSLIAAAAVFLARMTLDPMVHPWNSTLQHYTGYKVSDMRDCICAIHDLQLNRKGCTLAAIRDKYNQPKFKCVANLFPPPVISPQFFIDNEV

SEQ ID NO: 39420 - protein, 552 aa, Ustilago maydis 521
MASVPQAPQFGLFSLPPIKNEPMRNYEPKSEDRIKLQQAVDEMIAAGPFEVPVVINGEKIKTGKVAQQPNPSNHSHILCNYHEADEALVEKAIEGSLKAKTAWENMPWNDRAAIFLKAADLIASKYRYKVLAATMLGQGKNVWQAEIDAAAEICDFYRFSAKYIQELYSSQPPECSPNTWNRTEYRPLEGFVLAVSPFNFLAIAAGNLICAPAMTGNVVVWKPSPMSIYSNYVAYEILREAGLPDGVIQFVPGPAPEIVGAAINHREFAGLHFTGSTHVFRQLWKQIGNNLDKYRGYPRIVGETGGKNFHMVHKSANVDAAVTQSIRAAFEYQGQKCSALSRLYVPKSMWQGEFKQKLLDQIAQISVGPVQEFKHFMGPVIAKHSFEKIMGLIEAAKKEGGEVLCGGQGDDSKGWYIQPTVIETKDPKSVTMVNEIFGPVITVYAYPDDEFEKTCELIDTTTEYALTGSIFSADRYALIRASNLLRNASGMMYFNDKCTGAVVGQQPFGGARASGTNDKAGSISIFYRFVSARTIKETTIDPTTHIYLSNLE

SEQ ID NO: 39421 - protein, 350 aa, Oryza sativa (japonica cultivar-group)
MRSTARQAATAAAFALIVFLVLLSPSPTAAATATTRMFKTIDARRSQHLDLGGSLVGPESVAFDGKGRGPYSGVSDGRIMRWNGEAAGWSTYTYSPSYTKNKCAASTLPTVQTESKCGRPLGLRFHYKTGNLYIADAYMGLMRVGPKGGEATVLAMKADGVPLRFTNGVDIDQVTGDVYFTDSSMNYQRSQHEQVTATKDSTGRLMKYDPRTNQVTVLQSNITYPNGVAMSADRTHLIVALTGPCKLMRHWIRGPKTGKSEPFVDLPGYPDNVRPDGKGGYWIALHREKYELPFGPDSHLVAMRVSAGGKLVQQMRGPKSLRPTEVMERKDGKIYMGNVELPYVGVVKSS

SEQ ID NO: 39422 - protein, 250 aa, Oryza sativa
  misc_feature (210)..(210): Xaa can be any naturally occurring amino acid
MLGVARRRLGSGCALGQLMQALRPAAAAAAARTYSAAAKEMTVREALNSALDEEMSADPSVFLMGEEVGEYQGAYKISKGLLDKYGPDRVLDTPITEAGFTGIGVGAAYQGLRPVVEFMTFNFSMQAIDHIINSAAKSNYMSAGQINVPIVFRGPNGAAAGVGAQHSQCYAAWYAHVPGLKVLTPYSAEDARGLLKAAIRDPDPVVFLEXELLYGESFPVSAEVLDSSFCLPIGKAKIEQEGKDVTITAF

SEQ ID NO: 39423 - protein, 143 aa, Nocardioides sp. JS614
MRIGDVLKAKPSHEVITIGPDAGVRELIAKLAEHNVGALIVSSDGTSVDGIVSERDVVRHLHSDGTVINNTVQAIMTTVVQTCDQETQVDELMKTMTERRVRHVPVVEGGRLVGIISIGDVVKHRIDQLEFERDQLDSYVHQT

SEQ ID NO: 39424 - protein, 704 aa, Acinetobacter sp. ADP1
MPGEEVSQAKQQLKLIIDAYLSESDVDNVLAACDFADLAHSGITRKSGEPYILHPIAVSCILAHMRLDAETLMAALLHDVIEDTEHTKDEIGERFGEVVADLVDGVTKLTHSSDKQYNKAASFRKILQATLQDPRVIIIKLADRYHNMTTLDALRPDKRARIAQETFDIFVPMARIVGMNEMGDNLELLCYQNLDLDMYNNVQEALLETKPRRCEYQTKWEHHLGELLTTYHIHGRVKKKNNNIELLRHFVKNEIDLQELTHSHAFEIILNSISDCDRLVDALKENFQILHFEDHIRRPLPGGNQSIMMKLKGEQTTLSLTIQTELMRKAARFGVVLGENAPQACRSAIQASMQNLTTLIDGECAKTTFNDLLDYLHQEKIWVYTPHGHLHELPQGATVIDFAYSASLFLGNHAVGAKIDGEIRPLSTPLVSGQVIDVITDVLATPNPDWLSFINTQKARRAIQNMLRDQDIEEQLLVGQQALNRALKLFNRSMHDLSESDWLNVLQWRHVENKEALFEQIAVGDLLPQLVANHLYAQDTSDKTGHAPDRLIQGTEGVDVKYAHCCNPILGDPIQGHLSRRGLIVHRARCHNLLHEQHLHPENIMPLQWTSDDLDDVSFTAYLCIDMPLDGEQISELIYLCRKSHTGVEMVQPHGDHTYVNIVVNNRKVVAQIIRDLRMLFGFPRVSRLFTPAAVTESVKIKVS

SEQ ID NO: 39425 - protein, 460 aa, Zea mays
MGSAATEGNDTLLGNGVVGILAETCNMWERRAPLTPSHCARLLLGGGKNGPRVNRIIVQPSTRRIHHDAQYEDAGCEISEDLSECGLIIGIKQPKLQMILSDRAYAFFSHTHKAQKENMPLLDKILEERVSLFDYELIVGDDGKRSLAFGKFAGRAGLIDFLHGLGQRYLSLGYSTPFLSLGQSHMYPSLAAAKAAVIVVAEEIATFGLPSGICPIVFVFTGVGNVSQGAQEIFKLLPHTFVDAEKLPEIFQARNLSKQSQSTKRVFQLYGCVVTSRDMVSHKDPTRQFDKGDYYAHPEHYTPVFHERIAPYASVIVNCMYWEKRFPPLLNMDQLQQLMETGCPLVGVCDITCDIGGSIEFINKSTSIERPFFRYDPSKNSYHDDMEGAGVVCLAVDILPTEFSKEASQHFGNILSRLVASLASVKQPAELPSYLRRACIAHAGRLTPLYEYIPRMRNTM

SEQ ID NO: 39426 - protein, 534 aa, Zea mays
MALEPVALLLTVLVAAPLTVLLLLLFLVAGNKRPARAASPTPRHRLRLPLPPSPRGLPLLGHLHLLGSLPHRALASLARAHGPVLLLRLGRVPTVVVSSAAAAEEVMRARDLAFANRPASAMAVRLLYGRDVAFAPYGEYWRQARRVCVVHLLSARHVGSFRRVREQEAAALVARVARDSAGGAAVGLSDLLTEYANAVVSRAAFGDESARGLLGEFDSGRRQRKVLTDFQKLVGTTPVGELLPWLGWVDAVTGLEGKIRRTFEALDGLLEKVIDDHRRRPRSGEEGGDRDFVDVLLDVHNKDQEHGIQLETNEIKAIILDMFAAGTDTIATAMEWAMAELVTHPRAMRRAQDEVRAAAAGSTGVNEDHVAQLDYLKAVLKETLRLHAPLPLLVPREPAADTEILGYHVPARTRVLVNAWAIGRDPATWERAEEFVPERFLGGAAAADVGFKGQHFELLPFGGGRRMCPGIAFAEGSAEMALASLLYHFDWEAASRGQNGKGTLSLDMTEMNGLAVHINSGLPLVAKPWIPFKN

SEQ ID NO: 39427 - protein, 261 aa, Solibacter usitatus Ellin6076
MKKRILILGGGFAGAYTALHLERRLGGLPDVEILLAAQENFVLFTPMLHEVAAGDVAVTDVVQPFRKMLRRTRVLIVEIKSIDLAGKSVRIVQPHLAQAFDIAYDHLVLAFGTVPNFHRTPGVEEHDLTMKTLGDAILLRNRIIESLDVADNHPDEVERKTMLTVVVAGGGFAGVETAGAVNDLLRAAVHFYPNVKEDMLRIRRNIWKRGGDPDTIPEPHSPAGEADTLLQRNHDRPAADAIDSDSRSQPDRGRRTCGFPR

SEQ ID NO: 39428 - protein, 524 aa, Ashbya gossypii ATCC 10895
MSVQIFGDQVTEERAENARMSAFVGAIAVGDLVKTTLGPKGMDKLLQSASSDSSLVTNDGATILKSIPLDNPAAKVLVNLSKVQDDEVGDGTTSVTILGAELLREAEKLVDQKIHPQTIIEGYRIACAASLEALKKAAVDNRNDKDKFYNDLLHIAKTTLSSKILSQDKEQFAKLATDAILRLNGSTNLEHIQIIKIIGGNLSDSFLDEGFILPKKFGNNQPKRVEKAKILIANTSLDTDKVKIFGAKFKVDSTSKLAELEKAEREKMKSKIEKISKFGINTFINRQLIYDYPEQLFTDLGINSIEHADFEGVERLALVTGGEVVSTFDHPEKCRLGECDLIEEIMIGEDTYTKFNGCKVSNACTVVLRGATLQVLDEAERSLHDALSVLSQTTKESRTLLGGGCAEMLMSKAVDTAAQNVDGKKSLAVEAFARALRQLPTILADNAGLDSSEIVSKLRTAIYNGMSTSGLDLENGTIADMRELGIVESYKLKHAVVSSAAEAAEVLLRVDNIIRAKPRTANRG

SEQ ID NO: 39429 - protein, 435 aa, Triticum aestivum
MASEKHFKYVILGGGVAAGYAAREFGKQGVQPGELAIISKESVAPYERPALSKGYLFPQNAARLPGFHTCVGSGGEKLLPEWYTEKGIELILSTEIVKADLASKTLTSAAGATFTYETLLIATGSSTIKLTDFGVQGAESNNILYLREIDDADKLVAAMQAKKDGKAVVVGGGYIGLELSAALKINNFDVTMVYPEPWCMPRLFTAGIAHFYEGYYASKGINIVKGTVASGFDADANGDVSVVKLKDGRVLDADIVIVGVGGRPLTGLFKGQVEEDKGGLKTDTFFETSVAGVYAIGDVATFPMKLYNEPRRVEHVDHARKSAEQAVKAIKAKESGESVAEYDYLPYFYSRSFDVAWQFYGENVGETVLFGDNDPAVAKPKFGTYWVKDGKVIGVFLEGGSADENQAIAKVARAQPPVADVEALGKEGLDFATKI

SEQ ID NO: 39430 - protein, 509 aa, Medicago sativa
MTMAGPGQLNVIESPSRGSRSVDCFEKLEQIGEGTYGMVYMAREIETGEIVALKKIRMDNEREGFPITAIREIKILKKLHHENVIKLKEIVTSPGPEKDDQGRPDGNKYKGGIYMVFEYMDHDLTGLADRPGMRFTVPQIKCYMRQLLTGLHYCHVNQVLHRDIKGSNLLIDNEGNLKLADFGLARSFSNEHNANLTNRVITLWYRPPELLLGTTRYGPAVDMWSVGCIFAELLHGKPIFPGKDEPEQLNKIFELCGAPDEVNWPGVTKTPWYNQFKPSRPMKRRLREVFRHFDRHALELLEKMLTLDPAQRIPAKDALDAEYFWTDPLPCDPKSLPKYESSHEFQTKKKRQQQRQNEENAKRLKMQNPQQHTRLPPIQQGGHAQMRQGPNHLIHGSQPAGAAGPSHHYGKPRGPSGGPGRYPPGGNPSGGYNHPNRGGQGGGAGYGSGPYPPQGRGAPYGSSGMPAGTGGGPRGGGGFGAPNYPQGGPPYGGSAAGRGNRNQQYGWQQ

SEQ ID NO: 39431 - protein, 1164 aa, Arabidopsis thaliana
MVSGGGSKTSGGEAASSGHRRSRHTSAAEQAQSSANKALRSQNQQPQNHGGGTESTNKAIQQYTVDARLHAVFEQSGESGKSFDYSQSLKTAPYDSSVPEQQITAYLSRIQRGGYTQPFGCLIAVEESTFTIIGYSENAREMLGLMSQSVPSIEDKSEVLTIGTDLRSLFKSSSYLLLERAFVAREITLLNPIWIHSNNTGKPFYAILHRVDVGILIDLEPARTEDPALSIAGAVQSQKLAVRAISHLQSLPSGDIKLLCDTVVESVRDLTGYDRVMVYKFHEDEHGEVVAESKRNDLEPYIGLHYPATDIPQASRFLFKQNRVRMIVDCYASPVRVVQDDRLTQFICLVGSTLRAPHGCHAQYMTNMGSIASLAMAVIINGNEEDGNGVNTGGRNSMRLWGLVVCHHTSARCIPFPLRYACEFLMQAFGLQLNMELQLALQVSEKRVLRMQTLLCDMLLRDSPAGIVTQRPSIMDLVKCNGAAFLYQGKYYPLGVTPTDSQINDIVEWLVANHSDSTGLSTDSLGDAGYPRAAALGDAVCGMAVACITKRDFLFWFRSHTEKEIKWGGAKHHPEDKDDGQRMNPRSSFQTFLEVVKSRCQPWETAEMDAIHSLQLILRDSFKESEAMDSKAAAAGAVQPHGDDMVQQGMQEIGAVAREMVRLIETATVPIFAVDIDGCINGWNAKIAELTGLSVEDAMGKSLVRELIYKEYKETVDRLLSCALKGDEGKNVEVKLKTFGSELQGKAMFVVVNACSSKDYLNNIVGVCFVGQDVTGHKIVMDKFINIQGDYKAIIHSPNPLIPPIFAADENTCCLEWNTAMEKLTGWPRSEVIGKLLVREVFGSYCRLKGPDALTKFMIVLHNAIGGQDTDKFPFPFFDRKGEFIQALLTLNKRVSIDGKIIGAFCFLQIPSPELQQALEVQRRQESEYFSRRKELAYIFQVIKNPLSGLRFTNSLLEDMDLNEDQKQLLETSVSCEKQISKIVGDMDVKSIDDGSFLLERTEFFIGNVTNAVVSQVMLVVRERNLQLIRNIPTEVKSMAVYGDQIRLQQVLAEFLLSIVRYAPMEGSVELHLCPTLNQMADGFSAVRLEFRMACAGEGVPPEKVQDMFHSSRWTSPEGLGLSVCRKILKLMNGGVQYIREFERSYFLIVIELPVPLMMMMPSS

SEQ ID NO: 39432 - protein, 311 aa, Medicago sativa
MEKYEKLEKVGEGTYGKVYKAKELSTGQIVALKKTRLEMDEEGVPPTALREVSLLQMLSQSLYIVRLLNVEHIDKPPKNATHTPSKPLLYLVFEYLDTDLKKFIDTFRKGTNPRPLPNTLVQSFLFQLCKGVAHCHSHGVLHRDLKPQNLLLDQAKGILKIADLGLGRAFTVPLKSYTHEIVTLWYRAPEVLLGSSTYSTGVDIWSVGCIFAEMVRRQALFPGDSEFQQLLNIFKLLGTPTEQQWPGVSSLRDWHVYPRWEPQNLARAVPSLSPDGVDLLTKMLKYNPAERISAKAALDHPYFDSLDKSQY

SEQ ID NO: 39433 - protein, 231 aa, Burkholderia pseudomallei K96243
MTQDELKRLVGEAAARYVTENVPQGAVIGVGTGSTANCFIDALAAVKDRYRGAVSSSVATTERLKSHGIKVFDLNEIESLQVYVDGADEIDGSGAMIKGGGGALTREKIVASVAETFVCIADASKRVAVLGQFPLPVEVVPMARTAIGRRLAALGGVPVLRVKQDGAPYVTDNGNEILDVKGLRIDDPRALEAAINGWPGVVTVGLFAQRGADLCLLGTERGVETLRYAAH

SEQ ID NO: 39434 - protein, 414 aa, Medicago sativa
KFKQSKDGDGVSPTAIREIMLLREITHENVVKLVNVHINHTDMSLYLAFDYAEHDLYEIIRHHRDKVNQSINQYTVKSILWQLLNGLNYLHSNWIVHRDVKPSNILVMGDGEEHGVVKVADCGLARIYLAPLKPLSENGVVVTIWCRAPELLLGAKHYTSAVDMWAVGCIFAELLTLKPLFQGAEVKATPNPFQLDQLDKIFKVLGHPTLEKWPSLAHLPHWNQDTSHIQGHKYDNASLNSVVHLSPQSPAYDLLSKMLEYDPKRRITAAQAMEHEYFKMEPQPGRNALVPCQPGEAFVNYPTRPVDTTTDFEGTTNMQQSQPVSSGAAIAGNMPGGHASNRSVPRPINVGMQRMHQLQTYNLTSQAGMSSGINPAGIPMQRGVPQQAHQQQQLRRKDPMGMPGYPPQQKSRRM

SEQ ID NO: 39435 - protein, 342 aa, Solanum chacoense
MGALPHHHLQLHIQQQQPHQQQQQQQSKSYRDLYNNMDGQITTPVVYFNGSNLPEQSQHPPYIPPFQVVGLAPGTADDGGLDLQWNYGLEPKKKRPKEQDFMENNNSQISSVDLLQRRSVSTGLGLSLDNGRLASSCDSAFLGLVGDDIERELQRQDAEIDRYIKVQGDRLRQAVLEKVQANQIQAITYVEEKVLQKLRERDTEVDDINKKNMELELRMEQLDLEANAWQQRAKYNENLINTLKVNLQHVYAQSRDSKEGCGDSEVDDTASCCNGRATDLHLLCRDSKEMKELMTCRVCRTNEVGMLWLPCKHLGLCKECESKLSLCPLCQSIKYIGMEVYM

SEQ ID NO: 39436 - protein, 127 aa, Acinetobacter sp. ADP1
MSRQVIHTENAPAAIGTYSQAILIDNTLYLSGQIGLDPYSMELVDGIEAQIRRVFDNLKAVCEAAGGTLADIAKLNIFMTDLSHFQLVNQIMGEYFAQPYPARAALGVASLPKGALVEMDGIVFINQ

SEQ ID NO: 39437 - protein, 506 aa, Burkholderia pseudomallei K96243
MHAGGPQRSPLVANSLSRIEHIVHLMLENRSFDQMLGFLYTDDGNRSPTGQPFDGLTGNESNPDDLGRPVGVYRIRATDPHPYLMPGADPGEGFQNTNYQLFCDDHPAPGAVPTNQGFVVNFKSAIATDQSRHDKDALPGTTPEQIMGMYTPELLPVLSGLAKGYAVCDRWFASAPTMTMPNRAFALAATSQGHLDDHVKIFTCPSIFGRLSDQGVDWAIFGYNRDPLTRHDFPDTQNADDSHFGHFRDFQARAASGTLPAFTFLEPSWDASGNSQHPNYDVAAGEQLIHDVYYALRNGPGWNSTLFIVTYDEHGGNYDHVAPPSGATPPGDGTVGEFGFDFTRFGVRVPAVLVSPLIAAGTVFRSAAGTIDHTSVLKTIGERFGTAPLTARDRAAPSLGDALTLASPRAASDDPLAGVTVPVSRVSHPNAAMPSKLDKLQAARIAALPLRNEKGYYEEADTPLASSAELSNFIRDRGAAWSQHRQRQQQRRQQQQRQQPRSKPRR

SEQ ID NO: 39438 - protein, 303 aa, Arabidopsis thaliana
MIPYATVEEASIALGRNLTRLETLWFDYSATKSDYYLYCHNILFLFLVFSLVPLPLVFVELARSASGLFNRYKIQPKVNYSLSDMFKCYKDVMTMFILVVGPLQLVSYPSIQMIEIRSGLPLPTITEMLSQLVVYFLIEDYTNYWVHRFFHSKWGYDKIHRVHHEYTAPIGYAAPYAHWAEVLLLGIPTFMGPAIAPGHMITFWLWIALRQMEAIETHSGYDFPWSPTKYIPFYGGAEYHDYHHYVGGQSQSNFASVFTYCDYIYGTDKMWLYQGYRFQKKLLEQIKESSKKSNKHNGGIKSD

SEQ ID NO: 39439 - protein, 524 aa, Carboxydothermus hydrogenoformans Z-2901
MLLLTGREMAEFDQKAINEYGIPGIVLMENAALKTFYRIKEILGDVSGKKIIILVGKGNNGGDGLALARHLANAGAKIRVFLLFKDNFKGDALINFNILKKMSEKIYEGITENLNLLKISLIDADMVVDAIYGTGFRGALPPEIREVVEIVNQADAVRLAVDIPSGVDASTGQVEGVAFQADYTVTFGLPKVGQILFPGRKYCGEIYVEDISFPEKLKKEFSVRRWLIEEKLIKKIIKPVAADTHKGRQGFTLVAGGSRAYSGAPLLSARGCLASGVGGVYLAVPEELFEPLAGKVPEIILRGIPAAAGQLAAEGFFMLSELLSKVKAAVIGPGMGELTGSKEAYLNFLESCPLPLVIDADGLNNLVGYLEVLKRRTAPTVLTPHLGEMARLLGLSVNEVKVKGEEISKEFTKEYNVYLVLKSETTLIAAPTGEVWYLAGGNPLLAKAGSGDVLSGLIAGFLTQGYGPEEAAILGVYFHGRAGELALKERAVNSFFISDIFSYLNEVFREVGGNGGKKNIHMER

SEQ ID NO: 39440 - protein, 536 aa, Zea mays
ANANATRLSLTSMMDLAAYIAILSLVFLFLLRRVHGLARRDGKSRSMRRPPPSPPGAVPFLGHLHLIKKPFHATLSGLAQRHGPVFTLRLGSRDAAVVTSPACARECFTEHDVTFANRSLLPSQRLVTFDGAALGTASYGPRWRDLRRVAVVQLLSAHRVGCMSGVICGEVRAMVRRLHRAAAAAAGAGARVELKRRLFELSLSVLMEAIAETKAARRDPEPEPDADGTTDMSPEAQEFKRVIDEVFPYVSSVLWDYLPVLRWFDVAGVRSRILAAVSRRDAFLRRLIDAERRRMADGVCGEKKSLIAVLLALQKLEPEVYTDTVITAFCSKNLFGAGTETTSTTVEWAMSLLLNNPGTLEKAREEIDAAVGHSRLLNAGDLPRLGYLRCIIAETLRLYPAAPLLLPHESSADCKVGGYDVPRGTALLVNVYAIHRDPAVWEEPGRFVPERFEGGKAEGLFVAPFGMGRRKCPGERLALQTVGVALGSLIQCFHWSRVDGVEVDMSEGSGLTMPKAVPLEALCTTREAMYDVLQKL

SEQ ID NO: 39441 - protein, 606 aa, Oryza sativa (japonica cultivar-group)
MKISATWEEGGSKTPASPARVVQYEASDVGADDALGIWKIDDADNSFYTQPFRIKYARQDIYLSVMVSFNIFNSEEEGPAASSVILKFELIYAPTLENGSDIQASSATSSAAVHEFRVPRRALLGSHSYCPVHFDAFHSVLVDLTLHIVYLKAGATKSSLKIPDQGLGPTSHHIVKALLTSREMLLEELKKISDAIGKTVEDLDVADLSLGKYEAVQPAKSGLPNSNKVFPATTKGVGHLAGILHDFLEKPNSAVDGANDAMLYTLPKEELLELFLTINTLSVQDMQIYADPSRVPVVLIEQHVMVVPQHGSSKDLATNSSEQKDTIVLPKLQGDSLALKSSAVRVKLIMVYKKQGHHLDLRLVRNQWLLLDPGAECLMSEANEDKTSGDFKEMGGRLAGEVVAFLKKKVDKLAKYGGCKELKLSFVGHSIGNVIIRTALAEPALQPYLKNLYTYMSISGPHLGYWYSSNSLFNSGLWLLKKLKGAQCIHQLTFSDDQDPQNTFFYKLCKDGYVPYHSARIELCPAASSDNSRKGQVFTEMLNNCLDQMRAPTSETRIFMRCDVNFDQSAQGRNLNTMIGRAAHIEFLETDIYAKFIMWSFPELFR

SEQ ID NO: 39442 - protein, 126 aa, Lactococcus lactis
MKIIATLDAPAAIGPYVQGKIVNGLLYASGQIPLNPLNGEIVGDSIETQTEQVMKNISAILKEAHSDFDLVIKTTCFLKNIEDFSRFNAIYSKFFDKEFAARSAVGVAGLPKNVLIEIEVIAEVKS

SEQ ID NO: 39443 - protein, 232 aa, Triticum aestivum
DGGVTDIGLTILAHGCKRLVKLELVGCEGSYDGIAAVGRCCAMLEELTIAEHRMDGGWLAALAFCGNLKTLRLQGCARIDDDPGPAEHLGACLTLESLQLHRCQLRDRHALHALFLVCEGARELLVQNCWGLEDDMFALAGLCRRVKLLSLEGCSLLTTRGVESVVTSWNDLQSLQVVACNKIKDEEMTGALSELFSNLKELKWRPDNKSLLAASLVGTGMGKKGRVFFKRV

SEQ ID NO: 39444 - protein, 493 aa, Legionella pneumophila str. Lens
MNKLENALYRCDQIKACEQQAATLYQKDENALMALAGAEAFSFLQKLYPHVRHIAVFCGAGNNAGDGYVLARLAHEQGFSVTVYQCKSIEDLPSAARNAARLALASGVHCQSADEPLDVDAELIVDALLGIGLQGAVHGVIANAIHQINASGLPVLSIDIPSGLNADTGLVENICVNATATITFIGLKTGMYTLDGPDYCGVIHCAHLNLEACTTKLTRFASLLRDSTLPLPLAARKKNSHKGDYGHVLVIGGGPGMPGAVSLAAKAALKTGAGVVTVATWPDYAKSALPLIPEAMIWGVKTAGELTPLLAKATVCVIGPGLGDSDWAKTLFLTAITTQLPMIIDASALRLLSQYPQMDDNWILTPHPGEAASLLSCTARDVQIDRYHAASAIQKQYGGVVVLKGVGTVIQTAEKNIFVCPQGNPGMATAGMGDILSGIIAAFCAQGFTLSDAAKLGVWVHAVAGDKVAEKSGEVGVLASDLLDEIPSILNCI

SEQ ID NO: 39445 - protein, 187 aa, Oryza sativa (japonica cultivar-group)
MALRLSVSSSHGPASSPAISTCRPAACGRFPALLGGGVASQRRSLTVVSGPETRAVIPVRSSGSDTATVGAEAEAVAVTGQVTEVNKDTFWPIVKSAGPKVVVLDMYTQWCGPCKVMAPKFQEMSEKDQDVVFLKLDCNQDNKSLAKELGIKVVPTFKILKDGKVVKEVTGAKLDELIQAIETVKSS

SEQ ID NO: 39446 - protein, 216 aa, Zea mays
MEKKAGREHVIGIPVNNRAFGIEEPDFSSKGAARNAAAAGRAAKSGWTTGDRVAQGLKEHVALGPNLYETVRGKLSLGARILRAGGVEKAFRRWFSVVGKGERLLRASQCYLSTTAGPIAGTLFVSTERIAFRSDRSLALTSPKRGTVVLVRVPYKVSIPLGRVKTATPGGNKDRPEQKYVQVVTDDGFVFWFMGFVRYQVSLHELEKAIKQAQAQ

SEQ ID NO: 39447 - protein, 533 aa, Prochlorococcus marinus subsp. marinus str. CCMP1375
MNFPDFNNNNKDDQWERFSQLLFYDEEIGFWLDISRMKFSSEDIGSLQDNFKEACKSMKALEKGSIANIDESRQVGHYWLRNASLAPSKQTSNSIRNEINDIKTFGENILNGKITTAQGKPFTDVLWIGIGGSGLGPLLIVNSLQDNNKGLNFSFLDNVDPNGINKTLNSFRDKLSTTLFVVVSKSGGTPEPQIAMDQTRFFLDKNGLDWSSRAVAITMEGSSLDQIAENEKWLKRFDLPDWVGGRTSITASVGLLPLVLIGEDIDSFLDGASQMDQITRRIDIYKNPSALLAASWYFSGAGKGKRDMVVLPYQDRLQVFSKYLQQLVMESLGKEEDRNANKVNQGLAVYGNKGSTDQHAYVQQLRDGIDNFFVTFVEILEDCTEIPKINKKSPGDYLSGFLQGTRLALSENDRQSITITIKKFNSYTLGSLIALFERAVGIYAELIDINAYHQPGVEAGKKAASNILKLQSEIELLLEDGKLYSIEGIMNTIPGSSQESIYIILRHLSNNDHTYKFVGNLSDPRELQIKKAV

SEQ ID NO: 39448 - protein, 912 aa, Wolbachia endosymbiont of Drosophila melanogaster
MMGEKLIHYFSQGKCEGNAEMKNLLGGKGANLAEMCNVGIPVPPGFTISTSACKVYYQDNRSSVIQVADYSDPEKNVVTHWNDICSGIKNYMAMLENDIGCKFGDLNNPLLVSIRSGSVSSMPGMLDTILNVGLNDETVVGLAKKSGERFAYDSYCRFIMMYSNVVLQLDHHLFQDVVDNKQQKSGAKSLADLDVDVLKEIVNNFKRIVHEKTGKHFPQNVEEQLLSSVNAVFASWKNDRAVSYRKIHNIPENFGTAVNVQAMVFGNLNDNSATGVIFTRNPSTGEKKYFGEFLINAQGEDVVSGVYTPMPIDGEQKNTMEKLLPSVYRELCVVCEKLERHYKDMQDIEFTVQDGKLWILQTRSGKRTAEAAIRIIVDMVNEGTITKEEGILRIDPKTFDNLLHPVLDVKSDQKVIGKGLPASPGVASGYVVFSASDAEKAAEQGKKVILVRSETSPEDINGMNAASGIVTARGGMTSHAAVVTRGMGKPCICSVSGLYIDKDGTFFSVGDTKVNKGEPITINGGTGEVMLGILPTISPELSQEFKTVINWIDEIKTVKVRANADTPKDAKIAKEFGAEGIGLCRTEHMFFASDRIEFIQKLIIADDENERANALIKLEEMQKSDFKEIFSIMEGREVTIRLLDPPLHEFLPNDQSTIEKIAKSLSKSVESVKNKIAQLSEKNPMLGHRGCRLAISHPEIYSMQIRAILSAASELKKEKKIEVEPEIMIPFIMSEKEFILICELAKKESSVISAGIQTQIPASRAGMTSDKAYSIGTMIELPRAALIADKLAKHAEFFSFGTNDLTQTTMGLSRDDSVNFLDSYKESNIFENDPFEVLDIEGVGELIKMAIERGKKTRKEIKLGICGEHGADPKSIEFLIESGVDYVSCSPYRVPIAKLVAAQFSVRSKFAR

SEQ ID NO: 39449 - protein, 449 aa, Burkholderia thailandensis E264
MSYNDSRFWHPMLHPNDMKRREPIRIVRGDGCHVYDERGRQLVDGVAGLWNVNVGHNRAEVKEAIVRQLDELEYFQLFDGITHPRAEELSTKLIDMMEPEGMRRVLYSSGGSDSVETALKIARQYWKVRGQADRTKFISLKQGYHGTHFGGASVNGNTVFRRNYEPNLPGCFHVETPWLYRNPFTQDPEALGRICAELLEREILFQSPDTVAAFIAEPVQGAGGVIVPPANYWPLVREVCDRYGVLLIADEVVTGFGRSGSLFGSRGWGVKPDIMCLAKGISSGYVPLGATAVNARIEDAFASNADFGGAIMHGYTYSGHPVACAAALASLDIVLRENLPANAAKQGAHLIEALQPFVERFDAVGEVRGKGLMVALDLVADKATRAPIDPMSGYANAVAEVARENGVLVRPVGTKIILSPPLVIQREQIDRIVAGLEAGFRATPFSGGR

SEQ ID NO: 39450 - protein, 488 aa, Polaromonas sp. JS666
MSAVLADAPSQALPSRVLHESLRIAGEKVSRDRVIEVKHPYSGKIVATVPKATLDDVRRALRIARDYRSTLTRHDRYRILMKAGELVAHRRDEIARLITLESGLCLKDTQYEVGRASDVMLFAANQALVDDGQVFSCDLTAHGKSRKVYTLKEPLLGAITAITPFNHPLNQVIHKIAPAVATNNRVVLKPSEKTPLAAYLIADILYEAGLPPQMLSVVTGDPAEIADELLTSPDVDLVTFTGGVAIGKYIAGKAIYKRQILELGGNDPIIVMDDADIEEAATLAASGSYKNSGQRCTAIKRILVQESVADRFVELLVEKTRALKYGDPFDPAMDMGTVIDEPAAIHFEKVVNEAIAQGAKLLVGNVRRGALYAPTVLDHVRPGMTVVREETFGPVSPVIRFKTLDEAIAIVNGTAYGLSSSLCTNRLDTITRVVQELHVGSVNVREVPGYRLEMTPFGGIKDSGLGYKEGVLEAMKSFCNTKTYSLPW

SEQ ID NO: 39451 - protein, 411 aa, Nicotiana plumbaginifolia
MNALAATNRNFRQAARILGLDSKLEKSLLIPFREIKVECTIPKDDGTLVSYVGFRVQHDNARGPMKGGIRYHPEVDLDEVNALAQLMTWKTAVADIPYGGAKGGIGCKPKDLSKSELERLTRVFTQKIHDLIGINTDVPAPDMGTNAQTMAWILDEYSKFHGHSPAIVTGKPIDLGGSLGREAATGRGVVYATEALLAEYGKNIKDLTFAIQGFGNVGAWAAKLIHERGGKVIAVSDITGAVKNPNGLDIPALLNHKEATGKLIDFSGGDVMNSDEVLTHECDVLIPCALGGVLNRENADNVKAKFIIEAANHPTDPEADEILCKKGIVILPDIYANAGGVTVSYFEWVQNIQGFMWDEEKVNRELRKYMTKAFHNLKNMCQSHNCSLRMGAFTLGVNRVARATTLRGWEA

SEQ ID NO: 39452 - protein, 506 aa, Zea mays
MVSESNRGGADRTTAAGEERGQLLFDVPEIRFTKLFINGSFVDAVSGRTFETRDPRTGGVIASVAEADKEDVDLAERGRIMARLADLVEERADELAALESLDAGKHPAVTRAVDVGNAAGSLRYFAGAADKIHGETLKMPGQFQGHTLREPLGVAGVIIPWNFPSTMFAVKVAPALAAGCALVVKPAEQTPLSALYLAQLAKQAGVPDGVINVVPGFGPTAGAALASHMDVDMASNYRQISSHYTTGLAFVGRLIMKASAESNLKPVYLELGGKSPLIVFDDADLDMAVELAVGASFFNKGEACVAASRVYVQERVYDRFEERLAERMRSWVVGDPFSDPSADQGPQVDKAQYERVLSYIDHGKREGATLLTGGRPCGPEGKGYYIEPTVFTNVKEDMIIAKEEIFGPVMCLMKFKTVEEAIARANDTRYGLGAGVVTRDLDVANRVVRSVRAGVVWVNCYFAMGSDCPFGGRKMSGFGKDEGMHALDKYLAVKSVVTPLRASPWI

SEQ ID NO: 39453 - protein, 125 aa, Carboxydothermus hydrogenoformans Z-2901
MKEVINTSKAPQAIGPYSQAIKVNGFLFVSGQIGINPQTGELVPGGVEAQIKQAMENIRQILSAAGMEFSHVVKTTIFITNMDDFTTVNKIYSEYFGEVFPARSCIAVASLPKGALVEVEVVACK

SEQ ID NO: 39454 - protein, 875 aa, Carboxydothermus hydrogenoformans Z-2901
MGLKAVGKSRWIENFSQDIAEAANLPAEKWVNSVCPYCGAGCSILYGVREGKVVSVRGNPEAWNRGGVCIKGATLADLYLSNSPGVKDRLKKPLLRDPEKRGSLENFREVSWDEALNYMVKKVKEYTKTKFGDKHPFAMYGSGQVSTEFMYLQAKFNVIGMNIHNDNNGRLCQATKANAMVISFGIDGPPMSFDDVFEADNLFIFGFNIADTLPGWFGKIVEAKVQKGDNLKIAVINPVKISATQILNYKAGDLYLPIIPTTDVAFINSMAHVIIYELEGVNRDYAGDVSRWADDVISGKVKPKHIDTEFIAKYVNFYRGDYQVLARLGKEGPKIFEEIKLPSGLEGFKEYAKFLAAYKPEDVAKTTGLTPEDIRKAAQMFVRNKNTMSMYLQGFGQQSNGVSKHLALVTLHAVTGRIGRAGAGVMPTVGQPNGLGQRVGGAVVGRLPGNRNHPLAAHRASLAKAMARGNQEMEAKILERLEDPVTKYSRLSLTSVDIFKNLKNGNIKGIWTVCTNPMVAFPNLNMVHEALRKADLVVVQDIYPTETMAFADVVLPAAAISGEAYGTYLNSERRVQILEKAVEPPGDALPDEIIHLAFVYKYQKALAEEGRQEDADFLKFLLEPIIQGYEPLFENVQANIRELREAHQEIQKRLFSELAYVSKGIPGNDLSGLSYERLRTEKDAKGYVGFKLPVLDSSHKGLERLYDENYEAIYQKRFATPDGKLRCFLFEQVHPAEEWIDAEYPFMLTLPRIYEHWHTRTRTGRCALPHRLRPEAWLSINPNDAKKLGIKDGDWVEVESRRGKVTVKAKIDTVKTPREGVVWMPWAYGFLGNLFTGQKEAPPGKSAGNVLSTDAYDPVSKQPELKFAAVKIRKV

SEQ ID NO: 39455 - protein, 503 aa, Zea mays
MAAAALLWQAGRLLRLLWWQPRRLERALRAQGVRGTSYRFPAGDLKEYGRLAKEAWSKPLPLRCHDTAPRVAPFLHRLVLEHGRTSMSWFGPSPKVTIVDPELAKDVLSNKFGHFEKLKVPALSKMLGSGVASHEGEKWVKHRRILNPAFHLEKLKRMLPAFSACCEELVNRWAAESLGSDGSCELDVWPELQNLTGDVISRTAFSSSYREGRRIFQLQAEQASLVMTNIRKIMMIPGYMYLPTANNRKMRRNNREVESILREIIGKRIQAMERGEGTKDDLVGLLLETNMRDDMGMTIEDVIEECKVFYFAGMETTSVLLTWTMVVLSMHPEWQDRAREEVTALFGRDDKPEYDGLSRLKVVTMVLYEVLRLYPPATSVVRQTYKEMEVGGVTYPAGVILELPVLLIHHDPDIWGGDAREFRPDRFSEGVSRASKDPGAFLPFGWGPRICIGQNFALLEAKMALCMILQRFEFGLAPFYAHAPHTVITLHPMHGAQLKLRAI

SEQ ID NO: 39456 - protein, 565 aa, Bradyrhizobium japonicum USDA 110
MRHGSFSGERRQVRSSYNMAFARPCTSRHGRSSFLAAFTPFRHRCILSRPTIPPRSNPINHLTGSAAMAVSQAIPITRHPFANGSYKQMLIDGKWVDAASGKRFETHNPATGELLATVAEGDKEDIDRAVAAARRAFEGPWSKVKPFERQNLLLRLADLVEKNFDELSQLDTLDMGAPLSRTRAYRLRAVGMLRYYAGQTTAIHGETIENSLPGEIFSYTLKEPIGVVGAIIPWNGPLTATIWKIGPAIATGCTVVLKPAEEAPLTSLRIAELAMEAGIPPGVVNVVPGYGETAGAALAAHPDVDKVAFTGSHVTGQSIIRASAGNLKRVSLELGGKSPDIVFADADLDAAVPGAAMAVFANSGQICSAGTRLFVEQSIYEEFVGRVAEFGKKLQVGNGLDPNVQIGPLVSEQQLERVTGYLDIGQKEGARALAGGGRVTEGALSKGFFVSPTVFAGVQDNMRIAQEEIFGPVISAIAFKDMDELVKRANNTTFGLGSGLWTRDVSKAHAVAKSLRAGSVWVNCYQAMDPAVPFGGYKMSGYGRESGKQHVEEYLNVKAVWIKTA

SEQ ID NO: 39457 - protein, 219 aa, Ashbya gossypii ATCC 10895
MSNNEDYGYDYDYLFKIVLIGDSGVGKSNLLSRFTTDEFNVNSKSTIGVEFATRTIEVEGKKVKAQIWDTAGQERYRAITSAYYRGAVGALIVYDISKSSSYENCNHWLTELRENADENVAVGLIGNKSDLAHLRAVPTDEAKNFAQGNQMLFTETSALNAENVDLAFRELITAIYQMVSKNQVDLSENNGSGTVPRGPTISLAPAPSEKSKKKTNNCC

SEQ ID NO: 39458 - protein, 375 aa, Zea mays
RNGWWSMNNLLRPPFEQQHHASLFMPSTTTSSSTAAAAPSSSSSSSPPLQSFSSLLLSNHYPLPTTTSTSPWQNDSSSTSSHGQPDSWSQLIHTGSKESQMAFPTTICSESGGGGSSYVVYGAAAASHGSSTSDVEIQLPWGSSSVLQQQQQKASSPRSSSRTTATTTSPGSNMLEFSNNSSSSPRECISTVSGSAFKKARTQEPSPAQSTVKVRKEKLGDRITALHQLVSPFGKTDTASVLLEAIGYIRFLHSQIEALSSPYVGGSNGGGGGSKQNQQLHEASAQRESRHSIFPEDPGQLLHDSSAINKRAGLQPADGEQDEESCDEEKKKDLRSRGLCLVPVSCTLDVGVDVAAGPADYWAAAAPAFGMGFGA

SEQ ID NO: 39459 - protein, 136 aa, Triticum aestivum
  misc_feature (38)..(38): Xaa can be any naturally occurring amino acid
  misc_feature (58)..(58): Xaa can be any naturally occurring amino acid
  misc_feature (72)..(72): Xaa can be any naturally occurring amino acid
  misc_feature (85)..(85): Xaa can be any naturally occurring amino acid
  misc_feature (90)..(90): Xaa can be any naturally occurring amino acid
  misc_feature (92)..(92): Xaa can be any naturally occurring amino acid
  misc_feature (96)..(96): Xaa can be any naturally occurring amino acid
  misc_feature (99)..(100): Xaa can be any naturally occurring amino acid
  misc_feature (102)..(103): Xaa can be any naturally occurring amino acid
  misc_feature (105)..(105): Xaa can be any naturally occurring amino acid
  misc_feature (110)..(110): Xaa can be any naturally occurring amino acid
  misc_feature (118)..(118): Xaa can be any naturally occurring amino acid
  misc_feature (133)..(133): Xaa can be any naturally occurring amino acid
MAPAVMASSATTVAPFQGLKSTAGLPVGRRSSGSLSKXVSNGGRIRCMQVWPIEGIKXKFENLSYLATLSKXGLLKQVHYLIRSXKWVAXLXFNKXGFXXRXXNXSPGYXEGRYWAMXELPMFRCTDPNKVLXEGE

SEQ ID NO: 39460 - protein, 251 aa, Oryza sativa (japonica cultivar-group)
MSTKMKKGILRPFRYISNMMDGKEAAQDMQIGFPTDVKHVAHIGWDGPSVPNNNNNTAGAPSWMKDYHSAPLDSASFRSDRGGSAAANPWASQEIVVDGGSLGDTSFSETRSEASGSMDITAGDSPPSPDSRRSRRHRSRGSAATSSMDCTAADGGAAPEKKDKAKKSSRGKNRKKDKSDKSAAAGAGDDASGATCQDLPAVPKKSNRRKNKGGSEGTGAAAASKADGAGAGGEDAAAPEPPATEEAQDHD

SEQ ID NO: 39461 - protein, 379 aa, Psychrobacter arcticus 273-4
MAAQNQSTKVLSGAGLRGQVAGKTALSTVGKSGSGLTYRGYDVSELADKCIFEEVAYLLLYGNLPTQSELDAYQTKLKGLRGLPQSLKEVLERIPAAAHPMDVLRTGCSMLGNLETEISFDEENDQADRMLAAFPSIINYWYRFSHDNVRIETETDDETIGGHFLHLLKGEKPNELHTKVMNVSLILYAEHEFNASTFTARVCASTLSDIHSCITGAIGSLRGHLHGGANEAAMDMIEGFSSPDEAESEMMAMLARKDKIMGFGHAIYSESDPRNVVIKGWAEKLAADVGDDVLYPVSVRCEEVMWREKKLFCNADFFHASAYHFMGIPTKLFTPIFVCSRLTGWAAHVFEQRANNRIIRPSAEYTGEELRPVPDMSAR

SEQ ID NO: 39462 - protein, 87 aa, Polaromonas sp. JS666
MNAALCAVCRPRTGLCGIEAILKAGGSSLGQVVRATAYLTNMDDFAAVNAVYARYFPSAFPARSCVEVSRLPLGALVEIDVIARVAA

SEQ ID NO: 39463 - protein, 489 aa, Burkholderia thailandensis E264
MTTAHETLALKDPALLRERAFVAGEWQAADGGATLEVRNPATGALIGTVPAMGAAETRRAIDAANAAWPAWRKKTAKERAAILRKWHDLMIAHADDLALILTTEQGKPLAEAKGEIGYAASFLEWFAEEGKRVYGDTIPSPANDKRIVVTKEPVGVCAAITPWNFPAAMITRKVGPALAAGCPIVVKPAEATPFSALAMAVLAERAGVPAGVFSVVTGEPKAIGGELTSNPIVRKLSFTGSTPVGRLLMAQCAATVKKVSLELGGNAPFIVFDDADLDAAVEGAIASKYRNSGQTCVCTNRFYVHEKVYDAFAEKLTAAVAKLKVGLGTEAGVVQGPLINGAAVQKVESHIADALDKGARVTTGGKRHALGHGFFEPTVLTGVTPDMKVAKEETFGPLAPLFKFSTEEEAIRYANDTEFGLAAYFYSRDIGRVWRVAEALEYGMVGINAGIISNEVAPFGGVKQSGLGREGSHYGIDDYVVIKYMCVAV

SEQ ID NO: 39464 - protein, 396 aa, Nocardioides sp. JS614
MAEAESASPHPYAGDPVFDLHVGGKMAVRSSVALDGPDDLSKAYTPGVARVCEAIAEDPSLTQHYTWVPNTVAVVTDGTAVLGLGDIGPAAAMPVMEGKAVLFKQFAGVDAVPICLDTTDAEEIIETVARLAPSFGGINLEDISAPRCFEIEDRLKERLDIPVFHDDQHGTAVVTLAALTNALKLTGRNPESTRVVISGAGAAGVAVAKILLEAGIKDLAVTDRKGVLNSERGDLTPVKRSLAVLTADRSGRTGSLADVLAGADVYIGVSGGTVPEEWVAAMAPDAIIFGLANPTPEVHPEVAHRHARVVATGRSDFPNQINNVLAFPGIFRGAFDVHATAITEGMKVAAAQALADLVGDALAEDMVIPSPFDPRVGPAVAAAVADAARRDGVARR

SEQ ID NO: 39465 - protein, 106 aa, Xanthomonas campestris pv. campestris str. ATCC 33913
MPVMERIQAEVEQHPIVLFMKGTPQFPMCGFSSRAVQALVAAGADQLRTVNVLEEPEIRANLPRYSNWPTFPQLFIHGELIGGCDITMELFEAGELKRIVSEAYQP

SEQ ID NO: 39466 - protein, 462 aa, Bacteroides fragilis NCTC 9343
MNQTVTENHRLRDTIIIGAGLTGLTTAYCLTRKGCDIEVIEQSPCVGGQIRTYHENGFTFESGPNTGVISHPEVAELLAELSPTCRLETAREASRQRLIWKGDRFHSLPSGLFSAITTPLFSTKDKFNILGEPFRSKGNNPDETIGELIQRRLGISYLHYAVDPFISGVYAGDPMRLVTRHALPKLYQLEQTYGSFILGGIAKSFSHRSERDRLATRKVFSTYGGLSNLTKALEQAIGIKRFSLGATSTSLMPCEQGWVVSFTDSCGIVNRIHCRKVITTAPAFALPSLLPFVPDKQMNRISNLTYAPVMQVSVGLRNTYGKEFHAFGGLVPSCEQKPVLGILFPSACFDNRSPEGGALYSYFLGGTRHPELLEKSDDEIIRLITTGLNEMLDYPAGIVPDLIRIFRHKKAIPQYESSSTDRFAAINELQKQYPGLVVAGNLKGGIGMADRIKQAVEIARER

SEQ ID NO: 39467 - protein, 196 aa, Arabidopsis thaliana
MADSGDVQALVVDNGSGMCKAGFAGDDAPRAVFPSIVGRPRHKGVMVGMGQKDAYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILN

SEQ ID NO: 39468 - protein, 438 aa, Polaromonas sp. JS666
MSQAPIPSASAAAGTHPLPSYLQADKLGPWGNYLQQVDRVIPHLGSLGRWAETLKRPKRILVVDVPINMDDGTIAHFEGYRVQHNVSRGPGKGGVRFHQDVTLSEVMALSAWMSIKNAAVNVPFGGAKGGIRVDPKTVSQGELERITRRYTSEIGIIIGPTKDIPAPDVNTNEQVMAWMMDTYSMNTGSTSTGVVTGKPVDLGGSLGRRDATGRGVFTVGVEAARHIDLDISTSRVAVQGFGNVGGVAGRLFHETGARIVAVQDHGGTIYREAGLDVPALIRHVAETGSVGGFPNAEVIANELFWEVDCDIMIPAALEEQINAANAGRIKARMIIEGANGPTTPEADDILQERNVLVLPDVIANAGGVTVSYFEWVQDFSSFFWDEAEINARLVRIMKEAFAGVWQVAQDHKVTLRTATFIVACKRILHTRQLRGLYP

SEQ ID NO: 39469 - protein, 262 aa, Oryza sativa (japonica cultivar-group)
DFLKKSISSRRFPCSPDFSTPFQEQSRQRAKKQQGKMCSIRSFAFVLVLAFSVAVAESRDSFNVLAHKSFPLENKKTGLTSANGKLCQLCEQYSTEALFYLQQNETQTEILSILHHACANVGPLKQQCITLVDYYIPLFFLEVSMVTPEKFCESVHLCRKGTMLRLPSRGDTCGICHHVLVEVLIMLKDPDMQLEIVEIFLKACSKADNYVQQCKKMVLEYTPLILVKSQKFLETTDVCSTIHACKTGTQASAETMLLSAAS

SEQ ID NO: 39470 - protein, 447 aa, Brucella suis 1330
MPINITMPALSPTMEEGNLSKWLVKEGDKVAPGDVIAEIETDKATMEVEAVDEGTVAKIVVPAGTEGVKVNALIAVLAEEGEDVAAAAKGAGAAPKAEAPKEEPKPAEAKKEAAAPAAAPAPARSEQPAVAPAVNKGERVFASPLARRIAKDAGVDISAVKGSGPHGRVIQRDVEAALASGGAKAVSAQAESAAAPKPMSDDAILKLFEDGSYEVVPHDGMRKTIARRLVESKQTVPHFYLTIDCELDALLALRSQINAAAPMLKTEKGEVPAYKLSVNDMVIKATALALRDVPEANVSWTEGGMIKHKCSDVGVAVSIPGGLITPIVRHAESKTLSVISNEMKDMARRARDRKLKPEEYQGGSTSVSNLGMFGVKDFAAIINPPHATIFAIGAGEERAVVKKGEIKVATVMSVTLSTDHRAVDGALAAELAQAFKRHIENPMGMLV

SEQ ID NO: 39471 - protein, 461 aa, Brucella suis 1330
MPIEILMPALSPTMEEGKLSKWLKKEGDKVTSGDVIAEIETDKATMEVEAVDEGTIGKLLVDEGTEGVKVNTPIAVLLGDGESAADIGSAPAAKAEAAKEEPKAEENKADAVPAAPKAPAVEVASDPDIPAGTEMVSMTVREALRDAMAEEMRRDPDVFIMGEEVAQYQGAYKITQGLLDEFGPKRVVDTPITEHGFAGVGVGAAFAGLKPIVEFMTFNFAMQAIDQIVNSAAKTLYMSGGQMGAPMVFRGPSGAAARVAAQHSQCYAAWYSHIPGLKVVMPYTAADAKGLLKAAIRDPNPVIFLENEILYGHHFDVPKLDDFVLPIGKARIHKQGNDATIVSFGIGMTYAVKAAEELAGQGIDVEIIDLRTIRPMDIPTVVESVKKTGRLVTVEEGFPQSSVGTEIATRVMQQAFDYLDAPILTIAGKDVPMPYAANLEKLALPSVAEVVEAVKAVTYTA

SEQ ID NO: 39472 - protein, 901 aa, Mycobacterium bovis AF2122/97
MASYLPDIDPEETSEWLESFDTLLQRCGPSRARYLMLRLLERAGEQRVAIPALTSTDYVNTIPTELEPWFPGDEDVERRYRAWIRWNAAIMVHRAQRPGVGVGGHISTYASSAALYEVGFNHFFRGKSHPGGGDQVFIQGHASPGIYARAFLEGRLTAEQLDGFRQEHSHVGGGLPSYPHPRLMPDFWEFPTVSMGLGPLNAIYQARFNHYLHDRGIKDTSDQHVWCFLGDGEMDEPESRGLAHVGALEGLDNLTFVINCNLQRLDGPVRGNGKIIQELESFFRGAGWNVIKVVWGREWDALLHADRDRALVNLMNTTPDGDYQTYKANDGGYVRDHFFGRDPRTKALVENMSDQDIWNLKRGGHDYRKVYAAYRAAVDHKGQPTVILAKTIKGYALGKHFEGRNATHQMKKLTLEDLKEFRDTQRIPVSDAQLEENPYLPPYYHPGLNAPEIRYMLDRRRALGGFVPERRTKSKALTLPGRDIYAPLKKGSGHQEVATTMATVRTFKEVLRDKQIGPRIVPIIPDEARTFGMDSWFPSLKIYNRNGQLYTAVDADLMLAYKESEVGQILHEGINEAGSVGSFIAAGTSYATHNEPMIPIYIFYSMFGFQRTGDSFWAAADQMARGFVLGATAGRTTLTGEGLQHADGHSLLLAATNPAVVAYDPAFAYEIAYIVESGLARMCGENPENIFFYITVYNEPYVQPPEPENFDPEGVLRGIYRYHAATEQRTNKAQILASGVAMPAALRAAQMLAAEWDVAADVWSVTSWGELNRDGVAIETEKLRHPDRPAGVPYVTRALENARGPVIAVSDWMRAVPEQIRPWVPGTYLTLGTDGFGFSDTRPAARRYFNTDAESQVVAVLEALAGDGEIDPSVPVAAARQYRIDDVAAAPEQTTDPGPGA

SEQ ID NO: 39473 - protein, 643 aa, Bifidobacterium longum NCC2705
MAVRGDIRNVAIVAHVDHGKTTLVNAMLQQSHVFSEREEVPDRVMDSNDLEREKGITILAKNTAVEYTGPLAAKYGHPEGITLNIIDTPGHADFGGEVERGISMVDGVVLLVDASEGPLPQTRFVLRKALEAKLPVILCVNKVDRPDARIEEVVGETSDLLLGLADDVQHEGIDLDLDQLLEMPVIYCAAKAGYASVNQPADGGLPDNDNLEPLFETIISTIPAPEYEEGAPLQAHVANIDSSDFLGRLGLVRIYNGTLEKGKTYGLSRVDGSLENFRVSELLRTQGLERIPVESAGPGDIVAVAGVNDIMIGETIVDPNDPKPLPLIHVDDPAISMTFGTNDSPLAGTEGKDHKLTARMIKDRLDRELIGNVSIKVLPTDRPDAWEVQGRGELALAVLAEQMRREGYELTVGRPQVVTKKIDGVINEPMENTTIDVPEEYMGTVTQLMADRKGRMDGMTNHGSGWVRLQFTVPSRGLIGFRTALLSATRGTGISSSISAGYAPWAGAITIRQNGSMVSDRKGIATPYAMQRLQARGNFFVEPQSPVYEGQVVGVNNKPDELDVNITLAKHMTNMRSSTADVLETLTPPIKMSLEESLDFANEDECVEVTPESIRVRKIILGREDWYKWRAKQRRQNAAQQGK

SEQ ID NO: 39474 - protein, 235 aa, Glycine max
MAVQLWETLKEAIVAYTGFSPSTFFTVLALLFAAYYVVTGLFGSSDDHHHRHRHAQEEEMPPLRPPVQLGEITAEELKAYDGTDPEKPLLMAIKAQIYDVSQSRMFYGPGGPYALFAGKDASRALAKMSFEEKDLTGDISGLGPFEIDALQDWEYKFMSKYVKVGTVKSEEVPVTEPESTGEPSESTSRDIDAAAAAAKHTEDGKSETPAVKSDETPSNVDADIPLRKMKKKRTS

SEQ ID NO: 39475 - protein, 247 aa, Emericella nidulans
MPLPARTASLSRNTNETKIQVSLSLDGGVLPPYEPSSHFPVPTDPLEAEAAKKGIVPNKDAAHATQFTPTQQITISTGIGFLDHMLHALAKHSGWSLAIRAKGDLYIDDHHTTEDTFLALGTAFTTALGARQSLARFGRGDAPLDEALSWAVIDLSSRPWAVINIGFKREKIGDLSTEMITHGLQSFAQAAGVTLHIGCTYGDNDHHRAESAFKALAVAIRAACARRVEGEVGAGDVSGTKGPALIE

SEQ ID NO: 39476 - protein, 656 aa, Burkholderia thailandensis E264
MCGISGFVGPVACAPETARATLARMTDSLAHRGPDDTGLWIDPDAGVALGHRRLSIVDLSEHGHQPMPSACGRYAMTFNGEIYNFRELRRELEREHRAPEWRGHSDSEVLLAAFSAWGIDRALQKAVGMFALALWNRESRVLTLARDRIGEKPLYYGRIGGSFVFGSELKALRRFPGFGAHPIDRNALCLYLRHASVPAPYTIYEGIRKLPPGTYVQHEGLGDEPAPRRYWSLDRVIAAGRANPFDGDANAAVAQLDHVLRDAIAEQSVADVPLGAFLSGGVDSSVIVALMQTQTAQPVQTFTIGFHEAGYDEAGYAKAVARHLGTSHTELYVKPSDVLATVPRMPSVYDEPFADSSQIPTLLVSELTRRHVKVSLSGDGGDELFGGYTRYFLTPRLWGRLRRVPAAVRMRIAAALHALRPDHADQIAALVQGAWSAAAQRDASPRVGDRLHKLANVMTADSRASLYRLLMSSVHHPERFTLAGHEPQTLIDTPGAWPAGLSFAEQAMAVDTLTYLPTDILTKVDRAAMAVSLETRMPFLDHRVVEFAWRLPEALRIPDGQDKWLLRKLLYRYVPRPLIDRPKQGFCAPVGAWLRGELSDWAAELLRPARLRDEGYLDATRVERLWRQHQSGRMNWQHPLWTVLMFQAWLERQRAE

SEQ ID NO: 39477 - protein, 487 aa, Triticum aestivum
MEKKQASYGKGAARMAPMEVSVEAGNGAESDWLDDDGRPRRTGTVWTASAHIITAVIGSGVLSLAWAIAQLGWAAGPAIMLLFALVIYYTSTLLAECYRSGDPETGKRNYTYMDAVRSYLPGTKVKLCGVIQYANLVGVAIGYTIAASISMRAIGRADCFHYHDVRGRSGKDECKSSSNPYMIVFGVVQILFSQIPDFDQIWWLSIVAAVMSFTYSTIGLGLGIAQTVANGGIQGSLTGLSVGPGVTSMQKVWRSLQAFGNIAFAYSYSIILIEIQDTVKAPPPSEAKVMKKATGISVATTTVFYMLCGCMGYAAFGDAAPDNLLTGFGFYEPFWLLDVANAAIVLHLVGAYQVFCQPLFAFVEKWAAARWPDSAFIARELRVGPFAISVFRLTWRTAFVCLTTVVSMLLPFFGDVVGLLGAVAFWPLTVYFPVEMYIVQRGVRRGSTRWVCLKMLSAACLVVSVAAAAGSIADVIGELKEYRPFSG

SEQ ID NO: 39478 - protein, 466 aa, Nocardioides sp. JS614
MSHEAGWAHAPGALRGPAWLQAPADPDALVSHLWSSTAHKVDGVLHVGGLSVPDVVANVNTPAYVLDEADFRMRARAFRDAFAAYDVFYAGKAFLCTTVARWVQEEGLCLDVCSNGELTVALRAGFDPARIGYHGNNKTVTELRRALAAGVGRIIVDSFDELARLEMITADSGLPARVMIRVTAGVEAHTHEYIATAHEDQKFGFSITSGDAFEAARRAEAAPGIDLLGLHSHIGSQIFDSSGFEVAARRVLALQARISQELGVTLPEMDLGGGFGIAYTTQDDPAEPAQLAPAMTKIVEHECRALGIPEPRLSIEPGRAIVGPAMCTVYTVGTVKPVQLDGGAVRTYVSVDGGMSDNIRTALYDADYSCTLASRPSTIGGSVLARVVGKHCEAGDIVVKDEFLPADVRPGDLVAVPGTGAYCRSMASNYNHALRPPVVAVRDGVARVVVRRETEDDLLATDMGDQ

SEQ ID NO: 39479 - protein, 561 aa, Arabidopsis thaliana
MKESFKVCFCCVRNFKVKSSEPPEEIKNLFHDYSQDDRMSADEMLRFVIQVQGETHADINYVKDIFHRLKHHGVFHPRGIHLEGFYGYLLSDFNSPLPLTREVWQDMNQPLSHYFLYTGHNSYLTGNQLNSNSSIEPIVKALRNGVRVIELDLWPNSSGKEAEVRHGGTLTSREDLQKCLNVVKENAFQVSAYPVVLTLEDHLTPILQKKVAKMVSKTFGGSLFQCTDETTECFPSPESLKNKILISTKPPKEYLQTQISKGSTTDESTRAKKISDAEEQVQEEDEESVAIEYRDLISIHAGNRKGGLKNCLNGDPNRVIRLSMSEQWLETLAKTRGPDLVKFTQRNLLRIFPKTTRFDSSNYDPLVGWIHGAQMVAFNMQSHGRYLWMMQGMFKANGGCGYVKKPDVLLSNGPEGEIFDPCSQNLPIKTTLKVKIYTGEGWNMDFPLDHFDRYSPPDFYAKVGIAGVPLDTASYRTEIDKDEWFPIWDKEFEFPLRVPELSLLCITVKDYDSNTQNDFAGQTCFPLSEVRPGIRAVRLHDRAGEVYKHVRLLMRFVLEPR

SEQ ID NO: 39480 - protein, 478 aa, Actinobacillus pleuropneumoniae serovar 1 str. 4074
MNLTSPGSFRQVVLKVPLKETALVRREYVFNAGVPVLGICYGMQTMAMQLGGLTETSDHREFGYASVDLQATDALFAKLNDNLTASEPKLDVWMSHGDKVTRLPQGFQVTGITPTCPIAAMSDESRRFYGVQFHPEVTHTKSGLELLTNFVVGICGCECKWTAENIIEDAVARIKEQVGDDEVILGLSGGVDSSVTALLLHRAIGKNLHCVFVDNGLLRLNEGDQVMEMFGDKFGLNIIRVNAEDRFLDALKGIDEPEAKRKTIGKVFVDVFDDESKKLTSVKWLAQGTIYPDVIESAASKTGKAHVIKSHHNVGGLPDYMKLGLVEPLRELFKDEVRKIGLALGLPAEMLNRHPFPGPGLGVRVLGEIKKEYCDLLRKADAIFIEELYKADWYYKVSQAFTVFLPVKSVGVMGDGRKYDWVVSLRAVETIDFMTAHWAHLPYDLLGKISNRIINEVNGISRVVYDVSGKPPATIEWE

SEQ ID NO: 39481 - protein, 132 aa, Brassica napus
  misc_feature (41)..(41): Xaa can be any naturally occurring amino acid
LDIFHYIFVWFLRKGLRRHQDATRARGGAVRVLANPNCLCXASSPPPGRVKAKKEVIMVDPLEAKRLAAKQMEEIKGRERQQRRREIEAINGAWAIIGLTIGLIIEAQTGKGILAQLVGYWSALLHLFTPST

SEQ ID NO: 39482 - protein, 214 aa, Brassica napus
  misc_feature (206)..(206): Xaa can be any naturally occurring amino acid
MGPKAGTLVIILLGLTLLSDARSFLHSSLDSEKVIKNEKVCTLCEEYVNVAISYLENNQTQAQIIEDLHDRCSHMRGFAQQCVTLVDYYVPLFFIQLESFQPQDFCKRMNLCDKVAALVEEASQDSCAVCHKTVSDILIKLQDPDTQLDIVELLLKGCKSFKNYEKKCKKLVFEYGPLILVNANDFLVKNDVCKLLRACPDEKTVXTQPGTADS

SEQ ID NO: 39483 - protein, 629 aa, Cocos nucifera
MAVLERDVMVPWFLWLILVFHPLARVLANSEGDALHSLRTNLIDPSNVLQSWDPTLVNPCTWFHVTCNNDNSVIRVDLGNAQLSGTLVPQLGLLKNLQYLELYSNNISGTIPSDLGNLTNLVSLDLYLNSFTGGIPDTLGKLTKLRFLRLNNNSLSGSIPQSLTNITALQVLDLSNNNLSGEVPSTGSFSLFTPISFANNPQLCGPGTTKACPGAPPLSPPPPFISPAPPSSQGSSASSTGAIAGGVAAGAALLFAAPAIGFAWWRRRKPQEHFFDVPAEEDPEVHLGQLKRFSLRELQVATDNFSTKNILGRGGFGKVYKGRLADGSLVAVKRLKEERTPGGELQFQTEVEMISMAVHRNLLRLRGFCMTPTERLLVYPYMANGSVASCLRERPPSEPPLDWTTRRRIALGSARGLSYLHDHCDPKIIHRDVKAANILLDEEFEAVVGDFGLAKLMDYKDTHVTTAVRGTIGHIAPEYLSTGKSSEKTDVFGYGIMLLELITGQRAFDLARLANDDDVMLLDWVKGLLKEKKLDMLVDPDLQDDYVEAEVESLIQVTLLCTQGSPMERPKMSEVVRMLEGDGLAERWEEWQKVEVVRLDVEMAPPNGNNEWIIDSTDNLHAVELSGPR

SEQ ID NO: 39484 - protein, 425 aa, Brucella suis 1330 [sequence omitted]

SEQ ID NO: 39485 - protein, 274 aa, Zea mays
MAATAISVRLHPTAARHVASARRARLGAVRAQSAPAAAAAALTQDDLKRLAAVRAVEQVKSGMVLGLGTGSTAAFAVAEIGALLAAGKLEKIVGVPTSKRTFEQAQSLGIPLSTLDDNPLIDLAIDGADEVDPDLNLVKGRGGALLREKMVEAASDKFIVIVDETKLVDGLGGSGLAMPVEVVQFCWKYNLVRLQELFKEEGVEAKLRFEGDKPYVTDNSNYIVDLYFKTPIKDALAAGQEIAALEGVVDHGLFLNMASSVIIAGTDGVSVKTK

SEQ ID NO: 39486 - protein, 254 aa, Brucella suis 1330
MTPGIRPLVAGNWKMNGKGESLTELRAIAAGLSSDLGRKLDAVICVPATLLSRAAETLEGETVGLGGQDAHFKTSGAHTGDISPEMLKEAGATHVILGHSERRTDHHESNKLICAKTEAAWAAGLVAIVCVGETASERKAERALDVIGDQLSGSLPDGVTAENTIIAYEPVWAIGTGLTPTVQDVRAAHAFMREQLIERFGAKGAHLRLLYGGSVKPSNAAELLGVADVDGALVGGASLKAADFLAICETYRNL

SEQ ID NO: 39487 - protein, 435 aa, Chlamydophila pneumoniae J138
MKRAIIIGAGISGLAAGWWLHKKFPQAEILVLDKEAYAGGFVRTESPQGFSFDLGPKGFLTRGDGEYTLKLIHELGLQNSLIFSDRAAKNRFVYYRGKARKISTWTLLRKGLLPSLIKDFRAPCYTQDSSVQDFLKRHSSQNFTSYILDPLITAIRAGHSSILSTHMAFPELAKREASSGSLLRSYLKNRSPKKSKTDRYLASLSPSMGTLITTIQEKLPATWKFSTSVTHIDCSPKEACVTTPSETFFADMVIYTGPLQQLPVLLPNYGIENLSKRVLPWNLSSISLGWHHANFSLPKGYGMLFADELPLLGIVWNSQIFPQATPGKTVLSLLIEGKWRESEAHAFAIAALSEYLNINQKPDAFALFSSQDGMPQHAVGFLERKERILPHLPGNLKIVGQNIAGPGLNRCIASAYHAICDLHTEETLAQPQSSL

SEQ ID NO: 39488 - protein, 471 aa, Bacillus cereus ATCC 10987
  misc_feature (25)..(25): Xaa can be any naturally occurring amino acid
MKQIFQKKPIAKLMQESKQKTLARXLGALDLTMLGIGAIVGTGIFVLTGVVAAKHSGPAIILSFAIAALACAFAAFCYAEFASSVPVSGSVYTYTYATMGEVFAFLIGWDLMLEYLLATSAVANGWSAYFQSLLKGFGIHIPTILSSAPGTGKGGIIDLPAVLIILVMTVLLSRGVRESARVNNIMVFIKLAVVLIFIFAGFNYVKPENWTPFMPFGLDGVMAGAATVFFAFIGFDAVSTAAEEVKRPQRDLPIGIIASLLICTALYIIVSLILTGIVPYGQLNISDPVAFALQFIGQDSLAGVISVGAITGITTVMLVMMYGQVRVSYAMSRDGLLPKRLAKVHPKFKTPFLNTWTTGIIAALISGLIDLNVLAHLVNMGTLSAFALVAVAVIVMRRTHPDLPRAFKAPLVPFLPALTVIFCLYLMLQLSGTAWISFGVWMIIGIAVYFLYSRKHSALNNSKEEDDAANL

SEQ ID NO: 39489 - protein, 367 aa, Oryza sativa (japonica cultivar-group)
MARWLYLAAPAAGPSEPARADVKARAFELVLNVVARMVAGKQYYGGEGDAEAETEEAARFREMVREYFAMHGASNLQDFVLLLGLVDIGGAKRRAVKLSRERNTWAQRLIDEHRATATAAAATEARTMVGDLLKMQASEPEAYSDKVITALCLTGTDTSSSTIEWGMALLLNHPAAMAKARAEIDRFVGTGRVVEEADLPNLPYLQCIIRENLRLYPVGPLLAPHESSADCSVSVAGGGRYAVPAGTMLLVNVHAMHRDARFWGPDPESFSPERFEGGRSEGKWMLPFGMGRRRCPGEGLAVKVVGLALATLVQCFEWRRVGDEEVDMTEGSGLTMPKAVPLEALYWPRPEMVPALSGIFFIYNFFY

SEQ ID NO: 39490 - protein, 551 aa, Malus baccata
MENKIQDQQQGTSTDGASKRISAIYSEPTPPPPSEHFDLELDHNTDPKDEPQKPGLRKFLAHVGPGFLVSLAYLDPGNLETDLQAGANHRYELLWVILIGLIFALIIQSLSANLGVITGKHLSELCKAEYPPFVKYCLWLLAEVAVIAADIPEVIGTAFALNILFNIPVWTGVLLTGFSTLLLLGLQKYGVRKLEMLIAVLVFVMAACFFGEMSYVKPPASGVLKGMFIPKLSGQGATGDAIALLGALIMPHNLFLHSALVLSRKIPNSVRGMNDACRYFLIESGFALFVAFLINVAIISVSGTVCHQSNLSDKNNDTCSDLTLNSASFLLQNVLGRSSKILYAIALLASGQSSTITGTYAGQFVMQGFLDIKMKKWARNLMTRCIAITPSLIVSIIGGSSGAGRLIIIASMILSFELPFALIPLLKFSGSATKMGPHKNSIYIIVISWIIGMAIIGINIYYLSTGFVGWIIHSSLPKVATVFIGILVFPIMAIYILAVLYLALRKDSVVTFVEPTKNDPAAQNQMENGLPNYGEPPVPFREDLADVSLPQ

SEQ ID NO: 39491 - protein, 641 aa, Triticum aestivum
MSKLLVIALLLLPLINQGIYLATAWDDQDFFKYCPPSQCSQDGPEVRFPFCLESSNTSAAAAASCGCAGRSIRKLACSGRDTILFHPVLGPYNVSAIDYGRSSMKLIPLVDPCFVLQQKPVISRSSSSPQADVINDEKRSLQFFEWTSTALVRCSREFAPGAADGIAGPVSCLSNTTHFFYLVHGYEDMSLLPLDCKVVPLSDGVGGGLIPMYMFYNPMSDTLRVSFKESIERILSFAEMTVYWFNGYTCRQCERSGGRCAFSSQSVGPFCMPGPHGSRIKVIAATSSVAAFVVLLLTVATVLYLSLKTRYNAEIHMKVEMFLKTYGTSKPTRYTFSEVKKMARRFKEKVGQGGFGSVYKGELPNGVPVAVKMLENSTGEGESFINEVATIGLIHHANIVRLLGFFSEGMRRALIYEFMPNESLEKYIFSDDSNIFQNLLVPEKLLDIALGIARGMEYLHQGCNQRILHFDIKPHNILLDYNFNPKISDFGLAKLCARDQSIVTLTAARGTMGYIAPELYSRNFGGVSYKSDVYSFGMLVLEMVSGRRNADPRIGSQDDVYLPEWIYEKVINGEELALTLETTQEEKDKVRQLAMVALWCIQWNPRNRPSMTKVVNMLTGRLQSLQMPPKPFVSYENEPMP

SEQ ID NO: 39492 - protein, 665 aa, Chlamydophila pneumoniae J138
MINKELDIGILGKIAGAIKQISIESIQKASSGHPGLPLGCAELAAYLYGYVLRQNPRDPHWINRDRFVLSAGHGSALLYSCLHLAGFDVSLEDLQEFRQLHSRTPGHPEYGETVGVEATTGPLGQGLGNAVGMALSMKMLESRFNRPGHEIFNGKIYCLAGDGCFMEGVSHEVCSFAGSLNLNNLVVIYDYNNVVLDGYLNEISVEDTKKRFEAYGWDVYEIDGYDFTHIHETFSSIKRGQERPVLVIAHTIIGHGSPKEGTNKAHGSPLGVEGTHETKQFWHLPEEKFFVPPAVKNFFAHKIQEDRKAQEQWLDEVRVWSKQFPELHEEFVALTSHKLPKNLESLVQSVEMPDSIAGRAASNKLIQVLVQHIPYLIGGSADLSSSDGTWIANEKVIHTYDFSGRNIKYGVREFGMATIMNGLAYSQVFRPFGGTFLVFSDYMRNAIRLAALSKLPVIYQFTHDSIFVGEDGPTHQPVEQLMSLRAIPGLYVIRPADANEVRGAWIAGLKHTGPTVIVLSRQALPTLPAAHRPFKDGVGRGAYIVLKESGEKPDYTLFATGSEVSLALSVAKELEHLDKQVRVVSFPCWELFEAQDVDYKQSIVGGDLGIRVSIEAGSALGWYKYIGSEGLAIAMDRFGYSGASDDVSEECGFTTEQILQRILSQ

SEQ ID NO: 39493 - protein, 355 aa, Streptococcus thermophilus LMG 18311
MLATDFGLENLTGYFYQYRIKRGDQSIIVLDPYAKSLAAWNSDDASKGPEHKIAKAAFVDLANYGPKDLDYAKIPNFKSREDAIIYEAHVRDLTSDKAISAELKHQFGTFAAFAERLDYLKDLGVIHIQLFPVLSYYFVNEMQNGKRLDAHASSNSNYNWGYDPQNYFSLTGMYFEKPSDPDKRIEEFKNLVSAIHAHGMDVILDIFYNHTAKTAIFEDLEPNYYHFMDADGTPRSSFGGGRLGTTHYMSRRVLVDSIAYLTKEYKVDGFRFDTMGDHDAESIEKAYLAARALNPNLIMLGEGWVTYAGDENSPVQPADQSWMKNTDTVAVFSDDIRNILKSGYPNEGDTCLHRR

SEQ ID NO: 39494 - protein, 249 aa, Pseudoalteromonas tunicata D2
MKLRKQMVAGNWKMNGSVELVNQIANAISAVELDKVDVVVFPPYPLLNNALQNELVVGAQSVSEHEAGAYTGEIDAQLLAELGCKYTLVGHSERRSIYGESDEVVASKFQRAQCQGLIPVLCVGESEQEREQNLTESVVSRQIDAVINKLGVVSLVKSVIAYEPVWAIGTGKTATPEQAQQVHKFIRDKIASLDDAVSQSLILLYGGSVNEKNSELLFAQPDIDGGLVGGASLNPDSFVNICKSAQGNV

SEQ ID NO: 39495 - protein, 163 aa, Xanthomonas campestris pv. campestris str. ATCC 33913
MMNKITHYFKSLLLLELLGGLWLTLKYTFKPKYTVLYPMEKFPQSPRFRGLHALRRYPNGEERCIACKLCEAVCPALAITIDSAKREDGTRRTTRYDIDLFKCIFCGFCEESCPVDSIVETHILEYHFEKRGENIVNKPQLLAIGDRLEAEIAERRAADAAFR

SEQ ID NO: 39496 - protein, 443 aa, Pichia anomala
NSLYTALKDLFESMIEHESKTGVVSPSHLVETLKKENELFRSTMHQDAHEFLNFLLNEVIDTINNLHHCRKNALHDLFEGLLTNQTKCLTCENVSSRDETFLDLSIDLTDNETLETCLKQFSASEMLNGSNKFYCDNCHSLQEAEKKMGLRKLPKILALHLKRFKYSEEQQRNVKLFQKIKYPLYFKLESDIPAEKKEDGLKFYQLYGVVVHIGGGPHHGHYVALVKTIQHGWLLFDDETVEKIDEKFVLRFTGDSPDLATAYVLFYQEISEEKYEQVINKPVEEEVKPSEKDEIQEKVIRVNSNNNSISSSQPSTISSDTNKPIRPPPVSVVEPQDKNRLRTPSLSSIARLKSKSSQNTVTTTSTPASSISAPQAPLAKNVNDANTIDTPTPTPSNPQPITPTNNNPQSTSTSSSFWRRKEKEAKEAKVGSVEDKREGEKEE

SEQ ID NO: 39497 - protein, 293 aa, Oryza sativa (indica cultivar-group)
MDAVAGASVSSSSARLRPCPRPRRIGNVAPATVRRRSRRRAVTCAAAADADVVGLFDAAKLTVDRFVESGMVVGLGSGPASGLAIQYLGTRLRRGSLTGILGIPSSTISASEAVKAGIQVSSYEEGTQIDFAFTDADIIEEDTMTAVIGRRKTESGEPSFMVEKGIVKSADKLAFIIGHEKYVKGIEGSIPVLVKSVWRRPSIGTAGPLGGDFPLVTKEGHHVLDVIFTTPIPDLGKDQYRFDRFSDPQVAHEDRQFIEFLDRMLDAIRNPQSLARIQREKLPKDLKILDDDI

SEQ ID NO: 39498 - protein, 435 aa, Xanthomonas campestris pv. campestris str. ATCC 33913
MSEYRQATDAFASNPVESKQEIRNYTMNFGPQHPAAHGVLRLILEMDGETVVRADPHIGLLHRGTEKLAESKPFNQSVPYMDRLDYVSMMCNEHAYVRAIESLMGIEAPERAQYIRTMFDEITRIKNHLMWVGSNALDLGAMAVMLYAFREREELMDVYEAVSGARMHAAYYRPGGVYRDLPDRMPKYKESRWHKGGALTKLNAAREGSMLDFLENFTDTFPSRVDEYETLLTENRIWKQRTVDVGIISPDLARAWGMTGPMLRGSGIEWDLRKKQPYAKYDAVDFDVPVGTNGDCYDRYLVRVAEMRESNRIIKQCVKWLKANPGPVMVTNFKVAPPSREGMKDDMEALIHHFKLFSEGYCVPAGETYCAVEAPKGEFGCYLMSDGANKPFRVHLRAPGFAHLSSMDAVVRGYLLADVVAMIGTYDLVFGEVDR

SEQ ID NO: 39499 - protein, 347 aa, Zea mays
THASERSEAELAEPIIRLLPVALGLLYLGKQDSVEATAEVSKTFDEKIGKYCDVTLMSLAYAGTGNVLKVQKLLGICSQHLEKGETHQGPAVLGIALIAMAEELGAEMAVRSLERLLQYGEQNIRRAVPLALGILCISNPKVNVMDTLSRLSHDADADVSMAAIISLGLIGAGTNNARIAGMLRNLSSYYYKEAAHLFCVRIAQGLVHLGKGLLTLSPYHSDRFLLSPMALGGLVTVLHACLDMKSTILGKYHYILYIIVLAMQPRMLLTVDEDLKPLSVPVRVGQAVDVVGQAGRPKTITGFQTHSTPVLLAAGERAELATEKYIPLTPVLEGFVILKKNPEYHEE

SEQ ID NO: 39500 - protein, 188 aa, Campylobacter lari RM2100
MKKVLVPLAKGFEEAEFIGIADVLKRAGEASGNLEVIIASLDDELLVQGANGISIRADVSLASVDQENLDAIALAGGFEGMMNLKNNSLIIKIIQDLHAKKKIVAAICASPMVLAKAGVINGEFSCYPGCEAGIEGIRVNKAVVVNENIITAAGPATAILFGLELAKHLCSEEIYQKLYDGMLIPLTK

SEQ ID NO: 39501 - protein, 227 aa, Triticum aestivum
MDSEHWISRLAAAKRFYAAQLGHAGADRAGMDELDMDGDENAGRPDFTCPYCYEDHDVASLIAHLEEDHPFEPHAAPCPICSEKVSKDMLNHITMQHGYLFKNRRRLRRFAVPGSQSLSLLSRDLREAHLQVLLGGGGHRSSNNNAANISADPLLSSFGLSFPTLDAEETSKLSTPAQSDVPVLKEAAARPWRSSMDSSLTREEREQASVRAAFVQDLLLSTLFRDQ

SEQ ID NO: 39502 - protein, 408 aa, Mycobacterium smegmatis str. MC2 155
MSVKTLDDLLAEGVQGRGVLVRSDLNVPLDDDGNITDPGRVIASVPTLQALAEAGAKVIVTAHLGRPKGEPDPKLSLAPVAAALGEKLGRHVQLAGDVVGTDALARAEGLTDGDVLLLENIRFDARETSKDDSERLSLAKALAALVEGPDGSPGVFVSDGFGVVHRKQASVYDVATLLPHYAGTLVAAEVKVLQQLTSSTDRPYAVVLGGSKVSDKLAVIENLATKADSLIIGGGMCFTFLAAQGFSVGSSLLQEEMVDTCRRLLDEYADVIHLPVDIVVADKFAADAEAETVAADRIPDGKMGLDIGPGSVERFTALLSNAKTVFWNGPMGVFEFPAFAAGTKGVAEAIIGATGKGAFSVVGGGDSAAAVRRLGLPEDGFSHISTGGGASLEYLEGKELPGIQVLES

SEQ ID NO: 39503 - protein, 295 aa, Actinobacillus pleuropneumoniae serovar 1 str. 4074
MTKILGSDLIKRGMAQMQKGGVIMDVVNAEQARIAEAAGAVAVMALERVPSDIRAAGGVARMANTAIVREVMEAVSIPVMAKARIGHIVEARVLEAMGVDYIDESEVLTPADEEFHLLKSDYTVPFVCGCRDLGEALRRIGEGASMLRTKGEPGTGNVVEAVRHLRKVNAQLRKVINMSHDELMTEAKHLGAPFELLLQIKTLGKLPVVNFAAGGIATPADAALMMELGADGVFVGSGIFKSENPEKFAKAIVQATTHYQDYDLIARLSADLGEPMRGLEISELAVQDRMQERGW

SEQ ID NO: 39504 - protein, 129 aa, Desulfitobacterium hafniense Y51
MKQAIQTSNAPKAIGPYSQAVQAGDFLYVSGQIPLDSMSGTIVEGGIEAQTRQVFANLKAILNEAGCDFANVVKATVLLSNMGDFAKVNEIYAEYFVGDVLPARAAYQVSALPKDALLEIELIAYTADK

SEQ ID NO: 39505 - protein, 109 aa, Glycine max
MFVPGSFMLTIWSSFHPDYLRKIIVQGRSSKSTKVGDIMTEENKLITVTPDTKVLQAMQLMTDNRIRHIPVIDEKGMIGMVSIGDVVRAVVREHRQEVERLNAFIQGGY

SEQ ID NO: 39506 - protein, 584 aa, Streptococcus thermophilus LMG 18311
MAFEIIMPKLGVDMQEGEIIEWKKQEGDVVNEGDILLEIMSDKTNMELEAEDSGILLKITRQAGETVPVTEVIGYIGAEGEVVADNSTSAPAAEATAQLEAAGLEVPKAPSQPSPATAEKAALADNEYDIVVVGGGPAGYYAAIRGAQLGGKVAIVEKSEFGGTCLNKGCIPTKTYLKNAEILDGLKIAAGRGINLASTNYTIDMDKTVDFKNSVVKTLTGGVQGLLKANKVTIFNGLGQVNPDKTVTIGSETIKGRNIILATGSKVSRIDIPGIDSQLVMTSDDILDLRELPKSLAVMGGGVVGIELGLVYASYGVDVTVVEMADRIIPAMDKEVSLELQKILSKKGMKIMTSVGVSEIVEGNNQLTLKLNNGEEIVAERALLSIGRVPQLNGLENLNLELDRGRIKVNEYQETSIPGIYAPGDVNGTKMLAHAAYRMGEVAAENAMHGNVRKAHLDYTPAAVYTHPEVAMCGLTEEDARAKYGDVLIGKSSFAGNGRAIASNEAHGFVKVVADAKYHEILGVHIIGPAAAELINEAATIMENELTVDELLQSIHGHPTFSENMYEAFADVLGEAVHNPPKRK

SEQ ID NO: 39507 - protein, 190 aa, Picea abies
MARECKVSLKSSDDELFDVNEAVAFESQTIKNMIEDTGTASAIPLPNVSSKILSKVIEYCKYHVEAQKPADEKSAISEDEIKTWDQEFVKVDQATLFDLILAANYLNIKNLLDLTCQTVADMIKGKTPEEIRKTFNIKNDFTPEKGGGRSGVKISGRLNDTRGSVVQKQYIYFCAIVFCFVLVAQNLFRN

SEQ ID NO: 39508 - protein, 462 aa, Streptococcus thermophilus LMG 18311
MAFEIIMPKLGVDMQEGEIIEWKKQEGDVVNEGDILLEIMSDKTNMELEAEDSGVLLKITRQAGEIVPVTEVIGYIGAEGEVVADNAAIAPAAEAAPQVEKVADVETPAAKPQPQVAIVHEGGKIRATPKARKVAREMGIDLAQVLGTGAKGRIHADDVENFKGAQPKATPLARKIAADLGIDLATVSGTGFGGKITKEDILAISAPAQVKVAAAAPAVEAKPEKVLPEGVEVIPMSAMRKAISKGMTHSYLTAPTFTLNYDVDMTNLIALRKQVLDPIMNKTGMKVTFTDLIGLAVVRTLMKEEHRYLNASLINDAQNIELHKFVNLGIAVGLDDGLVVPVIHGADKMSLSDFVVASKDVIKKAQAGKLKAAEMSGSTFSITNLGMFGTKSFNPIINQPNSAILGVSATIQTPVVVDGEVVVRPIMGLCLTIDHRIVDGMNGAKFMVDLKHLLENPMELLI

SEQ ID NO: 39509 - protein, 337 aa, Streptococcus thermophilus LMG 18311
MSNTSMSETKLMALREAVNLAMSEEMRKDPDIFLMGEDVGIYGGDFGTSVGMLAEFGEKRVKDTPISEAAIAGAAVGAAITGLRPIVDLTFMDFITIALDAIVNNGAKNNYMFGGGLKTPVTFRVASGSGIGSAAQHSQSLESWLTHIPGIKVVAPGNANDAKGLLKSSIQDNNIVIFMEPKALYGKKEEVTQDPDFYIPLGKGEIKREGTDLTIVTYGRMLERVLKAAEEVAEQGINVEVVDPRTLVPLDKELIFESVKKTGKLMLVNDAYKTGGFIGEIAAMVTESEAFDYLDHPIVRLASEDVPVPYARVLEQAVLPDVEKIKAAIIKMANKGN

SEQ ID NO: 39510 - protein, 323 aa, Streptococcus thermophilus LMG 18311
MVKLSKETHLEMFTKMERIREFDSRINKLVRRGFVQGMTHFSVGEEAANVGAVQHLSYDDIFFSNHRGHGQSIAQDMDLNKMMAELAGKATGVSKGRGGSMHLADFEKGNYGTNGIVGGGYALAVGAALTQQYKETGNIVVAFSGDGATNEGSFHESVNMAATWKLPVIFFIINNRYGISMDIRRATNTPHLYTRAEAYGIPGFYCEDGNDVMAVYDTMGKAVDHVRGGNGPAIVEVESYRWFGHSTADAGVYRTKEEVDEWKNNNDPIIRYRDYLVSENIASVEELDAIQSQVKAQVDAAYEFAKNSPDPELSVAFEDVWVD

SEQ ID NO: 39511 - protein, 221 aa, Triticum aestivum
  misc_feature (175)..(176): Xaa can be any naturally occurring amino acid
  misc_feature (178)..(179): Xaa can be any naturally occurring amino acid
  misc_feature (196)..(197): Xaa can be any naturally occurring amino acid
  misc_feature (215)..(216): Xaa can be any naturally occurring amino acid
  misc_feature (220)..(220): Xaa can be any naturally occurring amino acid
MATPTVEKPDGVEIREVWAENLEAEFAVIREIVDDYPYVAMDTEFPGVVCRPLGTFKSNADFNYATLKANVDMLKLIQLGLTFSDERGGLPALGPAGRPCVWQFNFRGFDPRTDVAAADSIDLLRRSGIDFARHATEGADSRRFAELLMSFGYLLKLLTGSNLPDTSSGFFDLIXXYXXVIYDIKHLMRFCNSLHXXLNKLAELLDVERVGICHXXGSDXL

SEQ ID NO: 39512 - protein, 251 aa, Xanthomonas campestris pv. campestris str. ATCC 33913
MRRKIVAGNWKLHGTRAFATELVAQVAAHMPLAGVDVVILPPLPYLGDLIEDFEAHHLAFGAQDVSSNEKGAYTGEVSASMLVDVGAEYGLVGHSERRQYHQESSELVARKFAAAMHAGLIPVLCVGESLEQREAGQTEAILRAQLEPVLSLVGSAGFARAVVAYEPIWAIGTGRTATPDQAQAVHAFIRGEVAKADARIADSLPILYGGSVKPDNASELFSQPDVDGGLVGGASLVAEDFLAIARAAAAC

SEQ ID NO: 39513 - protein, 539 aa, Arabidopsis thaliana
MVDLVSSLPDDLLGHILSLLTTKEAALTSILSKRWRYLIAFVPYLEFDDSAFLNPEEGKQTREGTRQSFIDFVDRVLALHGDSPIRKFSLKCKTGVDLDLLNQWICNVLQRGVLLIDLSMDLGHRCMFIEIFMSRTLVELKLGSGCRIAFGPEHISALPMLKTLTLDSVSWSDSGQLERLLSACPALEALNLANVHGSYPNATVSIASLKTLTIKSVSLSGPAHVFSFDTPNLLCLNYTALFEDDYPLVNLEYLVEAQIKFVLTDRLIKLVSVRKNGLLMLSEVQKLIRGISSVRKLYLSPGTLQVLGQCSQAMPVFNNLTFLVIESSMDIRWQAMPVLLKNCPRLETLVIKGGLVHCVAADCGDACTCISREEKGRSLASCPVKRLEIREFQGTLREMEMIKHFYYCFLCLKEMEIYVKDGRPQFLAPLASDSNPFKHLLGRNVIIKVHGSGPSLASCPVKRLEIREFQGTSREMDMIKHFLDYFSCLEELDIYVKDGRPQSPITPDSNPFNDLSGRNVKFKVVDYPMKSWWKFYFPN

SEQ ID NO: 39514 - protein, 563 aa, Bacillus cereus E33L
MKVEKPWLKSYPEEIPSTISYDIQPLHKYVEQMASRYPEKKALHFLGKDITFSVFHDKVKRFANYLQKLGVEKGDRVAIMLPNCPQAVIGYYGTLLAGGIVVQTNPLYTERELEYQLHDSGAKVILCLDLVFPRVTNVQSATKIEHVIVTRIADFLPFPKNLLYPFVQKKQSNLVVKVSESETIHLWNSVEKEVNTGVEVPCDPENDLALLQYTGGTTGFPKGVMLTHKNLVSNTLMGVQWLYNCKEGEEVVLGVLPFFHVYGMTAVMNLSIMQGYKMVLIPKFDMKMVFEAIKKHKVTLFPGAPTIYIALLNSPLLKEYDISSIRACISGSAPLPVEVQEKFETVTGGKLVEGYGLTESSPVTHSNFLWEKRVPGSIGVPWPDTEAMIMSLETGEALPPGEIGEIVVKGPQIMKGYWNKPEETAAVLQDGWLHTGDVGYMDEDGFFYVKDRKKDMIVASGFNVYPREVEEVLYEHEKVQEVVTIGVPDPYRGETVKAFVVLKEGTECSEEELNQFARKYLAAYKVPKVYEFRDELPKTTVGKILRRVLIEEEKRKNEDEQTG

SEQ ID NO: 39515 - protein, 405 aa, Zea mays
MGCFSTFCKKRRATRQPSSHHNEDVPGCSNITKYTYKELVRATNNFNPLNKIGEGGFGSVYKGQLRNGTVIAVKVLSSESRQGVREFLNELVAISDISHDNLVKLYGYCAEGDQRILVYNHLENNSLAQTLLGSSHSNIQFDWKTRVNICLGIARGLAYLHHGVSPHIVHRDIKASNILLDRDLTPKISDFGLAKLLPPNATHVSTRVAGTLGYLAPEYAIRGQVTRKSDVYSFGVLLLEIVCGRSNSDTRLAYGDQILLEKFPEITNGALLLQTWMHYEQGSLERIIDRSLGGGDLDVAQACRFLKVGLLCTQDVTRHRPDMPRVVAMLTGEWDVEPETVSKPAIISDFMDLKVRSTRKASDNVATPPTSSSTFLSSLMAHSSPLLSNESTQASMAFTGVSDRE

SEQ ID NO: 39516 - protein, 243 aa, Acinetobacter sp. ADP1
MKDLFSTDSQRYQQARPTYPPSLLQSLLQYIPERELAWDCGAGSGQLTHMLASYFDQVVGTDISQTQLSHAEYYDNISYQLQPAENTTFPDHCFDLITVAQAIHWFDFEAFYAEVRRTIKPSGILAVVGYGLIHVDDLEINAKVQHLYHQTLNGFWDAERHYVDELYQTIPFPFDEIEMPAFQIEAQWTLQQLLQYLNTWSAVQHYILEKNLDPVQQLLSKGRDLQDQVSIQFPVLLRVGRCS

SEQ ID NO: 39517 - protein, 364 aa, Prochlorococcus marinus str. NATL1A
MNMNEVMSHNQDKTGQDPIQHREHADRLSNLGNTKPAQINREIGLNLFKDMTLGRRFEDKCAEMYYRGKMFGFVHLYNGQEAISTGVIGAMKRKHDWFCSTYRDHVHALSAGVPAKEVMSELFGKETGCSKGRGGSMHLFSKEHHLLGGYAFIGEGIPVALGAAFSSKYKREALKESSDSVTAAFFGDGTCNIGQFYECLNMAQLWKLPIIFVVENNKWAIGMAHDRATSETEIWRKASAFGMHGEEIDGMDVLAVRGAAERALERARAGEGPTLIECLTYRFRGHSLADPDELRSEKEKEFWAKRDPIKKLKNDLTSSGLVSDEELKNIEKEIDLEVNDAVEFALNAPEPDPSELTKYIWAEN

SEQ ID NO: 39518 - protein, 202 aa, Acinetobacter sp. ADP1
MRNVSMTERIIEVVRNTNETKIRVRLNLDGSGQGTLNTGVPFLDHMIDQIKRHGLFDIDIHCDGDLEIDDHHTVEDCGITLGQAFAQALGDKKGLRRYGHFYAPLDESLSRVVVDLSGRPGLFMDIPFTRARIGSFDVDLFSEFFQGFVNHALMTLHIDNLKGKNSHHQIESVFKAFARALRMACEIDPRAAGSIASTKGSL

SEQ ID NO: 39519 - protein, 312 aa, Xanthomonas campestris pv. campestris str. ATCC 33913; identical to SEQ ID NO: 938

SEQ ID NO: 39520 - protein, 396 aa, Leptospira interrogans serovar Copenhageni str. Fiocruz L1-130
MELPRLENVDLSGKRVFLRVDFNVPVENGKVTDKTRIEKTLPTIELLIKKGARIIIASHLGRPKGQVNPEFSLAPVVETFQSLVKSKVYFSKTVIGEDAIKLSKELKNGEILVIENVRFHKEEEENDPGFSKKLAALADIYVNDAFGAAHRAHSSTEGIARLLPAYAGLLMHKEILELSALLHKPARPFVAIIGGSKVSTKIKVLTNLFDKVNHLLIGGGMAYTFLKSRAIPIGNSLVEKEFEVQAFQLIEKAGVAGIDLQLPVDHIIGDQFNEKAKTKSVDKMGILDGWMGMDIGSKTVSNYEKIIKNAGTIFWNGPMGVFEMDKFASGTMAIAKAVAKSKAKTVVGGGDSIAAINKARVADKITHISTGGGASLEFMEGRKLPGVEALKKKTSE

SEQ ID NO: 39521 - protein, 563 aa, Prochlorococcus marinus str. NATL1A
MFAVFLMFSRLFLLKANDLKLFLFLLFPHSWALMIVASIHSGFGCFLILNWPQSDSEHLMVSSEQMQNIEKEMFSMGMPVEALMEKVGIGISSWILDRHGLIENGAIVLVGPGHNGGDGLVVARELYMAGVDISIWCPFPLKKQLTQKHFDYAMQIGIENLERKPDSNSDLLWIEALFGLGQSRIISDEILRLLNSKKTFSPEKLISIDVPAGLDSDNGNIVSNTPCKASSSLTLGLFKSGLIQDSAIDYVGNLERVDIGIPDKILAGFPETQPLRISFSDLSTFVWPMLSKSKSKYQRGRVLVIAGSEKYRGAASLALNGALASGVGSVSAFLPNSVSSALWITHPEVLLLGDLNAFQDGSSDFSKVLNEVDLNRFDSILLGPGLGMAEEKDCFGSDLQDFKGLLVLDADAINRLSITSKGWEWLNDREGPTWLTPHLEEFKRLFPLIDCSNPLKAGIEAAKTCSSTVLLKCAHSVISDPEGKTWQIGQVNSSVARTGLGDVLAGFVSGMGASGLASDKKLDSSLLAASALMHAYAGAFSIKGSTASTICTFLGELIKKEST

SEQ ID NO: 39522 - protein, 369 aa, Oryza sativa
MDHAAEAQRTDLMTITRHVLNEQGRHPESRGDFTILLSHIVLGCKFVASAVNKAGLAKLIGLAGDTNVQASNPISDPLYSTLLFLHTNPCDGGWPPRGEEQKKLDVLSNEVFVKALVSSGRTCVLVSEENEEAIIVDAPLRGKYCVCFDPLDGSSNIDCGVSIGTIFGIYMIKDKDNVTLDDVLQPGTDMLAAGYCMYGSSCTLVLSTGNGVNGFTLDPSLGEFILTHPNIKIPNRGKIYSVNEGSAKNWDAPTAKFVEKCKFPQDGSPSKSLRYIGSMVADVHRTLLYGGIFLYPADQKSPNGKLRVLYEVFPMSFLMEQAGGQAFTGKQRALELVPRKIHDRSPIFLGSYDDVEDIKALYASESIIG

SEQ ID NO: 39523 - protein, 311 aa, Zea mays
MARNEEKAQSMLNRFITMKQEEKRKPRERRPYLASECRDLADAERWRSEILREIGAKVAEIQNEGLGEHRLRDLNDEINKLLRERGHWERRIVELGGRDYSRSSNAPLMTDLDGNIVAVPNPSGRGPGYRYFGAARKLPGVRELFDKPPEMRKRRTRYEIHKRINAGYYGYYDDEDGVLERLEGPAEKRMREEIVSEWHRVERVRREAMKGVMSGEVAAAGGRSGEAAREVLFEGVEEEVEEERKREEEKREREKGEEVGREFVAHVPLPDEKEIERMVLERKKKELLSKYASDSLLVEQEEAKEMLNVRR

SEQ ID NO: 39524 - protein, 590 aa, Bacillus subtilis
MQNNSVQQANISIMSSFSGSKKVYVEGSSSDIQVPMREIALSPTTGSFGEEENAPVRVYDTSGPYTDPEVTINIQEGLKPLRQIWITERGDVEEYEGRAIKPEDNGYKKAKPNVSYPGLKRKPLRAKAGQNVTQMHYAKQGIITPEMEFIAIREHVSPEFVRDEVASGRRLFLPNINHPESEPMIIGRNFHVKINANIGNSAVTSSIEEEVEKMTWAIRWGADTMMDLSTGKDIHTTREWIIRNCPVPVGTVPIYQALEKVNGVAEDLTWEIYRDTLIEQAEQGVDYFTIHAGVLLRYVPLTAKRTTGIVSRGGAIMAQWCLAHHQESFLYTHLEEICEIMKMYDIAFSLGDGLRPGSIADANDEAQFAELETLGELTQIAWKHDVQVMIEGPGHVPMHKIKENVDKQMDICKEAPFYTLGPLTTDIAPGYDHITSAIGAAMIGWYGTAMLCYVTPKEHLGLPNRDDVREGVITYKIAAHAADLAKGHPGAQIRDDALSKARFEFRWRDQFNLSLDPERALEYHDETLPAEGAKTAHFCSMCGPKFGSMRISQDIRDYAKKNDLSEAEAINKGLKEKAKEFVDTGSNLYQ

SEQ ID NO: 39525 - protein, 97 aa, Brassica napus
KGCGCLLVVDEGHRLIGTFTDGDLRRTLKASGEAIFKLTVGEMCNRKPRTIGPETMAVEAMKKMESPPSPVQFLPVVNEDNTLIGIVTLHGLVSAGL

SEQ ID NO: 39526 - protein, 244 aa, Deinococcus radiodurans R1
MQTLLALNWKMNKTPTEARSWAEELTTKYAPAEGVDLAVLAPALDLSALAANLPAGIAFGGQDVSAHESGAYTGEISAAMLKDAGASCVVVGHSERREYHDESDABVAAKARQAQANGLLPIVCVGENLDVRERGEHVPQTLAQLRGSLEGVGADVVVAYEPVWAIGTGKTATADDAEELAAAIRGALREQYGARAEGIRVLYGGSVKPENIAEICGKPNVNGALVGGASLKVPDVLGMLDALR

SEQ ID NO: 39527 - protein, 130 aa, Glycine max
  misc_feature (120)..(120): Xaa can be any naturally occurring amino acid
MVRVSVLNDALKSMYNAEKIGKRQVMIRPSSKVIIKFLTVMQRHGYIGEFEYVDDHRSGKIVVELNGRLNKCGVISPRFDIGVKDIEGWTARLLPSRQFGYIVLTTSAGIMDHEEARRKXVGGKGLGFFY

SEQ ID NO: 39528 - protein, 411 aa, Deinococcus radiodurans R1
MTGLCPLHQPSPLDHPHSGGTPMQNLSQLDVKGKRVLVRVDYNVPVGDGVVQDDTRITASVPTIKKLLDGGASVVLMSHFGRPKNGPEDKYSLKPVAEAVSRALGQDVKFIPSLPGSDETLQAVQALRPGEVALLENVRFEAGEEKNDAALNDKLAKLGDAFVLDAFGSAHRAHSSVSGVAGKLPHAAGGLLQSEVDALGKLLHAPEHPYVVIIGGAKVSDKIKVIENLLPKVDRMLIGGGMMFTFIKARGGQIGNSLVEDDQLDLAKGLLEKYGDKLLLPTDAVAADKFAADAQSKVVPADQIPDGWMGLDIGPDTQRAYADALQGAKTVFWNGPMGVFEFDQFAAGTNAVAAAVGSLKDQAYTVVGGGDSVSAINKSGKADQIDHISTGGGASLELLEGKELPGVVAMA

SEQ ID NO: 39529 - protein, 714 aa, Oryza sativa (japonica cultivar-group)
MATATQAPTSPAAASGRGSVLPLLRGRPSTRVRLAVGRRPQTALRAQPPGAAEVVEQSVNTIRFLAVDSVEKAKSGHPGLPMGCAPLGHVLFDEFLRFNPKNPYWFDRDRFILSAGHGCMLQYALLHLAGYDSVTMDDLKAFRQWGSRTPGHPENFETPGVEVTTGPLGQGFANAVGLALAEKHLAARFNKPDLKIVDHHTYVILGDGCQMEGVSNEASSLAGHWGLGKLIAFYDDNHISIDGSTGIAFTEDALARYEALGWHTIWVKNGNTGYDDIRAAIKEAKAVKDKPTLIKVTTTIGYGSPNKANTYSVHGSALGTKEVEATKNNLSWHHEPFHVPDEVKRHWSHHIDEGASLEAEWNKKIVEYEKKYRQEAAELKSIISGELPSGWDNSLPKYTPENPADATRNLSQQCLNALAKAIPGFLGGSADLATSNMTLLKMFGDFQKDTPEERNIRFGVREHAMGAISNGIALHSPGLIPYCATFFVFTDYMRAAIRLSALCGSRVIFVMTHDSIGLGEDGPTHQPVEQLFSLRAMPNILMLRPADGNETSGAYKIAVLNRQRPSVLALSRQKLQQLKGTSAEGVAKGGYIISDNSSGNKPDIILIGTGSELEIVEKAADELRKDGKTVRVVSLVCWELFEEQSEKYKESVFPSEVTSRISVEAGVTFGWEKYIGEKGKAIGVDRFGSSAPAGKIYKELGLTVENVIATAKSL

SEQ ID NO: 39530 - protein, 377 aa, Clostridium acetobutylicum ATCC 824
MKAITFEGMNNVKVKNVNDPNIIKNDDAIIKITSTTICGSDLHLLRGTMPKVPHGFIIGHEAMGIVEETGKEVTNLKKGDRVIVPFPVSCGHCWYCTHGLSSQCDNSNEHGEVGAIYGYGDLMGGYDGGQAEYLRVPYANFGPKLVPENLTDEQVLFLTDILPTSYWGTIVNGGVKQGDTVVVLGCGPVGLLAQKWAAYAGASRIIAVDNIDYRLEHAKKYNSAEILNFNDYDNTGEYIKEITHGGADVVIDCVGMDGERSPIENVETLLKIQGGSKSAIEISTQAVRRGGTVSVVGVYGARYNNFPFGDFFSRNITIKTGQCPAHSYVDVILDLIKQNKFDATDIITHTMSLSDGEKAYNLFNNKLDNCIKVILKP

SEQ ID NO: 39531 - protein, 119 aa, Pseudoalteromonas tunicata D2
MAKVNQNLIKVLEDEQLKSDVPAFGPGDTVNVKVRIKEGDKERLQAFEGVVIAKRNRGLHSSFTVRKISNGEGVERVFQTHSPLIDSVEVKRRGAVRRAKLYYLRERSGKSARIREKLN

SEQ ID NO: 39532 - protein, 540 aa, Prochlorococcus marinus str. MIT 9313
MPSSSSGNSRHFSRVAPVVLAILDGWGHREEVEHNSIRSAETPIMDALWHAYPHTLIEASGAAVGLPDNQMGNSEVGHLTIGAGRVIRQELVRISETVQAGRLGQTPALIALAERLRKSDGTLHLLGLCSDGGVHSHINHLCGLLHWAAAAGLNKVAVHLITDGRDTPIQSASKYLHQIEDAINASGVGELASLCGRYWAMDRDHRWERTIRAYEVLTDPNQSISRVTAEDVLSASYANGTTDEFLEPTRLSNNYFKDGDGLVMFNFRPDRARQLVQALTLPDFDGFPRANQPSLDVVTFTQYEHDLPVGVAFPAESLDDLLGQVVSEHGLRQYRTAETEKYPHVTYFMNGGIEQPLAGEERHLVPSPRVATYDLAPAMAADTLTESCVNAIESGVYSLVVINYANPDMVGHTGVMGAAQEAISTVDRCIGRLLDSTGRMGGTLLITADHGNAELMQGSDGQAWTAHTTNPVPVILVEGEKRKLAGYGNDIQLREGGGLADIAPTLLQLLDLPKPDAMSGLSLIQAIDSPTPSARLPQPV

SEQ ID NO: 39533 - protein, 250 aa, Leptospira interrogans serovar Copenhageni str. Fiocruz L1-130
MRKTIIAGNWKMNLSLKEAVFLAHSIREKIPSISKDKVSMVFPSTLHLENVSKILEGSSVIVGAQNCYHSGLAAFTGETSPDQLKEIGVKVVMVGHSERRQFLGESNFFCNDKIRFLLKNEFTVLYCVGETLSERESGKTLEVLSSQIREGLKGIDSVFFSNLILAYEPVWAIGTGKVATPSQAQEVHSFIRKEISGLFVGASSISESISILYGGSVKPDNIQDLLKEKDIDGGLVGGASQKISSFAGLF

SEQ ID NO: 39534 - protein, 247 aa, Bacteroides fragilis YCH46
MQKYGLIGYPLKHSFSIGFFNEKFKSEGIDAEYVNFEIPEINDFMEVVEENPNLCGLNVTIPYKEQVIPFLDELDKDTAKIGAVNVIKIIRTPKRKIKLVGYNSDIIGFSQSIQPLLQPYHKKALILGTGGSSKAIYHGLKNLGIDSVFVSRTKKEGMLTYEELTPEVMAEHTVIVNCTPVGMYPKVDFCPAIPYELLTPNHLLYDLLYNPNITLFMKKGEEHGAVTKNGLEMLLLQAFAAWEIWNK

SEQ ID NO: 39535 - protein, 106 aa, Thiobacillus denitrificans ATCC 25259
MTPLDRIREQVTNNAIVLYMKGTPQFPQCGFSSRAAQVLQACGVKDFLAVNVLADPEIFENLKYYANWPTFPQLYVKGELIGGSDIMIEMYQKGEIQKLLEEAQTA

SEQ ID NO: 39536 - protein, 505 aa, Zea mays
MGSSSGHQRSKTRSRNRKPLGIQLLERVRGSPISFRSCQALVLVLTFLSYASYHATRKTTSVVKSVLDPKTKTNLGTSSAHYWPPSHLFYLHNLKDADNSSAGGSLSSGGGGGWVPFNEAEDGTALLGEIDLAFLGAYAAGMFFAGHLGDRVDLRILLTVGWWPAGLFQSSGWPSVVAVVGNWFGKSKRGLIMGVWNAHTSVGNISGSLVAAAMLRYGWCWSFVVPGVVIALVGLAVFLLLPVAPDVIGVQEDLCLKDAPLLERRRADVEEKAVGFIEAWRIPGVAPFALCLFFCKLVAYTFLYWLPFYISHTAIGGEYLSDSAAGVLSTLFDVGGVVGGILAGHISDHLDARALTAASFTFSAIPALFFYRVYGNVSLAWNIALMFVTGMLVNGPYALITTAVSADLGTHSSLNGNSRALATVTAIIDGTGSIGAAVGPLLTGYISARSWSAVFTMLMASALVAGLLLSRLVAAEVVAKMESRRTPAPAASDLLPVSSSSMDEP

SEQ ID NO: 39537 - protein, 330 aa, Deinococcus radiodurans R1
MKVGINGFGRIGRLVFRILEARGVEVVAINDLTDNHTLAHLLKYDSTAGRFDGTVEYDESSLTVNGKKIQAIAERDPANIKWGEYGADIVIESTGIFTSREGASKHMQGGAKKVIITAPAKGEDFSIVLGVNDEQYDPANHHIISNASCTTNSLGVPMKVIDEAFGIEKAIMTTVHSYTNDQRVLDLPHSDLRRARAAAINIIPTSTGAAKAVSQVYPALKGKFDGTSLRVPTPTGSISDVSVILGRDVTVEEVNNVFREAANGKYKGIMAYTEDPIVLTDIQGDPHSAIIDGGLTMAMGNLVKFFSWYDNEWGYSNRIADLVQLVQNKG

SEQ ID NO: 39538 - protein, 502 aa, Zea mays
MSTHAASRRSSSSSAVAKRPAIAEGATKAAGPGPTAAQAKKRTALVNITNVAAPGARVAAVGKVAPPVTGAKLNPATSGAPLKKPSLANARTIRGSAAKSASIKPAPPVSRHDSSSEQKHNVLVPTTVHVPSRAPALVPYSSFVSPGRSRDSVSTDETMSTCDSMKSPDFEYIDNGGCSMLASLQRRADEHLRTSEDRDVEENKWKKNGPAPMEIDSICEVDSNLEDPQLCAALASDIYMHLREAEMKKRPSTDFMETIQKDVNPSMRAILIDWLVEVAEEYRLAPDTLYLTVNYIDRYLSGNEINRQRLQLLGVACMLIAAKYEEICAPQVEEFCYITDNTYFRDEVLEMEASVLNYLKFEMTAPTAKCFLRRFARSAQACDEDPALHLEFLANYIAELSLLEYSLLSYPPSLIAASAIFLARFVLQPTKYPWNSTLAHYTQYKPSELSECVKALHRLSSVGPGSNLPAIREKYSQHKYKFVAKKQCPPQIPAEFFRDAAC

SEQ ID NO: 39539 - protein, 150 aa, Zea mays
  misc_feature (111)..(111): Xaa can be any naturally occurring amino acid
LPHTHNLEQNAYSKGQPAWGAQLADELERIVALHDASTIAAVIVEPMAGSTGVLIPPKGYLEKLREITSKHGILLIFDEVITAYGRLGAATASEFFGVTPDLIAMAKGVSXNAAVPAGAVAVRREVHDAIVNGPAGGIEFFHGYTYSAHP

SEQ ID NO: 39540 - protein, 814 aa, Kluyveromyces lactis NRRL Y-1140
MDLRTTYASTKLEPFYAGTGAIASVSEDGRLLATSVVDKINIVSLDSPRRVLHSVDTEDEQDITALHLTPDGSYLCFVSQAQLLRVYSLKQERIIRSMKISSPVYVMNCDQTSTLLAIGGTDGSVSVIDIENGYVTHSLKGHGATISSVKFHGELNSEIWKLASGDTNGMIKVWDLVKRNCQCTIQEHTTAVRGLDFRVTDEEKGTLQLLSGGRDNILNLFEFNSTKKYKLLKTIPVIEQVESCGFTQDPDVVYSAGGGAIYQLVSLSTGRVLKKTAKPIEELFIIGTLCILNGTKQYLVFSDQTLFLIDVESALQSESEVIEVENKIAGNHGTIADIRFVGPKRDKLALATNSPTLRIIPTPTSSEEEFENGENKETFPIEVKMYEGHTDLLNSLDATADGLWVATASKDHSVILWRYHAKYEDFYPYTKFVGHVGSVNAVGLPNVMPRSWPEFIITASNDLTIKKWKVPKVTSDEPEDLILVKTSEYTRRAHEKDINAISISPNDSLFATASYDKTCKIWNLDDGEFQATLANHKRGLWDVAFCQYDKLLATCSGDKTIKIWSLESYAVVKTLEGHTNAVQRCSFINKNKQLISTGADGLVIIWDLSTGESVKTLDAHNNRIWALAVMNDGESFVTADADGFFEFWRDNSEEEHERNLEQEKLKIEQEQSLQNYLSEGDWTNAFLLAMTLDHPMRLYNVLRQSVDNSNEDPNVVFNNEIDEVVSTLDKDQLLLLVKRCRDWNTNARTHTVAQKMIRCILLRQNIEELSEIPGLVRIVESIISYAERHYSRMDNLVQESYILDYALVQMDKLL

SEQ ID NO: 39541 - protein, 512 aa, Bacillus cereus ATCC 10987
MKKQHDTIIVLDFGSQYNQLIARRIREFGVYSELHPHTITAEEIKEINPKGIIFSGGPNSVYGEGALHCDEKIFDLGLPIFGICYGMQLMTQKFGGKVERANHREYGKAVLKVENESKLYANLPEEQVVWMSHGDLVTGLPEGFVVDATSESCPIAGMSNEAKNLYGVQFHPEVRHSEHGNDLIKNFVFGVCGCSEGWNMENFIEVELEKIRETVGDKKVLCALSGGVDSSVVAVLIHKAIGDQLTCIFVDHGLLRKGEAEGVMKTFSEGFHMNVIKVDAKERFMNKLKGVEDPEQKRKIIGNEFIYVFDDEASKLEGMDFLAQGTLYTDIVESGTATAQTIKSHHNVGGLPEDMQFKLIEPLNTLFKDEVRVLGSELGIPDEIVWRQPFPGPGLGIRVLGEITEEKLEIVRESDAILREEIIKAGLDREIWQYFTALPGMRSVGVMGDERTYDYTVGIRAVTSIDGMTADWARIPWDVLEKISVRIVNEVKHVNRIVYDVTSKPPATIEWE

SEQ ID NO: 39542 - protein, 459 aa, Wolbachia endosymbiont of Drosophila melanogaster
MTDYDLIVIGGGPGGYKCAIAAAKLGLKVACIDKNSIFGGTCLRVGCIPSKALLHSSYQYAHTKNDLSKLGIKIKDASFDLKEMLGYKDARVQELGKGIEYLFNLHKITKINGLASFDQGNLEVSVEGKVLKTKNIVIATGSDVISLPGINIDEKSIISSTGALSLTEVPKKLVVIGAGAIGLEMSSVWRRLGSEVTVVEFFDRIAAAMDGELSKSLLSSLQKQGIKFLLSTKVEEIKQSSNSLSVKVCSVKDNQTNTIEADKVLVAAGRKPCTENLGIDEKIEKDNRGFVQVNNRYETNVKGIFAIGDVIGGAMLAHKAEEEGVAVAEIIAGQSPHVDYGIIPSVIYTHPAVSSIGKTEEELKNAGRKYKVGKCQFAANGRAKITDDAEGFVKVLTCSRADTILGVHIIGAYADTLINEAAVAMAYSAAAEDIYRICHSHPDINEAFRDACIDAFFKK

SEQ ID NO: 39543 - protein, 856 aa, Triticum aestivum
MGASRKLQGEIDRVLKKVQEGVDVFDSIWNKVYDTENANQKEKFEADLKKEIKKLQRYRDQIKTWIQSSEIKDKKALMDARKQIEREMERFKVCEKETKTKAFSKEGLGQQPKTDPREKAKAETRDWLNSVVSDLENQIDNFEAELEGLSFKKGKQRPPRLVHLEKSITRHKAHIKKLESILRLLDNDELSPEQVNDVKDFLEDYVERNQEDFDEFSDVEDLYSTLPMEKVEALEDMVSLAPSILIKGVAAVSTTAVLSTKSPTATSPTQATVSTISQGTSQDQAEETTTLESNPESVPQTPPPKGGNLGPSVPVVPTAISTSAAAVSVSADTITSPGPVRPVIPATAPTIFAPSAAVRNAPESMPAVASTPANLSTAVKDDESMSFPPRRPSPAVTEIGLGRGIARGLTSQPLAAPISVGPVPGNGSITAIPPINDLSKRNIMNTDERVNSGGLSQQLVSPLGSKVQPQPVLKTNDAVSSDSSNTSESAVIGGRVFSPPVVPGAQWRPQAPAGFQNQSETGQFRGRPEVTDQREKYLQRLQQVQQQQGNLLNASHITGINQKQFSTQQANSLLQQFNSQSSSISSQGGLGLGGQGPDAGQTKSDEQQGLADDASVESAATTGPNKHTNEDDTKAPYSNPPASVAEGTQLSRDSDLSPGQPMQAGMPSSGVGVIGRRSVSDFGAIGDNLSGASVVSGHDHLYNLQMLEAAYHRLPQPKDSERAKTYIPRHPSVTPASYPQIQAPIVTNPAFWERLGSDTLSTDMLFFAFYYQQNSYQQYLAAKELKKQSWRFHRKYNTWFQRHVEPQVTTDEYERGSYVYFDFHLADDGNGWCQRIKNDFTFEYNFLEDELSVQPN

SEQ ID NO: 39544 - protein, 321 aa, marine gamma proteobacterium HTCC2080
MITSIRACVADEFQQVNELIIEQLKSDVAMVENVGHYIVDAGGKRLRPLLALLAASAQGGVDLSDIKFAAVVEFIHTATLLHDDVVDLSSLRRGRATANAEFGNAPSVLVGDFIYTRAFQLMVKLGDLSLLQSMADTTNTIAAGEVLQLMRAGDPSVTESQYLDVIDRKTAALFAAACRGSAILKGRDTTQQEQMAAYGRHLGIAFQMIDDVLDYTGDPQVTGKQVGDDLNEGKPTLPLIHTMASGSADDAAIVRDALSQKNSENLTGVIAAVRRSGGIDYTREQAVLHQQSALAALKGLDRSPALEALHELADMAINRER

SEQ ID NO: 39545 - protein, 469 aa, Thiobacillus denitrificans ATCC 25259
MAVADVLKRIQDDEVKFVDLRFTDTRGKEQHVSIPARIVTEDWFEDGHPFDGSSIAGWKGIQASDMLLKADPDSAYMDPFFDEPTLILTCDVIEPSDGKGYERDPRSVARRAEAYLKSTGLADTAYFGPEPEFFIFDSITWHDDMSGSGVKINSEEAAWSSAEKFENGNTGHRPGIKGGYFPVPPVDSLQDIRAAMVVALEEAGVPVEVFHHEVATAGQCEIGTQFSTLTKRADWTQVLKYIVHNVAHAYGKTATFMPKPIVGDNGSGMHVHMSLWKDGKNTFAGNGYAGLSETALYYIGGIIKHAKALNAITNPGTNSYKRLVPGFEAPVMLAYSARNRSASIRIPIAASEKARRIEVRFPDPLANPYLAFSALMMAGLDGIQNKIHPGDPGDKDLYDLPPEEDAKIPKVCHSLEMALDELDKDREFLTRGGVFTNDMIDAYITLKMEEVTKFRMTTHPVEFAMYYSL

SEQ ID NO: 39546 - protein, 185 aa, Zea mays
NTFKDSNNGYLYDGDHCEFGVDVTTPTVFKESELFTVTDKFYNPKYTWSIQKFSTLLEDSYYSDVFSIGGRRWNIKVYPGGSATGKGKAVSIFLILNANEKFRPYEKIYVGAKLRVLNQRNFKNIEKQIDNWYNGPGYGDGSGWGYNEFIPFSDLKDSSKGFLVNDVLMVQVEIEAISSTKYFPS

SEQ ID NO: 39547 - protein, 265 aa, Thiobacillus denitrificans ATCC 25259
MTDRYAVFGHPIAHSKSPQIHAAFARQTGQDMCYEAILAPLEGFTESIARFAAQGGRGANVTVPFKEEAFRLADRLTPRAERAGAVNTLMFDADGILGDNTDGTGLVADLTGNLKRPLATRRILLVGAGGAARGVIAPLLEQAPAELVIANRTVSRAEQLAELFDGRLRACGFDALDTPFDVVINATAASLAGELPPLPPQVFGTGALAYDMMYGRDTPFLAFARAHGADTADGLGMLVEQAAEAFHLWRGVRPDTAPVIAALRA

SEQ ID NO: 39548 - protein, 483 aa, Oryza sativa (japonica cultivar-group)
MSLGYAEKLSYREDVGNVGMPEIFDSPELLHKKIEELAVMVRESKHLVVFTGAGISTSSGIPDFRGPKGVWTLQRSGKGVPGASLPFHRAVPTLTHMALVELEKTGRLKFVISQNVDSLHLRSGLPREKLAELHGNSFKEICPSCKKEYLRDFEIETIGLKDTPRRCSDKNCGARLKDTVLDWEDALPPEEMDAAKEQCQKADLVLCLGTSLQITPACNMPLLSLKNGGRVAIVNLQATPKDKKASLVIHGLVDKVIAGVMYMMNLRIPPYIRTDFVQISLRNSVKKKCVRWTLRVTSIHGLRAPLPFLRSVEVSFPERPDMKPVVLKEQPFSLQRETSMNRPFVMLLTFNFSDGCGCSSSSIEWPVDFLKQKDSFVRDRSLVLQELQHAAEHRSRAGQHAILEREGVPRAETSIHALVTNIVRYDTEDSKAAVPMATWMNSNGSLSKRHMDAIGCNPASSKKQKLVATRHRRKGLNPATQKV

SEQ ID NO: 39549 - protein, 980 aa, Nostoc punctiforme PCC 73102
MSNPIRVVCLGGGYVAMWLTKALRNAIIYKKVEMIVISRDNYHTYHGFIAEMLTGKIQPSQVASPARRIFEPAYFYNAEIENIDVIKQVITTSRSLDGRQYEVSYDHLVISLGSVDDLSRYPGIAEHAMKLKSFNDCYKIRNHIIQMLELAEIETDTEERSRLLTFVVAGGNYGGIEVATELADHFRLLIKKEYRQIAPDEIKVIVIHSGERILSELVRRFPELVRYAENFLHDEFSNLEIITNTRIVAATPEEAILSNGERISTRTIISCTGTAQSPLLDKLPLERDKYGKIVTDEFVRVKGTNNVWAGGDCAAVPLPTGGTCPPLAIYALTCGYQIGGNILRSIESRKLKAYKFTGLGDAVSLGNRHAIAHLKGVPLYGFNAWVAWRIALFIFVPSWERKLRLLVDWSMWPFLGRDIISMKVQEKQSLKKAYFQAGQVIVKQGDIGRCLYLIRNGEVEVLQEMSNGETIIQTIGSGEHFGETSVIENSPHIATVRAKTSVQLVVIDREEALLLSNSLSVFNDTNRLLSSDTFVKENIDEYHAIASDIPRGSIAPVNSVMSATLEAAPWQELPSKAPARIGSSRILTRSESSQPSKFGFLGLASVAALIALSSTTTYLLTSKKVTTPEPKDNAIASQKLEVIALGRLEPAGEIISVAGPVGERIGHLEVAEGDNVKNGQILAYLESYNERLQTRNLAAAKVREIQEQIKTDTLLRQVEAEKSQSEIEQVNTPQLLQIKSQQALIRKAEVELSEVVKTRDRFQYLSQEGAIAKQDFDNKQLIVRQAEENLNQAKATLEQLAQARSSNIRTAQTAFKASQVNLARVDSHSGLEPAKNNLALGQAQLERSIIRAPQDGKVLKVFAHTGEAISQKSILQLGDTQQMFAVAEVYETDVSKVKFGQEAVITSPAFTKPIKGTVDKVGNLVFKNNTIGDDPTAEKDARIVEVKIRLQQSEQVANFSNLQVDVRIQLNNTGKIGAKP

SEQ ID NO: 39550 - protein, 320 aa, Bifidobacterium longum NCC2705
MPEPVRERLRALKDAPGSVIVVGSMNADYTVTTKRLPKPGETVNGGAMKVLPGGKGANQASAAARLGVNVQLLGAVGEDSNADFLLSKLDEAGVDTADILHVEGPSGTTVITVSAEGENTIVYSPGSNAKASAGYVQSHRTTIAECAVLGLCLESPIATVIAAAQTAHDAGVTVLLNDSPFMDELPHELVEATDILLVNQHEVAQLLGLPDDDVESLDWYEVAERFTDYGFDRAIVTLGASGSVVIENGRWHRVSAAQVNAVDTTGCGDSFMGTVLAGLAAGHTLLQSAQIGSYVSAYAATKLGAQSAYGTAEEVIAYFS

SEQ ID NO: 39551 - protein, 296 aa, uncultured bacterium
MSRTRNVLAIVMAGGEGSRLHPLTDERCKPAVPFNGKHRIVDFVLSNLVNSEIYSIYLLVQYKSQSLIEHIRSSWTMTRFIPQHFVTVVPPQMRNGPEWFQGTADSVYQNIHLIESFQPDIVAVFGADHIYRMDVRQMVDFHRASEAHVSVATLPVPLSQCNQFGIVEVDAHHRIANFVEKPKNTRPMPGSSTHALASMGNYLFNADVLLDALKKAHATGHSDFGRDILPTMLQSHRLMAYDFTQNEIPGTASYEEHAYWRDVGTIDAYFDAHFDTLGATPRFRMTNRDWPIYASP

SEQ ID NO: 39552 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKEGQ

SEQ ID NO: 39553 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 39554 - protein, 355 aa, Arabidopsis thaliana
MNRGANSASIPNDLILEILSRLPAKSTGRFRCVSKLWGSMLCHSYFTELFLTRSSARPRLLIGIHQDGDRFFFSCPQPQSPYDNSSIVLAADFHMKFGRVEDEWVYHILTLGTENVRWREIICPFSYDPPREKPICINGVLYYISVGSYYSLIGCFDVRSEKFKFLYLSPDCFPNWSRKLINYKGKLGVTIMEDYHGGFPLKLRMWVLEDVEKEEWTRYAYTLRPENKVEDNDYVYVVGATASGEIVLTKQNAYKPFYVFYFSPERNTLLSVEIQGVGEEWFYHNVYYFVDHVEDLRFDVMKTTYAGTSRSPPKQSTSTSSREDHEVRTLAHQKEDRLTFESVNQFDALRLLEDD

SEQ ID NO: 39555 - protein, 611 aa, Gibberella zeae PH-1
MDALSLRHPFSFQFVSFILIFFNSQSNLFTMVFYPPSSVKLPFDPPDSVTVPEFIFREDGVRKPHSRSRNPFTCGISGKTYTTAEVIERQKLLARALAKRLGYDIREGTEWDRVVALYSVNTIDYITMTHAVHRLNGIVTPASAAYSAPELEHQLRSSGANALFTCVPLLEVALQAAKGVGIPEDRIFLLPVPGAESKQPFKTINDLVAEGKDAPELKPLDWIKGQGERQVAYLCYSSGTSGLPKAVQITHRNVIANVIQATIQNEEGRKSAGVDAQIQLGLLPLSHIYGLVPVAHYANIKQGIYNGDETIILPKFDLKLLLSAIQRFKIQQMALVPPIFIQMMSNYAECQKFDLSSVRFIFSGAAPLGKETTIDLNKHWPSWKICQGYGLTETSPVVTSTSELDIDPGSSGTLLPGLKAKVIDAEGKEVTEYNKPGELYVQGPTIVLGYLNNAKATAETFVHHDDGRWMRTGDEVIVRKSPKGTEHFVIVDRIKELIKVKGHQVAPAELEAHLLTHPLVDDCAVIQVPDLRAGEVPKAFVVKAPQAKGKSDDEITQSINKHVEEHKARHKWLKGGIEFIDVIPKSPSGKILRRLLRDRERQARKETGAKL

SEQ ID NO: 39556 - protein, 355 aa, Trichoderma atroviride
MSRSTAPNASASRKISFNVSEQYDIQDVVGEGAYGVVCSAIHKPSGQKVAIKKITPFDHSMFCLRTLREMKLLRYFNHENIISILDIQKPRSYDSFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEDALKHPYLEPYHDPEDEPTAPPIPEEFFDFDKHKDTLSKEQLKQLIYQEIMR

SEQ ID NO: 39557 - protein, 439 aa, Burkholderia sp. 383
MIRISALADRRALLHARRLWLHYGVFWLGAVAVGLVAVLYAKLIDFGYAVFLGYAAEHAWLPLIVTPLIGAVTVWLTRRFFDGAEGSGIPQVIAMLHAPGNTGARLLKFRILIGKILVSFLAILGGFTIGREGPTIHVGAALMFNLRQFYPQRFRAIRPGVLEHRLALAGAAAGLSAAFNAPLAGVVFAIEELTRSFEQRTSGVLITAIIFAGIVSLGIQGNYVYFGTIDVGAHLPQSLALAVILIGVIAGVMGGIFCWLLLNTRRWMPRRLQDFRAGQPVLFGAACGLVVAVVGVATHGHTFGSGYAEARSMLESHTNVSVLYPVFKMVSMIGSYLPGAPGGLFAPSLAIGAGIGNTLHTLFSGMQLQMLIALGMVGYLAAVTQSPITAFVIVIEMINGHALVISLMATALIASRVSRFFAPPLYEALSTRYFPADHR

SEQ ID NO: 39558 - protein, 432 aa, Burkholderia sp. 383
MNEAMIQAVVPKTLTEQTCSDIRETLAGRRRGARTVLSFAGPAVVASIAYMDPGNFATNIQAGAGYGYTLLWVVALANVVAMLFQSLSAKLGLVTGRNLAELCRDSLPRRWVIAMWGMSEVAAMATDLAEFVGGAIGVSLLLHLPMIPSMLITAAVTYGLLQFEKLGFRPLELAIAALIGVIGLSYLAELLIAPVHWPSVALHSVTPSIPDSNALTISVGIIGATVMPHVLFLHSGLTQNRVRPRNDRECSQLLAFSNVEVVVALGIAGLINMAMVIMASSAFHLGHADIASIETAWRTLTPLLGGAAAGLFLTALIASGISSSVVGTMAGQMIMQGFVGFRIPVWVRRLVTMAPAFIVVASGVDATRALVLSQVMLSIALPVPMIALVWFTSRRDLMGRHMNRRVTTVSAVLGTLLVLALNGVLLVQLALG

SEQ ID NO: 39559 - protein, 284 aa, Zea mays
MKLNLIKSFPNLACTAALFLLMTVVTSSLHSSLPAYASMQPVAKTGGGGGLFTTEILSSGWAGFLAGCLHTLSGPDHLVALAPLSIGRSRLESGLVGALWGCGHDAGQVIFGLLFLLLKDRLHIEVFRAWGTRVVGLTLLIIGAMGVREASEVQESSLVLEGVDTSSMSSNEPLQPASAPRKKKVGFATFATGIVHGLQPDALLMVLPALALPSRFAGAAFLGMFLVGTVFSMGSYTAFVGSCSEALKEKVPRITEKLTWAASLVAIAMGVALLVGQFFGFSLY

SEQ ID NO: 39560 - protein, 415 aa, Arabidopsis thaliana
MTTMSNLPAEVLEEILSRTPVTSLRTMRSTCKKWNNLSKKKIIPEAARKQQGLMLIKKKICSLSFSLHEIHKDDYVVPCINQVDIPRNIEVEKIFHCDGILLCVIEDNCSLLVWNPYLGQTRRIEVSSDADMNDRYALGYDNNNSSHKILRIKKDFKNSDGLGYEIYRFASNSWSLLDEEVMKPEWDVWSVQRSSVSLKGNTYFLLQGNDYDDQEDEEEEDDEEYEDDDDVLPKDNFLLCFDYTTERFGPRLLLPFNPHVEETVALSCIGEERLVMLYQSFKTYKGIEIWVTDKIDPKAVSWSKFLKVDITPLTGFPVDFYADSFVIDEEKKVAAVFDIHCSYQKAHIIGEDGYLKCVNMGRASDVGNGQPLVFSSYVPSLVKVPVKQPKGKRKGRSSETKSNKNKKGRKIKIIG

SEQ ID NO: 39561 - protein, 655 aa, Arabidopsis thaliana
MSYSFIWMLFVIHISCVLSADGNHILCSPSFTCGNQRGLLYPFWIAGRKECGHPDFELDCNAGVPELSISSVKFRILGADYDSGIITLARSDNIDDPCLPNSFTTSFNETVLPLASTTDLLTIYYDCNRNVSSFVSTFVKELDCPDDGTDDRRNYYLTRNLTFLPPSLKLEGNSFLLNDFGGSCSRNVSNPASRTALNTLESTPSTDNLKIALEDGFALEVNSDCRTCIDSKGACGFSQTSSRFVCYYRQEPQNPTRNKVILKLFFIVIYVLGIGAASFAMMGVILVVTCLNCLIRRQRKTLNDPRMRTSDDSRQQNLKALIPLKHYSYAQVTSITKSFAEVIGKGGFGTVYRGTLYDGRSVAVKVLKESQGNGEDFINEVASMSQTSHVNIVTLLGFCSEGYKRAIIYEFMENGSLDKFISSKKSSTMDWRELYGIALGVARGLEYLHHGCRTRIVHFDIKPQNVLLDDNLSPKVSDFGLAKLCERKESILSLMDTRGTIGYIAPEVFSRVYGRVSHKSDVYSYGMLVLDIIGARNKTSTEDTTSSTSSMYFPEWIYRDLEKAHNGKSIETAISNEEDEIAKKMTLVGLWCIQPWPLDRPAMNRVVEMMEGNLDALEVPPRPVLQQIPTATLQESSTFSEDISAYTEICSINVA

SEQ ID NO: 39562 - protein, 658 aa, Yarrowia lipolytica CLIB122
MRTASLTTAKLLLTLIARLPLLHALPYGGLSRSGSYSPYEHDDDTLDPESSDFWLYMFVSFVLVVAGGVFAGLTIALMGQDEVYLHVISQSGESHERKAAEKVLRLLKRGKHWVLVTLLLANVITNETLPIVLDRCLGGGWRAVVIATVAIVIFGEVIPQSISVRYGLSVGAYFAPFVLGLMYILYPLAYPTALLLDHLLGEDHGTVYKKAGLKTLVTLHQTMGVERLNEDEVTIISAVLDLKEKPVGTIMTPLDDVYTMSSDTVLDEKVVDQILQAGFSRIPIHAPGEPTNFIGMLLVRILISYDPEDALPVSSFPLATLPETRPDTSCLNILNYFQEGKSHMVIVSESPGDAYGALGVLTLEDVIEELIGEEIIDESDVYIDVHRAIRRTNPGPLSKRNLVSYVQNSPRNSIGNYESVSHFLSRSLSRDEAGKVQHQSHSNLGPHGSSQLAANPTITVSSSPKTGLKLGNNTATPHDASAPGPFQKKHHRIEPLNLAANPKETSNTKVTIKKSGSGHRPTGSSDLVHHPDHPEGGTSTQYGTIFETEQGAVVDALNDPEINTRLSPRTGMSPRTAAVNGVNGARPSAIPSRPDLGTEIHSFRSGGIIESVVNVQGVHKTIIEAAVSDNDFEEEDSPKSSNGSSRRGSRRALLDSSP

SEQ ID NO: 39563 - protein, 290 aa, Zea mays
NWKCAQENFSAHLLPTASARLSFATDETTLKDAFSEFGNVLEARIIIDRESGRSRGFGFITFTSTEEASAAMTSMDGKELQGRNIRVNHANERAGGIRGGGGFGAGGGYGGGGGYPTGGYGGGGYSSGGGGGYSSGGGGGYSSGGYAANGYGVGSGSGYGGTYSNASGGGYSGSDGYGNGAASGGYANNLSSGYNSNGRYNTIGSSDGNTGGYNSSPNPYGVGNYNTGGSSSSGGTLGEFGGGGFGGNNFAGNVTGGFSGGGASYGANKPQYNGDDDLLGEGFFDKEVAE

SEQ ID NO: 39564 - protein, 389 aa, Triticum aestivum
NKFVQKSRLVPVRNSRDIVDPRVRTRTVLSLPPIINGAHSAITLKTRNVFIECTATDITKANIVLNTMVAMFSEYCENKFEVEPVEVVSHDGSTAIYPDLSCYKMEVSLSDIVGPIGISLDETQVISLLNKMQLQAELCSSNGEPCISVSVPPTRSDVLHARDLAEDVAIAYGYNNVPKSKPKSMTIGGRQPLNRFSDKIRAEVARAGYMEVLTFVLTSHEENFDMLNRTDDGNKAVIIANPRTSEFEVVRSSLMSCLLKTLKHNIDHPRPIKIFEVGDVVSLDTSRDVGASNNRRLAALYCNSNSGFEEIMGLVDRIVKIVRAPHINFGQTYYVPSSEPEFFTKRQCKIVMSDGKQVGYLGIVHAEVLRKFGIPDPCTFVEIDIEALL

SEQ ID NO: 39565 - protein, 170 aa, Helicobacter pylori
GSGMHTHVSVWKNNENLFSGKTYKGLSELALHFLGGVLRHARGLAAFTNASTNSYKRLIPGYEAPSILTYSANNRSASVRIPYGISKNSARFEFRFPDSSSNPYLAFGAILMAGIDGIKNKMDPGEAMDINLFKLTLDEIREKGIKQMPHTLRRSLEEMLADKQYLKEGQ

SEQ ID NO: 39566 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFGAILMAGMDGVKNKMDPGEAMDINLFKLTLDEIREKGIKQMPHTLRSSLEEMLADKQYLKEGQ

SEQ ID NO: 39567 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESQ

SEQ ID NO: 39568 - protein, 219 aa, Candida glabrata CBS 138
MSGRQDKLLTKYKIVFLGEQGVGKTSLITRFMYDTFDDNYQATIGIDFLSKTMYLDDKTIRLQLWDTAGQERFRSLIPSYIRDSRVAIVVYDITKRKSFEFIDKWIEDVKNERGAENVILCVVGNKSDLADERQVTAEEGEKKAQDLGAKIFMQTSTKVGYNVKNLFKKIAKSLPEFQDSDANPLENTGGAAGNRNSNKAGVIDISTTDEDQSQSGCQC

SEQ ID NO: 39569 - protein, 307 aa, Deinococcus radiodurans R1
MRGQPRPKLRRMTEQQTGTPQLKQGFAEMFKGGVIMDVVTADQARIAEAAGATAVMALERVPADIRKDGGVARMSDPKMIREIMAAVSIPVMAKVRIGHVVEAQILQAIGVDFIDESEVLTPADEQFHILKRDFKVPFVCGAKNLGEALRRVGEGASMIRTKGEAGTGNVVEAVRHARAVLGDIRAVQSRPAEELMTVARDLQAPYDLVQYVHAHGQLPVVNFAAGGVATPADAALMMQLGLDGVFVGSGIFKSANPERRAQAIVRAVTHFQNPDILAEVSEDLGAPMTGINIDELIPEARLASRGW

SEQ ID NO: 39570 - protein, 170 aa, Helicobacter pylori
GSGMHTHVSVWKNNENLFSGEIYKGLSELALHFLGGVLHHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESQ

SEQ ID NO: 39571 - protein, 203 aa, Glycine max
TFPLYLLISLDFPSLSPKSAGPKNVSLTSSTTESTPDLEDKDKLLGGLLTTGFDEASCISRMQSQLYRKASPHKPSPYLISKLRNYEDIHRRCGPNSRAYDRSMRKIVRSKNKGAAATLCKYLIWTPANGLGNQMISMAATFLYAMLTDRVMLVKFDKDKQGLFCEPLLNSTWVLPEKSPFWNEKHIETYQTMLEKDRNRTSN

SEQ ID NO: 39572 - protein, 643 aa, Oryza sativa
MIYTAIDTFYLTDEQLRDSPSRKDGIDEATETALRVYGCDLIQESGILLKLPQAVMATAQVLFHRFYCKKSFVRFSVKRVAASCVWLAGKLEESPRRSKHIIIVFHRMECRRENVPIEHLDVFSKKYSDLKHDLVRTERHLLKEMGFICHVEHPHKFISNYLATLEAPELTQEAWNLANDSLRTTLCVRFKSEVVACGVVYAAARRHGVPLPEDPPWWNVFDADEAGIQEVCRVLAHLYSLPKSQYIQVYKDNDSFTHRRTSDTNASKESPATTVASDKGTPVPSSSSQEKDALIKAGSDKVKEKGDDDGKTLPSEPNGKEGPAVNLKSEKSESNVDRSRERERDRSRGRDRDSRGRDSDRDSKGRDSDRERERDREADRDRQRRHHSKDRSSGYSDKEKSRHRSSREKEFFFCDHRTNVPQYPLYPVYGYPPSTVARQVGGLGAQGSTIMTSSFVNNSVNNGVKQKSTQTHKASSASTANHPSHLAVLVLGLNILGPFPRGQAGYKFLFVAIDKFTKWIEAIPTGEIKADNAIKFIKRIFCRYGLPHRIITDNGSQFISADFQDYCIGLEVKICFASVSHPQSNGQFERTNGIVLQGIKTRVYDRLMSHDKKWVEELPSVLWAVRTTPTTSNKETPFFLVYS

SEQ ID NO: 39573 - protein, 113 aa, Arabidopsis thaliana
  misc_feature (38)..(39): Xaa can be any naturally occurring amino acid
  misc_feature (45)..(45): Xaa can be any naturally occurring amino acid
  misc_feature (48)..(49): Xaa can be any naturally occurring amino acid
  misc_feature (53)..(53): Xaa can be any naturally occurring amino acid
  misc_feature (58)..(58): Xaa can be any naturally occurring amino acid
  misc_feature (62)..(62): Xaa can be any naturally occurring amino acid
  misc_feature (65)..(65): Xaa can be any naturally occurring amino acid
  misc_feature (67)..(67): Xaa can be any naturally occurring amino acid
  misc_feature (75)..(75): Xaa can be any naturally occurring amino acid
  misc_feature (78)..(79): Xaa can be any naturally occurring amino acid
MASSMLSSAAVVTSPAQATMVAPFTGLKSSAAFPVTRXXNKDITXILXXGGRXSCMKXWPPXGKXKXFETLSYLXDLXXFIRKSLLVYSFVIILLAFFIFFLFFLLSFYSYYC

SEQ ID NO: 39574 - protein, 459 aa, Bacteroides fragilis YCH46
MKQTRGYLLLICIVSAMGGLLFGYDWVVIGGAKIFYEPFFGIENSAALRGWAMSSALIGCLAGALLSGIWSDKYGRKKMLVIASFLFALSAWGTGAVDHFSYFIFYRIVGGLGIGIASNISPVYIAEVSPTHVRGKFVSLNQLTIVLGILLAQLANWQIGEYYTQGSDILSETSVQWAWRWMFWAELIPAGIFFLLSFIIPESPRWLATVHQQEKAQKTLTRIGGETYARQTLEELNQLTQSQGNRQNNEWKSVFRPEMRKVLIIGIVLAIFQQWCGINVIFNYAHEIFSSAGYAVSDVLMNIVVTGITNVIFTFVAIYTVDKWGRRTLMLIGSAGLALIYLILGTCYFLDVSGLPMLLLVVLAIACYAMSLAPVVWVVLSEIFPVKIRGMAIAISTFFLWVACFILTYTFPVLNESIGAEGTFWLYGGICLAGFLFIRQNLPETKGKTLEEIEKELIK

SEQ ID NO: 39575 - protein, 635 aa, Dechloromonas aromatica RCB
MCGITGIFDTRSKRDIDRAVLHRMNESQIHRGPDEGGTHVEPGVGLGHRRLSIIDLSTGQQPLYNEDNSVCVVFNGEIYNYQELIPELQALGHVFHTRSDTEVIVHAWEAWGESCVDRFRGMFAFALWDRNRETLFLARDRLGVKPLFYALLDDGTFLFGSELKSLLAHGGLKRDIDPCAVEEYFALGYVAEPRSIFKQALKLPPASTLLVRRGQPVGTPREYWDVRFTLDNPISDADAQAELTHRLEESIKLRMISEVPLGAFLSGGVDSSAVVALMAGLSQKPVNTCSIGFSDPAFNESEFAKMVADRYQTNHHLDIVESDDFDLIDTLARLYDEPYADSSAIPTYRVCQLARKHVTVALSGDGGDESFGGYRRYRLHMMEEKMRSALPLGLRRPLFGALGKLYPKADWAPRVFRAKTTFEGMARNSVEAYFHSVSILRAPMRDRLFSTQFKSALSGYDALKVFTDHAAKADTTDPLALIQYLDLKTYLIGDINTKVDRASMAHSLEVREPLMDHKLVEWLATLPSTLKIRGQEGKYLLKKSMEPHLPNDVLYRPKMGFSVPLARWFRGPLKTRVQESILGSRLADTGWFNRDYLQKLVTDHNNGSRDYSASIWTILMFEAFLRNVMEQGEAA

SEQ ID NO: 39576 - protein, 286 aa, marine gamma proteobacterium HTCC2080
MSLKASVLPLISCKDPNFPRLFVDSLRDFGFGALVDHPLNMPRVRAIYGEWRDYFSEGVASAYAMDPVQQDGYFSLQVAEHAKGSPQRDFKEYFQYYSWGRCPPELQAHLTAHFHQAVDFAGELLAHIEREAPPEVMINLSEPLSGMIESSRQSMLRVLHYPPMPDEMSAPRAAPHEDINLLTLLPAADGPGLEIRARNGEWIKAPNQPEQLLVNIGDMLQEALSGWLPSTTHRVVHSPKSQTIGRMSLPLFLHPRPEVKLSARYTAESYLQERLSELGVLPASST

SEQ ID NO: 39577 - protein, 3044 aa, Burkholderia thailandensis E264
MPRPPMNTDNPCRAEPIAIVGMGCVFPGAVGPAAFLDLLRAGRVAVRELPPERWDAAALHDPDPDAPGRVLTRRAATIDGADLFDPDFFGLSRRDAREMDPRQRLMLKTAWWALEDAGMPGWGLGGRSVGVFLGASNGEFGGAHAQLSAIGASTAAGHATSVLANRLSYLLGLTGPSLVVDTACSSSLVAVHLACAALRAGECELAIAGGVSLMLRPDASVAFSRARMLAADGRSKPFSASADGYGRGEGAGAVVLKRLSDARRDGDRIVAVVLGSAVNHNGSSNGITAPSALAQEALIRRALEAAGVAPEQIDVVEAHGTGTLLGDPIEAKALGRVLGAVVGRAAALPVGSVKGNIGHLEAAAGVAGLIKLALALRHREVLASAGFDAPNPHIDFHAWNLTVPTALAPLPDRGRPPIGALSSFGFGGANCHLIAAAPPSDLLAPPDPPARHAGTKTGDPWLPLLVLSAASDEALNRLAAATAERVRGDPPGAWRLARASHAARSPLKQRLAVVAADAGALAAALDRAAAGGLEGVAARGAAPRRRPALAFLYAGQGAQFPGMAAGLLDGDTELRRTLEQACAITGLPIMDWLAAGDETIDRTDVTQPLMVALQVGLTRQWAAWGIEPDIVIGHSLGDYAGAVAAGALSFDAAMRVAALRGRLAATSARPGGMVAVAAARDAVAPHLAPGAAIAVDNGPAQLSVAGDAHALAETVRRLAAAGIATRALPVSAAFHSPAMEPMLDAFRAALADVAMQPLRLPMVCNRTGAVLPAGTVLDAEFWVRHLREPVRFADGVRALATEGIALGLEIGPQAMLSRLAPLSAPTLKVVPSLARGTRDRDALLAAAGALWVAGVTPDWRAIDGPGRVHAELPLYPFDDAPFPLLAEGTVVAGAAATTGAVATRDAQAEPPPVAAVLPATAAHERACDIGAKLRDAIAQALETSPDRIDPTVPFIEMGADSLVLMAAARKIEAAFGVRVPMRAFFDELSTMDALAAYLAAEAPQPPAEPGEPAGAASASSDVIAQVVREQLDLMRRQLDLIEGRRGAGERALPDGAARRPVAEIARAGGMRGAIRAAHPTRRADTARDALSPRRQAHLDRLIGDYTRRTAGSRALAARYRDVMADSRASAGFRPSIKAMLYPIVCRSAAGTTFEDVDGNRYLDISMGFGVHLFGHAPDFVAHALRESLSRGLRLGPQSDRAGKAAAAIARLSGQDRVAFVNSGTEAVMVALRLARTVTGRERVVIFRGAYHGHFDGVLADAADPDDPAAGGTPAVPGVARGAVADTLVFEYGDEACLDTLAALLGQVAAVLVEPVQSRRPDLQPAAFLRRLRALTEQAGALLIFDELITGFRIAAGGAQAHFGVKADLVAYGKILGGGLPIGALAGRADVMAAVDGGAWRYGDDSAPVAETTLFAGTFNKNPLSIDACVAVLTEIERRGDALYAQLNDRAARLHARLAQALAGTPIGIARFGSVFRFVFERNLDLFFYHLLLRGIYVWEGRTCFLSAAHTEADCDRLVAAVSDTVAALRDGGMLDERHGGAAIGAADGIDAAGTAVEAAGDAGALPMIRAQRQLAALAEMDPAGAVAYALPLLLDLDGPLDANRLRDAVERAAARHDGLWAAMDPVSGTLRMMPPGRLALAARAIDAAELDAEVRRGMAVPFDLKTPPLLRATLFEIADGAHALLLVGHHAALDGFSLQVLAADIAACYGGAPLPHAPSLRRVLASHRDAERDGRWAAARDWWRARLQDAPLGLDLDLAAPRPSVRAFRGAREVRRVDAPLARALRARAAAERTSLLAVLLTGFAWLLARHGALDVVIGVPYAGRAAAGDGAERVVGYCAHLLPIRLRIDAVDSACALLAHTRAAVTEALEHADYPFAHIVDDLALKRDPARPLLVPATFNLDRVPPALDFGERVAARLRSPAVGAGRFDLACNVADGGDALMVELDHDEALFGDGRAQRLADEYLQLLGRIAQGGEQPLRDGAEHVARWATVVAAGRAEPLAARWRRHLERAPQHVAVAVDGDARLTRAELDRWSDAAADAIDGAGAAHGPVALLLPRTEALPVAMLACWKAARAWMPIDPATPAERIADMIRRAGCALVLRDAAADADPTLAHGCATLDLPSRAQATRRDARRAWPAPNPEDVAYVLFTSGSTGRPKPVAVPHRAVEWYVQGLLNRLGLPPGLACGLVSTVAADLGLTATLPALFDGGCLCVQSDAAARDPLLLAAVHRKRPVDLLKIVPSHLEALLAGAPDPQLLPRRVLVLGGERARPGLLSRLAECAPPGLRVMNHYGPTETTVGVATGEWTRGAGELRLDAPLAGAALVLLDAGGRPAPAGVCAQLHVGGPQVALGYPGCPDETGARFRPQPSSGVDGPLYATGDLARLNADGTLTIVGRTDDQTKIRGYRVEPGEVAAALEALPGVVSAAVVAADHPARGTVLVAYVVGDGAPGDPASLARALHGRLPDYMVPAQVVRCGRLPLSANGKLDRGALPAPDWSAGAAEAPVSASCDADRVQAALVALWRELFGRADIGVHDEFFALGGDSILGIRMVARLHRDGWRLQASDLYRHPTIAALAPLIRPVDTQAEQGVLSGPVPLLPAQRRWLEIGAGWRAHANLSLLLELDVAVTPDRVADAFVRLMHQHDGLRLRANAGGGEPAQIYGPVAPPPLHRVDAAHATPDALTRLQALADPAVSPLVLGWLDGAPPRLLIVMHHWIADAVSCAILLDDLARLLRDPGAPLGPKTPSLRQWAQTLAERAASPDALAQLEYWTLSTSLPPPALPVKAGGGGGAPASAGLTLSGDETREVIAGPAAQAGAETEDLLLAALTLALGGRTGEPLLYVELEGHGRTPPHGLPEPARTIGWLTARHPAWFDLTGVPEAAAAAAVRAQRLSIPNRGADYGALRHLGPDDARNALAAGHRPAVSLNWLGQLTGIAHAPFRVISWRPGCPLRGAERAADLPQPHALAVEAMLIDGCLRIEFIYDVARFDAAAIDALAADCAASLLRLARESAAPPAAPAASAPPPDPRGELDADDLAALAANR

SEQ ID NO: 39578 - protein, 308 aa, Bacillus cereus G9241
MKEVLEVLPKTMKQLVESCKWCDALEEIRVRIGRPLECIAHGEVFFYDYIVTAEDAIYLLNKLSQFSIYTMEEELKRGYVTLRGGHRIGLAGKVITEKSAVKMIRDVSSFNIRIARQKIGIAEPLLPYLYETRWLNTMVIGPPQTGKTTLLRDVARCMSQGVSASKIPSCKVGIVDERSEIAGCVKGIPQYDFGTRVDVLDACPKAEGMMMMIRSMSPDILIVDEIGRKEDSEAIMEAVHAGVQLFISAHGFSYDDVVKRPSLKAVLELGIFDRFVELSKARGPGTVMQVKDKNGKSVLPHRKAEGVW

SEQ ID NO: 39579 - protein, 686 aa, Prochlorococcus marinus str. NATL1A
MGKVKVGSAWPLGSSVTLDGVNFSIAAPHATNLELLIFQSADDEYAKETISLDQKNRSGDYWHVEIEGLAEGTLYGYKVSIDGQKAAEDHIVLDPCARAITGWENYIRNHKEKVNRGYAHCLKGVVTKRDYFDFKSHPRPKHSWNKTIIYELHVGGFTKSNDSSISESKKGTFLGLIEKIPYLKSLGITTIELLPVFAFDSNDAPEGLVNYWGYSPINWFTPHQDFVDSCNPLEARRQFKKLVEVCHDNELEVLIDVVYNHTTEGNQNGPSISWKSFGPKTYYHQDDKENYQDVSGCGNSIAANRPLVRKLILESLRCWAIELGVDGFRFDLGIALSRGENLIPLDKPPLFEEIEADPKLSDVKLISEPWDCGGLYKLGDFPAKQFRTWNGHFRDDIRRFWKGDKGTIWPLKDRLIGNKSLYNDNNLANIFSINFITSHDGFTLKDLVSFNKKHNLANGENNRDGENNNNSYNYGVEGPTTDKEINNLRQKQQRNLLATLLLSPGIPMILMGDELGRSQGGNNNTWCQDNPLGWMDWNHNNCDHDLKEFVLKLISLRKQLSEFFSPDIIYDCQKDNTKVKTSHFWIQWHGIKVNKPDWGDWSHTLGFSINKNNDGSAIWLGFNAYKESMLFDLPTPISPWKKYIDTSILKTKNVSKKPLANQSNVRIESNSLVLMVSSEYSKKIKL

SEQ ID NO: 39580 - protein, 673 aa, Rhodospirillum rubrum ATCC 11170
MSIRARLDAGEPWPLGAMAREGGVNIAVFSEAATQIDLCLFDGDQETRLPLPARTGDIWHGFLPGGGPGLRYGLRAHGPYDPGRGQRFNPHKLLIDPAARRLDGPVVWDKALFGFDPDHPERDLSFSIRDSAAFVPKAVVEADPATRALRSPPDPGRLLIYEAHVKGLTRTHPQVAPEARGTFDGVAGSAVIAHLKHMGVTALELLPVWAFADEPHLPPLGLTNYWGYNPVCLTAPHAAYGPPDSFRRMIDCLHGADIAVILDVVLNHSGEGDEYGPTLSFRGLDNAAYYRLDPTDPRRYLNDSACGNTLRMEHPQVLRLAMDALRYWVGVMGVDGFRFDLAVTPARHKGAFDPSGPFLSAIAQDPLLSRALVIAEPWDVGPGGYQAGRFPKSWMEWNDLARDGLRRFWLANGRSGDLAAVLAGCAARYAPSGRGPRAGVSYISAHDGFTLADMVSYGHRHNNANGESNRDGSAIELSANHGVEGPTNDLAIRSLRDRQRRNLLACLLLSLGVPMIRGGDELGQTQQGNNNVYCQDNPLNWLDWGGADANFAAFAARAGALRARLPQLGRASFLNGFPDAKGKRDVVWLRPDGGEMSPADWDALPRLLAMRLTGAEKASDLLVLINGQPHEQSFRLPPGPAWTIALRSAGDDAPAAAGSSLVVPEMSLVALTS

SEQ ID NO: 39581 - protein, 297 aa, Campylobacter lari RM2100
MALLDLNTALDEIYTNDQKNAIFDSFKTQKDVNIFRNSLIVEDIILEEILKKEGVKFKKIDEFCYKIPQEFKSKLSSMNAFNEGKFYIQNYSSYLCAKTLGVKAGESVLDMCAAPGGKSLNLANFMQNEGYLASCELSKARFFTLKKTMENYQVKIVKCFLKDARIIGKACPLKFDKILLDAPCSTFAKMGFEIQKNTKEIKQIANLQKKLLHSALLALKHGGELVYSTCTFLREENEAVLENALRNENFKLELLDFDLVNVDFICAKSDEFDLSFAKRVLPDDYADGFFIAKVKKH

SEQ ID NO: 39582 - protein, 1267 aa, Kluyveromyces lactis NRRL Y-1140
MSCAVQAAVVAMKDNSSHGQVPYRANNEHLNRVVQSVTDATKRLSQISTASSNANVNNTKTSKRRNRDTVGPWKLGKTLGKGSSGRVRLAKNMETGKLSAIKIVPKKFVKSNQIKQLPYGIEREIIIMKLISHPNVMGLYEVWENKSELYLVLEYVEGGELFDYLVSKGKLPESEAIHYFKQIVQAVAYCHGFNICHRDLKPENLLLDKKKRSIKIADFGMAALETSDKLLETSCGSPHYASPEIVLGRKYHGSPSDVWSCGIILFALLTGHLPFNDDNVKKLLLKVQSGKYQMPQWLSVEAKDLISRILVVDPNRRITIDQILQHELLTKYDQKSRSKSNSDLNLLNRTPNIVSFSSERDIDETILSNLQILWHGAARKHLVTRLMKPGFTEEKMFYSLLWNYQEKQQKSMQKDLIPVPTLKTSSASSVSPLNISSDVNSVTNTAKKQQQSSNGTVLPASMAPTISAFGQQISSDSSESSTLQAPKIHQKSHFSISSLKNGSSKSPKKTKQGFIASSSSSKLFQPNFGAKSSSQSISKSSSKKSLTPTTPKKRTLQNSASKRSLYSLQSISKRSINLNELLHDELQHEYPPPPLPSISSSEHTSSKLESIVDDYDRSTSVHGATMDNFLGESGQHMKAQQNEKLTQPSKNILAQPKLNNQPQTENRQSVTSMKRKTADNTIATVPVSMTPLKDMTNTFQSKSMYVSSLDPKRNKPKPSLENLLRKVSVPQRIKSRSTIRKLRDSGDWTVSGEAQALFGGKGSSEGENQLQRQKTNPSKLTAPETVLTTSTPMTDIKPDLLRMPSSLINSSMTFKDLSQFIMNIDEDKVPVTQASNPVNTDHEKLSENQTLMIENDSNRFETSSNYDDYNVNTAPAVTTAGDIDIFEDAPDDANESVTTSESMIDQSQLNLKKKAASIDSIDTSHVLTPATDVRVSLYINQMDKLDNLPRETTEQIISKFKLSPIKDIKQKRFSNGDRDLTITGSMISMFKDLDGDESRAEYDDNGLGLLGSALDTRPVENETNEDTNGTTVKRNSTVLVSSINGDNLDLSTEEQKNDDGNHGQGQTRRVTLLFDDGSSESEQVFKPVAAERRQPTLNANSTTTNNVGSKRKSNYINKLPKIKEDEVKPITSMKSSSPVNWFSKLLQRIKTSKPKRTVYEYRTSSIPFDNIHILLMTQFGKNGVDCELKKMERKGDKEYVTYDCNFGGIKRNRPKSKFTVEMRCMNGTETVLSLETRSKRFVNDKDTMASFERFNKDVAGAISAQEE

SEQ ID NO: 39583 - protein, 523 aa, Haemophilus ducreyi 35000HP
MNNIHNHKILILDFGSQYTQLIARRIREIGVYCELWAWDVTEKQIREFNPTGIILSGGPESTTETNSPHAPEYVFKAGVPVLGICYGMQTMAMQLGGLTEASEQREFGYAAVELQHADQLFAKLNDDLTASQPKLDVWMSHGDKVTRLPAGFQTTAVTPTCPIAAMSDEKRRFYGVQFHPEVTHTKSGLALLTNFVENICGCARSWTPENIIEDAVAKIKQKVGNDQVILGLSGGVDSSVTALLLHRAIGKNLHCVFVDNGLLRLNEGDQVMEMFGDKFGLNIIRVNAEERFLEALKGIDEPEAKRKIIGKVFIDIFDDEAKKLTDVKWLAQGTIYPDVIESAASKTGKAHVIKSHHNVGGLPDYMKLGLVEPLRELFKDEVRKIGLTLGLPAEMLNRHPFPGPGLGVRVLGEIKKEYCDLLRNADAIFIEELYKSGWYYKVSQAFTVFLPVKSVGVMGDGRKYDWVVSLRAVETIDFMTAHWAHLPYELLGKISNRIINEVNGISRVVYDVSGKPPATIEWE

SEQ ID NO: 39584 - protein, 582 aa, Desulfitobacterium hafniense Y51
MIGEVSMPIIIRFFKDKRFRVIITMFLRFVFQLWWLSKKRRFYGEEAYQKQLKAVYQKQARIFAEIAMGMGGLLIKLGQFFSSRVDILPEEYTRELALLQDAVKPVPTADIIRRIEAEYGRPLGEIYLNFSPEPIASASLGQVHTAEIKGHDQVAVKILRPGIEEIISSDFDALRFVVTFAKRYPRIRAAVDLEQIYAEFTETTLDELDYLKEGRHADQFRENFAGEPGIAVPKVYWEYTTRRVLTMEYITGYKINDFAALDKAELDRVKLADTLITAYVQQFLSDAFFHADPHPGNLLVKEDGTLVFLDFGMVGRIDEGMREELISFVMALFKKDTEQMVEVFANLGFLRPHAEKGTLAKGLKLILANIFAEKDLKKVNSEEFLWELREFMYSQPFQIPARTLFLGKALLSIIGICGGLNPRLDLIKTLRPYAEELLAGKEQADGAQGFAQKFILDQAKKTFTDVVGLPERINHLITGLEGGSIRLHPARSFEQNLLQSQREQGNRIVQAIVSSGFLIAGTILLEGPYLKIGIGLIAFSALSFLSLLKSNAGRARSERRGRGNRAMRNASATGFKKPRFHP

SEQ ID NO: 39585 - protein, 400 aa, Medicago truncatula
MNVWVKTMAMVLPKLRKVNLSGYYNIDDSSLLHLCKNCEFLEEVMMLKCPFLTHDDVASAIRERPTLKSLFVRWRTNGRHDNIGANFIGSLVSLNGLTCLNLSSLRISDELLFSIAMGGLPLRRLVLQNCTSYNYVGIYSLLSKCRIQHLDLQNATFMNDHDVAELSLFLGDLVSINLSECSMLTDSAMFALVRNCPSLIEVKMEHTSLGEKSVDNSNSSMDCVLNHQLKSLHLTCNFQLLNENIILFASIFPNLQFLDLSSCHNISEEGICEVLRRCCKVRHLNLAYYSRVKLLRINFKVPELEVFNLSHTCVDDETLYMISKNCCGLLQLFLENCDEVTENGVKHVVENCTQLREVDLGGCDNVNANVTASVVFSSTSLRKVNAPPHFRISDREMKLL

SEQ ID NO: 39586 - protein, 126 aa, Brassica napus
MEDQELQKSSRVVKVDSPESWNFYVSQAKSQACPIVAHFTASWCIPSVFMNSFFEDLASSYKDALFLIVDVDEVKEVARRLKVKAMPTFMFLKDGNTMDKLVGANPDEIKKRVDGFVQSSRLVHIA

SEQ ID NO: 39587 - protein, 440 aa, Tuber borchii
MITKIHARSVYDSRGNPTVEVDLTTTDTGLHRAIVPSGASTGQHEAIELRDKDKTKWAGKGVLKAVENVNTIIAPALIKEKFDVKDQATIDKFLIDLDGTPNKAKLGANAILGVSLAVAKAGAAAKKVPLYAHVADLAGTKKPFVLPVPFMNVINGGSHAGGRLAFQEFMIVPSEAPSFTEAMRQGAEVYQILKTLTKKKYGQSAGNVGDEGGWPDIQTVEEALDLITDAIDKAGYTGQIKIAMDVASSEFYKEDAKKYDLDFKNPDSDSSKWLTYQELADLYKSLAQRYPIVSIEDPFAEDDWEAWAHFYKTSDFQIVGDDLTVTNPIRIKRAIDEKSCNALLLKVNQIATLTESIQAAKDSYSAGWGVMVSHRSGETEDVTIADIVVGLRAGQIKTGAPARSERLAKLNQILRIEEELGEQAIYAGTSSEPPHLYIFI

SEQ ID NO: 39588 - protein, 246 aa, Brassica napus
LNSIFLFFYFSICLAHMAPSTKTVLIPIAHGTEPLEAVAMITTLRRGGADVTVASVETQVGVDACHGIKMVADTLLSDITDSIFDLIVLPGGLPGGETLKNCKPLENMVKKQDTDGRLNAAICCAPALALGTWGLLQGKKATGYPVFMEKLASTCATAVESRVQIDGRIVTSRGPGTTIEFSITLVEQLCGKEKADEVSSILLVRPNPGEEYTFTELNKTEWLFEDTPQILVPIAEDSEETEAIAL

SEQ ID NO: 39589 - protein, 421 aa, Clostridium acetobutylicum ATCC 824
MLFIIKYYEPKNLYEHILFILKHLCRSKSMILNPQKLSVDFGNGITATEPIIPRRYTLTHSDITAKLFLNIGLTYAYNKMTTMRDEVLGEWVKKSQDYSYQVFLHVDGRLGPKTTAIRNKIFRRELPLALEAIRYGDKRFFNAHPYLDNAPITVFFISTNPNFNKIENWGTFSDYNIESYYRNYKNVYLLDRKVGDVTGDDIPDTVSLYGEKEAPSEIFADDITVIITDGSTGNTTTITPEFNSGYNPTIFLGDFTKNRVYDIKISIDSGGSGGYGFFYIYSFMENTFREIFNFDAYNKEYKYKVDYDDLYKVNVGAITLNKLFILDISYKGYDVLSQYYYENGKLIKPVDGDVLALGALVPIVSNELLDFYNLLAFQRIIGTYNADTLGYVQNLLSWDGKNFTPSSTFVNISGSSLISPY

SEQ ID NO: 39590 - protein, 391 aa, marine gamma proteobacterium HTCC2080
MNAERQYDVVVFGASGYTGRLVAEYLNEQYPNAEFSWAMAGRSIEKLTAVRSEMSISDAIPLIAVDSDDPASLEAMVKSAGVVITTVGPYQLYGEELVKQCATHGTDYVDLSGEPAWMHHTIAMYNSAAKASGARIVHSCGFDSIPFDLGVFHLQEHAKAVTGHTVSRVKGRVRAMNGSFSGGTIASLRATMTAAAAQPEIIATLMNPFALTEGFAGPAQPDGDQPQYDEELKSWSAPFIMAAINTKNIHRSNFLMGHPYGEDFAYDEMMLTGDGDEGKALADFVAKDKTLAESPLKPGEGPSPEERKAGNYEAIFVAQGAGGEMLITSVAGDRDPGYGSTSKMLAEAALCLLNNPELGEGGVTTPAAAMGQPLIDRLQENAGITFKIESP

SEQ ID NO: 39591 - protein, 924 aa, Prochlorococcus marinus str. MIT 9313
MSSVAHVTTAPDVAKLEPDPFAIFSFPLDEFQLEAIAALNHGHSVVVSAPTGSGKTLVGEYAIHRAIAHGQKVFYTTPLKALSNQKLRDFREQFGSQNVGLMTGDLSVNREASIVVMTTEIFRNMLYAEADQADDPLADVEAVVLDECHYMNDSQRGTVWEESIIHCPASVQLVALSATVANAGQLTDWIERVHGPTQLVFSDYRPVPLQFSFCSAKGLHPLLNDAGKGLHPNSKVWRAPKGHKRKGRSPKPPQPEPPPIKFVIAQMAEREMLPAIYFIFSRRGCDKSVKDLGSQCLVSPTQQEQIRQRLRTYSETNPEAVRDGIHADALLRGIAAHHAGVLPAWKELIEELFQQGLVKVVFATETLAAGINMPARSTVISALSKRTERGHRPLMGSEFLQMAGRAGRRGLDSQGYVVTVQSRFEGVREAGQLATSPADPLVSQFTPSYGMVLNLLQRHDLKKARELVERSFGRYLASLDLVYEEESLEQLRLQLGQLQGVAGDVPWQDFEDYEKRRSRLREERRLLRILQQQAEETLANELTLALQFASVGTLVSLKAPQLRGRVTPAVIVDKLEGPGQFPLLLCLTDENVWLLLPCPAVVSLHAELSCLQVTEMNEPDLQRSGELRHGDQHSGSLALAVAHMAKRHDMTTPQYDLAGEVLAQAQRVRGLEEELEQQPAHRWGDRKQLKKHRRRMEELELEICERQQLLHQRANRHWETFLSLIEILQHFGCLDDLEPTEIGRTVAAMRGDNELWLGLSLMSGHLDDLHPANLAAVFEAISTEVNRPDLWSGYPPPASAEEALHDLAGIRRELLRAQERCQVVVPAWWEPELMGLVDAWARGTAWSDLIANTSLDEGDVVRILRRTVDLLAQVPYCEAISEQLRRNARLALKAINRFPVCEAEDLLNAAAVDEELNPATERVA

SEQ ID NO: 39592 - protein, 463 aa, Arabidopsis thaliana
MAEEGFIGIGESEEEAAEIGAFSYSHHQISDLRRRSSAVKDDSAQTSTPSSPPPPLPIHAGGSAVGATGKAKKKTGGARLWMRFDRTGAMEVVECDKSTIIKRASVPARDLRILGPVFSHSSNILGKNFDLLIPGLAREKAIVVNLEVIKAIVTAEEVLLLDPLRPEVLPFVERLKQQFPQRNGNENALQASANVQSPLDPEAAEGLQSELPFEFQVLEIALEVVCSFVDKSVAALETEAWPVLDELTKNVSTENLEYVRSLKSNLTRLLARVQKVRDELEHLLDDNEDMADLYLTRKWIQNQQTEAILAGTASNSIALPAHNTSNLHRLTSNRSASMVTSNTEEDDVEDLEMLLEAYFMQLDGMRNKILTVREYIDDTEDYVNIQLDNQRNELIQLQLTLTIASFAIAAETLLASLFGMNIPCPLYSIHGVFGYFVWSVTALCIVLFMVTLGYARWKKLLGS

SEQ ID NO: 39593 - protein, 977 aa, Arabidopsis thaliana
MDRISNLPNEIICHIVSFLSAKEAAFASILSKRWRNLFTIVIKLQFDDSVKNEGSLKDFVDGVLALPTSSRVRSCSLECRREFDPTHYDDFNRCICALLKRGILDLKLDICAGRRYSLPLEVFTCKTLVKLELGSDFGGFVVDLVPEDAFLPALETLLLNYIRFKDLRRCAFEKLLSACLVLKELVIHNMEWERWKWSGNISSPTLERLTISHVDLYECEFTRINLDTPNLTYLELSDAVPDDYPIVNLDSLVEVKLDLTLMVDHKYHGYVDDNDTISSNPTNLINGLRNVEIMNLQSPNTFQAFSYFHEAIPVFKNLYHLTITNNDTVIGFCWEFLPFVIKKCPNLKTLVIDGPLHYNEDRPKSVCHCLSGYSFLLSCPLEVLQITDYSGTPGEVEQLKHFLEKLSGLKLVKLHSLTRFGSDKKKLLMLPRASSKCKIKHYDSLENALLPSLKTLILDSVKFYDRCGCCAFQKLLSACPVLVESVMRNLEWEDWEWSGCASSQTLERLTIDHRYWAEHNLESFTFDTPSLTYLDYNAHVPGSYPTVNLDSLVEAKLNLGFTTDLVEDDDDPFTSDPTNLIKGLRNVEILRLWIVVCNEFKSRVQKVDLVSNLPEEVRCHILSFLPTKHAALTSVLSKSWLNLWKLVPNLDIDDSEFLLPEEEIPEIFLSRTLVELKIRSERYVDWWRRDRGTVLPMLKTLDIDSESIHCGTIDMFLPSFPVLEYLRMANMEWTESDETVSSATIKLLSIHGTVAEDYPLVNMKALFEARINFIVTEKQIKRVRAPNEDWLQDDEVDVVLRFSNVVKLMNGIQNVQKLYLTADTIEVLSLCCESVPLFNNLKTLGITSEEGRGWQAMPVLGLLHYMTDKCGDACDCISREDKGRSLTSCPVKKLEIRGFRGTMKEMTMIKHFLVYFPCLKEMNIYVEEYDPTELRFPQVSKVIIQMMEEYNKLSSCNVQLLITDYLSEKWTAAGRIL

SEQ ID NO: 39594 - protein, 136 aa, Triticum aestivum
MSGNKKAGDHPVADAAWPARRRDGMGRAGVLLIACLFTLPFMALLFGGRAGALAVWQNAAKLTAMGGGLLNVSRQSAAGADELFGGLLSPGSDRRACLSRYQSPHYYKHSPYAPSRHLLWKLRDYEARHSRCGPGT

SEQ ID NO: 39595 - protein, 368 aa, Oryza sativa (indica cultivar-group)
MDEKVKMESKLSSAAAFVEGGVQDACDDACSICLEAFCDNDPSTVTSCKHEYHLQCILEWCQRSSQCPMCWQPISMKDPMSQELLEAVEQERNIRANRLNTAAVFHHPVLGDFEVPVGADDAELEERIIQHLAAAAAMRRSHRHGRRDGHRSRSGSHSRPQIVVFSRNEAIPGGSLHASSGQDEDHEQSSDLGSAHPFAALAAIDQGHMGGGSQLYVGHSDQGASNPSLHDERAMSRYKDSITKSTRGWKERWFSRSNTISGLGTEVRREVNAGIAAVSRMMERLETKDDTGPSAVPAASACSPSDANNQRTDLALNEPTPCSLKNWIHCEDRKFAEAFASRSRDIRLVLADEPLHFFTLCNIYARLL

SEQ ID NO: 39596 - protein, 1387 aa, Aspergillus nidulans FGSC A4
MFQINRELAALGIEWNPRRIYYLETWRYPEVESPTRWNIRDGLLEDFQVEEWLNQRGEFSPPVPPAEVGNGSHGGIRLLACNYHLFPKISVGMSPETFGLAPQKYEIGNYMLSLTYDMSSHWTTALLAGESIVDTASTIFNRSSLPLAPLSPCDVVREYLMSSPTLWDHPLMLPCIVLSHHLRRLQHHCNRDLTPIVMGIEAQLGVTRVGRRNFDARPRSINAIKDGPVARVQSEHLTVTINTQLTRVGFTARNPKWNYEASALLEKIVTELAAYTPALRPEANEEILGVLDHNITLAKSLEDNVLGLQKRLELQLNVLYSFVAQTDNRLSARLAATAGRDSTSMKILAFITTIFLPGSYVASLFSMNMFNWEDGASGSEGPGSGGSTISPQFWIYWTVAAPLTALTLAGWALWWSFEKHRYDEHLEGNRQDTRVKIPPWWRRILETRHTLNPGLADDYLRFAQQRYETSRPRSKAQHQRATSHLPGGNTRSVLHATPFPLCMQAGKGNRLVDVDGYEYIDCMGDMTACLYGHSHPVIMETVDSTMKSIGMNLGSSTSAEAHFAEALCDRFASIDHIRFCTSGTEANLYALSVARQSTNRTKVIVFEGAYHGGVLSFSHGIAPNNVDKDDWILGQYNDIDGAVQLITENKDIAAAVVVEGVQGAGGCIPGSAGFLHAIQDAARENGIIFILDEVMTSRLAPGGLQSILLHPDHGTPLKPDLTTFGKWIGGGLSIGAFGGRRDLMSVYDPRTSIIHHSGTFNNSTLAMNVGCKGLTSVYTPEACTSLNNLGDELRSGLQELAKGTKMVVTGLGAVMNIHFVRASGSRVVARTSDLEVNSGSVEEALRDLLWFYLIERGFWIARRGMISLILGTGVEEVEQLKGVVGDFLEDFRELVSAYLLPVAALATAVSTHPQTPSDLIVATSSGIVHGIYNDTAHKVRAFLGIPYAEPATGDLRFAPPQPRAPSQHPINASSFGAPCPQVYNYDNESIWNVLPYRIRNVEDMSEECLFVNIWTPAEHQTKKSGAGRKGKAVMLFIHGGGFGEGAGSVGFYDGVDLASSEDVVVVTFNYRLNVFGYPNAPGLDPAEQNLGLLDQRLAVQWVHQNIANFGGDPDRILLFGQSAGGASVDAYAYAYPEDPLVSGFVLQSGTVSLFNNADTAHANWNRLSTAVGCSAGDGSLACMRSVSFSRILEVLGNGSYTFTPVADNRTVFSDYIARAKAGGLARLVRIRTPLTRCQPTLAGINAREFSAGFPLSQSSINETAVTEDLFGSFSCPAYQAVKTRLRQHIPTWRYVYHGNFTNLSPKPWLGAYHSGAWVAFAQNRHTGLEDYGWPLFTFNETTLVNLAVDNRPGAVLGSAEDWDRHCRGDVYIGYTIPDSLQLHVYNM

SEQ ID NO: 39597 - protein, 505 aa, Coccidioides immitis RS
MDQSVPAAVADAGPSAENRSRRESFASQNSHTAAEFINAQLQLELDAREALPYSFDSCTRPLGPLRQSLFSCLTCNPPPADSNTPYNPAGVCYSCSISCHGEHTLVELFTKRNFVCDCGTTRLPPTSPCTLRTDPKTGAKSVHSDEPSSENKYNQNFRNRFCCCAEVYDPHREKGTMFQCLGLGSVETGGCGEDWYHPECLVGLPRSWNEKNPEDQAKDKEKVNNNSEENADNSDPPLPPGFPGEDEFESFICYKCLDSNVWLKRYAGTPGFLPPVYKNRSNPAQADITVLTPNAPAKDDSGRKRKLDIDLDSEPGLKRAKSDSTNEEPLKISTPPALVREKHNSLPQDIPSGTFSLFVKEDFRDYLCHCAACFPSLIPHPQLREEEETYEPPLSEPGDGAQGAPSAGSQHTGSLLERGEAALSNLDRVRAIEGVMVYNHLKNKVKEFLQPFAESGTPVGAEDIKAYFEKLRGDDEAIREAGSKRNGSYEDNNDEGDSRREQSGK

SEQ ID NO: 39598 - protein, 180 aa, Triticum aestivum
MAGAASSVAPVLVICLLSLALFLHRCRSCEAVERERTLAMIKPDGLSGNYKEKIKEAILGSGFDIIEEAVVHLDAERASLFYAEHADRSFFNSLVKYMTSGPVCAMVLESPDAISRWRNLIGPTDARKAKTSHPDSIRAMCGLDSEKNCVHGSDSPQSAAREISFFFRDDKSEALEHDEL

SEQ ID NO: 39599 - protein, 411 aa, Mycobacterium tuberculosis H37Rv
MASSTTFVIVGGGLAGAKAVEALRRSDFGGRIILFGDEEHLPYDRPPLSKEFLAGKKSLSDFTIQTSDWYRDHDVDVRLGVRVSSLDRSAHTVELPDGAAVRYDKLLLATGSAPRRPPIPGSDAAGVHYLRSYNDAVALNSVLVQGSSLAVVGAGWIGLEVAASARQRGVDVTVVETAIQPLLAALGEAVGKVFADLHRDQGVDLRLQTQLEEITAADGKATGLKMRDGSTVAADAVLVAVGAKPNVELAQQAGLAMGEGGVLVDASLRTSDPDIYAVGDIAAAEHPLLGTRVRTEHWANALKQPAVAAAGMLGRPGEYAELPYLFTDQYDLGMEYVGHAPSCDRVVFRGNVAGREFLSFWLDGDSRVLAGMNVNVWDVVDDVKGLIRSGNPVDVDRLVDPQWPLADLTTN

SEQ ID NO: 39600 - protein, 425 aa, Desulfitobacterium hafniense Y51
MSYIEEIYGREILDSRGNPTVEVEVLLEDGSMGRAAVPSGASTGAFEAVELRDGDKGRFLGKGVLQAVANVNEVIAPELEGLNPFDQPAIDRELIALDGTENKGKLGANAILGVSLANAKAAAECVGLPLYQYLGGVNAKELPVPMMNILNGGQHADNNVDIQEFMIMPVGAKSFAEALQMGTEVYHSLKAVLKEKSLATAIGDEGGFAPSLESNADALLAIMDAIQRAGYTPGKDIALALDVAATELYRDGKYHLEGEGLTKTADEMIAYYEDLVEKYPIVSIEDGLSEEDWEGWKKLTEKLGSKIQLVGDDLFVTNPARLARGIKEKCANSILIKLNQIGTLTETLDAIEMAKRAGYTTVISHRSGETEDVTMAHVAVAVNAGQIKTGAPARTERVAKYNELLRIEEELGETGVYPGHEALGR

SEQ ID NO: 39601 - protein, 620 aa, Kluyveromyces lactis NRRL Y-1140
MVSINLAKVFAPLPSTKRNFTTHLSYDPKTDSLAYGSGRSAIIRSLDGEHVVQFNGHGTSNVTVVKFSPIQGSQYVASGDDSGRVIVWSWNQDDKSGEIEYNVKSELHVLAGPVADISWDFEGKRLAVVGEGRDRFGAFVSWDSGNSLGEVSGHSQRVNAVHFKQSRPMRAFSVSDDGSVVFYQGPPFKFASSDRTHHGQGKFVRDVKFSPGAGKYAVSVGSDRKICCFDGKTGEFIKYIESEKAPIGGGLFAVAWLDDGEESSRVVTVGADCTARLWDVSLDDPFQQSWKLGADVSNQIVGVVVTKDNSIVTLTLDGTLSILSLNDHTIKFIHGHNKGITSLAVNPLVSGSYDGRVVTWNSEGDEVNAISHDIHGNLVLAIDNSDNEVSSVSWDETLKNFIDGEKALAETKYQFSEQPKCAVFSHNTLAVATNTNELLIIDNKSGLLSKSITLDKPVGALALGTTFVAVAYEQTNSVQLFKISDLSDAFTLATPLRATPSALSFSPSQKYLAAGDVSGKIILYDLDTKDVKTSRWSFHTSRITSIDWRPSANDDDLEEDYVVTGSLDTNIFIYSVNKPMKVIKRLNAQKDGVSSVLWENDSTIVSAGVDACIKRWTVEF

SEQ ID NO: 39602 - protein, 510 aa, Desulfitobacterium hafniense Y51
MKPLLLMILDGWGYNPQSAGNAVAKAPKPHFDRLLEEYPHTLIVASGEEVGLPPGQMGNSEVGHLNIGAGRVVYQEFTRISQAIRTGEFARNRVLQEAMERVKDGPNALHLMGLLSDGGVHSHSEHLFALLAMAKTMGVKKVFIHALLDGRDVLPQSAKGFMTQLNSKCRELGLGQVATVSGRYYMMDRDKRWERVEKGYRALVNGEGLKAPNSLAAIEQSYDVRVTDEFVAPTVIVDSAGEAVGPLRDGDSFIFFNFRSDRAREISYALLDEEFTGFDRGKPLQLHYVCMTEYDDKLKGAAVAFPAQNLDNTLGEVLAKHQKKQLRIAETEKYAHVTFFFNGGVEEPCPGETRCLIPSPQVATYNLLPEMSAYGITEELLKRLEREEDEVIILNFANADMVGHTGEFEATVKAIAAVDQCIGQIVPRVLERQGTVIITADHGNAEAKVDLQTGQPLTAHTTNPVPLILVNDQLKGKTLREGGALRDVAPTMLRLLEIPQPQEMTGKSLI

SEQ ID NO: 39603 - protein, 668 aa, Actinobacillus pleuropneumoniae serovar 1 str. 4074
MAERKVLANAIRFLSMDAVQKANSGHPGAPMGMADIAEVLWRDFLKHNPTNPKWADRDRFVLSNGHGSMLIYSLLHLTGYDLSIEDLKQFRQLHSKTPGHPEYGYAPGVETTTGPLGQGITNAVGMAIAEKTLAAQFNREGHKIVDHYTYAFLGDGCLMEGISHEACSLAGTLGLGKLIAFYDDNNISIDGHVDGWFSDDTAQRFEAYGWQVIRNVDGHDAEQIKFAIENAKAETERPTLIICKTIIGYGSPNKSASHDCHGAPLGNDEIALTRKALNWEYAPFEIPAEIYAEWDAKAQGAVVEKEWNAKFAAYEAAYPELAAEFKRRMAGDLPANWEAESKAFIEKLQANPAAIASRKASQNAIEAYAHILPEFLGGSADLASSNLTLWSGSKPIRADHNVDGNYINYGVREFGMSAIMNGIALHGGFIPYGATFLMFYEYAHNAVRMAALMKQRSLFVYTHDSIGLGEDGPTHQPVEQTASLRFIPNLETWRPADQVESAVAWKAAVERKDGPSALIFTRQNLAQQTRTPEQLANVARGGYILRECCQKGGCPDLILIATGSEVDLAMKAAEVLDAEGTKVRVVSMPSTNVFDKQDAAYRESVLPSSVTKRVAIEAQLSDFWYKYVGFEGRIVGMNSFGESAPADQLFKLFGFTVDNVVAKAKEIL

SEQ ID NO: 39604 - protein, 261 aa, Desulfitobacterium hafniense Y51
MKGAHFMAKRHPIIAGNWKMNKSLRETQEYAVKLLGVLGEVTAIDVVVCAPFTALNVLKNELEESVIHIGAQDMFYAPDGAYTGEISAAMLVDVACTYVILGHSERREILRETDEEIAKKVKAALKAGLTPILCVGENLANREEGKAFAIVRGQVEKDLTDLAPDDLKRVVIAYEPIWAIGTGKTASSEDAQEMCAMIRSTLAGIAGVVADEVNILYGGSVKADNIGELMSQPDVDGALVGGASLEAEGFAQLVQNAVAVL

SEQ ID NO: 39605 - protein, 395 aa, Desulfitobacterium hafniense Y51
MMNKKGLKDIAVQGKRVFVRVDFNVPMDDHGNITNDTRIRAALPTIDYLIDEGAKIILASHLGRPKGKPDPNYSLAPVAKRLGELLKRPVAMATDCIGPEVEKAAAQLQEGEVLLLENVRYHAEEEKNEPEFVKQLARLAEVYVNDAFGTAHRAHASTEGIAHHLPGVAGFLLQKEIESMGKALENPERPFVAIIGGAKVSDKIGVIENLLHKVDALIIGGGMANTFLKAQGYSLGKSLVEGDKLSLAQEILEQGRELQVDILLPQDVVAAKEFKADAPYRVTPVREIAEDEMALDIGPESAGLFSARIQKARTIVWNGPMGVFEMEQFAKGTEKVAQAVALCPGLTIVGGGDSVAAVEKMGVGEQMSHISTGGGASLKLLEGKTLPGIAALQNI

SEQ ID NO: 39606 - protein, 144 aa, Glycine max
  misc_feature (99)..(99): Xaa can be any naturally occurring amino acid
MGSAASPPRALDAATQEDLKRVSTHRAVYMVESGMTLGLDTCSTARHTLDCLESTLRTGALCSLSGEPTSLKTEAHTARDGIPLLALGNTNQIQLSVEXAHEVDAKLNLPKGHGGSLLHQNMIEGDGAHYAIMFDNPKHQPRVL

SEQ ID NO: 39607 - protein, 215 aa, Zea mays
  misc_feature (156)..(156): Xaa can be any naturally occurring amino acid
MGEQENNKIGGSGNDNAMAVDEAGAGAAANKGKSLGAADPRLQAISDAIRVVPHFPKPGIMFNDITELLLRPGVFRDAVDMFVERYRGMGIAAVAGIEARGFIFGPAIALAIGAKFIPLRKPKKLPGEVFSESYVLEYGMDCLEMHVGAIEPGERXVVVVDDLVATGGTLSAAIRLLERAGANVVECACLIGLPKFKDFYKLNGKPVYILVESRK

SEQ ID NO: 39608 - protein, 555 aa, Dechloromonas aromatica RCB
MLKNPDILVVGKHSFNDAALSQIAKSKGDEAAWQQAFQRFGVKAAEHVSGDFAVALNEPNGQVFLAIDRFAIRSLCYRQIGNRLLFAERADELADASTEIDPQAIFDYFYFHAIPSPRTIFKGVYRVPPGHYVLFENAQLTVAPYWIPTFEETRNQPFEKLRDEFRDILQQATTRQLDGGKAACFLSGGTDSSTVAGMIGLAHGAPAATYSIGFEAEGYDEMAFARIAARRFNTEHHEYYVTPDDLVSSIPMVASSYDQPFGNSSALPAYYCAKMAKEGGVSKILAGDGGDELFGGNSRYAKQRIFNSYRHLPSFLQKGLLEPLFSLPGMDQIPLLKKGSSYIEQASIPMPDRLQLYNLITRLGVDQVLTPGFLQAINLNAPLGLQREVWSSAVTDSLTNRELAFDWRFTLAESDLPKVCGTTRLAGINVGFPMLDDELLAFSLRLPVEYKLKGLKLRWFFKEALRGFLPDEIIVKKKQGFGLPFGVWLNRHDALRKLARNSVMGLVDRGVLRGEFVDQLFNKHLQEHPGYYGEMIWISMMLEQWLVHHRANYSI

SEQ ID NO: 39609 - protein, 197 aa, Medicago sativa
  misc_feature (78)..(78): Xaa can be any naturally occurring amino acid
  misc_feature (110)..(110): Xaa can be any naturally occurring amino acid
MSASRFIKCVTVGDGAVGKTCLLISYTSNTFPTDYVPTVFDNFSANVVVNGSIVNLGLWDTAGQEDYNRLRPLSYRGXDVFILAFSLISKASYENVSKKWIPELKHYAPXVPIILVGTKLDLRDDKQFCIDHPGAVPITTAQGEELRKLINAPAYIECSSKSQENVKAVFDAAIRVVLQPPKQKKKKNKAQKACSIL

SEQ ID NO: 39610 - protein, 445 aa, Acidobacteria bacterium Ellin345
MSKAQQLVRSVGLFDATMLVMGGIVGSGIFINPYVVAQQVHTAPLILGAWLAGGVIATLGAFIYAELAGRQPSVGGQYAYLRDAIHPLAGFLYGWVLLLVIQTGGMAAVTVTFARYFLVLTHWAVPERVVAVVTLSLLTLINCLGVKFGSRVQSALMILKIGAIAFLVVAGFLYIREPFAVGGTVLDRPLSPGLLSSFGAAMVPVLFAFGGWQTANFVAGEVRDPRKNLARALLLGVAGVIVLYLAVNFVCVRALGPVGLAATRVPATDVMRLAMAQRGATIVTLGITVSTLGFLSQSILTAPRVYFAMAEDGVFFRAVAKVNEKTHVPILAIVLQSVWTIVVALTGRYEQILNYVVSMDFVFFGLTACTLFVFRKRSSLENGASGGFQVPGHPWTTLVFIAASWLVVTNTIYKYPANSLLGFAILLVGMPVYWLWRRKGKVLSQ

SEQ ID NO: 39611 - protein, 333 aa, Bacteroides fragilis YCH46
MIKVGINGFGRIGRMVFRAAVKNFGNDIQIVGINDLLDAEYLAYMLKYDSVHGRFEGEVAVEDGALIVNGNKIRLTAEMDPANLKWNEVDADVVVESTGFFLTDETARKHIQAGAKKVIMSAPSKDSTPMFVYGVNHTSYAGQDIISNASCTTNCLAPIAKVLNDKFGIVKGLMTTVHAATATQKTVDGPSKKDWRGGRGILENIIPSSTGAAKAVGKVLPVLNGKLTGMAFRVPTSDVSVVDLTVVLEKAATMAEINAAMKEASEGELKGILGYTEDAVVSTDFRGCANTSIYDSKAGISLDSNFAKVVSWYDNEWGYSNKVCEMARVIAAK

SEQ ID NO: 39612 - protein, 308 aa, Phaeodactylum tricornutum
MKFTAACSLALVASASAFAPIPSVSRTTDLSMSLQKDLANVGKVAAAGALAFGLATAPANALTKSQINELSYLQVKGTGLANRCPEVVGEDSITPKGGQRLVDMCIEPKAWAVEEEIGKAGRTEKKFVNSKVMTRQTYTLDGIEGALKSEGGSIVFQEQEGIDYAATTVQLPGGERVPFLFTVKDLVAKGNGGSFKPGFQMGGDFNTPSYRTGLFLDPKGRGGTTGYDMAVALPGLQSGEEGDDDLFKENNKTFDITTGRIEMEVNKVNAEEQEIGGVFVATQLSDTDMGSKVPKKVLTKGIFYARVE

SEQ ID NO: 39613 - protein, 331 aa, Erythrobacter sp. NAP1
MAGSTDIVTVDVGGTHARFAIATIHTDGAIALGEPVTIHTETHASFQTAWEDFASQMGGTIPDQLAMAVAGPIKPDIIRFTNNPWIIRPPLIESKLGCTNHVIVNDFEAVAHAAARAPDEEFLHLAGPDEPFPEPGTISVLGPGTGLGVAYFYRRPDGSYRVQATEGGHGDFAPLDSIEDAILARLRKRHTRVSDERVVSGPAIVDIFHALAAIEGRAVRELSDVEIWTAGTDGSDSLAAAAVDRFCLALGSVAGDIALVQGAKGVVIAGGLGYRIRETIRASGFASRFTAKGRFAGLMATLPVKLITHPQPGLLGAAAAFAQTHLEEPQP

SEQ ID NO: 39614 - protein, 398 aa, Pyrobaculum aerophilum str. IM2
MFLMEVKLHEFEKVYGDANKAAEARRQYLEKVTGVKLENIGRTIIDLNTVVGRNIENVIGAVQIPVGVAGPLLVRGDYANGYFYVPLATTEGALVASVNRGAKFVTESGGARVKVLKDGMARAPLFRVPSLIDAVELVEWVTGHFEELKKVAESTTRFGKLKDIQHFIVGNYVWLRLVFSTGDAMGMNMVTIASEAVAKFIQENFPKAKLIALSGNMCVDKKANAVNFILGRGKTVVAEAVIKKEILERLGITPEDVHNVNVRKNLIGSALAHSYGFNAHFANIIAAIFIATGQDVAQVVESSMGITSTEAREDGLYISVFLPSLEVGTVGGGTGLPTQREALELLGVAGSGNPPGVNALKFAEIIAAAVLAGELNLLIALARNELASAHKKLGRGAR

SEQ ID NO: 39615 - protein, 385 aa, Phaeodactylum tricornutum
MKVATTLTLAFICCASAFGLNGQTTSVMKKVGFGAGSKPMVQAIDVQGNRLGSNMQPLKSAVANEDAPRGGATKSPVDIGLLLYFGLWYLGNYYYNITNKLALNAAGGKVGFPMTISSLQLGVGSIYALFLWLAPDARSRPKISMDDIVKMLPVALCFMGAHSASVFAMGMGAVQFAQIVKASEPAFAAVLSQFVYGKKSRRHKWLCLPIVIGGVILASVKELDFAWSALIAACIANMFAAVRGNENKKLMETPGLKDRIGTVGNQFAITTVLGFILSLPVLFLREGSRFGEFVQLAKTTPAIWMNLVASGLWFYGYNECATMTLKKTGAVTQSVANTAKRVIVIVGVALVLGESLSPIKLIGCSIGIGGVFLYSIIDNLVKPKK

SEQ ID NO: 39616 - protein, 440 aa, Gibberella zeae PH-1
MFYQGTLQEGISTAVSQQKLVLCFVADDSDESSQWETEFLADDTLRDLFEGHVLLRLEAGSASAGYLAQIFPLPRTPTVVIIKNGELKEYIAPGTGKDEFLRRVKEAFNSSATPQPAPAQPAQVAPPQPVTPTAPEQTQTTVSSSTSENVRRILSERATRLQAQREENERKVKEERARTKERAKAEAEAGMNTDNARAHKAAEAVKKKRQQDQEERARILKRIEDDKAERRIRAEEREKQRRGSMKGGDVAASLVNAPETKLADSTKTGGMTALQVRLFDGSTLRSRFKTNAPLKEIRQWVDENRSDGAQPYTFKQVLTPLPNKNIDETEEDKAIGELGLSPSSTLVLIPVKKYTSAYDDDSQGIVSRIIGFILSIFSWILSIFSSDERAHRGSVGPTSSRERSQIREFQNPSDQRDQQLYNGNSAKLNFEPRPEEEKDS

SEQ ID NO: 39617 - protein, 827 aa, Arabidopsis thaliana
MEANKKAKPSYGDVISNLPNDLLCRILSYLSTKEAALTSILSKRWSNLLLSIPILDFDDSVLLKPQKGQRKNVFFKAFVDRLLSQRVETSSHVQRVSLKCRQGGVEPDCVIKWILTTVRDLGVLDLSLCIDFGIFHLPFNVFRSKTLVKLRIGTMIRLSQFPSDVVSPTLNSLVLDLVEFRDGDKVEFRQILLAFPSLQSLRVHESNKWKFWNGSASSRTLKSLVYRSDDDSSAPKPCVSFDTPSLVYLDYSDMVADKYENLKFDSLVEARLDLHLTAFQIMRKPNNIGIVSGDVTTLFKGIRNVKILCLSPDALEALYYRGEKIPMFNNLITLSLGSDKPHGSPFIFWKLLPSLLNNSLKLETLIIKGLVHYVAEGWEGLSPMTPMSRLCFSWDTVSDSLSSSAMKVLEISGYKGTWQELNQMKRFLGNLSRLEVIGSELMSSKPEFVICQFEPPARLMATPLVVQIIVAYVARTQTSALRMVDSKRMDSGSKDMINDLPDALLCHVLSYLTTKEAASTSLLSRRWRYLLAFVPNLEFDDSAYLHRDKRVKNPLHEKGLVGFVLTVDDKRKKLSTSFPDFVDRILDLQGNSPLDKFSLKMVDDHDPVDPDCVAPWIHKVLVRGVSDLHLVIDMNEWTSLPAKIFLTETLVKLTLKIRDGPPIDVKHVHLPKLKTLHLESVMFDEEDIGFSKLLSGCPELEELVLHHIWSCVWTSCSVSVATLKRLTFCCNNMKFCGMHEENPNNVSFDTPNLVYLEYAEVIANNYPKVNFDSLVEAKIDIWMTNDQLDEVRIRDIYEKNVMVGNATDLIVGIRNVRVLCLSADTLE

SEQ ID NO: 39618 - protein, 202 aa, Shewanella sp. MR-7
MYTEFDGIIFDMDGTLVDSGQLHEQAWRQTLNHFGIPVEPALMRSLAGVPTIGTLEILIAHFGVTPTASYEAMNEYKEALVRDTMHLYVKPTALAEFAKQNQGKRPMAVGTGAYTEEAIQILTLCGLLELVDYVVGADQVASPKPAPDTFLRCAELMGIAPERCIVFEDAKAGIQAAEAAGMFVVDVHAELQIENDYFLGTR

SEQ ID NO: 39619 - protein, 218 aa, Triticum aestivum
  misc_feature (3)..(3): Xaa can be any naturally occurring amino acid
  misc_feature (5)..(5): Xaa can be any naturally occurring amino acid
PVXSXYRANLAGAGQRVGIQIRVFRKKQTPLQHVLDQVLSCVRREKLLPEITSSSNINASDQAVLVTSLSSWYYERIREEYGGGRVAGGVHQPSHEGRQKRGDTSHDRRALSEMYLLSTCDVLVTTGFSTFGYVAQGLGGIRPWIMPSTPMWSESDTADTKVVPEPPCVRAMSVEPCFHSPSYYDCTARRDVDVGKVVPYVRHCEDVSWGIKIANQSS

SEQ ID NO: 39620 - protein, 509 aa, Zea mays
  misc_feature (204)..(204): Xaa can be any naturally occurring amino acid
MMIARRLLRPNAPAQATSLLKHVTGTASLQGNADSLLDGTVRHFGSAPSAQPEENGFKGHGMLAPFTAGWQSNDLHPLIIERSEGSYVYDINGNKYLDSLAGLWCTALGGSEPRLLKAATEQLNKLPFYHSFWNRTTKPSLDLAQEILSMFTAREMGKVFFTNSGSEANDSQVKLVWYYNNALGRPNKKKFIARSKAYHGSTLXSASLTGLPALHQKFDLSAPFVLHTDCPHYWRYHLPGETEEDFATRLATNLENLILKEGPETIAAFIAEPVMGAGGVIPPPKTYFDKVQAIVKKYDILFIADEVITAFGRLGTMFGCDYYNIKPDLVSLAKALFNAYVPIGATLVSPEISDVIHSQSNKLGSFAHGFTYSGHPVACAVAIEALKLYRGRDIPGHVKQIAPKFQDGIRALADSPIIGEIRGLGMIMGTEFTNNKSPTDLFPAEWGVGAIFGEECQKRGMLVRVAGDAIMMSPTLIMTPGEVDELVRIYGEALKATEERVAALQSKKN

SEQ ID NO: 39621 - protein, 442 aa, Alteromonadales bacterium TW-7
MTKISLPTCSPLLTKEFIYGVATASFQIEGGSTHRLPCIWDTFCDTPGKIADNSNGHVACDHYNNWKKDIDLIESLGVDAYRLSISWPRVITKSGELNPEGVKFYTDILDELKKRNIKAFVTLYHWDLPQHLEDEGGWLNRETAYAFAHYVDLITLAFGDRVHSYATLNEPFCSAFLGYEIGIHAPGKVGKQYGRKAAHHLLLAHGLAMTVLKQNSPTTLNGIVLNFTPCYSISEDADDIAATAFADDYLNQWYMKPIMDGTYPAIIEQLPSTHLPDIHDDDMAIISQSIDYLGINFYTRQFYKAHPTEIYEPIEPTGPLTDMGWEIYPKSFTELLVTLNNTYNLPPIFITENGAAMPDSYNNGEINDVDRLDYYNSHLNAVHNATEQGVRIDGYFAWSLMDNFEWAEGYLKRFGIVYVDYSTQQRTIKNSGLAYKALISNR

SEQ ID NO: 39622 - protein, 272 aa, Brassica napus
MVRCSNNLVGILNFIVFLLSIPILAGGIWLSQNGSTECEGFLDKPVIALGGFLMVVAIVGLIGSCCRVTWLLWTYLFVMFLLILLVFSITVFAFVVTNKGAGEKVSGRGYKEYRLGDYSNWLQKRVNSDKNWNKIRSCLVDSKVCSKLDDKLVGVPVNNFYHEHLTALQSGCCKPAEKCQFAYVSATNWTKTAGTHPDPDCQTWDNAPNKLCFDCQSCKAGLLDNVKSAWKKVAVVNIIFLVFLIIVYSVGCCALRNNKRDDSYGRTYGYKP

SEQ ID NO: 39623 - protein, 596 aa, Coprinopsis cinerea okayama7#130
MNECDETLDLGVLTDTVLENPGLTFAYSGHLHNATVARFSPSGFYCASGDASGTVRVWDVVGEDKALKGEYRVLAGRINDLAWDGESKRIIAVGDGRDKFGHAFMMDTGSSSGEIIGHSKAVNAVSIRPQRPFKAITASDDAQINFHAGVPFKYERTIKTHTKFVQDVKFSPSGDHFLSVGSDAKIFIYEGKTGDTVAEFTDSPHTGTIFAGNWSPDGKSIVTSSGDRTVKLWDVETRKVVSSWALGTAIEAQQVGNTWNDDINIVSLSMSGALNQFDPRVGDKPVHVYTAPQMPITSLLSTKSDTFLAGTADGRVYSYSTSKQESTPVGGPGHSSYVVDLAASPSSSSGTTTAYSVGFDDHVREIDSVGESYVQAAVKTTAQPKSISISSNDTIFVAQPELIEVFRSNQKLYSLAPKAFKPTAIAARPSGNGNENESVSLVAVGAEDNKVYLFEWDGKELKPKESGGVFDNNKGPISVLAFSPDGKVLAAGDTKGKIMPYSIEEKKPITPTWVFHTARINTLSWTSNSQFLASGSLDTNVYIWSLAKPSKKVVIKEANPGGVNGVQWVNGGEGGKLVSAGADGCARVWDVVFPEA

SEQ ID NO: 39624 - protein, 412 aa, Dechloromonas aromatica RCB
MEAKVPPTHSPMTQFATVDGELQVGGLPLSRLAERVGQTPFYAYDRELLRTRVRELKAVLPAGIKLHYAMKANPMPALVAFMASLVDGIDVASGGEMKVALDAGGVPQEISFAGPGKRDAELRQAVAAGVLINVESFRELDLLARISTELGLPARVAVRVNPDFELKGSGMKMGGGPKQFGVDAEQVPLLLARIGELKLSFEGFHLFAGSQNLKPESICEAQQKSYELALALSRHAPSPVRFLNLGGGFGIPYFPGERPLDLSSIGDNLAQLASRAAQDFPLASLVIELGRYLVGEAGIYVSRIIDRKISRGQTYLVTDGGLNHHLSASGNFGQVIRKNYPVSIGNRMNAEDIEIATVVGPLCTPLDILGDRMALSVAMPGDLVVVFQSGAYGASASPQSFLGHPEVTEVLV

SEQ ID NO: 39625 - protein, 126 aa, Roseovarius nubinhibens ISM
MPYDYDDQNIFAKILRGEIPNDTVLETEHSLAFNDIAPQAPVHVLVIPKGPYVCYDHFASTASDAEIVDFNRSVADVCRMTGVAPGAAGAGYRAITNCGEDGVQEVPHFHLHILGGRMLGRMLAKD

SEQ ID NO: 39626 - protein, 332 aa, Alteromonadales bacterium TW-7
MAAFGTVFMPQMIQARFSDNQWGETSVVPCDKLEFHAGAHVLHYSSTCFEGLKAFRHEDGSVYIFRMDANIARMQQSSALLSLPSFDGDMLKTMIIDIVRQYADETPLPPGSMYIRPTHIGTEAAIGKAAAPSMSSLLYTLLSPVGDYFAGGATALRVLLEEDGMRCAPHMGMVKSGGNYASALGPISAARKQYQADQILFCPGGDVQETGAANFILIDGNEIITKALDSTFLHGVTRNSILTIAKDLGMTVSERNFTVTELLERAAKPGTEAALSGTAAVLTAVGTFIHNDKEYKVGTGEPGPTTARLRQALNDIQWGKSEDKHGWLTKVV

SEQ ID NO: 39627 - protein, 134 aa, Mycobacterium sp. JLS
MTIRSFTFTLDDGVPPAVAPFAHATAAGQTLYVTGQMPTDHTGEIVGTGIEAQTDQVLRNLLRVTRLCGGGLDDVVAVRAYLTDWAEYAAFNTAYAAWFPDRLPSRTCVGVTGLAVGARVEIDWTCWRADGWGR

SEQ ID NO: 39628 - protein, 461 aa, Treponema pallidum subsp. pallidum str. Nichols
MAHLPKEYDFSIESLGESKIPSPIYLSHTLGDFIPNYVSDNEYISHELSARLGETVGPFTHKNLMERAGPRQKIFFNPHHVHAGIVTCGGLCPGLNDVIRAIVRCLWGRYGVKRISGIRFGYKGLLPDYNFDILPLTPEVIDNCHKTGGSLLGTSRGGGNRVVDIVDGIERLNLHILFIIGGDGSQKGAKEIADEIKHRNLKISIIGIPKTVDNDISFVQKSFGFDTAIVKATEAVAAAHMEARSQINGIGLVKLMGRESGFIATYTAIASHETNFVLIPEVSFDLDGPNGLLAHLEKRIALRKHAVLVVAEGAGQDLMVNADGVPSGDSQGGSLRVSSGTDASGNKRLADIGLFLKEKIGVYFKEKRIHINLKYIDPSYLIRSAVAAPIDSIYCERLGNNAVHAAMCGKTKMIIGLVHNKFVHLPIDVVVCQRKHVNPEGSLWRDALDATGQPIVMKNII

SEQ ID NO: 39629 - protein, 507 aa, Bacteroides fragilis YCH46
MQEKIIILDFGSQTTQLIGRRVRELDTYCEIVPYNKFPKGDETVKGVILSGSPFSVYDESAFKVDLSEIRGKYPILGICYGAQFMAYTNGGKVEPAGTREYGRAHLTSFCKDNVLFKGVREGTQVWMSHGDTITAIPENFKTIASTDKVAIAAYQVEGEQVWGVQFHPEVFHSEDGTQMLRNFVVDVCGCKQDWSPASFIESTVAELKAQLGDDKVVLGLSGGVDSSVAAVLLNRAIGKNLTCIFVDHGMLRKNEFKNVMHDYECLGLNVIGVDASEKFFSELEGVTEPERKRKIIGKGFIDVFDEEAHKLKDVKWLAQGTIYPDCIESLSITGTVIKSHHNVGGLPEKMNLKLCEPLRLLFKDEVRRVGRELGMPEHLITRHPFPGPGLAVRILGDITPEKVRILQDADDIFIQGLRDWGLYDQVWQAGVILLPVQSVGVMGDERTYERAVALRAVTSTDAMTADWAHLPYEFLGKVSNDIINKVKGVNRVTYDISSKPPATIEWE

SEQ ID NO: 39630 - protein, 377 aa, Aspergillus nidulans FGSC A4
MPEIFDDKSQHCIPFLLQRLKAHQARHSNDPANTPPFFLGLNGVQGAGKTVLVSTLNSILRSPPYSLAVVTLSLDDLYLTHEDQVSLAKSNPTNPLLQHRGQPGTHDLPLAQSVFSALRAGRPTAIPQYDKSAFSGQGDRVPMEQWETVNVEGQEQIKVLIFEGWSVGFRAWDDDILKQKWEDAVKRKEQDKEYRGRLGHVKFEDVRKVNEALRGYDVLTDDAQDNHFVYEWRQEQERTLRATKGIGMTEEQVNRFVDGSRLSAQEHSDRFRIRLRHLRRRRAGRGDNFDWLSIKIILTTMDETYFIHRRSPKNMHEEIVPSQPDSLRSMQLREEPQIWKRRMQCRRTRLPQMTAFNDIGVNVDKKDYNLPLIMERG

SEQ ID NO: 39631 - protein, 356 aa, Prochlorococcus marinus str. MIT 9313
MSSTHLPGGNQALLGCSATELEGWAVAEGQPAFRGRQLHEWLYAKGARSFEAITVLPKSWRLSLQQRGITIGRLLEVNRAVAVDDTTKLLLATVDGETIESVGIPTQQRLTVCLSSQVGCPMACRFCASGKGGLQRSLATHEIVDQVLSLREAMDRRPSHVVFMGMGEPLLNIEAVLAAIRCLNIDLGIAQRRITVSTVGVPHTLPHLAELAMKRLGRAQFTLAVSLHAPNQELRERLIPTACAYPFETLLQDCRHYLAVTGRRVTFEYILLGALNDQPQHAEELADRVRGFQSHVNLIAYNPIDDEGFQRPNPETIEAFRRVLEQRGVAVSLRASRGLDQNAACGQLRRQHAATG

SEQ ID NO: 39632 - protein, 273 aa, Pseudoalteromonas tunicata D2
MDKYAVFGNPIKHSKSPAIHSKFAELLGEQLHYQAILAPLEHFEATVNAFFDGGGLGANVTMPFKEQAFAMCQQLSERAQVSGAVNTLKRLESGGLYGDNTDGAGLVSDLLNNDVTLKNQRILLMGAGGAARGVLLPLLNEQPRKITIVNRTKEKAQILAELFSQYGEIDYCSFDELPDSSFDVVINSTSSSIAGVLPSLTEVHIADAKAIYDMVYSDSSTVFLNWAKQHNTTAILLDGIGMLIGQAAEAYYVWRNVYPPSERVIELAKQKAV

SEQ ID NO: 39633 - protein, 425 aa, Thiobacillus denitrificans ATCC 25259
MSRNEALFEASQKVIPGGVNSPVRAFRSVGGTPVFFSRARGSRVWDADGREYIDYVGSWGPAILGHAHPGTVKAVQDAAANGLSFGAPSEAELTIATRITELLPSVEKVRLVSSGTEATMSAIRLARGFTGRSKFIKFEGCYHGHADFLLVKAGSGALTFGNPTSAGVPPEVAAQTIVLDYNDVAGLERTFAEIGDEIACIIVEPFAGNMNLVKPSAEFMAAMRRLCDEHGALLIFDEVMTGFRVDLGCAQKLLGIRPDLTTLGKVIGGGMPVGAFGGRADVMDALAPVGPVYQAGTLSGNPVAVAAGLATLASVSEPGFYPALAARTEKLVKGLTAAAREAGVTFCADSVGGMFGLYFAAEPPASFAEVMRCDKEKFNRFFHAMLDHGVYLAPSAFEAGFVSAAHSDADIDATVAAAREVFRTL

SEQ ID NO: 39634 - protein, 339 aa, Brassica napus
MADNKKIKIGINGFGRIGRLVARVILQRNDVELVAVNDPFITTEYMTYMFKYDSVHGQWKHNELKIKDEKTLLFGEKPVTVFGIRNPEEIPWGEAGADFVVESTGVFTDKDKAAAHLKGGAKKVVISAPSKDAPMFVVGVNEHEYKSDLNIVSNASCTTNCLAPLAKVINDRFGIVEGLMTTVHSITATQKTVDGPSMKDWRGGRAASFNIIPSSTGAAKAVGKVLPQLNGKLTGMSFRVPTVDVSVVDLTVRLEKAATYDEIKKAIKEESEGKLKGILGYTEDDVVSTDFVGDNRSSIFDAKAGIALSDNFVKLVSWYDNEWGYSTRVVDLIIHMSKA

SEQ ID NO: 39635 - protein, 129 aa, Zea mays
MAQGTLEVLLVGARGLENTDYLSNMDPYALLQCRSHEQKSSVASGKGCEPEWNETFVFTVSDGAAELFIKLLDSDGGTDDDFVGEATIPLEAVYTEGNIPPTVYNVVKDEEYRGEIKVGLTFTPEDQGF

SEQ ID NO: 39636 - protein, 297 aa, Escherichia coli
MATNLRGVMAALLTPFDQQQALDKASLRRLVQFNIQQGIDGLYVGGSTGEAFVQSLSEREQVLEIVAEEAKGKIKLIAHVGCVSTAESQQLAASAKRYGFDAVSAVTPFYYPFSFEEHCDHYRAIIDSADGLPMVVYNIPARSGVKLTLDQINTLVTLPGVGALKQTSGDLYQMEQIRREHPDLVLYNGYDEIFASGLLAGADGGIGSTYNIMGWRYQGIVKALKEGDIQTAQKLQTECNKVIDLLIKTGVFRGLKTVLHYMDVVSVPLCRKPFGPVDEKYLPELKALAQQLMQERG

SEQ ID NO: 39637 - protein, 238 aa, Prochlorococcus marinus str. MIT 9313
MADLQTQMKQAVAAAAVEQIKDGMVLGLGSGSTAALMIQALGAKLASGELRDIVGVTTSFQGEVMAAELGIPLRNLTAVDRIDLAIDGADEVDPSFQLIKGGGACHVQEKLVASRADRFVVVVDSTKIVDRLNLGFLLPVEVLPGAWRQVQGRLAELGGIADLRMAQCKAGPVVTDQGNLVLDVSMAGGIGDPEDLECRINNLPGVLENGLFVNLTDEVLVGQISDGVAGVRRLQRRE

SEQ ID NO: 39638 - protein, 843 aa, Oryza sativa (indica cultivar-group)
MAGASHHLVVFLAALLALLPGSSQLQYSQTWTLFKIQQMLNHPPVLSHWRRTTDFCGGGGTAAPSAAVVCYGDTVTQLHIAGVRGAPPLPMNFSIGALVMALSRLPDLKVLTLSGLGLWGPLPDKIGRLAALEIVNMSGNYLYGGVPGGLSQLTGLQTLILDDNLLAGELPAWIGELPQLAVLSLRNNSLGGAVPASVGRMESLRSLVLASNNLTGNLPDMSGLTNLQVIDVGDNWLGPAFPALGRKVVTVVLSRNRFTGGLPGEITSFYLLERLDVSWNRFVGPFMPALLSLPAIRYLNVAGNRFTGVLSDKVACGDNLQFVDLSSNLLTGSEPACLRPDKKPATVVLVNANCLEATGGDASQHPSPFCQNQALAVGITHGGKVRKKLTHHAGFLAGIAMAALAAASAIAVVAVVAVRRKNKKGVMVRPPAMLGEDNSSSTSGYPSKMFADARYISQTVKLGALGIPPYRTFSLVELEAATDNFENSLLLGQDSFGEMYRGRLGNGTLVAIRSLKVKRNQSSLSFSRHIETISRLRHRNLVSALGHCFEYDLDDSTVTQLYLVFEYVQNGNLRCRISQGTEGRKLTWAQRISAAIGIANGIQFLHAGMMPGLFGNNLKINNILLDQNHVAKISSYNIPILGEAMKSEKCYDVCQSKKGGPGGKHHTESPLLNDKTDIFDFGVILLEIVSGKTITSLYEVEIMKELMLWAVADEDLVRRRSFADQEVSKGCSDESLRTIMQICLRCLAKEAVQRPSIEDVLWNLQFAAQVQDDWEGDNRSSDGSMVSSSSRITKSSRFQNEQTRSGREKECEDSSARGSVWLQAATEDGNFETGRRQAEDERY

SEQ ID NO: 39639 - protein, 89 aa, Brassica napus
IFEVNDIMSSKGWHLNALQRPNSIHICVTLQHVPVVDDFLQDLREAVETVKANPGPITGGLAPIYGAAGKMPDRGMVNELLVSFMDSQY

SEQ ID NO: 39640 - protein, 1465 aa, Adiantum capillus-veneris
MATPGGPKTKHSVSVAQTRADARLHAAFEGSGDAGAGGSRAPFDYSKSGMDASSVTSVAPEAITAYLQRMQRGGLTQAFGCMLVVAGQKIVAFSENAPEMLEVAAGLGTDLRMLFTQGSTAALDQAVKEEDLSSVNPLVLQSCGGSAKQFYAMLHRIEDVAGVVIDLEPIENGVVEKKSSAEMAVKPIARVQSLPGGEIGRLCQVVVEEVQEMTGYDRVMAYKFHEDGHGEVVAEVRRPDLEPYLGLHYPSTDVPQASRMMFMKNGVRMIGDCTLPPVRVVQAKELAQPISLAGSTLRAPHGCHAQYMSNMGSAASLTMAVAIDDYDDDSSLSCGSRKLWGLVVCHHPSPRTVSYPLRCACEKLMVAFGVQLNIELDLAAQLRENHILTTQALLCDMLRRIRGAPIGIVSRSPSIMDLVKCDGAALYYGGRFWPLGTTPSEFQIRDLAEWLLGASEEIASTGVTCTDSLAEMGYPGAALLGDAVCGMAAAMITPNSDFLFWFRSHTAKEVYWGGAEHDPQSRDDDSWMQLPRSSFKAFLEIVKRRSLPWEEVEVDAIRSLQLILREDLEQFCAAVGAVKASDGDDEDSLVPSAKKLSLKETEENGGADNSKKLERMHSAAAGGGGGGGRWEKMRLPSSLAQEWMEAIRGTGDGGASGGGGGGPFDWDLISAFQHNSFIVVDALKPDFPIIYASTGFFNLTGYTSREVIGGNCRFLQGPDTNPADVASIREALAQGTGTFCGRLLNYRKDGSSFWNLLTIAPIKDDLGSIVKLIGVQLEVSKYTEGIRANNRRPNGMPQSLIRYDVRHQDKVSAFIAQLVAALTKPDKVETPRLSSAMRFSLTGQTIESLPQPTAIPREGGGRTRRPRSSSFLSLLGMEKEKDIPEEDELQELEVIMLEDASVGRPGSLDDPERTRRGIDLATTLERIGKSFVITDPRLPDNPIIFASDRFLELTEYTREEVLGNNCRFLQGRGTDRKAVQLIRDAVKEQRDVTVQVLNYTKGGRAFWNLFHLQVMRDENGDVQYFIGVQQEMVAPRPVHQPPELPDILPDRVEQEKAEVVRATAQRVDAAARELPDANLVPDHLFAPHSKVVTPLPHSKTNSSSWFAIRRVQRRLRRGERLGLKHFRPIKPLGSGDTGSVHLVELRGTGQVFALKAMDKSMMLQRNKVHRARAEREILAIMDHPFLPTLYASFQTKTHVCLITDYCPGGDLFLLQDKQPTQTLSERTASFYAAEVVVALEYLHCMGVIYRDLKPENVLLQKNGHILLTDFDLSFLTSCRPQLILQGGKGRSRRSKRRRRVTFCAEPRVSSNSFVGTEEYIAPEIISGEPHSSAVDWWALGILLYEMLYGRTPFVGRNRQKTFYNVLNKELIFPTSIPVSLAGRQLIAGLLQRDPTIRLGTLRGASELKKHPFFREINWPLIRWRKFSANQAHNANNVSSLDEGESDSGNAWEANGGSTQSFQDTF

SEQ ID NO: 39641 - protein, 367 aa, Roseovarius nubinhibens ISM
MSTPSLLILPGDGIGPEVMTEVRKVIDWFGAKRDLAFDVSEDLVGGAAYDKHGVPLHDDTMARAQEVDAVLLGAVGGPKYDELDFSVKPERGLLRLRKEMDLFANLRPAQCFDALADFSSLKKDVVAGLDIMIVRELTSGVYFGEPRGIFEEGNERVGINTQRYTESEIERAARAAFELAMRRNKKVCSMEKANVMESGILWREVATRVGKDYPEVELSHMYADNGAMQLVRAPKQFDVILTDNLFGDILSDCAAMLTGSLGMLPSASLGAPMANGRPKALYEPVHGSAPDIAGQGKANPIACILSFAMALRYSFDQGDEATRLENAIEAVLASGARTADLMGPEGGTPLSTAEMGDKVIEALDQSL

SEQ ID NO: 39642 - protein, 577 aa, Glycine max
RADALRKLDKIGQGTYSSVFRAKEVRPGKIVALKKVRFDNFEPESVRFMAREIMILRRLDHPNIIKLEGLITSRLSCSIYLVFEYMEHDITGLLARPEIKFSESQIKCYMKQLLSGLEHCHSRGVMHRDIKGSNLLVNNEGILKVADFGLANFSNSGNKQPLTSRVVTLWYRPPELLLGSTAYGPSVDLWSVGCVFAELLIGKPILQGRTEVEQLHKIFKLCGSPPEEYWKKTRLPHATLFKPQQPYDSSLRETFKDFHASTVNLLQTLLSVEPSKRGTASSALSLEYFKIKPYACEPSSLPIYPPSKEIDAKHEEESRRKKIGGRACKPESRKPSRKPLALSKLAPAEDLTSQTQTSHKMNDRSVHIIKQEDTNTCEEAPKQSSGKPEDASSYMKNASQVDIPFPGPLQVSKSSGFAWAKRRRDDTSVRSHSRSISRGFIFNSLETSTLNSRDNSESRNHENKEFFGARTNSRGNHLLEISKLAMQNQWSKFDRPDSFDTCDEYHSQELSLAIYNRQDSLSKRSNLSYQDQEEKVEFSGPLLSQMHTVDELLERHERHIRHTVRRSWFQRGKKQGK

SEQ ID NO: 39643 - protein, 530 aa, Oryza sativa (indica cultivar-group)
MCGILAVLGVADVSLAKRSRIIELSRRLRHRGPDWSGIHCYQDCYLAHQRLAIVDPTSGDQPLYNEDKSVVVTVNGEIYNHEELKANLKSHKFQTASDCEVIAHLYEEYGEEFVDMLDGMFAFVLLDTRDKSFIAARDAIGICPLYMGWGLDVCRIKILVLIYVPSKKFKVFVTGHEVGFFFDVISGSLFKAIIKRLMTDVPFGVLLSGGLDSSLVASVVSRHLAEAKVAAQWGNKLHTFCIGLKGSPDLRAAKEVADYLGTVHHELHFTVQEGIDALEEVIYHVETYDVTTIRASTPMFLMSRKIKSLGVKMVLSGEGSDEIFGGYLYFHKAPNKKEFHEETCRKIKALHLYDCLRANKSTSAWGVEARVPFLDKNFINVAMDIDPEWKMIKRDLGRIEKWVLRNAFDDEEKPYLPKHILYRQKEQFSDGVGYSWIDGLKDHANEHNAARLTVPGGPSVACSTAKAVEWDAAWSKNLDPSGRAALGVHDAAYEDTLQKSPASANPVLDNGFGPALGESMVKTVASATAV

SEQ ID NO: 39644 - protein, 868 aa, Coprinopsis cinerea okayama7#130
MKANYKFSNICGTVYRQGNIVFSADGNTLYSPVGNRVSVFDLVNNKSFTFPFENRKNITTIALSPDGNVLISVDEDGRALLVNARRGVVMHHFNFHKTVKDIKFSPDGKYIAVTHGPHVQVWCTPNHLVREFAPFNLHRTYTGHHDEVLSISWSPDSRCFITTSRDMTARLFTLNPLDGFRPKTFAGHRDAVQSAYFSANGDTIYTVSKDGAVFTWKAKDEDGSDSDEPMASTSTEIYGRIANTRWGIQKRNYFNQANTKVVCSTFHPASNLLVVGFTSGIFGIWELPEFTSIHTLSISQEKISSVAINASGEWLAFGARKLGQLLVWEWQSESYVLKQQGHFFDMNTLDYAPDGQTIATGGDDGKVKLWSSFSGFCFVTFTEHTAPVSTVSFAKQGSVLFTASLDGTVRAYDLIRYRNFRVFTSPRPVQFSCLAVDPSGEVVAAGSTDSFEVFLWSVQTGKLLDILTGHEGPISSLAFSPAGDNQLASGSWDKTVRIWSVFGRSRAVEPFNLSGDVLAVAFRPDGNELAVSTLDGQITFFDVRDGKQTNVIEGRKDVSGGRKADDRVSAANSSSGKSYNSLAYTADGRCLLAGGNSKYVVLYDVREGEGLMLKKFQISQNLSLDGTEEFLDSRKVNEVGINTDLIDDGDESDLEDRLDTTLPGARRGAGDMSVRKYRQEARTKCIRFSPTGRAWAAASTEGLLIYSLDEAVTFDPFDLSIDLTPQAVLEVLSQREYLKALVMAFRLNEKPLIQRVYESIPPADIRLLSRQLPLVYVPNLLRFVAEHLEKSPHLEFDLIWSKTLLMLHGRYLKERSGEYASVFRVLQKGLSDSEQSISRICDENTSLLSYLVDQTKIRQQKDVEMSSS

SEQ ID NO: 39645 - protein, 426 aa, Escherichia coli [sequence omitted]

SEQ ID NO: 39646 - protein, 362 aa, Bacillus cereus G9241
METTVRKQKKNLETKKPSIYSLQLHEMQDWLKEQGEPKFRAGQIFDWLYKKRVKNYEDMSNLSKGLRDKLSNSFDITTLNTLVKQTSSDGTIKFLFQLYDGYSIETVLMRHEYGNSICVTTQVGCRIGCTFCASTLGGLKRNLEAGEIVAQVVEVQRALDESEERVSSLVVMGIGEPFDNYDNLMGFLRIINHEKGLHIGARHMTVSTSGIIPKIYKFAEEDLQINFAISLHAPNSELRSKLMPINRAYKLPDLMEAIKYYVNRTGRRITFEYGLFGGENDQVEHAEELAALLKGVKCHVNLIPVNYVPERDYVRTPREQIFLFEKTLKDRGVNVTIRREQGHDIDAACGQLRAKERKEETR

SEQ ID NO: 39647 - protein, 426 aa, Escherichia coli [sequence omitted]

SEQ ID NO: 39648 - protein, 219 aa, Ageratina adenophora
MATLIQFNTPYTSLSADNIPTTESSSTSDYSTGTSFSDEEVMLASKNPKKRAGRKKFRETRHPIYRGVRRRDSGKWVCEVREPNKKTRVWLGTYPTADMAARAHDVAALAMRGRSACLNFADSLWRLPIPESSNVKDIQKAAVKAAEAFRPTETDVAVIEESNELTGNVFCVDDESIFEMQGFLADMAEGMMLPPPRTIEYDNCQDDLEFFVDASLWSF

SEQ ID NO: 39649 - protein, 500 aa, Kalidium foliatum
MAFPIPSRQLFIDGEWTEPIKKNRIPIINPATEEIIGDIPAATAEDVELAVAAARRALKRNKGEDWASASGAHRAKYLRAIAAKIMERKGQISKLEAMDSGKPLDETEWDIDDVAGCFEYYAEQAEALDAKQKAPISLPMDTFKCHVLRQPIGVVGLISPWNYPLLMATWKVAPALAASCATILKPSETASVTCLELADVCREVGLPPGVLNILTGLGPEAGAPLACHPDVDKVAFTGSTATGSKIMSSAAQMVKPVTLELGGKSPILVFEDVDLDKAAEWAAFGCFWTNGQICSATSRLLVHESIAADFLDRLLKWCKNIKVSDPFEDGCRLGPVISKAQYEKVLKFISTAKSEGATVLCGGSRPEHLKKGYFIEPTIISDVSTSMQIWKEEVFGPVLCVKTFRSDDEAVELANDSQYGLGSAVLSKNLERCEKVTKELQAGIVWVNCPQPCFCQAPWGGSKRSGFGRELGEWGLENYLNIKQVTEYISDEPWGWYKSP

SEQ ID NO: 39650 - protein, 413 aa, Botryotinia fuckeliana
MADLQGRKVFKVFNQDFIVDERYTVTKELGQGAYGIVCAATNSQTQEGVAIKKVTNVFSKKILAKRALREIKLLQHFRGHRNITCLYDMDIPRPDNFNETYLYEELMECDLAAIVRSGQPLTDAHFQSFIYQILCGLKYIHSANVLHRDLKPGNLLVNADCELKICDFGLARGFSVDPEENAGYMTEYVATRWYRAPEIMLSFQSYTKAIDVWSVGCILAELLGGRPFFKGRDYVDQLNQILHILGTPNEETLSRIGSPRAQEYVRNLPYMAKRPFPTLFPNANPDALDLLDHMLAFDPSSRIDVETALEHPYLHIWHDASDEPGCPTTFNFDFEVVEDVGEIRKLILEEVHRFRQHVRVQPGQQGQSNGPQVPIPQEQASWRAEDPRPQEAYGQGPNDLEQDLQGGLDAMRS

SEQ ID NO: 39651 - protein, 384 aa, Mycobacterium tuberculosis H37Rv
MRAVVIDGAGSVRVNTQPDPALPGPDGVVVAVTAAGICGSDLHFYEGEYPFTEPVALGHEAVGTIVEAGPQVRTVGVGDLVMVSSVAGCGVCPGCETHDPVMCFSGPMIFGAGVLGGAQADLLAVPAADFQVLKIPEGITTEQALLLTDNLATGWAAAQRADISFGSAVAVIGLGAVGLCALRSAFIHGAATVFAVDRVKGRLQRAATWGATPIPSPAAETILAATRGRGADSVIDAVGTDASMSDALNAVRPGGTVSVVGVHDLQPFPVPALTCLLRSITLRMTMAPVQRTWPELIPLLQSGRLDVDGIFTTTLPLDEAAKGYATARARSGEELRFCLRPDSRDVLGAHETVDLYVHVRRCQSVADLQLEGAADGVDGPSMLN

SEQ ID NO: 39652 - protein, 148 aa, Brassica rapa
MEQTFIMIKPDGVQRGLVGEIICRFEKKGFTLKGLKLITVDRPFAEKHYQDLSAKPFFSSLVDYIISGPVVAMIWEGKNVVLTGRKIIGATNPAASEPGTIRGDYAIDIGRNVIHGSDSVESANKEAALWFPDGPVNWQSSLHSWIYE

SEQ ID NO: 39653 - protein, 453 aa, Coccidioides immitis RS
MHSFRGLLHDSVSASSVSRQGHGDPLGFPGLPECSEPCEPFSSRPPPRKFITPLQFAIRIQQSRQYRAATANSNRLLESLDNKKPLPFSYASKVKLREKYLIVGFISSGTYGRVYKAKGRDGVGGDFAIKKFKPDKEGEKVEYTGLSQSAIREISLCTELNHPNVVRLVETILEDKCVYMLLNGLLYLHSQWVMHRDLKPANILVTSKGAVRIGDLGLARVFKKPLNSLFSGDKVVVTIWYRAPELLLGARHYTTAVDLWAVGCIFAELLSLRPIFKGEEAKMDSKKTVPFQRNQMLKIIEILGLPKKEKWPGLSSMPEFPQLQAMAMAPGSGHLHKPSNLEHWYHVCLKSGGYSGSSPAGSPGKEGFDLLSRLLEYDPEKRISAKEALNHPYFTTGTPVAKNCFEGFEGKYPNRRVSQDDNDIRSGSLPGTKRSGLPDDTLTSRAAKRAREM

SEQ ID NO: 39654 - protein, 199 aa, Asparagus officinalis
LDEYSKFHGYSPAVVTGKPIDLGGSLGRDAATGRGVVFATEALLAEYGKSISGLTFVIQGFGNVGSWAAQLIHERGGKVIAIGDVSGAIKNSNGIDIPALVKHKSGGGVLKDFRGSDAFDPKELLVHECDVLLPCALGGVLHRENAADVKAKYIIEAANHPTDPEADEILSKKGVVILPDIYANAGGVIVSYFEWVQNI

SEQ ID NO: 39655 - protein, 192 aa, Gloeobacter violaceus PCC 7421
MRRLSQVGTCLAVLALLTAAGAGAQQAGPLKQNPTTTTASEPTAPIIPDASKYRQLEQESSVLSVAGTDQMLKAAQQMAKDGKFVDAVARNQEAITMLNQMSTLHSQLSKAFAGIDNRIADQEKQVALQAAIRRDEATYQLALIHRAQGKPELAVPLLVRITTSQNPTRDLGQKAYQQLFEIGFVKSQYPRQ

SEQ ID NO: 39656 - protein, 285 aa, Mycobacterium sp. JLS
MAAARVCVVGSVNADLRFAVPSLPRPGQTVLASSMTTSPGGKGGNQAIAAARAGGDVSLVAALGDDPAAGQLRAHLRANGVGLDGVVTVPGPSGSAVVIVDAAAENAIVVAPGANAHLSVASSAVREAIAGADVVLLQLEIPLHTANDAARVARDAGAVVMVNASPAGAPPHELLRLSEVADVVVVNQAEAGEWHWPVPHLVITRGARGASYLGDGERFDVPAPAVEAVDTTGAGDVFAGVLAVHWRSGHENALRRACVAGALATLVPGAGDCAPTAEAIDDALR

SEQ ID NO: 39657 - protein, 442 aa, Alteromonadales bacterium TW-7
MKQLSLPSGSPLLAKHFTYGVATASFQIEGGAADRLPCIWDTFCSKEGKIADNSNGDVACEHYTRWQDDIDLIESLGVDAYRLSISWPRVMTKKGHLNPKGVKFYTDILDELKRRNIKAFVTLYHWDLPQHIEDEGGWLNRNTAYEFAHYADLITKAFGERVHSYATLNEPFCSSYLGYEIGVHAPGIVGREHGRKAAHHLLLGHGLAMLVLAKNSPNSLNGIVLNFTPCYSVTQCEEDLKATAFADDYINQWYMQPVMQGQYPDIINQLPKAQRPDILPGDMDIIAQPLDYLGVNFYTRMHYQASETDFYHELPHKAPMTDIGWEIYPEALTELLVSLNEKYTLPPIYITENGAAMADEFKDGEVKDTDRIDYYHEHLNALHNATAQGVKVDGYFAWSLMDNFEWAEGYLKRFGIVHVDYNTQKRTVKASGKAYTKLITSR

SEQ ID NO: 39658 - protein, 265 aa, Oryza sativa (japonica cultivar-group)
MGRRHGGGGGGGGGRGRGGRGRGGGEEDDLHLHKAARSGDLAAAESLCEANPLALNSRDRLSRTPLHLAAWAGHVELVKCLCKHKADVGAAAMDDTAAIHFASQKGHVEVVRELLASGASVKAKNRKGFTALHFASQNSHLELVKYLVKKGADIAAKTKGGQTALHVAEKDDVRDFLKECEQSLKKGGELPSEKKDDSVSTIAEKPDDDKSSGEATKDEDEAGFGEKRKSDGIAAALRSPELKKAKVSLGHLISANDMEEEEEAD

SEQ ID NO: 39659 - protein, 426 aa, Escherichia coli [sequence omitted]

SEQ ID NO: 39660 - protein, 337 aa, Thiobacillus denitrificans ATCC 25259
MHTGTTLTQFIIEEQRRTAGATGDFTSLLNDVVTACKAISNAVNKGALLGVMGALESENVQGETQKKLDVITNDIMIRSNEWAGHLAGMASEEMDDVYAIPGQYPLGKYLLVFDPLDGSSNVDVNISVGTIFSILKAPVAGRAAKAEDFLQAGTKQVCAGYAIYGSSTMLVLTFGHGTNGFTLDRDVGEFVLTHPAMKIPTETKEFAINASNMRFWEKPVQRYVDECLAGKTGPRGKDFNMRWVASMVAEVHRILTRGGIFMYPKDTKDPSKAGKLRLMYEANPMAFIVEQAGGAATTGYQRILDIAPEGLHQRVPVILGSKTEVDTVTGYHHEKAA

SEQ ID NO: 39661 - protein, 479 aa, Streptomyces avermitilis MA-4680
MSSTFRNYIDGAFADASDGRTLDVVDPTTGDVYATSPLSGAADVDAAMAAAAAAFPVWRDATPSVRQRTLLKIADAMEARADELVAAESRDTGKPLHLTRSEELAPAIDQVRFFAGAARMLEGRSAGEYMEGMTSIIRREPVGVCAQVAPWNYPLLMAVWKFAPALAAGNAVVLKPSDTTPASTVLIAEIIGGVLEELGLPRGIFNVVCGDRETGRLMVEHPTPAMASITGSVRAGIQVAQSAAKDVKRVHLELGGKAPAVVFEDADLAKAVEDLVVGGFFNAGQDCTAATRVLVHESVHDEFVAALAKAAADTKTGQPDDEDVLYGPLNNAGQLAQVSGFIERLPEHATIEAGGHRVGEKGYFYAPTVVSGLRQDDEIVQNEVFGPVMTVQSFTDEAQAVQYANGVDYALASSVWTKDHARAMRMSKNLDFGCVWINTHMALVAEMPHGGFKKSGYGKDLSAYGFEDYTRIKHVMTSL

SEQ ID NO: 39662 - protein, 367 aa, Buchnera aphidicola (Tetraneura caerulescens)
MIKKFKLAILAGDGIGPEVMEEGIKILEVIKKKFMLKLDIKEYLVGGVAIDKFGTALPKSTIDGCLNADAVLFGSVGGDKWKHLPVEQQPERAALLPLRKILNLFVNIRSSKLYSSLSHLSPLKSKIVNNGFDILCVRELIGGIYYGIPKGQKMDNYKRRYAVDTSIYYEEEITRIANFAFEIATFRRKKVTSVDKANVLETSILWREVVNKVAKKYPEISLNHLYVDNASMQIIKNPMDFDVILCPNLFGDILSDECGMITGSIGMLPSASLNKSKFGLYEPAGGSAPDISGKNIANPIALILSISMLFKYSFEQLNIADAIESSVINVLKDGYRTFDILTTNTNEKLLSTSSMGSKISDYLKHEE

SEQ ID NO: 39663 - protein, 215 aa, Schizosaccharomyces pombe
KGQSNESLPQESYIVHTLVMVASDTGPLRIRSGHLPEVHPPAAEDKGKFEVVPFLLSSLDGIAHIRVFLPNDLKSQGQKLTVGKALSEVKRRFPEGITLLDPVENMNIKEPTFIKLMKKVNILESRLLSNPLHNFSELEEKYAEYLRKLALLEEVKDLKKKLSKARSIMQLDELNSRKRVLRRLGFTTSDDVIEVKGRVACEISSGDGLLLTELI

SEQ ID NO: 39664 - protein, 122 aa, Arabidopsis thaliana
MAGAVGTSMLGSLIVFTVILSLQEIYRGKLASSELFTILGGFTSSLLFLFSLTFIGNFQESSGIKSGWGAVILAEIIALIAAGTVHRVCITTCFLFSAGLLYEVNKISGYMLSKTESKSKRH

SEQ ID NO: 39665 - protein, 438 aa, Methanocaldococcus jannaschii DSM 2661
MHYYFITNLVIVMTQMDDAKNGIITEEMKIVAEKEKIDIEKLRKLIAKGYVVILKNVNRDTNPVGIGQSLRTKVNANIGTSPDCVDIELEIKKAKIAEKYGADAVMDLSTGGNLEEIRKAIMDAVKIPIGTVPIYEVGKLAREKYGRVIDMNEDLMFKVIEKQAKEGVDFMTLHCGITKQSVERLKRSGRIMGVVSRGGAFLTAYILYHNEENPLYKNFDYLLDILKEHDVTISLGDGMRPGCLADNTDRAQIEELITLGELVERCREKGVQCMVEGPGHIPINYIETNIRLQKSLCKNAPFYVLGPIVTDIAPGYDHITAAIGGALAGYYGADFLCYVTPSEHLRLPTIEDVKEGVIATKIAAQAADVAKGNKLAWEKETEMAYARKNHDWEKQFELAIDKEKARKMREEIPSKEEKACSICGDYCALLMVEELGKR

SEQ ID NO: 39666 - protein, 204 aa, Buchnera aphidicola (Chaitophorus populeti)
MLTISQILDLNWDKVNNLIPIIVQDVFSNEILMHGYANKKSLLITLKKKKLTFFSRTKNRLWTKGETSKNYLKVIDIIPDCDQDSLLALVQAIGNTCHLNNKSCFKKKKNINVSFILELERILKYYKKNNNSTSYTSNLYKKGINKISQKVGEEAVELVIAAINKDKKNMLEECADLIYHILVLFSYTNIPFIDLIKILKKRNT

SEQ ID NO: 39667 - protein, 377 aa, Methanocaldococcus jannaschii DSM 2661
MLFMKYEGEIAIGPVHPTMLEPHRLRLFIEDEIIKEAELVIGVNYRGIELIMEGLPPEKISILSEKICGICSHIHVWCNVTVTERGCDIEVPERAEYIRAIVEELERLHSHMLLFGHAFEVLGFETMAFRAFMIREPIMQILGEITGGRAQYSCPIIGGIRPRCNIKESKIPALLERLEKFEENLKKLLERTVNDPMIMSRIKDVGVLDKKTAKKLHALGPTARGSGIHSDMRKMGQVPVYDNFEFEEIVFDDGDVFSRLAVRFYECFESVKIIRQGLKDLPNLDKRIYNPNYELKEFKPIDVYNEAQRGQVYYSYGLDENGRVRQVKIRTPTATNLACMEAILPGHHVSDAELIIASCDPCFTCTDRMIVVKENKI

SEQ ID NO: 39668 - protein, 151 aa, Schizosaccharomyces pombe
AKNNPNNPLVQHRGLAGTHDVTFLNNVLNAFVKGSDEEVSIPFYDKSKFGGYGDRGDESQWKKANPKTTTYVIFEGWMVGFEPLDSCMLSVRARSTRWQNIEGSLLWVNRKLADYQPIFQKIDSLVELEAQEINYVYRWRLQQEHALKARI

SEQ ID NO: 39669 - protein, 1338 aa, Kluyveromyces lactis NRRL Y-1140
MSFLKKKSSTAGHSRSGSASSILNKHVDPANISEFYPSSLDHKVTSGLKNDYSFDSSSKGSRKSSGGSTNSLTSERLLFNWDVTDPSQWTMPRIIQWFRANDFNDQWITFFKRNSISGNKFLKLLAYDNFAPYEKSLQQSKSSSYERFQYLLKKTLEENVVKGNNRNGNRIINNSRSSSESAKVSQRLSTSFSTHIRSTSESALLNIENITKDSSSSEPTTSKKQEASNYSLPLRQAKTNSASALYRRSLISLRNASSTKDNASKNDIKITIPPRPLSTTENTNKSPTTPSSVSPSHTAYTGIFRRQHKTSSSESSLFTSIFGHGVVEEPEETPKPRPVENRRIPAASTVNASTSKQSINVDDKARLWDKIKRKGQLPAEPSSQPAARIIIEEVKESPKAEPPEIVIPEEIYPKRPSDSRELFIMLTKDNSTFSPFNVQPHLGTDVSELKKAVALALGLTHSNFSIHLTDFGAEFGSQIPDGLLADFQKTSFQNIPNKLYIQDLEKKANLNPRPRTETLASQHSTAASTKSKTSVKSNASAASNGEGSSSDLTSIDDQGSSHRRAYPQTPSHYYDNSTSAETDYWSFKDSVPETISDAPHITLPKSRPSLKLNSSVLNTHASEKSTFRIIRQTSDTDIDFNKRRESPYVRVAELAPKRKAPKPPVNGNPVTSGSLPSAAAKNVSESPLESPPKLDRNGKTIYQKNKPRPPPPLTTELGSRRSVSSLSGQDLNEVKESPVQSFTPASTQVMVPQPYKGALETLKPRKSSADLSIRPRMSLRQFSRSNSSLNRKVLSTSRQTLNRTNSKPLVTSSTAADIFDENDISFADAPELSDSDDYSASSDEIIWSRDRKSISNDVPEFSFNTEDTIDLVGTDTTQVSVGATEGSDTPKKMALRPSPDVVYQNLEKFFPDADLDNPILEGLTPPPSPNADSSPPSPRGFEKSLKTKSEQQPAFLSSRGESSQFLTPVKSLKPPKRTKTIRIIAQEASEARKNEVSQKLQRKNTKMWGTKVVEITDKRTISINKSRNSRGEYKEFAWIKGEIIGKGSFGAVYLALNVTTGEMLAVKQVTVPEFSSQDESAISMVEALKSEVSTLKDLNHVNIVQYLGFEEKNGIYSLFLEYVAGGSVGSLIRMYGRFDDQLIRHLTKQVLEGLAYLHSKGILHRDMKADNLLLDNDGVCKISDFGISRKSNNIYSNSDMTMRGTVFWMAPEMVDTAHGYSAKVDIWSLGCVVLEMFAGKRPWSNFEVVAAMFQIGKSKTAPPIPDDTKDLVSPAGQSFLDQCFEIDPEMRPTADSLVGHPFCKTSSSFDFPKTKLAQFIKSNDKLNSSRLRISSQEL

SEQ ID NO: 39670 - protein, 207 aa, Coprinopsis cinerea okayama7#130
MSSHNEDGNSIVNDLNGMNFSNLYGAIDRQNVHGLNLTTPEDAKAIIKPWAEREDDTIWAESNVDDQLIIHIPFMENLRHLSDGTAGRGESTPRHLRVFANHSTIVDFAAAEATKPHLNISLQEGETSVVEYPLRAAAFSSVHSLSLFFNEAVGEEVSRIYYIGFKGDMRSVKREVASELEVPAPHTADAPLSQKAENRAAHRPTAH

SEQ ID NO: 39671 - protein, 543 aa, Oryza sativa (japonica cultivar-group)
MASAAEAVEELTRLYRELPPRPAVEEVEAAEAVLASADAEEAARLDEVAREEASASASSSAAAPGRADGELLAVLREARRNAVRLRALQQRKEAAYVVELERRFKVFDDLIQRASRVVSSSSDAAEAGGGTTGDGYVGVGADSVDLEMELRKKEAAVAAAAAVAEMERGSKGLAALGLESKPISSLRRDVSAGTDMEKLSLIQVASLIESSAKKGITELSLRGKLVDQIEWLPVSLGKLQDVTELDLSENRIMALPSTIGSLRYLTKLDLHSNQLINLPDAFGELSNLIDLDLHANQLKSLPSSFGNLTSLANLDLSSNMLKALPDCLGKLANLRRLIVETNELEELPYTIGSCTSLVELRLDFNQLKALPEAIGKLEKLEILTLHYNRIKGLPTTVGSLSRLRELDVSFNEVEVIPENICFATSLVKLNLSRNFADLRALPKSIGNLEMLEELDISSNQIRVLPDSFRCLSRLRVFHADETPLEFPPREVVKLGAQAVVKYMNDLNAARGTNQKKTDRGSFWTWLFSLFGCCKKNQEVGLPV

SEQ ID NO: 39672 - protein, 379 aa, Glycine max
MSTAGQVIKCRAAVAWEAGKPLSIETIEVAPPQKGEVRLRILFNSLCRSDVYWWDAKDQTPLFPRILGHEASGIVESVGEGVTHLKPGDHALPIFTGECGECTYCKSEESNLCELLRINTDRGVMLSDGKTRFSKNGQPIYHFVGTSTFSEYTVLHEGCVAKINPNAPLDKVAIVSCGFCTGFGATVNVAKPKPNNTVAVFGLGAVGLAACEGARVSGASRIIGVDLLPNRFEQAKKFGVTDFVNPKDHNKPVQEVIAEMTNGGVDRAIECTGSIQASISAFECTHDGWGTAVLVGVPKKDVEFKTNPMKFMEGRTLKGTFYGHYRPRTDIPGVVEKYLNKELELDKFITHSVPFSKINTAFDLMLKGEGIRCLICMEE

SEQ ID NO: 39673 - protein, 556 aa, Streptomyces avermitilis MA-4680
MQHERAGTSAGPEDLIDVAKLVTAYYALHPDPAEPGQRVAFGTSGHRGSSLATAFNEDHIAATSQAICEYRDSQGTNGPLFLGADTHALSEPARVTALEVFAANGVTVLIDSDDGYTPTPAVSHAILTYNRGRASGLADGVVVTPSHNPPADGGFKYNPPSGGPAGSEATSWIQDRANEIITGGLKDVRRVPYTQALAAPGTGRYDFLGTYVADLPSVLDLDAIRAAGVRIGADPLGGASVAYWGRIAEQHGLDLTVVNPLTDPTWRFMTLDWDGKIRMDCSSPYAMASLIEQRDRYRIATGNDADADRHGIVTPDAGLMNPNHYLATAISYLYSHRERWPAGAGVGKTLVSSGMIDRVAADLGRRLVEVPVGFKWFVDGLADGSLGFGGEESAGASFLRRDGSVWTTDKDGILLALLASEITAVTDKTPSEHYAALTARFGEPAYARIDAPASREEKALLAKLSPAQVGADTLAGEPVTAVLTRAPGNDAPIGGIKVTTDNAWFAARPSGTEDVYKIYAESFLGPDHLSQVQQEAKLVVDAALGADAPGAGSDMA

SEQ ID NO: 39674 - protein, 358 aa, Candida glabrata CBS 138
MLQFRTPLTRLTPMARLATRSAVRMASTKTMTVREALNSALAEELDRDDDVFIIGEEVAQYNGAYKVTKGLLDRFGERRVVDTPITEYGFAGLAVGAALKGLKPIVEFMSFNFSMQAIDHVVNSAAKTHYMSGGTQKCQIVFRGPNGSAVGVAAQHSQDYSAWYGSIPGLKVLVPYSAEDARGLLKAAIRDPNPVVFLENELLYGEQFEVSEEALSPDFTLPYTAKVEKEGKDISIITYTRNTEFSLAAAKILEEKYGVSAEVINLRSIRPLDIDAIVKTVKKTNHLITVESTFPSFGVGAEIIAQVMESEAFDYLDAPIQRVTGADVPTPYAKELEDFAFPDPETIVRAAKEVLSIE

SEQ ID NO: 39675 - protein, 129 aa, Brassica napus
MASEKEAALSATPSDAPTIFDKIISKEIPSTVVYEDDKVLAFRDITPQGPVHILLIPKVRDGLTGLSKAEERHIDILGRLLYTAKLVAKQEGLDEGFRIVINDGPQGCQSVYHIHVHLIGGRQMNWPPG

SEQ ID NO: 39676 - protein, 119 aa, Coccidioides immitis RS
MTQDLSGSAILGTLLISRERKLNWDEINMTLKELVTGDASQPTAATREEMSNARLPIAFRDSCAHLLIPLNRCRVQEYYLPWKCENERHSYEKCQYEEFKKRVAKMDELRAAKGGARSN

SEQ ID NO: 39677 - protein, 255 aa, Bacillus anthracis str. Ames
MKKKLGLLAMVVALMAITAGCSEVNQPITPKSTGIWNEYFVYPLSQLITYFANLFGSNYGLAIVVTTLIIRFALLPLMIKQTKSTKAMQALQPEMVKLKEKYSSKDQATQQKLQQEMMQLYQKNGVNPLAGCLPIFVQMPILFAFYHAIMRTSEISKHTFLWFDLGQADPYYILPVVAAITTFIQQKLAMAGTAGQNPQMAMMLWLMPIMILIFAINFPAALSLYWVVGNIFGIAQMYLIKGPEIKASKAGGSSK

SEQ ID NO: 39678 - protein, 108 aa, Arabidopsis thaliana
MAPELIGGGLVDFAVDIWAFGCSVLEMLTGKTVWGEHGDLVHDDWVDLIGHSDLTPQISTRLSAEAQDFLMRCLVKEPGSRWSIGELVDHLFLCSDVEFSHNGFVYDG

SEQ ID NO: 39679 - protein, 419 aa, Mycobacterium sp. JLS
MSPAQQREFDIVVYGATGFVGKLTAEYLADHGAGARIALAGRSQDKLLEVRESLGPKATDWELITADASQPSTLNAMAARARVVITTVGPYTKYGLPLVAACAAAGTDYADLTGETMFVRDSIDHYHKQAVDTGARIVHACGFDSIPSDLTVYALHRKVAADGEGELGDTSMVVRTLAGGASGGTIASILEVLNTASTDPEARREMTDPYTLSPDRSAEPELGAQPDMRWRRGAEIAPELSGYWTAAFAMAGPNTRIVRRSNALLGYAYGRRLEYSEVMSTGRTPVAPAVAALTTAGSAAVMGLGSRYFNRLPRKLVDRVLPAPGTGPSEQTRERGHYTVETYTTTTTGARYLARMSQRGDPGYKATSVLLGECGLALALDRDKLSDLRGVLTPAAAMGDALLARFPGAGVSLETSRLA

SEQ ID NO: 39680 - protein, 481 aa, Oryza sativa (japonica cultivar-group)
MGVPSAPAPDAHRRGVFLLSVGAGGGGAGTAVVEVEVEHPHSLSLSPPPMSSCGRYILHRVCRFDTLAGVAIKYGVEVADVKRVNGLTTDLQMFAHKTLRIPLPGRHPPAATATATAPSHPPPSSSPAATHRPREWATRRPPKNSALDPLLKPPQSTVAPSMDLLQNYYGLARPPKGDPENEGTEMATYSIGQHTKARSLSTGFSLVNGEVDDAEKPIRRRQKSDAEFSTREGNSGGVLMKAGPGLALRPKSGSRPEINNSQQDLVATAVPSYGDGLQAKNKEKRLLRECLEHYNALHPGSEFQLAAGKVIRHEGCAEHDHISIGDHGNFLARRKRTGCFSFLPGGPRTLFFYELDHFDGVVTCIPLDDEPVDEGYSFLCFCLGWDKRRSGIFDCVCKTCGHHVPVPYPFPKKKTYACGHGIGEVRPLCRICYSLSPFVHPSPGKFKVWHQRDCKIQRFGPSMSYGDPYLYGPWERVTAWR

SEQ ID NO: 39681 - protein, 99 aa, Brassica napus
GKKRKHSETESAAPPKKDDSAPERPKRTLLGWKDKAQDAEETKPAPGFRNKEKVLVTCSRRISFRYRHLMLNMVSLLPHCKKDSKVEAKSSKGATLNEL

SEQ ID NO: 39682 - protein, 163 aa, Treponema pallidum subsp. pallidum str. Nichols
MDGGYFLGQLHAVFSGEVFLSATCSWLASQVIKVAIACRRSAIRSVHGFFDFAVWRTGGMPSSHSALVSALTLSFALKCGLHSDLFIFSFFSAIIVVRDALGVRRSSGLQAEALNSLGARVSEKLDFSFRPVREIHGHKPLEVVVGVAVGIVTSALFYSSMSP

SEQ ID NO: 39683 - protein, 318 aa, Triticum aestivum
  misc_feature (154)..(154): Xaa can be any naturally occurring amino acid
MVGRMERQTVSTSSASCSPSAASSSSSSCGGRKRPDILNMIRSAACLNSSSTDTGKGRSKQSSTKVTHGFHLVEGKSGHDMEDYHVAEYKCDKNHELGLFAIFDGHLGDRVPSYLRANLFSNILKEPLFWTDPQEAIKNAYGSTNKYILENAKXLGPGGSTAVTAIVVDGKDMWIANVGDSRAVLCERGAANQITVDHEPHISNERQRIEQQGGFVTTFPGDVPRVNGQLAVARAFGDHSLKTHLSSEPDIRHVPINSSIEFVILASDGLWKVMKNQEAVDLVKSTKDPQAAAKRLTTEALARKSKDDISCIVIRFRC

SEQ ID NO: 39684 - protein, 259 aa, Datura stramonium
AGRWNLEGCTALVTGGSRGIGYGIVEELASLGASVYTCSRNQKELNDCLTQWRSKGFKVEASVCDLSSRSERQELMNTVANHFHGKLNILVNNAGIVIYKEAKDYTVEDYSLIMSINFEAAYHLSVLAHPFLKASERGNVVFISSVSGALAVPYEAVYGATKGAMDQLTRCLAFEWAKDNIRVNGVGPGVIATSLVEMTIQDPEQKENLNKLIDRCALRRMGEPKELAAMVAFLCFPAASYVTGQIIYVDGGLMANCGF

SEQ ID NO: 39685 - protein, 235 aa, Mycobacterium avium 104
MSSPDQDPREAIAQGDDEVIDVRRGMFGAAGTGDTSGYGRLVRTVTLPGSSPRPYGSYFDDVVDTLTESLQSNGIEFHQAIEKVVVYRDELTLHVDRAALPHVAQHLRDDPRLRFEMCLGVSGVHYPHETGRELHAVYPLQSITHNRRVRLEVAVPDGDPHIPSLYRIYPTTDWHERETYDFFGIIFDGHPSLTRIEMPDDWHGHPQRKDYPLGGIPVEYKGAQIPPPDERRAYN

SEQ ID NO: 39686 - protein, 275 aa, Triticum aestivum
  misc_feature (140)..(140): Xaa can be any naturally occurring amino acid
  misc_feature (173)..(173): Xaa can be any naturally occurring amino acid
  misc_feature (189)..(189): Xaa can be any naturally occurring amino acid
  misc_feature (243)..(243): Xaa can be any naturally occurring amino acid
  misc_feature (265)..(265): Xaa can be any naturally occurring amino acid
MEDERSTQSYQGGEAAEQVEVTDRGLLGNLLGKKKAEEDKEKKEEELVTGMEKVSVEEPEVKKEEHVDGEKKETLFSKLHRSSSSSSSSSDEEEEEVIDDNGEVIKRKKKKGLKEKLQEKLPGHKDTEGEHVTALPAPAXAPASVQTHHDTDVVVEKIDGDVKTEATPAVPEXEEKKGFLEKIKEKLPXAGHKKPEDAAGGGPSRTLAPAPGHARCSSTGATRRAPAAEEVSSPDAKEKKGLXLGKIMDKLPGYHKTGEEDKAAXAATGEHKPSA

SEQ ID NO: 39687 - protein, 255 aa, Mycobacterium tuberculosis H37Rv
MSVLDLFDLHGKRALITGASTGIGKRVALAYVEAGAQVAIAARHLDALEKLADEIGTSGGKVVPVCCDVSQHQQVTSMLDQVTAELGGIDIAVCNAGIITVTPMLDMPLEEFQRLQNTNVTGVFLTAQAAAKAMVKQGQGGVIINTASMSGHIINVPQQVSHYCASKAAVIHLTKAMAVELAPHKIRVNSVSPGYILTELVEPYTEYQPLWEPKIPLGRLGRPEELAGLYLYLASEASSYMTGSDIVIDGGYTCP

SEQ ID NO: 39688 - protein, 153 aa, Streptococcus dysgalactiae subsp. equisimilis
PMAYVLWNHFMNINPKTSRNWSNRDRFILSAGHGSAMLYSLLHLAGYDLSVEDLKNFRQWGSKTPGHPEVNHTDGVEATTGPLGQGIANAVGMAMAEAHLAAKFNKPGFDIVDHYTFALNGDGDLMEGVSQEAASMAGHLKLGKLFLLYDSND

SEQ ID NO: 39689 - protein, 504 aa, Zea mays
MLPSFVSPTASAAASVTPPPRPIPGSYGPPVLGPLRDRLDYFWFQSQDEFFRKRAAAHRSTVFRTNIPPTFPFFVGVDPRVVAIVDAAAFTALFDPDLVDKRDILIGPYNPGAGFTGGTRVGVYLDTQEEEHARVKTFAMDLLHRSARTWSADFRASVGAMLDAVDAEFGKDDGSDKKPSASYLVPLQQCIFRFLCKAFVGADPSADWLVDNFGFTILDIWLALQILPTQKIGLVQPLEELLIHSFPLPSFLIWPGYYVLYRFIEKHGAEAVAYAEAQHGIGKKDAINNMLFVLGFNAFGGFSVFLPFLVAKVGGAPALRERLRDEVRRAMVGKGKDGEFGFATVREDMPLVRSTVYEMLRMQPPVPLQFGRARRDFVLRSHGGAAYQVSAGEVLCGYQPLAMRDPEVFERPEEFVPERFLGDEGARLLQHLFWSNGPETAQPGPGNKQCAAKEVVVDTACMLLAELFRRYDDFEVEGTSFTKLVKRQASPSVAQAAAAAGAQQ

SEQ ID NO: 39690 - protein, 391 aa, Gloeobacter violaceus PCC 7421
MRLATRLEKLQSNVFSLMDEAKARARRAGLEVVDLSLGSSDLSPPAHALERIRESILDPTSHGYLLFQGTRSFREACAAWYERRYGLALDPETEILPLIGSQEGTAHIPLAVLDPGDVALLTDPGYPSHEGGVHLAGGQIYPLALRPETGYLPQLEQIPEEVLERSRLLVLSYPHNPTAATATLAYFERAVAFCRAHDIVLVHDFPYADFHLSGEQPPSILQADRERAVAIEFFSLSKSFHMGGFRIGFAVGNRDLVAALRQVKASIDFNQYRGILDGAEAALRGPQDYVREAVAVFRARRDRAVAALAQAGWQVPAPEATMYLWAALPECWRGSSAEFCIRLVEQTGVALAPGSGFGSSGEGYVRFALVRSEDMLERAIAQIAGFLQRSC

SEQ ID NO: 39691 - protein, 308 aa, Candidatus Desulfococcus oleovorans Hxd3
MVVAIGEVLFDVFPEDKRIGGAPFNFAVHLANMGFPVHFVTRVGKDANGRAILDLMHRFGLSRENVQIDPEYATGRVMVHPEADGGHRFDIVAPAAYDYLACTDQVMDLMRTPPDMVYFGTLAQRSEQSRQAMEEMFQAAPPETRFFCDINLRPGGYDRAIVDGALQQADLLKLNDAELAVIGEMFDIQGDTETMIRRLMEARGLVLVALTLGSRGGRLFTPDDHVRIDLPSRSAGPPVVDTVGAGDAFAAVTAAGFLQNRHLSTILEAATEFAGRICGIQGAVPDSPDFYRQGRLPEFFYKDTGESR

SEQ ID NO: 39692 - protein, 436 aa, Acidobacteria bacterium Ellin345
MSDTIRKYQEYVITSFVKAVQPVVIESASGAIIKDISGREFIDCFAGISVVNAGHCNPKINAAAKAQIDKLVHCGSYIYHSQPTAQLAEKMAKITPGRLKKSFFANSGAEAIEGAMKVARLFTGKHEIISLQQSFHGRTWGTLSITGNQGRKKRGGPYAPGIAFAPAPYAFRSPWPNEPEKFASYCAKQVEETIRYSTSGDVAAFIAEPVMGEGGIIVPPQNYFREVKEVLDRHGILFIADEVQSGFGRTGKMFAIEHYDVEPDILVTAKGIANGYPIAAFTTRDEIAAAFKPGDHLSTFGGNPICCAAALANIEFFEEEKLCDQSTEKGQHALTRLRALQGRQSGIGEVRGLGLMIGVELVKDDHLTPAAAEAEAVRDTCFKAGVLIGVGGTNANVLRLQPPLVITYEQLNTALDVLEGAITEVVGRTAAVAGKA

SEQ ID NO: 39693 - protein, 453 aa, Acidobacteria bacterium Ellin345
MASIVLRTKVPGPKALELASRRSAAVPRGIYASTPIYVSRAEGALIEDVDGNTFIDLAGGIGVINVGHRSPAVVEAIHRQTDRFLHTCFQVVGYESYIRLAEKLNEITPGEFPKRTFFVNSGAEAVENAVKIARYHTKRPAVICFEDAFHGRTTLGMALTSKTHPYKAGFEPFPSEIYRIPYAYCYRCSYGKKYPSCEVACADALEGVFKRTVAAESVAAIIIEPVLGEGGFVTPPSDFLRKLHGICKQHGIVFIADEVQTGFGRTGAMFACERYGVEPDILIGAKSLGGGLPIGSITGRAEIMDAPIPGGIGGTFGGSPLACEAALATIEAMQRQDLPARANALGERFRARALRWQAQWPQIGEVRGLGGMQAIELVRSAESRTPNDSATKHIIQYCYERGVITLNAGTYSNVIRILMPLVISDAQFEEALDVMESALSHEFATSRVTTGVS

SEQ ID NO: 39694 - protein, 193 aa, Cryptococcus neoformans var. neoformans JEC21
MQTIKCVVVGDGAVGKTCLLISYTTNKFPSEYVPTVFDNYAVSVTIGDDPYTLGLFDTAGQEDYDRLRPLSYPQTDVFLVCFSVTSPASFENVREKWFPEIAHHCPGVPALIVGTQVDLRDDPAQTEKLGRQRMKPITQDMGERLARELGAVKYVECSALTQRGLKNVFDEAIVAALEPPMATKKKSKKCLIL

SEQ ID NO: 39695 - protein, 493 aa, Acidobacteria bacterium Ellin345
MDTATKTSTKTYQMYIDGKFVESATGKLFPVYDPSTEEVIAECPAGNAADVDRAVAAARTAFDDGPWNATTAQERGRVLFRIAEKIRQHTAELAEIECRNSGKPIVEAEYDIADCATCFEYYGGLATKITGQVNPVPDNAVSLSLKEPIGVAGQIIPWNYPLAMAAWKLAPAIAAGCTVVIKPAEQTPLTLLELAKHFEEVGLPNGVVNVVTGYGEEAGAPIVAHKDVDKIAFTGSGSVGKLIMREASATLKRVSLELGGKSPNIFFADADFEAAIDGALFGVFINQGEVCSAGSRILVERPIYKKFVEAMTEKAKKIKLGAPLDRDTKMGPLVSKDQYERVREYQEIGKKEAKVASGGNRPSGFAKGYYVEPTIFYDVDNSARIAREEIFGPVASVIPFDNEADGLKIANDTPFGLAAAVWTRDIFKAFRMVKKIRAGIVWVNHMQPTYYEAPWGGYKQSGFGRELGPWGVEEYLETKQVHINLSEQPIGWY

SEQ ID NO: 39696 - protein, 435 aa, Magnaporthe grisea 70-15
MTVLPLEPEFSQAYNELAGTLEDSTLFEKYPELRTALSVVSIPERVIQFRVVWEDDSGALRVNRGYRVQFSSALGPYKGGLRLHPSGGADFDPKGKSDAEIRRFCVAFMTELSKHIGADTDVPAGDIGVGGREIGYMFGAYRKLRNRFEGVLTGKGLDWGGSLIRPEATGYGLVYYVGHMLEYAGVGGWAGKRVAISGSGNVAQYAALKIMELGGTVVSLSDSRSALVAVEGGRTITEADVKRVMELKDRRRPLSDLLPESEEGGSTSPGGLKHLPGARPWTHVGKVDVALPCATENEVSKEEAEALVAAGCRFVAEGSNMGCEQGAIDVFEANRRSKGKGDAVWYAPGKAANCGGVAVSGLEMGQNSSRLKWSREKVDKELANIMETAFRTGLDTAKEYVNRASDDELPSLVAGSNIAGFVKVARAMQAQGDWW

SEQ ID NO: 39697 - protein, 456 aa, Acidobacteria bacterium Ellin345
MHDALRQEIELFEKRTPKSAEAHKRNLKRLPLGVASNYRAYDPYPIFVKDAFGSKFRDLDGNEYIDHNLTFGALMAGHCHPAVMKAVEKRLTTGTMFGMPHDMEWELAEEICARFPIEMLRFASTGTEATMHTVRLCRAATGRDKIIKFEGGYHGLHDAALVSVKPKLEQIGDLKAPIAVPGGQGVPKTAVANVLIASFNDLESVEHRFKTHPNEISAIILEPVMMNVGICMPEPGFLEGLRELCDKHGALLIFDEVKTGAKLGWGGASEYFGVIPDAICLAKSIGGGLPLAAFGASKKVMGLISDHKVFHGGTYNTNPVSMAAGLATFREVLTRENYAHVEKLSHKLVTGYRRVVEEVGLDAYLEIAGANGVLMFAPKRVRNYRDWLEVDASLWQQYWFAMVNRGVMPQPYWWDEQWTMSVAHTDADTEKHLAVFGEIAPALAVAQKEPREAVVH

SEQ ID NO: 39698 - protein, 107 aa, Triticum aestivum
MAKLMCLCFIILAIAVAVSADECEGDRRAMIKECAKYQQWPANPKLDPSDACCAVWQKANIPCLCAGVTKEKEKIYCMEKVAYVANFCKKPFPHGYKCGSYTFPPLA

SEQ ID NO: 39699 - protein, 341 aa, Arabidopsis thaliana
MDNSAPDSLSRSETAVTYDSPYPLYAMAFSSLRSSSGHRIAVGSFLEDYNNRIDILSFDSDSMTVKPLPNLSFEHPYPPTKLMFSPPSLRRPSSGDLLASFGDFLRLWEINEDSSTVEPISVLNNSKTSEFCAPLTSFDWNDVEPKRLGTCSIDTTCTIWDIEKSVVETQLIAHDKEVHDIAWGEARVFASVSADGSVRIFDLRDKEHSTIIYESPQPDTPLLRLAWNKQDLRYMATILMDSNKVVILDIRSPTMPVAELERHQASVNAIAWAPQSCKHICSGGDDTQALIWELPTVAGPNGIDPMSVYSAGSEINQLQWSSSQPDWIGIAFANKMQLLRV

SEQ ID NO: 39700 - protein, 785 aa, Triticum aestivum
  misc_feature (200)..(200): Xaa can be any naturally occurring amino acid
LKILHPSTSPSHGATTATRAVAGSDVQTTSTATSARVQGKLLLQSSDSPNSPLRLSLQLVSATVPGSDGRGVRGEAAALDAVISSGETELDVELLWDEALGAPGAVLVTNNSDFPVYLQLLSLSSPAVHFVCNGWVYPVGTRPYRLFFTNDAYVKEKTPPALLKDREDELRLLRGEGSPADKPLQKWDRVYDYALYNDLXGNPDLREDLARPVLGGSEEYPYPRRTRTSRPPSKADPASETRASLEEGIYIPCDERTGAVAKAPNLPKLDGHFGSLADVHGLFDSNAKPIPFPVPQVISANRTAWRTDEEFARQTLAGTNPLSIELVTGLPLTSKLDRALYGDQDSKITKEHIEKNLGNMTVAQAIEKDRLYVVDHHDWVMPYLKRINELPGAEEKGEISQRKSYATRTLFFLQDDSTLKPLAIELSSPHPEDERLGATSTVYTPPDELKAGDAASDTFTAWDLAKAHAASNDACKNNYVLHWLRTHATMEPVVIAANRQLSVLHPIHKLLKPHFRNTLDTNSTARHIVIGSGDERQGGAFYRNMHEVNFFTGKYGMEMSSKAYASFNFTELAFPNELIKRGVARGDPKNAEELELLIKDYPYAVDGLEIWTAIKEWVTDYCAIYYADGDGAVAGDSELQAWWSEVRNVGHGDLRDAPWWPAMDSVGDLVETCATIIWLGSAYHSAVSFGQYAYNGFVPNRPTVTSGGDAGRRKTGVTEVESSGDHPKNQTFGLWAHHNRRLSRRAVMGDRQTGQGKTTQGGQPSRINSTWTHPGAPKKNLPPPE

SEQ ID NO: 39701 - protein, 345 aa, Arabidopsis thaliana
MAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAEC

SEQ ID NO: 39702 - protein, 691 aa, Ashbya gossypii ATCC 10895
MERNTVQRSGTMQTGGSSSASKNYSNINANLHARVKAFQEQRKLQRSGSVGSKSSGQSQDSAAIQHIVNKPLPPLPPGKGKEAAPPLRRQGSMLKADSRPRSMSSFTGSPPAVGASIADAEPVASAERPAPVLQANVGQEADSMPVQQSIPLKAAAVPGRQPHQKTHSASDIFQRTSSHVLPQIPIPLNPIRKAPRPPDAGMGHQRGRQGSHSGIVLGPQSGAGGTGSASDAPKHIMTKSKPSLSARRGLKLPSGGISLKMKQPLQEFASQPSNKDTALATSGVVPGHRVSKSNPGSLTNGIQTTSTSSDKQVDTKGTEPSKSGNSGTNSNGGLFAVFSKYVDIKSGSLNFAGKLSLSSQGVDFSNGSSFRITLDELEFLEELGHGNYGTVSKVLHKPTNIMMAMKEVRLELDESKFRQILMELEVLHKCQSPYIVDFYGAFFIEGAVYMCMEFMDGGSLDKSYDPHEIGGIEEPQLALITESVIRGLKELKDVHNIIHRDVKPTNILCSATQGTVKLCDFGVSGNLVASLARTNIGCQSYMAPERIKSLNPDKATYSVQSDIWSLGLSIVEMALGAYPYPPETYDNIFSQLSAIVDGPPPRLPKDTFSSDAQDFVRLCLQKIPERRPTYASLLEHPWLKKYRGLDVHMSEYITKRLVQRQHYLEQSGGDELPKVLPALHGRLVKPQPHIP

SEQ ID NO: 39703 - protein, 153 aa, Streptococcus dysgalactiae subsp. equisimilis
PMAYVLWNHFMNINPKTSRNWSNRDRFILSAGHGSAMLYSLLHLAGYDLSVEDLKNFRQWGSKTPGHPEVNHTDGVEATTGPLGQGIANAVGMAMAEAHLAAKFNKPGFDIVDHYTFALNGDGDLMEGVSQESASMAGHLKLGKLVLLYDSND

SEQ ID NO: 39704 - protein, 516 aa, Methanocaldococcus jannaschii DSM 2661
MMCGINGIIRFGKEVIKEEINKMNKAIKHRGPDDEGIFIYNFKNYSIGLGHVRLAILDLSEKGHQPMGYNVDEDKIIYRDDELDRADIIIVYNGEIYNYLELKEKFNLETETGTDTEVILKLYNKLGFDCVKEFNGMWAFCIFDKKKGLIFCSRDRLGVKPFYYYWDGNEFIFSSELKGILAVKEINKKENINKDAVELYFALGFIPSPYSIYKNTFKLEARQNLIFDLDKREIRKYYYWELPDYKPIYDKKKLIEEGKKLLYDAVKIRMRSDVPVGAFLSGGLDSSTVVGVMREFTDLSKLHTFSIGFEGKYDETPYIKIVVDYFKTQHHHYYFKERDFEELIDKYSWIYDEPFGDYSGFPTYKVSEMARKFVTVVLSGDGGDEVFGGYMTHLNGYRMDFIRKLPKFLRVVGSKLPVKKDLNGIANLYLLKEAFRLSLINPEEFYAESIKEDAIRPEIYKKWTIEKLRYCLNKGDNKLGEALRIFDLLFNTLCDNFLVKVDRASMLTLWKLEVHF

SEQ ID NO: 39705 - protein, 562 aa, Glycine max
MAPSTTVPNGTLPSGSVTGRLASVYSEVQKTRVDHALPLPSVLKHPFTILHGPPSSAAGNPDEIAKLFPHLFGQPSAALARSDAAQTQKKLKIGVVLSGGQAPGGHNVISGIFDYLQERAPGSTLYGFKGGPAGIMKCKYVELTSEYIYPYRNQGGFDMICSGRDKIETPEQFKQAEETAKKLDLDGLVVIGGDDSNTNACLLAENFRSKNLKTSVIGCPKTIDGDLKCKEVPTSFGFDTACKIYSEMIGNVMIDARSTGKYYHFVRLMGRAASHITLECALQTHPNITIIGEEVAAKKLTLKNVTDYIVDVVCKRAEINYNYGVILIPEGLIDFIPEVQHLIAELNEILAHDTVDEGGLWKKKLTDQSLKLFDFLPQAIQEQLMLERDPHGNVQVAKIETEKMLIQMVETELEKRKQEGKYKGEFKGQSHFFGYEGRCGLPTNFDATYCYALGYGAGALLHSGKTGLISSVGNLCAPVKEWTVGGTALTSMMDVERRHGKFKPVIKKAMVELEGAPFKKFASLRDEWALKNCYISPGPIQFSGPGSEVINHTLLLELEAQA

SEQ ID NO: 39706 - protein, 117 aa, Synechococcus sp. PCC 7002
MKKLLAIALTVLATVFAFGTPAFAADAAAGAQVFAANCAACHAGGNNAVMPTKTLKADALKTYLAGYKDGSKSLEEAVAYQVTNGQGAMPAFGGRLSDADIANVAAYIADQAENNKW

SEQ ID NO: 39707 - protein, 751 aa, Cryptococcus neoformans var. neoformans JEC21
MGPNTRPAPQAPTHYSRHRPQSITGNNAPQSRTKPRIGQYIVERTLGTGSFGKVKLATHAVTGHQVALKLINRSKITTPDMNARVKREIQYLKVLRHPHIIKLYEVITTPTDVIMVMEYAGEELFNYIVQKGKHGMTEDEARRFFQQMIGAIEYCHKHHIVHRDLKPENLFLDSRRNIKIGDFGLSNLMTDGDFLKTSCGSPNYAAPEVISGKLYSGPEIDVWSAGVIMFVLLCGKLPFDDEHIPTLFKKIENGVFHIPSHVSEPARHLLKRMLEVDPLKRCTIAEIRQMPFFQENLPRYLQPLPELADMERYPSLTMDDMTTLLLINEGQADPKKVAEDKGLVFSEDLGVIDPDIVEELLEKITTYSEGMVWEALKMPGDNQVKVAYQLVRDHRRILKDSNAYEDEDSSAMEEFMASSPPAWNADIAPPIDVQQNGADEYPDLEDVDLEIQDIPNAHFDVLDSSLPGWMTPPSSSTSAMSTPTTTHPTSAQNSANPSFSSVTSDTTASGSTAEEAARALLSPAPSSASQSVTSFSSPTPQPQPQRRLDKSMTKPKWHFGIRSRSPPMEVMLEIYRTLNVLGMQWRLKDIPLPDIGGAPPGGYSEEVELVLEDLKEKNGERPVMGRKPPSKKDAMAQEKLAQGLYHVETRARYGDVMVRMDLQLYRVDDQHYLVDFRNLGYYMVSEKDMSLPDVSRQGHSHEEGASNAGGSVPSATSATAAGAKEAGIGGVSGPFHFLEMACQLIAELASG

SEQ ID NO: 39708 - protein, 153 aa, Streptococcus dysgalactiae subsp. equisimilis
PMAYVLWNHFMNINPKTSRNWSNRDRFILSAGHGSAMLYSLLHLAGYDLSVEDLKNFRQWGSKTPGHPEVNQTDGVEATTGPLGQGIANAVGMAMAEAHLAAKFNKPGFDIVDHYTFALNGDGDLMEGVSQEAASMAGHLKLGKLVLLYDSND

SEQ ID NO: 39709 - protein, 313 aa, Gloeobacter violaceus PCC 7421
MQAVIVAGGKGTRLRPLTYRTPKPMLPIFERPFLCLLVERCRAAGIVDILMNVHYQAGQIQDYFGDGGAFGVRIRYSVEQNPLDTAGAVKLAEPYFTGAPLVVFNADILTDLDLTALVAAHRQAGAAATLALTRVLDPTAFGLVQLTDHNQVAAFREKPTAEEAARLGIDTINAGTYVLDPRIFADVPAQTPWSFERQLFPNLLAQRQKVLGFVSDTYWLDIGNPAKYWQAHLDILSGRMPLPLPAQQIAPGIWVAEGAAVDAAARLEAPCYIGGCCCVGPEAAIAPGTVLGSASLVNRPLSPGIYPPGTMVP

SEQ ID NO: 39710 - protein, 251 aa, Treponema pallidum subsp. pallidum str. Nichols
MKLVLIRHGESEWNRLNLFTGWTDVPLTPRGESEAQEGGRVLQEAGFDFDLCYTSFLKRAIRTLNFVLQALDREWLPVHKSWKLNERHYGDLQGLNKTETAQKYGEQQVRVWRRSFDVAPPPLTVGDARCPHTQASYRGVCASGRTPVLPFTESLKDTVARVVPYFEEEIKPQMISGQRVLIVAHGNSLRALMKHIESLDETQIMEVNLPTGVPLVYEFEADFTLCGKRFLGNEADVAARAQAVADQGKSN

SEQ ID NO: 39711 - protein, 363 aa, Triticum aestivum
  misc_feature (235)..(235): Xaa can be any naturally occurring amino acid
VKLPTRPRGPQLFYRERERERERERERDLRVGSPEEPSRTQPEGERSEGLAAKMAKLKELLDRSENRICADCSAPDPKWASANIGVFICVKCSGVHRSLGTHISKVLSVTLDKWTDDEIDSMVEVGGNSQANAIYEAFLPEGYRKPHPDSAQEDRQNFIKSKYELQEFLEPSLRIVSNHPSNAGKQASNSHSGSSKSEIGMVEFIGILNVKVIGGTKLAIRDVSSSDPYVVLTLXGQQKAQTSVIKGNLNPVWNEELKLSVPRKYGPLKLQVLDHDMVSKDDLMGEAEIDLQPMINAAASFGDPELLGDIQIGRWLKSGDNALTADSAVMVTGGKVKQEVSLKLQHTESGEVTVEMEWMALNI

SEQ ID NO: 39712 - protein, 539 aa, Ashbya gossypii ATCC 10895
MSRQVLHSDMRSVGTEVSAASQKKYLMEETVDIPTKPATAYITVCLLCVFVAFGGFIFGWDTGTISGFVNQTDFRRRFAQVNDEGGYYWSNARVGLIVAIFNIGCAVGGIILSRLGDMYGRRIGLMIVSLIYVVGIIIQISSNTKWYQYCIGRVISGLGVGGIAVLSPMLISETSPKHLRGTLVSCYQLMITAGILLGYCANYGTKSRYDDSRQWRIPLGLCFLWAIFMITGMAFVPESPRYLIEKDKIEEAKRSLATSNKVPVDDPAILAEVNNIQAGVELERMAGSASWGELFTVRTKILQRVIMGAMIQSLQQLTGNNYFFYYGTTIFDSVGLEDAFKTSIILGAVNFGSTFVAMYTVDRFGRRKCLLYGAAAMAVCMVIFASVGVTRLWPNGPDQPSSRPAGNAMIVFTCLYIFFFATTWAPIAYVIVSETFPLRVKAKGMAIATAANWIWGFLIAFFTPYITNAIRFYYGYVFMGCLIFAFFYIFFFVPETKGLTLEEVEEMWQEGVVPWRSESWVPSARRHAPYSSDKQAAGI

SEQ ID NO: 39713 - protein, 229 aa, Triticum aestivum
MARGLHHLLLLAALLQLLSTTSAATAGDVATGSGSEKVHVAIYYESLCPYSVRFVANHLLKAYRDGLLDAADLTLVPYGNAKVNAHGAITCQHGPEECLLNTVEACAIDAWPDVKVHLGFIYCVSDLVMKNKHREWESCFQKQGLDPRPVTECYKGERGHNLSLEYGKQTAALVPPHQFVPWVVVDGKPLYNDYGNFKAYVCKAYKGYPLLEACRSLGLEADNNVYGPL

SEQ ID NO: 39714 - protein, 546 aa, Ashbya gossypii ATCC 10895
MSAAIAQPDNRSVMSTHSSTASNKPSKEENKESGLVEIPVKPASAYITVSLLCILVAFGGFIFGWDTGTISGFVNQSDYKNRFGELNESGDYYLSDNRTGLIVAIFNIGCAVGGIFLSKFADMYGRRIGLMIVTLVYVIGIVVQISSTDKWYQYCIGRVISGLGVGGIAVLSPMLISETSPKHLRGMLVSCYQLMITAGIFVGYCANYGTKAKYEDSKQWRIPLGLSFAWAILMIGGMVLVPESPRYLVEVNKYEDAKRSLARSNKVPVDDPSIQAEFDNIHAGIELERMAGSASWGELFSTKSKILQRVIMGVMIQSLQQLTGNNYFFYYGTTIFKSVGLEDSFQTSIILGAVNFGSTFVAVWAVGKFGRRRLMLAGAAAMTVCMVIFASIGVTKLWPNGEDQPSSKPAGNVMIVFTCIYIFCFATTWAPIPFVIVSETFPLRVKAKGMAIATAANWIWGFLIAFFTPKITNAIKFNYGYVFMGCLIFAFFYMFFFVPETKGLTLEEVEEMWQEGVVPWKSESWTPSYKRNAYETEEVKPEKTWA

SEQ ID NO: 39715 - protein, 535 aa, Ashbya gossypii ATCC 10895
MTVSEGMTPSKSELSGDGSNSHPIESKKDIVSVISTETKPFSAYIFACLCCFMVAFGGFIFGWDTGTISGFVKQTDFIARFGQLSPSGEYELSDDRTGLIVSIFNIGCAVGGIFLSKIGDAYGRKIGLATVTAVYVIGIVIQISASDKWYQYFVGRIISGLGVGGIAVLSPMLISETSPKHLRGSLVSCYQLMITAGIFLGYCTNYGTKTNYTDSRQWRIPLGLGFAWALLMIGGMAFVPESPRYLVEAENLPKARMSIARANKVAEDHPIVEHELNTLQTAIELEKLAGKARIVDLFNVKKKIFQRLIIGIFIQSLQQLIGNNYFFYYGTTIFNAVGMDDPFVTSIVLGIVNFGSTFFSLYTVDKFGRRKCLIWGAFAMAICMAIFASVGVTKLWPNGEDQPSSKPAGNVMIVFTCIYIFFFATTWAPIAYVIISEIYPLRVKARAMALATAANWIWGFLIAFFTPRITSAIKFCYGYVFMGCLIFAFFYIFFFVPETKGLTLEDVDEMWQEGVVPWGSESWLPRSDREVAHDA

SEQ ID NO: 39716 - protein, 1104 aa, Kineococcus radiotolerans SRS30216
MPRRTDLKSVLVIGSGPIVIGQAAEFDYSGTQACRVLRAEGLRVILVNSNPATIMTDPEMADATYVEPITPAVVEAIIAKERPDAVLATLGGQTALNTAIALYENGVLEKYGTELIGADVEAIKLGEDRQLFKGVVERCGAESARSHLCHSMEEVLAGAADLGYPVVVRPSFTMGGLGSGFAYDEADLRRIAGQGLHHSPVTEVLLEESILGWKEYELELMRDRADNVVVVCSIENFDPMGVHTGDSITVAPAMTLTDREYQRMRDIGIAVIREVGVDTGGCNIQFAVNPEDGRIIVIEMNPRVSRSSALASKATGFPIAKIAARLAVGYTLDEIPNDITSSTPASFEPTLDYVVVKVPRFAFEKFPAADPTLTTTMKSVGEAMALGRNFTEALQKALRSTEKRGATFSWAGEPGDRADLLRRAAQPTDERIGLVMQAIRAGATPEELFESTRIDPWFLDQMFLLDEIAGEVRDSDELTPELLRHAKRHGFSDAQIGELRHLPEDVVRGVRHALGIRPVYKTVDTCAAEFAASTPYHYSSYDEEDETRPREKAAIVILGSGPNRIGQGVEFDYSCVHASFALRDAGYETVMVNCNPETVSTDYDTSDRLYFEPLTLEDVLEVVHAEMRCGPVAGVIVQLGGQTPLGLAAKLEQAGVPIIGTSPQAIDLAEERGAFGQVLERAGLVAPKHGTASSFPGAKAIAAGIGYPVLVRPSYVLGGRGMQIVYDEASLEEYMRTATEVSPERPVLVDRFLDDAIEIDVDALFDGEEMYLGGIMEHIEEAGIHSGDSACVIPPPTLGNAELARVRAATEAIARGVGVRGLLNVQFALAADVLYVLEANPRASRTVPFVSKATGVALAKAAARLMAGTSIRDLRAEGLLPGRGDGGLLPADSPVSVKEAVLPFARFRTAEGVVVDSLLGPEMRSTGEVMGIDVDFPTAFGKSQTAAYGGLPTAGTAFISVADRDKRAMIFPIKRLADLGFTLVATEGTAQVLRRNGITSTVVRKHSEGTSEDGELTIVGRIGAGEIAMVVNTPSGNQARADGYEIRAAATAVGSPIITTIQELSAAVQAIEAAIVQERNGGGVNVASLQEHTARLNAAWEGRA

SEQ ID NO: 39717 - protein, 154 aa, Oryza sativa
  misc_feature (62)..(62): Xaa can be any naturally occurring amino acid
  misc_feature (82)..(82): Xaa can be any naturally occurring amino acid
MRASSLFAESVFTTSAAAGRRRCPRLAAVPVTLFFSTGRGSPAMAEEAQQPRGVKVGGIHDXPAGRENDLTTVELARFAPVXVAEHNSKANAMLELERVVKVRQQVVGGFMHYLTVEVKEPGGANKLYEAKVWERAWENFKQLQDFKPLDDATA

SEQ ID NO: 39718 - protein, 501 aa, Arabidopsis thaliana
MENGKCNGATTVKLPEIKFTKLFINGQFIDAASGKTFETIDPRNGEVIATIAEGDKEDVDLAVNAARYAFDHGPWPRMTGFERAKLINKFADLIEENIEELAKLDAVDGGKLFQLGKYADIPATAGHFRYNAGAADKIHGETLKMTRQSLFGYTLKEPIGVVGNIIPWNFPSIMFATKVAPAMAAGCTMVVKPAEQTSLSALFYAHLSKEAGIPDGVLNIVTGFGSTAGAAIASHMDVDKVSFTGSTDVGRKIMQAAAASNLKKVSLELGGKSPLLIFNDADIDKAADLALLGCFYNKGEICVASSRVFVQEGIYDKVVEKLVEKAKDWTVGDPFDSTARQGPQVDKRQFEKILSYIEHGKNEGATLLTGGKAIGDKGYFIQPTIFADVTEDMKIYQDEIFGPVMSLMKFKTVEEGIKCANNTKYGLAAGILSQDIDLINTVSRSIKAGIIWVNCYFGFDLDCPYGGYKMSGNCRESGMDALDNYLQTKSVVMPLHNSPWM

SEQ ID NO: 39719 - protein, 110 aa, Xanthobacter autotrophicus Py2
MAHQLSAGFVPIRKKGKLPHQTVRMAYALEYGEDEIEMHVDAVMPGERVLLVDDLVATGGTATGAVKLLQTCGAMVEAACFIVDLPDLGGADKLRRAGVSVRTLVSFSGH

SEQ ID NO: 39720 - protein, 628 aa, Oryza sativa (japonica cultivar-group)
MAMKSLKLPKTAVLPGFGGIARPQDVQDRSANFTCSRPRAASVTDQSTAEPAKPRQNKHTVDPSAPEFLPLPSFEECFPRSTKESREIVHEESGHVLKIPFRRIHLTGDEKHFDTYDTSGPQNISPRIGLPKIRKEWIDRREKLGGPRYTQMYYAKQGIITEEMLYCATRENLSPEFVRSEVARGRAIIPSNKRHLELEPMIVGRNFLVKVNANIGNSAVVSSIEEEVHKLQWATMWGADTVMDLSTGRHIHETREWILRNSSVPIGTVPIYQALEKVNGIAENLSWEVFRDTLIEQAEQGVDYFTIHAGVLLRYIPLTAKRMTGIVSRGGSIHAKWCLTYHKENFAYEHWDEILDICNQYDVALSIGDGLRPGSIYDANDSAQFAELLTQGELTRRAWAKDVQVMNEGPGHIPMHKIPENMEKQLEWCNEAPFYTLGPLTTDIAPGYDHITSAIGAANIGALGTALLCYVTPKEHLGLPNRDDVKTGVISYKISAHAADLAKGHPYAQAWDDTLSKARFEFRWLDQFALSLDPVTAMSFHDETLPSEGAKVAHFCSMCGPKFCSMKITEDIRKYADEHGYGTVEEAVIQGMNAMSAEFSAARKTISGEQHGEAGGEIYVPESYTARK

SEQ ID NO: 39721 - protein, 399 aa, Triticum aestivum
MLTCIACSRQLGGGVPPLHEPPEDEDVVDAGAGVGGAATPSTRQAIKALTAQIKDMALKASGAYRHCKPCAGSSAGASGRHHPYHHRGGSGFRGSDASDRFHYAYRRAAGGGSSGEATPSMSARTDFPAGDEEEEEEEDGMSSGGGGGGKEDNAKEWVAQVEPGVLITFVSLPQGGNDLKRIRFSREMFNKWQAQRWWAENYDKVMELYNVQRFNHQSVPLPTTPKSEDESSKEDSPVTPPLDKERVPRSLQRPTSGGGAMGYSSSDSLEHHSNHYSNGLHHHHGHQCYDSVGLASTPKLSSISGAKTETSSMDASMRTSSSPEEVDRSGELSVSISNASDQEREWVEEDQPGVYITIRALPGGIRELRRVRFSREKFSEMHARLWWEENRARIHEQYL

SEQ ID NO: 39722 - protein, 304 aa, Prochlorococcus marinus str. MIT 9312
MHEFLPYAWFEGKCIPFKEAKISIATHALHYGTAAFGGMRAIPNPTNKEEFLLFRTDKHIKRLSQSAKLLLTEISEEYIFKALEEVIKRNKPEKPIYIRPFVYTSDLGIAPRLHNIETDFFIYCIELGDYLSPDGVSCRMSSWTRQEDRSLPLRGKISGAYITSSLAKTEASLSGFDEALLLNSSGKVSEASGMNLFIVRNGDLITPGVDQDILEGITRASVIELAKSFGINVIERPVDKTELLIADEVFLTGTAAKITPVKKIESTELNVERPIMNKLKSKLIEITEGRSQDYDNWVTRISLI

SEQ ID NO: 39723 - protein, 129 aa, Glycine max
MELARPASSRRKLKDLLLQSDNRLCADCNAPDPKWASANIGVFICLKCCGVHRSLGTHISKVLSVTLDDWSEDEIDAMMEVGGNASANSIYEAYIPEGYTKPGPDAGHEQRSKFIRSKYELQEFLKPSL

SEQ ID NO: 39724 - protein, 288 aa, Shigella flexneri 2a str. 301
MDVTAKYELIGLMAYPIRHSLSPEMQNKALEKAGLPFTYMAFEVDNDSFPGAIEGLKALKMRGTGVSMPNKQLACEYVDELTPAAKLVGAINTIVNDDGYLRGYNTDGTGHIRAIKESGFDIKGKTMVLLGAGGASTAIGAQGAIEGLKEIKLFNRRDEFFDKALAFAQRVNENTDCVVTDTDLADQQAFAEALASADILTNGTKVGMKPFENESLVNDISLLHPGLLVTECVYNPHMTKLLQQAQQAGCKTIDGYGMLLWQGAEQFTLWTGKDFPLEYVKQVMGFGA

SEQ ID NO: 39725 - protein, 252 aa, Shigella flexneri 2a str. 301
MKTVTVKDLVIGAGAPKIIVSLMAKDIARVKSEALAYREADFDILEWRVDHFADLSNVESVMAAAKILRETMPEKPLLFTFRSAKEGGEQAISTEAYIALNRAAIDSGLVDMIDLELFTGDDQVKETVAYAHAHDVKVVMSNHDFHKTPEAEEIIARLRKMQSFDADIPKIALMPQSTSDVLTLLAATLEMQEQYADRPIITMSMAKTGVISRLVGEVFGSAATFGAVKKASAPGQISVNDLRTVLTILHQA

SEQ ID NO: 39726 - protein, 292 aa, Magnaporthe grisea 70-15
MFNLRRLFVAAALFLGVMLSFTQTVAAVRGPKITHKVFFDMEHDGEPMGRIVMGLYGKTVPKTVENFRALATGEKGFGYKDSTFHRVIKDFMIQGGDFTKHDGTGGKSIYGDRFPDENFKLKHTKRGVLSMANAGQDTNGSQFFITTATTSWLDGRHVVFGEVLEGYDIVQKIEGVDKSPSDKPIKTVKIANSGELPVPEEAIYGFAEWASGVNDEPVDTPSPVADAKITHADKPATGAAATNEKIAESNEWSALQNAVFFGIIVGCIALYVRWTRTRDSKHRGLGYEKTLA

SEQ ID NO: 39727 - protein, 384 aa, Coprinopsis cinerea okayama7#130
MSQPGPAQAQAQAKKHGHAASVAQPAPRKVRFNVGTQYQVLDVVGEGAYGIVCSAVHRPSGRKVAIKKIAPFEHSMFCLRTLRELKLLKFLSEAGVSENIISILDIIKPPSLEAFKEVYLIQELMETDMHRVIRTQDLSDDHAQYFIYQTLRALKALHSADVIHRDLKPSNLLLNANCDLKVCDFGLARSVKTAEPSGTETGFMTEYVATRWYRAPEIMLTFKQYTKAIDVWSVGCILAEMLSGKPLFPGRDYHHQLTLILDVLGTPTLDEFYAITTRRSRDYIRALPFRKRKPFSQLFPNANPLAVDFLTRTLTFDPKKRITVEDALAHPYLEAYHDPDDEPVAPPLDPEFFEFDLHKDDISREQLKELLYEEIMSFKPAPIT

SEQ ID NO: 39728 - protein, 444 aa, Hibiscus cannabinus
NWLQVGDDLNHRNLTDLTKKFGDIFLLRMGQRNLVVVSSPELAKEVLHTQGVEFGSRTRNVVFDIFTGKGQDMVFTVYGEHWRKMRRIMTVPFFTNKVVQQYRHGWEAEAASVVEDVRKNPEAATNGIVLRRRLQLMMYNNMYRIMFDRRFESEDDPLFVKLKALNGERSRLAQSFEYNYGDFIPILRPFLRGYLKLCKEVKEMRLQLFKDYFLEERKKLASTTRSDNNALKCAIDHILDAQQKGEINEDNVLYIVENINVAAIETTLWSIEWGIAELVNHPRIQQKLRDEIDTVLGPGVQVTEPDTHKLPYLQAVVKETLRLRMAIPLLVPHMNLHDAKLAGYDIPAESKILVNAWWLANNPAHWKNPEEFRPERFFEEESKVEANGNDFRYLPFGVGRRSCPGIILALPILGITLGRMVQNFELLPPNGQSKIDTTEKGGQF

SEQ ID NO: 39729 - protein, 497 aa, Ashbya gossypii ATCC 10895
MSELFEEINVPETGFTYLQPLGLFIDNEFVAPMGGSQLQTTNPANGELIATFYAAGAADVDAAVAAARRAYEERWRHTSAQERGALLARLAELVDEEREVLAGIETLDSGKPYHTNALADLDQVAYVTRYYAGGADKMHQGDAFALSHTKQAYTLEVPYGVVAQIVPWNYPLAMASWKAQGCLAAGNCVVIKPSENTSLSLLYFASLVRRAGFPPGVFNVLPGLGPEVGQRLAEHKGVDKIAFTGSTAVGQKVMAAAAMSNLKDVTLECGGKSPAVIFADADLDSAVNYVAAGIFYNSGQNCTANSRIYVQEAVYDAFLDKFRAHVRSTYSFGSGLFSKDCNMGPVISKTQYDRVMGYINHGINEKLAYEQFGSVPEKGYYIPPTIFLDVPQSSRLCREEIFGPVAVVAKFKDYDEAIRYANDTNYGLASCVFTENIRVAHRFVRDVQSGTVWVNSSNDEEVGVPFGGFKMSGIGRELGKAGLQTYLQTKAVHLNFA

SEQ ID NO: 39730 - protein, 741 aa, Arabidopsis thaliana
MASTSSLALSQALLARAISHHGSDQRGSLPAFSGLKSTGSRASASSRRRIAQSMTKNRSLRPLVRAAAVETVEPTTDSSIVDKSVNSIRFLAIDAVEKAKSGHPGLPMGCAPMAHILYDEVMRYNPKNPYWFNRDRFVLSAGHGCMLLYALLHLAGYDSVQEEDLKQFRQWGSKTPGHPENFETPGIEVTTGPLGQGIANAVGLALAEKHLAARFNKPDAEVVDHYTYAILGDGCQMEGISNEACSLAGHWGLGKLIAFYDDNHISIDGDTEIAFTENVDQRFEALGWHVIWVKNGNTGYDEIRAAIKEAKTVTDKPTLIKVTTTIGYGSPNKANSYSVHGAALGEKEVEATRNNLGWPYEPFQVPDDVKSHWSRHTPEGATLESDWSAKFAAYEKKYPEEASELKSIITGELPAGWEKALPTYTPESPGDATRNLSQQCLNALAKVVPGFLGGSADLASSNMTLLKAFGDFQKATPEERNVRFGVREHGMGAICNGIALHSPGLIPYCATFFVFTDYMRGAMRISALSEAGVIYVMTHDSIGLGEDGPTHQPIEHIASFRAMPNTLMFRPADGNETAGAYKIAVTKRKTPSILALSRQKLPHLPGTSIEGVEKGGYTISDDSSGNKPDVILIGTGSELEIAAQAAEVLRKDGKTVRVVSFVCWELFDEQSDEYKESVLPSDVSARVSIEAASTFGWGKIVGGKGKSIGINSFGASAPAPLLYKEFGITVEAVVDAAKSFF

SEQ ID NO: 39731 - protein, 341 aa, Triticum aestivum
MSSSSSTPAFPPQEGDAETNEELYGQFTELASSWPCSGGLSRAKLLYRHEKGWYSTLPPMVGAMVADARFAARPSDIVVATMPKSGTTWMKALLYSTVHRREHTPGGPGHPFNSLGPHDCVRHLEYQLYTRNRVPDLDGLPDPRLLATHVPLASLPRSVAASGCRIVYVCRDPKDTLVSTWTFVNKFRAEDGLEPISVETAADYFCDGVSASGPYWDHVLGYWRAHLANPERVLFFRYEEMSRDPAAHVRRLAEFVGRPFSAEEEEDGAVDAVVKLCSFEHMTGLEATKSGKTELVLGAVENSSFFRRGLVGDWENHLSPETARRIDAITEAKFRGFGLSV

SEQ ID NO: 39732 - protein, 363 aa, Glycine max
MTQQNVVVSDTKSGVSLTVFSTTQKPPAAPGGYISIPRRRVLKNLEINGGQRINAWVESMRASSPTHHKSTPSLSQEHNSWILHHPSALDMFDQIIDASKGKQIVMFLDYDGTLSPIVDDPDRAFMSDSMRKTVRKLARCFPTAIVTGRCKDKVYNFVRLAELYYAGSHGMDIKGPTRSSKYNKDSKAEAILCQPASDFLPMIDEVYQQLVEKTKSTPGALVENNKFCLSVHFRCVDEKKWSELARQVKSVLKEYPKLRLTQGRKVLEIRPTIKWDKGKALEFLLESLGLANCSDVFPVYIGDDRSDEDAFKKLRDKGQGFGILVSKFPKDTSASYSLQEPNEVMNFLQRLVEWKHVSLRARS

SEQ ID NO: 39733 - protein, 511 aa, Prochlorococcus marinus str. MIT 9312
MTFVITTPLYYVNDKPHLGSVYTTIICDSIARYKRLVGEDVIFITGVDEHGLKIQRTANEKGIEPKSHCDEISEVFNINWKNWNISFDKFIRTSSKNHEFVVNEFYERVKSSDDIYMGVQKGWYCVGCEEFKDNPENSSTYKCPIHQKNLEWKNEENLFFRLSKYQKEIEKIINEPSFIEPIERKNEIINFVSRGLKDFSISRTNVSWGIPVPGYDNHTFYVWFDALLGYVSAISSDTSDNSLERSINGGWPADVHLIGKDILRFHAVYWPAMLISANMKVPKKVFGHGFLTREGQKMGKSLGNVLDPDLLLSKYGNDPVRWYLIKDISLGNDGDFQHKRFVDIINNDLANTIGNLLNRTSSMSRKWFGNKVPNNENIINENKLENYAKISVKNYIHNFDIYKLDLAANEVLSLAINTNLYLNDNQPWMLIKEIDNLPLVKEIIYNVLESTRIIGLLLIPILPELSTKINEQLGSIYRKEIPWKQQLKWGLLVSNSSLPKPSPIINKLEYE

SEQ ID NO: 39734 - protein, 221 aa, Hordeum vulgare subsp. vulgare
MDTVAAWPQFEGQDYMTVWPEEQEYRTVWSEPPKRRAGRIKLQETRHPVYRGVRRRGKVGQWVCELRVPVSRGYSRLWLGTFANPEMAARAHDSAALALSGHDACLNFADSAWRMMPVHATGSFRLAPAQEIKDAVAVALEVFQGQHPADACTAEGSTTPITSSDLSGLDDEHWIGGMDAGSYYASLAQGMLMEPPAAGGWREDDGEHDDGFSTSTSLWSY

SEQ ID NO: 39735 - protein, 232 aa, Brassica napus
  misc_feature (222)..(222): Xaa can be any naturally occurring amino acid
LLKEHVMDAVDHDGLVADRSNTGRWTAAWFIIGVEVAERFAYYGIASNLISYLTGPLGQSTAVAAANVNAWTGISSLLPVLGAFVADAFLGRYRTIIIASLIYVLGMGLLTLSALLVPISENKEVVSASPSSLLNVLFFFSLYLVAIGQSGHKPCVQAFGADQFDEKDPREQRDRSSFFNWWYLSMSAGICLAIVVVVYIQEAVGWALGLGIPCVFMVISLXLFVVGRRSYR

SEQ ID NO: 39736 - protein, 277 aa, Bacillus cereus ATCC 14579
MKQLYGVIGNPIGHSLSPVMHNDAFEHLNMDAHYHAFLVEEELLGEAVRGLKALGISGFNVTTPHKVAIMEYLDEIDPLARKIGAVNTVVHKDGRLIGYNTDGIGFVRALQSISNEPLQGKRILLLGSGGASRAIYFSLADVGVKEIDVANRTVDKAKELIAARTADVNSVALSLEKATEEQGNYDIIIQTTTIGMHPHVEHTPLQICSLKKGTIVSDIIYNPFETKILCEAKEQGAIIQNGIDMFVYQGALAFEMWTGRTPNIERMKQLVIEKLGG

SEQ ID NO: 39737 - protein, 430 aa, Cryptococcus neoformans var. neoformans JEC21
MNYVQLEKLGEGTYATVYKGRSRTTSEIVALKEIHLDAEEGTPSTAIREISLMKELKHVNIVRLHDVVHTESKLVLIFEYCEQDLKRYMDIHGDRGALDLNTVKSFTHQLLQGIAFCHDHRVLHRDLKPQNLLINKRGELKIGDFGLARAFGVPVNTFSNEVVTLWYRAPDVLLGSRTYSTSIDIWSVGCIFAEMITGYPLFRGRDNADQLVQIMKIVGTPSDATIAQIKLNSPEIQIKSPLAKHAKQPFQAIIPRAPRDAISLLEHLLQFEPTRRYDAHQAMAHQYFTSGPIAPPTLHENNPAVSSASSLALPPRVAARASQASAAVQAQQAAQAQAQAQAQAQAQAQAAQNAQMMAQQQQQQQQQQQQQQQYEMMMGQQNMQGYYDPQAAAQMQAHQQAQAQAHAAQMQQMAQQGYYMNPNGQHGHHH

SEQ ID NO: 39738 - protein, 556 aa, Eubacterium acidaminophilum
MKTDVQIAQEAKMLPIMEVAKQIGLGEDDIELYGKYKAKISLDVYKRLADKPDGKLVLVTAINPTPAGEGKTTTNVGLSMGLNKIGKKTITALNEPSLGPCFGVKGGAAGGGYAQVVPMDDINLHFTGDIHAITTAHNLLAALMDNHIKQGNALGIDINKITWKRVLDMNDRALRDIVIGLGGTANGIPRQDGFDITVASEIMAIMCLATSLSDLKDRLSRMIVGYTSRRLAVTADSLTLRGALALLLKDALKPNLVQTLENTPAIIHGGPFANIAHGCNSVTTTKTALKIADYVVTEAGFGADLGAEKFFDIKCRFADLKPDVAVIVATVRALKNHGGVAKANLGAENMKALEDGFGNLERHIENVHKFGVPAVVAINAFPTDTEKELKFVEDACRKLGADVVLSEVWAKGGEGGVELAKKVVEVTEKGAAKFKPLYPAEMPLKQKIETIAKEIYRADGVEFSAKASKELDKFEKLGFGNLPICVAKTQYSFSDNPNLKGAPKGFTVSVSNARISAGAGFIVVLTGDIMTMPGLPKVPAANHMDVLESGEIVGLF

SEQ ID NO: 39739 - protein, 356 aa, Synechococcus sp. WH 7805
MPKVLALETSCDESAAAVVEQRADRLMVLSHRIASQVEEHAQWGGVVPEIASRRHVEALPHLIGAVLDDAGQAVADMDAVAATVTPGLVGALMVGSVTGRTLAALHGKPFMGVHHLEAHLASVRLASSPPEPPYLVLLVSGGHTELILVGIDGGLQRLGRSHDDAAGEAFDKVARLLGLAYPGGPAIQMAAREGDPKRFSLPKGRVSRPEGGFYPYDFSFSGLKTAMLRQVESLRAQSDVLPLEDLAASFEQVVVDVLVERSLRCCLDRGLSTLVMVGGVAANVRLREQMERRGREHGVCVHLAPLEFCTDNAAMVGAAALGRLQSGWGASSIRLGVSARWPLERGGDLFTQDPQF

SEQ ID NO: 39740 - protein, 346 aa, Acidobacteria bacterium Ellin345
MERLGQPAYRSRQLWQGLYRDRIASLDQFTTLPIPLREELKSSGWAIAFPFVQKRFTSTDGTVRYLLQFSDGQSVETVWMPEGDGGEQGDGSEDGPSYDRATICVSSQVGCAVDCQFCMTALLGLLRNLSAGEIVGQILAVLKDENVDVEKSRINLVFMGQGEPFLNFDNFVKAVTLLAEAVGIPESRMTVSTSGIVPRIVDFGQLAIRPKLAISLNASNDESRRELMPITKKWTLEKLMSAAREFPLRNRERMTFEYVLLGGVNDSEQNAREVVQLLRGLRAKVNLIAWNPGPEIPFSTPDPQHVEAFQQILIDAGIPTFIRKPRGRDIFAACGQLKRTELVTLS

SEQ ID NO: 39741 - protein, 475 aa, Synechococcus sp. WH 5701
MTTIADPATSPEAISVADHDRFDLVVIGAGSGGLAAAKRAASHGARVAVIEGHRVGGTCVIRGCVPKKLLVYGSAYRHLLADAASYGWSVGQTHCDTSQLLAAVRAEVDRLNGLHIGFLESAGVELVKGWGRFLDAHHIEVGVAEGKGSSDRSRRLLRGERVLIAVGGRPHRPSFPGAELGWVSDDMFLLERLPQRVLIVGGGFIACEFACILRGLGVEVDQFVRGDHLLRGFDRELSAAVHEGMEADGITIHMAQTLSAIAGEPGELIATTCQGRQERCGGVLLATGRQPYLAGLDLAAAGVGVDGGSITVDADQRTNVPHIFAVGDVTDRINLTPVAVDEGRAFADSVYGGQARQVNHDLVASAVFSQPELASVGLSEEQALARFGPDGVRLYRARFRSMAQALPKRGPRCLLKLVVEVASGRVLGCHMVGEHAAEIIQMAAIAIGMGATKADFDRTMALHPTVAEEFVTMPQ

SEQ ID NO: 39742 - protein, 627 aa, Listeria monocytogenes str. 4b H7858
MAYALWSRVLNTNPKNSHWFNRDRFVLSAGHGSMLLYSLLHLSGFKLELEDLKNFRQWESKTPGHPEYRYTDGVDATTGPLGQGIAMAVGMAMAERHLEAKYNKDGFPVVDHYTYALCGDGDLMEGVASEAASYAGHQQLGRLVVLYDSNDISLDGDLDKSFSENVKQRFEAYGWEHLLVKDGNDTAEILAAIEKAKQNTSQPTMIEVKTVIGFGAPNAGTSKVHGAPLGDEGILEAKKAYGWNYEEKFFVPEEVTARFKETIGERGEKAETAWNELFASYKAEYPELAKQLEDSLNNKLPADWDEDLPVYDDSKALASRASSGEVINALAGKIPTIFGGSADLAGSNNTTIKTDGEFTKATPAERNIWFGVREFAMGAALNGMALHGGLQVYGGTFFVFSDYVRAAIRLSAIQHLPVTYVMTHDSIAVGEDGPTHEPIEQLASLRAMPGLSVIRPADGNEVVEAWKLAITSTSTPHVLVLTRQGLPTLPNSAKLTAEGVKKGAYVISPAKGDVPEAIILASGSEVNLAIEAQKELQAQGTDVSVVSVPSFDLFEQQSAEYKESVLPNAVRKRVAVEMGASFGWERYVGLDGKVIGIDKFGASAPGETVIKNYGFTVENVVNTVKSL

SEQ ID NO: 39743 - protein, 568 aa, Clarkia gracilis
MASPALISETEAWKDLKAHLEGIKRTHLRELMGDTERCQSMMVEFDNIFLDYSRQQASPDTINKLYNLADAAHLKQKIDRMYNGDHINITENRSVLHVALRAPRNSAICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDTINAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLAIYEHRVAVQGFVWGINSFDQWGVELGKSLATQVRKQLHASRVKGEPVEGFNFSTKTLLTRYLEATSDVPADPSTLLPNI

SEQ ID NO: 39744 - protein, 820 aa, Zea mays
  misc_feature (334)..(334): Xaa can be any naturally occurring amino acid
SKTRLVTHSTRTHYLIGQSQTNWAPSPPLPLPMAQQLPCVSSPRPLLAVPAGRWRAGVRGRPNVAGLGRGRLSLHAAAARPVAEAVQAEEDDDDDDEEVAEERFALGGACRVLAGMPAPLGATALRGGVNFAVYSSGASAASLCLFAPGDLKADRVTEEVPLDPLLNRTGNVWHVFIHGDQLHGMLYGYRFDGVFAPERGQYYDVSNVVVDPYAKAVVSRGEYGVPAPGGSCWPQMAGMIPLPYNKFDWQGDLPLGYHQKDLVIYEMHLRGFTKHNSSKTKHPGTYIGAVSKLDHLKELGVNCIELMPCHEFNELEYFSSSSKMNFWGYSTINXCSLGCSMQWKLENVGVALLSVVYMRMSVCEKRGIEVIMDVVFNHTAEGNEKGPILSFRGIDNSTYYMLAPKGEFYNYSGCGNTFNCNHPVVREFIVDCLRYWVTEMHVDGFRFDLASILTRGCSLWDPVNVYGSPMEGDMITTGTPLVAPPLIDMISNDPILGNVKLIAEAWDAGGLYQVGQFPHWNVWSEWNGKYRDTVRQFIKGTDGFAGAFAECLCGSPQLYQAGGRKPWHSINFVCAHDGFTLADLVTYNSKYNLSNGEDNRDGENHNLSWNCGEEGEFASLSVRRLRKRQMRNFFVCLMVSQGVPMFYMGDEYGHTKGGNNNTYCHDHYVNYFRWDKKEEQSSDLYRFCRLMTKFRKECESLGLEDFPTSERLKWHGHQPGKPDWSEASRFVAFTMKDETKGEIYVAFNTSHLPVVVGLPERSGFRWEPVVDTGKEAPYDFLTDGLPDRAVTVYQFSHFLNSNLYPMLSYSSIILVLRPDV

SEQ ID NO: 39745 - protein, 782 aa, Coccidioides immitis RS
MEIICRLLAGVRSGGEFCNHYHISLNLEITIAGVYEASPNQPASAGPDRSNSASSPHSALDVSTTTNPPSPRYSAAELLSLLRYPPEPTTRRSHLRRRREPSTERADIQGGTSRSSGLGNSRGGRIPPEGSSEQAQGQEQDDRPLSKRRRLENDNMKPDGGASASSTNGFSPASNGTGSSPFRKSITSNAISGRSSNSYSQAQPQTNGSTEPSLPRTYYGHDREEVTRILIQSLYDLGYSEAAATLSRESKYELESPAVAALRTSVLEGQWLEAETILLSSFFEGVENVADGKHAVGQPRHQGLVLAEGADRNEMLFSLRQQKFLELLENRDLAAALMVLRQELTPLNHDIARLHSLSSLLMCPPENLRVQAGLEDSVIDSRRKLLAELSKSISPSVMIPGHRLATLLDQVKQNQINRCLYHNTAEPPSLYSNHMCDRSQFPTQVTLELNQHTNEVWYLEFSHDGTKLATTSSDRSVIIYDTRTFGVIHKLTDHGGPVAFATWSPDDTKLISCSQDCKARLWDVETGRCLLTIDHHREPVTSAAWAPDSESFVTCSLDNKSQLCLWSVHGDPLYTWAGSSRIRDCAISPDGRRLIAISTDRRIHVYNFPTREEEYSMRLDLDLTCINISSDSRYMLVNMSEGEVQLLDIETKDVVRQYSGQKQGNFIIRSTFGGAAENFVVSGSEDSRIYIWHKENCMLVETLEGHAKGCVNAVAWNPKDPGVFASAGDDRKVKIPFYKRKRGPQKGSPNTRIPKSTSWITYAYFYDSSFHMRDIIGAHGLG

SEQ ID NO: 39746 - protein, 282 aa, Methanocaldococcus jannaschii DSM 2661
MINAKTKVIGLIGHPVEHSFSPIMHNAAFKDKGLNYVYVAFDVLPENLKYVIDGAKALGIVGFNVTIPHKIEIMKYLDEIDKDAQLIGAVNTIKIEDGKAIGYNTDGIGARMALEEEIGRVKDKNIVIYGAGGAARAVAFELAKDNNIIIANRTVEKAEALAKEIAEKLNKKFGEEVKFSGLDVDLDGVDIIINATPIGMYPNIDVEPIVKAEKLREDMVVMDLIYNPLETVLLKEAKKVNAKTINGLGMLIYQGAVAFKIWTGVEPNIEVMKNAIIDKITK

SEQ ID NO: 39747 - protein, 623 aa, Gibberella zeae PH-1
MADAPNSGDELYPIAVLIDELKHDDVLLRLNAIHRLSTIALALGAERTREELIPFLDESVEDEDEVLVALSEELGGFVEYVGGSQWGHVLLSPLENLAAIEEPVVRDKAVESLNKICSELSPQQVEEYFIPLTIRLAKADWFTSKVSGCGLFTTPYNKVSPPVQEQLRQQFGLLVHDETPMVRRQAATNLAKFVKEMPATIVVDEMIPLFQHLAQDDQDSVRLLTVEVLISIAEAVPKEQQASHGVLLTALRNLIEDKSWRVRYMIADRFEKIAKAVDEEVVSRDLVPAFVKLLKDNEAEVRTAIAGQIPGFCALVDRNVLLNDIMGSIEDLVSDTSQHVRAALGTQISGLAPILGKQETIDHLLPMFLQMLKDEFPEVRLHIISKLELVNQVIGIDLLSQSLLPAIVQLAEDKQWRVRLAIIEYIPLLASQLGVQFFDEKLSNLCMGWLGDTVFSIREAATHNLKKLTEVFGVEWASEAIIPKVMAMGNHPNYLYRMTTCFAISTLASVVSMDVIAKSILPMLDKLVSDDIPNIRFNVAKTYRVLISVLRRLPDEGTLYDLEKQGSEITPSPRGSELIQERVVPNLEKLQKDDDVDVRYFATTAAAEISGPIAGGEPMNTSP

SEQ ID NO: 39748 - protein, 958 aa, Ashbya gossypii ATCC 10895
MTMEVPLINGTNSVVVTAYSREQYAQCMQFYSAMLRLETLTKGENETVLTNKAVSVRVKYEEDKSRDQEARERREALAAAATTHDWRGEASTVVFSTVDVAKVRQTLGLCQAYPSELAPLEVYTLDPQGNVVGFTQTKNAISTFTNVPSVVGPRHARDSMTVSSAGSSTDLRSFGLDTTAHYPSLPKKSVAGDRKAIAVMTSGGDAPGMNANVRAIVRSVIFKGCRAFTVMEGYEGLVRGGPEYIKECKWEDVRGWSTEGGTNIGTARCMAFRERSGRLLGAQHLIEAGVDALIVCGGDGSLTGADLFRSEWPSLIQELLETGKITQAQYDRYRHLNICGTVGSIDNDMSTTDATIGAYSSLDRICQAIDYLEATAKSHSRAFVVEVMGRNCGWLALMAGIATSADYILIPEKPASSREWQDQMCDIVSTHRSRGKRTTIVIVAEGAIAADLTPITPKNVHQVLVDRLGLDTRITTLGHVQRGGSAVAFDRILATLQGVEAVNAVLESTPDTPSPLIVLNENKIMRKPLMESVALTKSVADAIQAKDFKKAMGLRDPEFVEHLNNFMAINSADHDEPKLRGEKRLNIAIVNIGAPAGGINSAVYSMANYCLSQGHKPFAIYNGWTGLARHESVRTLNWKDMLGWQSRGGSELGTNRTVPEDADIGMIAYYFQKYKFDGLVIVGGFEAFVSLHQLERARENYPAFRIPMVLIPATLSNNVPGTEYSLGSDTALNALMEYCDVVKQSAASTRARVFVVDVQGGNSGYLATHAALAVGAQVSYVPEEGISLEQLSQDIETLRESFEKAHGKGKHGKLILKSTNASKVFTTAVLADVITAEAKGDFDAKSAVPGHVQQGGLPSPIDRTRGTRLAVRAIGFIEAKQDVIREARENEEAFDCADKAVSHTAAVLGITGSQLKFTSIRQLYDLETEFSKRMPKVIHWEPTRAIADHLEGRKRVTV

SEQ ID NO: 39749 - protein, 609 aa, Gibberella zeae PH-1
MPTISVDKYKLYEALGQKFTTEEFEDLCFEFGIELDEDTENDERPIVNGEQEPPQLKIEIPANRYDMLCFEGIVSNLNVFRGKTEPPKYRLVDPSSGKLESITVKPEAEQVRPYVSGAILRNIKFDKSRYESFIALQDKLHQNLARNRTLVSIGTHDYDTIKGPFTYEALPPKDIKFTPLNQTKEMDSAELMSFYENDKHLGRFLHIIRDSPVYPAIYDSNRVVCSLPPIINGDHSKITLDTTNVFIEITATDLTKLDIVTDIMVTMFSMYCSEPFTVEPVQINSDHNNQTRITPNLKPRVAEVEIDYLNSCTGLNESPESLCKLLSKMSYTSTPSSKDANILEVAIPPTRADVLHQCDVMEDLAVCYGYNNLPRTAPSRSATVGAPLPVNKLSDIIRIETAVAGWSEVMPLILCSHDENFAWLNRKDDGNTVVRLANPKTAEYQVVRSSLLPGLLKTIRENKGHSVPMKIFEVSDVVFKDETQERKARNERHFAAAWYGRTSGFEVVHGLLDRILLMLRTSFLTHEEGLSGKSIDFEVKENPSKPDGYWIEELDDATFFAGHAASVYLRLGGKERRVGEFGILHPSVLEKFDLKYPVSTLEINLEVFL

SEQ ID NO: 39750 - protein, 304 aa, Oryza sativa (japonica cultivar-group)
MAAPSSLASSHLSRLADLRRAGVAAAAPAHPQQLRLGCSRRRAQRVVAMAGSGKFFVGGNWKCNGTKDSVSKLVTELNAATLEPDVDVVVAPPFIYIDQVKNSLTDRIEVSAQNVWIGKGGAYTGEISAEQLVDIGCQWVILGHSERRHVIGEDDQFIGKKAAYALSQNVKVIACIGELLEEREAGKTFDVCFKQMKAFADSITNWADVVIAYEPVWAIGTGKVATPEQAQEVHAAVRDWLKTNVSPEVASGIRIIYGGSVNAANCAELAKKEDIDGFLVGGASLKGPDFATIINSVTSKKVAA

SEQ ID NO: 39751 - protein, 356 aa, Glycine max
MNSTPANLESSLSVPSVQELAFQRPEKVPARYIRDQDGDGIIATYPSHPSLRVPFIDMAKLVNADTHQKEELRKLHLACKDWGVFQLVNHGLSNSSLKNMGNQVKRFFELPLQEKKRWAQRPGTLEGYGQAFVTSEDQKLDWNDMIFLKCLPIQNRKLDLWPQNPPEFRETLERYSEEIREVTMSVVKFLTMSLGIQDKEISESFREGLYDIRMNCYPPCPEPERVLGIAPHADNSGITLLLDCADFPGLQFLKDKKWVNVEPIEGAIVVNIGQIIEVMSNGIYKAPEHRAVVNKLKERFSIVTFCYPSPHMDIGPADKLTGEGKVAVFKKLTHAEYFRKFFNRDLDESFIDSLRV

SEQ ID NO: 39752 - protein, 339 aa, Cryptococcus neoformans var. neoformans JEC21
MVVKVGINGFGRIGRIVLRNAIEHGDLEVVAVNDPFIDLDYMVYMFKYDSTHGRFKGSVEVKDGKLYINNKAIAVFGEKDPANIKWGEAGAEYVVESTGVFTTTEKAGVHLKGGAKKVVISAPSADAPMFVCGVNLDAYKPEYQIVSNASCTTNCLAPLAKVIHDNFTIIEGLMTTVHATTATQKTVDGPSHKDWRGGRGAAANIIPSSTGAAKAVGKVIPSLNGKLTGMSFRVPTSDVSVVDLVCRIEKGASYEEIKNVIKKASESPELKGILGYTEDAVVSTDFIGSTESSIFDAQAGIALNANFVKLVSWYDNEYGYSRRVCDLISYIAGVDAKAQ

SEQ ID NO: 39753 - protein, 548 aa, Oryza sativa
MEIVDGASPPLHPWSLLLYALGALAALWWAWRALDRFWLRPRRLGRALRSQGLRGTDYRFPSGYLKEFARLLAAALAAPMPPLSHDVASRALPFELAAIKQHAAYTHAPANVRDQTEVAWNAGNVCVTWFGPEVRVIVSDPKLFREILANKNGRFGKQKSILWVQNLLADGLTSHQGEKWVAHRRIMNHAFHLEKLKRMLPAFAACSSELISRWQDSVGADGAQEIDVWPEFQNLTGDVISRSAFGSSFSEGRRIFQLQSEQARNVMKMAKALYFPGYRFLPTELNRRTKANAREVRELLKGIITKRESAMKDGHAVNDDLLGLLLETNIKESQEAGSSKPTMTTKDIIEELKLLYFAGSDTTAVLLTWTMVLLSMHPEWQDRAREEVLRVFGKNSPDFEGINHLKVVTMILHEVLRLYPPILLLGREAYEETELGGVTYPPGVTFALPIAGIHHDPDVWGEDVGEFKPERFAEGVSRASKDSPALVPFSWGPRICVGQNFALLEAKMALSMILQRFSFGLSPSYTHAPFPIPTLQPQHGAQIKLTKL

SEQ ID NO: 39754 - protein, 1202 aa, Arabidopsis thaliana
METIGDIWFTRSRSENRRIHQIGDLSYWLLQSVSHEEDRVIENNEGLPPALLGSCNDLARQPHASPGFVNLLTSQQEVHTLETNPCDDVPIFSTQCTDSPSLEEHVPKVKRERMKWSAKEDMVLVSSWLNTSKDAVIGNEQKANTFWSRIAAYYDASPQLNGLRKRMQGNIKQRWAKINDGVCKFVGSYEAASREKSSGQNDNDVISLAHEIFNNDYGYKFPLEHAWRVLRHDQKWCSQASVMSKRRKCDKAAQPSTSQPPSHGVEEAMSRPIGVKAAKAKAKKTVTKTTTVEDKGNAMLEIQSIWEIKQKDWELRQKDREQEKEDFEKKDRLSKTTLLESLIAKKEPLTDNEVWFGQNHMQIISPFQFGFQLYSLRPVPDITRRSINRPSQPSLTIGMELHVLIMVGEWIYKEEGWKFEAEKGSFGRCVRIIDTTTYTDLASPICDVFSYKFSEWNPIISYWMPGKMSDMIASNRPPVYIENQISLDTFMLIRNGDPSVNLFVSFYPIGNGGHTETEVTNVDAAHNFYEDINVDEEDDIDEGDEDEYEDEDNEEDEDMDVHDDDTDGESRGSTLDPTVDDSEGSGEDYDYNKWGDMIVEQYGNGHVEEGVVNDTQQTVEPPGELTRLLASCTSTGTHVPHVEPTGVLVDCTPTSALSPTCQHGLYQCTYTRVCAEETRCEGELVEHTDDIAENVTGDDGIVVLEGVSASGLNIESDDRLVTTGEAYKVYKGFSTLHNAENELLDTDAAPVFDDLANVRVDETEVELSTSGYDSIHVCKIETRKDYRKHATYKLLGEVMKNRYSSSQGGPRAVDLPQLVLNGLNVRISYSTAWRAREVAVNSIRGDDMASYRFLPTYLYLLQLANPGTICHLHSTPEDKGRQRFKYVFVSLSASIKGWKCMRKVVVVDGTQLVGRYKGCLLIACAQDGNFQIFPLAFGVVDGETDASWIWFFEKLSEIVPDTDDLMIVSDRHSSIYKGVSVVYPATKAYRIRDFEKYFEELRGRSPGCAKYLEDVGFEHWTRAYCKGERYNIMTSNNSEAMNNVLSKAKAYPIVYMLEFIREVIMRWFAARQKKVSKCNSLVTPEVDERFLQDLPASGKFSVMMSGPWSYQVTSKTGEHFHVVLDECTCTCLRYTILRIPCENALAAAIHFGINPKVVVGLWYSLQVFSDSFQEPVLPIPDPKDVVIPQELSDLILIPPRSR

SEQ ID NO: 39755 - protein, 630 aa, Cryptococcus neoformans var. neoformans JEC21
MVDTQYAFRAQKTAGVADAPAWEVSNRIPAETVGSKCYAYSPNGEWLAYAMNNCVEIIPSHSSSPTPVTLQQANIVALKFSPMSSYLFTFERPVKTESGEMYKNAKAWDVKNGEIVGGWYQKTMEDWEPIITPNETHLLRAGPSDLAIFSPPFAPRPSTRLKIEGIRGIFISDPSALPATSTNSRPIPAYHEPAVAIWIGEKKGAPASLGLWSLSSLMGKNALQANGNGDIQTETRDMPPTTARKAFYKADKLTVKWNNAGTMALFLAQSDVDNSGKSYYGETNLYLVGLDGTFDGLVELDKEGPIYDFAWSPISREFTVCYGYMPARTQMFDLKAKPVYSFGENPRNTLVYQPQGKLLLSAGFGNLAGGIDIWDVSTRNKVAEFKASNASHCEWSPCGRYVLTATLSPRLRVDNGVKIWWCNGQLLHIQPVEELYQASFAPQRVTEIGSFPAIVPKAPEANPSVAAYRPKGETDGVAAKPAGAYRPPGARNRPEGENASASFGSSRGKPGVRTVPGAGGRQPPGSAPGASTGAGGDDKKKRQRKRGGKDKEEEKKDEAPTQEAVKPEVKEEAGEDAVAKKIRNLMKKLKAIDELKTKLAAGEILEKTQLKKIESEAQVKSEIKALGGNV

SEQ ID NO: 39756 - protein, 741 aa, Oryza sativa (japonica cultivar-group)
MVRSGSVRRTAASSSPAAAAVPTAFTASPGDYRLLEEVGYGANAVVYRAVFLPSNRTVAVKCLDLDRVNSNLDDIRKEAQTMSLIDHPNVIRAYCSFVVDHNLWVIMPFMSEGSCLHLMKVAYPDGFEEPVIASILKETLKALEYLHRQGHIHRDVKAGNILMDSPGIVKLGDFGVSACMFDRGDRQRSRNTFVGTPCWMAPEVLQPGAGYNFKADIWSFGITALELAHGHAPFSKYPPMKVLLMTLQNAPPGLDYDRDKRFSKSFKEMVAMCLVKDQTKRPTAEKLLKHSFFKNAKPPELTVKSILTDLPPLWDRVKALQLKDAAQLALKKMPSSEQEALSMSEYQRGVSAWNFDIEDLKAQASLIHDDDPPEIKEDVDNDRINEADKEPFSGNHFGQPKILSGKHFSEQTCVTAVSPGGNMHETSRGLVSEPGDADSERKVDGYRKQGSENESLPSTSKHDSEGQNSSSEVKQKERTCSGPILCSGVHNKSITESSRIFDREAAVKLASDKQKSCTKRTTNLSGPLALPTRASANSLSAPIRSSGGYVGSLGDKSKRSVVEIKGRFSVTSENVDLAKVQEVPTSGISRKLQEGSSLRKSASVGHWPVDAKPMSNSHQRKELCNGSVSASVLIPHLRNLVQQTTFQQDLITNLLSSLQQNEKADATQYRLGNMDGDTEVETSISEGERSLLVKIFELQSRMISLTDELITTKLQHVQLQEELKILYCHEEIIDTREVDNA

SEQ ID NO: 39757 - protein, 164 aa, Synechococcus sp. WH 7805
MAADPNDTSAKESATATTDGAVENNGADTAVAESTKESSPTVSTVRLKPAELIREFETAQLKTDLPEIYVGDTVRVGVRISEGNKERVQPYEGVVIAKRHGGLNQTITVRRIFQGIGVERVFMLHSPQVASIKVERRGKVRRAKLFYLRERVGKATRVKQRFDR

SEQ ID NO: 39758 - protein, 474 aa, Hypocrea jecorina
MALNLTSSARALRSFKPYTRAALLANAARCYSTAEPDLKTTLKSVIPEKRELLKKVKAHGSKVIGEVKVENTIGGMRGLKAMVWEGSVLDPNEGIRFHGRTIKDCQKELPKGKTGTEMLPEAMFWLLLTGQVPSVNQVRQFSRELASQTQIPAFVNRMLDDFPKDLHPMTQFAIAVSALNYESKFAKAYEKGLAKADYWEPTFDDSISLLAKLPTIAAKIYQNSYRGGGALPAEVDLEQDWSYNFAAMLGKGGKENEDFQDLLRLYLALHGDHEGGNVSAHATHLVGSALSDPFLSYSAGLQGLAGPLHGLAAQEVLRWILQMKEAIPANYTEQDVHDYLWSTLNSGRVVPGYGHAVLRKPDPRFEALMDYAASRPAIAKDPVFQLVEKNSRIAPEVLKKHGKTKNPYPNVDSSSGVLFHHYGFHETLYYTATFGVSRGLGPLAQLIWDRALGLPIERPKSINLEGILKQVESS

SEQ ID NO: 39759 - protein, 155 aa, Kineococcus radiotolerans SRS30216
MAASCHPRRAAPRGGGETMTGVSSSPPPATGPATVPPLDPALAARLKRTDTGLVCAVVQQHDTREVLMVAWMDDEALASTLATGRATYYSRSRRSLWRKGDTSGHVQWVKRVSLDCDGDALLVEVDQVGAACHTGDRTCFDASPLPVRVGSRAEA

SEQ ID NO: 39760 - protein, 438 aa, Methanocaldococcus jannaschii DSM 2661
MKIMFLGNDTVEIKDGRFFIDGYDAIELAEKFGTPLYVMSEEQIKINYNRYIEAFKRWEEETGKEFIVAYAYKANANLAITRLLAKLGCGADVVSGGELYIAKLSNVPSKKIVFNGNCKTKEEIIMGIEANIRAFNVDSISELILINETAKELGETANVAFRINPNVNPKTHPKISTGLKKNKFGLDVESGIAMKAIKMALEMEYVNVVGVHCHIGSQLTDISPFIEETRKVMDFVVELKEEGIEIEDVNLGGGLGIPYYKDKQIPTQKDLADAIINTMLKYKDKVEMPNLILEPGRSLVATAGYLLGKVHHIKETPVTKWVMIDAGMNDMMRPAMYEAYHHIINCKVKNEKEVVSIAGGLCESSDVFGRDRELDKVEVGDVLAIFDVGAYGISMANNYNARGRPRMVLTSKKGVFLIRERETYADLIAKDIVPPHLL

SEQ ID NO: 39761 - protein, 583 aa, Oryza sativa (japonica cultivar-group)
MAARRAASSLLSRGLIARPSAASSTGDSAILGAGSARGFLPGSLHRFSAAPAAAATAAATEEPIQPPVDVKYTKLLINGNFVDAASGKTFATVDPRTGDVIARVAEGDAEDVNRAVAAARRAFDEGPWPRMTAYERCRVLLRFADLIEQHADEIAALETWDGGKTLEQTTGTEVPMVARYMRYYGGWADKIHGLVVPADGPHHVQVLHEPIGVAGQIIPWNFPLLMFAWKVGPALACGNAVVLKTAEQTPLSALFVASLLHEAGLPDGVLNVVSGFGPTAGAALSSHMGVDKLAFTGSTGTGKIVLELAARSNLKPVTLELGGKSPFIVMDDADVDQAVELAHRALFFNQGQCCCAGSRTFVHERVYDEFVEKARARALQRVVGDPFRTGVEQGPQIDGEQFKKILQYVKSGVDSGATLVAGGDRAGSRGFYIQPTVFADVEDEMKIAQEEIFGPVQSILKFRFATLEFPRIPSDRDRLSTGIYTNTLRAMCSTVEEVVRRANATPYGLAAGVFTQRLDAANTLARALRVGTVWVNTYDVFDAAVPFGGYKMSGVGREKGVYSLRNYLQTKAVVTPIKDAAWL

SEQ ID NO: 39762 - protein, 408 aa, Methanocaldococcus jannaschii DSM 2661
MDAIILCAGKGERLRPLTENRPKPMIPIAGKPILQHIIEKVEDLVDNIYLIVKYKKEKIVDYFKNHPKIKFLEQGEIDGTGQAVLTAKDYVDDEFLVINGDIIFEDDLEEFLKYKYAVAVKEVKNPENFGVVVLDDENNIIELQEKPENPKSNLINAGIYKFDKKIFELIEKTKISERGERELTDAIKHLIKEEKVKGIKLNGYWNDVGRPWDILEANKYLLDKINTDIKGKIEENVVIKGEVIIEEGAIVKANSVIEGPAIIKKGAVVGPLAYIRPYTVLMENTFVGNSSEVKASIIMKNTKIPHLSYVGDSIIGENCNFGCNTITANLRFDDKPVKVNIKSKRVESVRKLGVIMGDNVKTGIQVSFMPGVKVGSNCWIGASCLIDRDIESNTFVYKRDELIFRKLK

SEQ ID NO: 39763 - protein, 100 aa, Triticum aestivum
  misc_feature (39)..(39): Xaa can be any naturally occurring amino acid
  misc_feature (68)..(68): Xaa can be any naturally occurring amino acid
  misc_feature (70)..(70): Xaa can be any naturally occurring amino acid
  misc_feature (74)..(74): Xaa can be any naturally occurring amino acid
  misc_feature (79)..(79): Xaa can be any naturally occurring amino acid
  misc_feature (85)..(85): Xaa can be any naturally occurring amino acid
  misc_feature (88)..(88): Xaa can be any naturally occurring amino acid
  misc_feature (90)..(90): Xaa can be any naturally occurring amino acid
  misc_feature (96)..(97): Xaa can be any naturally occurring amino acid
SSATTAAPFQGLKSTAGLPVSRRSCSAGLSSVSNGGRIXRCMQVWPIEGIKKFETLSYLPPLSKEALXKXVDYXIRSSXVPASNXTKXGXSSGEQXXSPR

SEQ ID NO: 39764 - protein, 543 aa, Zea mays
MEEAHLTPATPSPFFPLAGPHKYIALLLVVLSWILVQRWSLRKQKGPRSWPVIGATVEQLRNYHRMHDWLVGYLSRHRTVTVDMPFTSYTYIADPVNVEHVLKTNFTNYPKGIVYRSYMDVLLGDGIFNADGELWRKQRKTASFEFASKNLRDFSAIVFREYSLKLSGILSQASKAGKVVDMQELYMRMTLDSICKVGFGVEIGTLSPDLPENSFAQAFDAANIIITLRFIDPLWRIKRFFHVGSEALLAQSIKLVDEFTYSVIRRRKAEIVEVRASGKQEKMKHDILSRFIELGEAGDDGGGFGDDKSLRDVVLNFVIAGRDTTATTLSWFTHMAMSHPDVAEKLRRELCAFEAERAREEGVTLVLCGGADADDKAFAARVAQFAGLLTYDSLGKLVYLHACVTETLRLYPAVPQDPKGILEDDVLPDGTKVRAGGMVTYVPYSMGRMEYNWGPDAASFRPERWINEDGAFRNASPFKFTAFQAGPRICLGKDSAYLQMKMALAILFRFYSFRLLEGHPVQYRMMTILSMAHGLKVRVSRAV
